United States Patent 8,952,217 (PROCESS FOR DECREASING VERBASCOSE IN A PLANT BY EXPRESSION OF A CHLOROPLAST-TARGETED FIMD PROTEIN) - sequence listing, part 6

SEQ ID NO: 16792 - DNA, 240 bp, Lactobacillus delbrueckii subsp. bulgaricus ATCC BAA-365
  CDS (1)..(240)
atgcctttggaagtcaaggcgatgaagagcgaattcagcgacgacttcatgttcgtcactccgggcatccggccaaagagctaccaaaaagacgaccaggcccgggtggccaccccaggccaggcgcgggaaaacgggtcaaccgctattgttgtcggccggccaatcacccaggccgctgacccgcaaaaagcatatgaagagattttgaaggattggagcaagaacgatgcaacataa

SEQ ID NO: 16793 - protein, 79 aa, Lactobacillus delbrueckii subsp. bulgaricus ATCC BAA-365
MPLEVKAMKSEFSDDFMFVTPGIRPKSYQKDDQARVATPGQARENGSTAIVVGRPITQAADPQKAYEEILKDWSKNDAT

SEQ ID NO: 16794 - DNA, 696 bp, Streptococcus thermophilus LMD-9
  CDS (1)..(696)
atgagagaaaatcgtcctgttattgcccttgatttcccgactcttgaggatgtgaaggctttccttgctaagtttcctgctgatgaaaagctctatgtgaagattggtatggaactttactatgcggctggtcctgagattatacgctacgttaaagagcttggccatagtattttccttgaccttaagcttcacgatattccaaatactgtcaaatcagctatgcgtgtcttgtctaaccttggcgttgatatgacaaatgtgcatgcggctggtggcgtggagatgatgaaagctgcgcgtgaaggcttgggagatggaccaatcttgattgctgtaactcagttgacctctacctctgaagagcagatgcgtgattttcaaaatatccaaaccacacttcaagaatcagtggttcattatgctcagaagactgctgaagcaggtctcgatggtgttgtctgttcagcacacgaagtacccaaaatcaaagaagcaactaaccaagacttcatttgtttgacacctggtattcgtccagcaggagcagcggttggtgaccaaaaacgtgttatgactcctgctgatgctcatcaaattggttcagactacattgtcgttgggcgcccaattacgcaagctgaagatccagtggcagcttatcacgacatcaaggcccaatggaacgatcaataa

SEQ ID NO: 16795 - protein, 231 aa, Streptococcus thermophilus LMD-9
MRENRPVIALDFPTLEDVKAFLAKFPADEKLYVKIGMELYYAAGPEIIRYVKELGHSIFLDLKLHDIPNTVKSAMRVLSNLGVDMTNVHAAGGVEMMKAAREGLGDGPILIAVTQLTSTSEEQMRDFQNIQTTLQESVVHYAQKTAEAGLDGVVCSAHEVPKIKEATNQDFICLTPGIRPAGAAVGDQKRVMTPADAHQIGSDYIVVGRPITQAEDPVAAYHDIKAQWNDQ

SEQ ID NO: 16796 - DNA, 684 bp, Anaeromyxobacter dehalogenans 2CP-C
  CDS (1)..(684): transl_table=11
atgaagccgtcggaacggatctgcgccgcgctcgacttccccaccttcgccgcggccgagccgttcgcgcgcgcggtcgcgccggaggtcgggatcctcaaggtcggcctcgagctgttcgcggccgaggggcccgccgcggtgcgcgccgcggcgcggctgggccggccggtgttcctcgacctgaagctgcacgacatccccaacaccgtggagggcgcggcgcgaagcgcggccgcgagcggcgcggcgctgctcaccgtgcacgcggccggcggggccgagatggtgagggcggccgtgcgcggcgccggccccggcgtgcgggtgctggcggtgacggtgctcaccagcctggacgccgcggcgctcgaggccatcggcctcgccggcccgcccgaggcggcggtggtgcggctggcgcgcctcgcggtggacgccggcgccggcgggatcgtctgctcgccgcacgaggtggcggcggtgcgcgcggcggtggggcccggcccgctgctggtggtgccgggggtccgcccggcgggcgcggcgaagggcgaccaggcccgggtggcgacgcccgccgaggcggtgcgcgccggcgccgacgtcatcgtggtggggcggccgctccgcgacgcgccggacccggccgccgcggcccgcgccatcgccggcgagctctag

SEQ ID NO: 16797 - protein, 227 aa, Anaeromyxobacter dehalogenans 2CP-C
MKPSERICAALDFPTFAAAEPFARAVAPEVGILKVGLELFAAEGPAAVRAAARLGRPVFLDLKLHDIPNTVEGAARSAAASGAALLTVHAAGGAEMVRAAVRGAGPGVRVLAVTVLTSLDAAALEAIGLAGPPEAAVVRLARLAVDAGAGGIVCSPHEVAAVRAAVGPGPLLVVPGVRPAGAAKGDQARVATPAEAVRAGADVIVVGRPLRDAPDPAAAARAIAGEL

SEQ ID NO: 16798 - DNA, 732 bp, Azotobacter vinelandii AvOP
  CDS (1)..(732): transl_table=11
atgcccgccacagcgattttcccggagcccgtccccatgtcctgccagaccccgatcatcgtcgccctcgacttccccggccgcgaggcggccctggccctcgccgcccggctggaccccgcgcggtgccgggtcaaggtcggcaaggagctgttcacccgctgcggcccggatatcgtcgagacgctgcagcagcagggcttcgaggtgttcctcgacctgaaattccacgacatcccgaacaccacggcgatggcggtgaaggccgccgccgagctgggcgtgtggatggtcaacgtgcactgctccggcggtctgcgcatgctgagcgcctgtcgcgagaccctggacggcattcatggccgccggccgttgctgatcggggtgacggtgctgaccagcatggagcgcgaggacctggccggcatcggcctggatgtcgagccgcagcagcaggtcctgcgcctggccgccctggccgagcaggccgggctggacggactggtctgctcggcccaggaggcgccggcgctgaagaccgcccggccgcggctgaaactggtgacccctggcatccgtccggccggcagcgccccggacgaccagcggcgcatcctcactccgcgccaggcgctggaggccggttccgactacctggtcatcggccggccgatcagccaggccgccgacccggcccaggcactggcggctctggtcgccgaactggactga

SEQ ID NO: 16799 - protein, 243 aa, Azotobacter vinelandii AvOP
MPATAIFPEPVPMSCQTPIIVALDFPGREAALALAARLDPARCRVKVGKELFTRCGPDIVETLQQQGFEVFLDLKFHDIPNTTAMAVKAAAELGVWMVNVHCSGGLRMLSACRETLDGIHGRRPLLIGVTVLTSMEREDLAGIGLDVEPQQQVLRLAALAEQAGLDGLVCSAQEAPALKTARPRLKLVTPGIRPAGSAPDDQRRILTPRQALEAGSDYLVIGRPISQAADPAQALAALVAELD

SEQ ID NO: 16800 - DNA, 711 bp, Chromohalobacter salexigens DSM 3043
  CDS (1)..(711): transl_table=11
atgtcgccggacctcgatacgccgctgatcatcgcactcgattacccacgcctcgatcaggcactcgctatggccgagcgcctggacccatcgcggtgtcgcgtgaaggtcggcaaggaactgttcacccgcaccgggccccgggttctggaggccttgcacgggctggggttcgaggtctttctggatctcaagtttcacgatattcccaatacggtggccggcgccgtcgaggccgctgccgatcacggcgtatggatggtcaacgtgcatgccggcggcgggcgccgaatgatggaggcggcccgggagcgactggaacgtcgtcggctcggtacccatctgatcgcggtcacggtgttgaccagcatggaacgtgatgacctgatcgaagtgggcgtcgaggccgagccgctgtcacaggtcgagcgtttggcgaggttggcgcagcagagcggcatggcaggcgtggtgtgttccgcgcaggaagcggcggcgttgcgtgctacgtgcggcgacgacttcctgaaggtcacgcccggcatccggccgcgtgcgtcgagtgccgacgaccagcgccgcaccctgaccccgggcgaggcgatggcggccggcagtacgcatctggtggtgggacgcccggtcacgcaggcgccggatccgatggcggcgctggcgaccatcgaacgcgagcttgcggagccgtcgtaa

SEQ ID NO: 16801 - protein, 236 aa, Chromohalobacter salexigens DSM 3043
MSPDLDTPLIIALDYPRLDQALAMAERLDPSRCRVKVGKELFTRTGPRVLEALHGLGFEVFLDLKFHDIPNTVAGAVEAAADHGVWMVNVHAGGGRRMMEAARERLERRRLGTHLIAVTVLTSMERDDLIEVGVEAEPLSQVERLARLAQQSGMAGVVCSAQEAAALRATCGDDFLKVTPGIRPRASSADDQRRTLTPGEAMAAGSTHLVVGRPVTQAPDPMAALATIERELAEPS

SEQ ID NO: 16802 - DNA, 699 bp, Crocosphaera watsonii WH 8501
  CDS (1)..(699): transl_table=11
atgtctgttgctgatcagatcattgttcctttagatgttcctacagaagaagcagcgatcgccttattggatcgtttacctcaagttagcttttggaaagtggggttagaattattcgtggccacggggccgactattcttaaacacctcaaagagcggaaaaaaaagatttttcttgacttgaaatttcatgatattcctaacacggtaatgggagcttgccgtagtgcctctagatacgaggtagacttattaacccttcatgctactgctggcaaaaatgccctcaaagcagcgagagaagctattgcccacagtgcctcaccccctcaattattagccataaccttgctcactagcctcaatgcacgggacctggcctttgatctgaaaattcctttagaactgccagaatacgccctacagatggctttattagccaaagattgcggcataaatggggctgtgtgttctcctcaggaagtagctcaactgagagcagtttgtgggaaagattttgtcttagtttgtcctggggttcgtcctagttggggacaaacaggggatcagcaaagggtaatgacacctaaacaggccctggatgcaggggcaaattatttagtcattggtagacctattacaatgtcagatgatcctgttatggcttggaaccgtattgttgatgaagttagtagctaa

SEQ ID NO: 16803 - protein, 232 aa, Crocosphaera watsonii WH 8501
MSVADQIIVPLDVPTEEAAIALLDRLPQVSFWKVGLELFVATGPTILKHLKERKKKIFLDLKFHDIPNTVMGACRSASRYEVDLLTLHATAGKNALKAAREAIAHSASPPQLLAITLLTSLNARDLAFDLKIPLELPEYALQMALLAKDCGINGAVCSPQEVAQLRAVCGKDFVLVCPGVRPSWGQTGDQQRVMTPKQALDAGANYLVIGRPITMSDDPVMAWNRIVDEVSS

SEQ ID NO: 16804 - DNA, 756 bp, Solibacter usitatus Ellin6076
  CDS (1)..(756): transl_table=11
gtggcgcgtgggacgggtgctgccgcgcggggaaagagcaatgcgaatcatatgacgacgaaagctatgcacaacccaatcattgtcgcgctggacgtggaatcggcggcggaggcccgcgagatgatcgcgcgcatcggaccgcgagtgaacttctacaaggtcgggctggaactctatgccgcatcgggcatggaggtggtgaaggaactgctcggccagggcaaacaggttttcctggatctgaagatgtatgacatccccgaaacggtgtcgcgggcggtggctcaggtcgcgaagacgggagtcacgttcctcactgtgcatgcggtgagcagcgtgatgcgggcggcggtagcggcgcgcgaaggcagcaagctgcggatactgggagtcacggtgctcacgagcttcgggccggaagacatggacgatttggggtacgacggaaccgtcggggaactggtggagcgccgcgccaacaaggccgcggaactgggcgtggatggagtggtggcgtcgccgctggaggcagcgtcggtgcggcgaattgtgggtccgcgggtggcgatcgtgactccgggcgtgcggtcggccggtgtggatgcgggcgatcagaagcggatcgcgaccccggcgcaggcgatgctcgatggcgcggattacctggtgatcgggcggcagatcacgcgcgcgaaggatccagcggcagcggtggatcaggtgctgatggagatcgccacggcgctggtgtaa

SEQ ID NO: 16805 - protein, 251 aa, Solibacter usitatus Ellin6076
MARGTGAAARGKSNANHMTTKAMHNPIIVALDVESAAEAREMIARIGPRVNFYKVGLELYAASGMEVVKELLGQGKQVFLDLKMYDIPETVSRAVAQVAKTGVTFLTVHAVSSVMRAAVAAREGSKLRILGVTVLTSFGPEDMDDLGYDGTVGELVERRANKAAELGVDGVVASPLEAASVRRIVGPRVAIVTPGVRSAGVDAGDQKRIATPAQAMLDGADYLVIGRQITRAKDPAAAVDQVLMEIATALV

SEQ ID NO: 16806 - DNA, 720 bp, Geobacter metallireducens GS-15
  CDS (1)..(720): transl_table=11
atgacgagagaccaggcccgcgaaaaggtcatttttgcccttgataccggtgaattcgcccatgtgcagtactgggccgaaacgctgtccgacaaggtcgggatgtataaaatcggcaagcaactcttcaccgcctgcggcccagccgcggtgcgaatgatccagaagttcggcggcgaggtctttctcgacctcaagttccacgacatccccaataccgttgccatggcctcggtggaggcggcccgcatgggagttaaacttttcaatctccatgccctgggtggctatgagatgatggcgaaaacagtggaggccctcgacaaggaattcaagggaggggatagggcaaaggtcctggcggtcactattctcacctcttccaccgaggagaccctcaaggatttggggattgaacacaccgtccccgacatggtggtgcggctcgcgacccttgccaggaaagccggcatcgatggcgtcgtggcttcgccccgggagattcccctcatccgcgaagcatgcgggagcgacttcctcattgtcactcctggcgttcgcccgtccttcgcggccctcaatgatcagaagcgggtcatgacgccggcggaggcggtgaaggcggggagtgattatctcgtcatcggccgccccattggtgatgcgccggacccggccgctgccgccgagctgattctcggcgagattgttgccggctga

SEQ ID NO: 16807 - protein, 239 aa, Geobacter metallireducens GS-15
MTRDQAREKVIFALDTGEFAHVQYWAETLSDKVGMYKIGKQLFTACGPAAVRMIQKFGGEVFLDLKFHDIPNTVAMASVEAARMGVKLFNLHALGGYEMMAKTVEALDKEFKGGDRAKVLAVTILTSSTEETLKDLGIEHTVPDMVVRLATLARKAGIDGVVASPREIPLIREACGSDFLIVTPGVRPSFAALNDQKRVMTPAEAVKAGSDYLVIGRPIGDAPDPAAAAELILGEIVAG

SEQ ID NO: 16808 - DNA, 699 bp, Exiguobacterium sp. 255-15
  CDS (1)..(699): transl_table=11
atggagcaactttacatcgcgcttgattttcagtcagccgatcaagtcgaacggtttttagaaaaattggcaccacaccggccggcacttaaagtcgggatggagctgtattatgcggaaggtcccgcctttgtccgtcatttggtccggcaaggacatgatgtctttctcgatttaaaagtccatgacattccggagactgcccggcggacgatgcgtgtcattggtcaactcggtgttgaactgacaaatgtccacgctgcaggcgggaaagcgatgatggaggcagcccttgccggactacgcgagacgtcgcccaagacacggctgattgccgtcacccaactgacctcaacggatcaagacatgttaaccgatctgatgattccacatgcgatggacgaagtcgttgcccattatgcccgcgaagccgaccaggccggtcttgacggagtcgtgtgctcggctctggatacgacacatatcaaagcaacctgccgctccggcttccaacttgtcacgccgggaatccggccgaacgggacggatgcgaatgaccaaaaacggattgcgacagtaacggatgcacgccggaacggggcaacggatctcgtcatcggacgtgccatcacacaggcaaaagatccgaaagtcgtttatgaaggattgctctcagaatggaaggggattaaacaatga

SEQ ID NO: 16809 - protein, 232 aa, Exiguobacterium sp. 255-15
MEQLYIALDFQSADQVERFLEKLAPHRPALKVGMELYYAEGPAFVRHLVRQGHDVFLDLKVHDIPETARRTMRVIGQLGVELTNVHAAGGKAMMEAALAGLRETSPKTRLIAVTQLTSTDQDMLTDLMIPHAMDEVVAHYAREADQAGLDGVVCSALDTTHIKATCRSGFQLVTPGIRPNGTDANDQKRIATVTDARRNGATDLVIGRAITQAKDPKVVYEGLLSEWKGIKQ

SEQ ID NO: 16810 - DNA, 666 bp, Methanosarcina barkeri str. fusaro
  CDS (1)..(666): transl_table=11
atggaaaagaaaagctgtatgattctcgcccttgatgtttccgacagggaagaagcgcttaaaattgcagaagacgtttcggaattcgtggacgctataaaggtaggctatcctctaatacttgctaccggacttggaattatcagggagcttgccgagtttgctcctataatagccgatttcaaagttgccgatattccaaataccaaccgccttatctgtgagcatgtctttgaggcaggaaccgatgcagtaattgttcagggttttacaggccgggacagccttgatgcctgcattgagattgcttccgaatacggaaaagatgtgttcgtggtaagtgaaatgagccacccaggaggagctgaattcctccagcctgtcggagaagcaatcgcaagaatggcagccgaagcaggggcttttggccttgttgcacccgcgaccagaccggaaagagtgacaacgattagaaaaattatcggtaacaaacttaccatcatctcgcctggagtcggcgctcagggaggaaaagcgtctgatgttattgccgcaggcgcagactgggtaattgtaggaagagccatttacaaagcagagtcaccaagagaagctgcccgcaagattgctgctgagattgaggctgaattcgagcaagaaaactga

SEQ ID NO: 16811 - protein, 221 aa, Methanosarcina barkeri str. fusaro
MEKKSCMILALDVSDREEALKIAEDVSEFVDAIKVGYPLILATGLGIIRELAEFAPIIADFKVADIPNTNRLICEHVFEAGTDAVIVQGFTGRDSLDACIEIASEYGKDVFVVSEMSHPGGAEFLQPVGEAIARMAAEAGAFGLVAPATRPERVTTIRKIIGNKLTIISPGVGAQGGKASDVIAAGADWVIVGRAIYKAESPREAARKIAAEIEAEFEQEN

SEQ ID NO: 16812 - DNA, 825 bp, Frankia sp. CcI3
  CDS (1)..(825): transl_table=11
atgagcgccggccggaggagctccggcgggaggagcgcggccgcgccccgcttcaccccgccgcggggccgggcgccgctggcggtcgcgctggatgccccggacgccgcgaccgcgctgcgctgggccgccgcggtcgcccccaccgtggccgtgctgaagatcggtctggagctgttctaccgggagggcccggcaatcgtgacggcgctgcgcgcggccggcgtgctcgccggggccggcggcgcggcggtcgccgcgggcggcaccgggagtgccccggagttgttcctcgatctcaaactgcacgacattcccgccacggtcgccgggggaatgcgctcaatcaccccgttgggccctcgtttcgtgaccgtgcatgcggctgggggggcggcgatgatacgtgcggcgatcgaggcggccccggatgtcgaggtagccgtcgtgaccgtactcacctcgctggatgtggcggcgctcagcgcgatcgggctcgccggacccccttccgacgccgtccgcaggctcgccgtgcttgcggtcgaagccggtgcgcgcaccctggtgtgcagtccgcgggaggttcgaatggtccgtatggagcttggtagcaatgtgactctcatcactccaggcgtgcgaccggcggggtcggaaaccggcgatcaggcccgaaccgcgacgccggaagctgcccttgtggggggttctgacctggtcgtggtgggtcgcccgatcaccggtgcgcccgaccccggggtcgccgcgagggccatcgccgcaggtctcagcgctgccggcagggctgctgacctgctgtga

SEQ ID NO: 16813 - protein, 274 aa, Frankia sp. CcI3
MSAGRRSSGGRSAAAPRFTPPRGRAPLAVALDAPDAATALRWAAAVAPTVAVLKIGLELFYREGPAIVTALRAAGVLAGAGGAAVAAGGTGSAPELFLDLKLHDIPATVAGGMRSITPLGPRFVTVHAAGGAAMIRAAIEAAPDVEVAVVTVLTSLDVAALSAIGLAGPPSDAVRRLAVLAVEAGARTLVCSPREVRMVRMELGSNVTLITPGVRPAGSETGDQARTATPEAALVGGSDLVVVGRPITGAPDPGVAARAIAAGLSAAGRAADLL

SEQ ID NO: 16814 - DNA, 717 bp, Desulfuromonas acetoxidans DSM 684
  CDS (1)..(717): transl_table=11
atgaaagatcggttgatttttgcgctggatgtcgacagttatgatgaagctcggcagtgggtacgcattctcgctgatgaggtagggatgttcaaggtcggcaagcagttgtttacccggtgtggtccccagattgtggatatgattcgccaggccgggggcggcgtttttcttgaccttaaatatcatgatatccccaatactgttgccaaggccggtattgaagcggcacgtatgggtgtgcagatgttcaatgttcatgcgctgggcggcggcaagatgatgcggacgatggttgatgaagttcgggaggccgccgtcaaggagggttttcctgtgccgatcacgttggcggtaaccattctcacctcgtcgtctgaagaagatctgcgtcaggtggggatcgaccttcctgtgacgcagatggtgcctcggcttgcaacgttagccagggaaagtggactgcatggtgtggtggcctcggctcaagaattgccgctgattcgtcaggcctgcggtggtgactttgtcgttgtgacccctggtgtgcgcccggcaacggcggcacgtgatgatcaacaacgggtgatgacaccgggggaagcgattgccgccggctcagattatctggttgtcggtcggccgatttccaaggcagatgacccggttctagcggcacgctctattgttgcggagatgaccgaggctggcgcgtga

SEQ ID NO: 16815 - protein, 238 aa, Desulfuromonas acetoxidans DSM 684
MKDRLIFALDVDSYDEARQWVRILADEVGMFKVGKQLFTRCGPQIVDMIRQAGGGVFLDLKYHDIPNTVAKAGIEAARMGVQMFNVHALGGGKMMRTMVDEVREAAVKEGFPVPITLAVTILTSSSEEDLRQVGIDLPVTQMVPRLATLARESGLHGVVASAQELPLIRQACGGDFVVVTPGVRPATAARDDQQRVMTPGEAIAAGSDYLVVGRPISKADDPVLAARSIVAEMTEAGA

SEQ ID NO: 16816 - DNA, 690 bp, Jannaschia sp. CCS1
  CDS (1)..(690): transl_table=11
atgtcggacgaccgtttgatcgtggcgctggatgtgcccaacgtggtgcagggcctggcgctggccgaaaaactcggcgacgccgtttcattctacaaaatcggactggggatgctgaccggcggtggcctggcgctcgccaatgagctgaagcaggaccacggcaagcgcattttccttgatatgaagttgttcgatatttccgccacggtcgaggccgcggtgcgggggctggcgcaattcaacctggatttcctgaccgtccatggcgatccccacgtggtgcgcgccgccaaggaaggagcggcgggcagcgacacgaagatccttgcggtgacgatcctgacctctctggatcggaccgatctggacgattgcctgatccgggatggagagatgcttgatctggtggccgagcgggcgggccgcgcgtttgaggcgggcgccgatggcgtcatctcttccccgcacgaagcgaccatgatccgcgccctgcccgaggccaagggccgcctgatcgtgacccccggcgtccgcccaacgggcagcgcgtccggcgaccagaaacgcatcgcgacgccgcgccaggccatcgcggacggggccgaccacatcgtcgtgggccgcccgatctggcagcatcaggacccgcgtgcggcggcgcagatggtggtggcggacctgccttaa

SEQ ID NO: 16817 - protein, 229 aa, Jannaschia sp. CCS1
MSDDRLIVALDVPNVVQGLALAEKLGDAVSFYKIGLGMLTGGGLALANELKQDHGKRIFLDMKLFDISATVEAAVRGLAQFNLDFLTVHGDPHVVRAAKEGAAGSDTKILAVTILTSLDRTDLDDCLIRDGEMLDLVAERAGRAFEAGADGVISSPHEATMIRALPEAKGRLIVTPGVRPTGSASGDQKRIATPRQAIADGADHIVVGRPIWQHQDPRAAAQMVVADLP

SEQ ID NO: 16818 - DNA, 729 bp, Desulfitobacterium hafniense DCB-2
  CDS (1)..(729): transl_table=11
atggagctggaaagaacagtgtcggagaacaataaaaaggtcatggtggctatggatgtgaatagccgggagaaggctttagccctggctgaccaacttcaggggagcggctgctggcttaaagtggggatggagctctataatgctgcaggtgccggcattatccgagaactgaaggacaaagggttccccatcttcctggacctgaagcttcatgatatccccaatacggtggaaagtgcggtacgggttctggccggatatggcgccgatgtgctcactattcactgcagcggcggtcatgatatgatggcccgggcggtccaggctacccatgaagtgaaaaagcaaaagaatgctgaggagcggatgaagattatcggcatcacggtactgaccagccttgatgaagagaggctgcagcaggatctgggagtgggcagaaccctgccggagcaggtggttgccctggccgaactgggtcaaaaggcaggtattgacggggtggtggcctcggctcaagaaagcgccatcctccgccggcatgtaggaccggattttgtggtcattacgccggggattcgccccaaaggcagtgaaacccatgatcaagcccgtacacttactcccaaagaagccctggaagcggggagctcttatctggtggtaggcagacccattacccaggcggccaatccaaggcaggctttggagcagctttgggattaa

SEQ ID NO: 16819 - protein, 242 aa, Desulfitobacterium hafniense DCB-2
MELERTVSENNKKVMVAMDVNSREKALALADQLQGSGCWLKVGMELYNAAGAGIIRELKDKGFPIFLDLKLHDIPNTVESAVRVLAGYGADVLTIHCSGGHDMMARAVQATHEVKKQKNAEERMKIIGITVLTSLDEERLQQDLGVGRTLPEQVVALAELGQKAGIDGVVASAQESAILRRHVGPDFVVITPGIRPKGSETHDQARTLTPKEALEAGSSYLVVGRPITQAANPRQALEQLWD

SEQ ID NO: 16820 - DNA, 648 bp, Methanococcoides burtonii DSM 6242
  CDS (1)..(648): transl_table=11
atggaaaaaaagaaccgactcatccttgctctggatgtaactgacagagagaatgcccttcgtatcgctaatgaagtttccgactatgtggattctataaaggtaggatatccgctggtccttggggaaggccttagtatagtcaaggaacttgtggaaattgcaccagttatcgctgatttcaaggttgctgacataccaaatactgaccgacttatctgtgaacacgtgttcaatgccggagctgccgggataatcacccacggattcacaggtcgcgacagccttgattcctgtgtaaaggttgctaatgaatttgggactgacgtttatgtggtcacagagatgagccacccgggtggtgtggagttcttccgcccggttgccgaggatattgccagtatggcagtggaagcaggagcctccggagttgtagcgcctgcaacaagacctgaaagagtaaaagacatacgcaagatcatcggagaggaacttagcattatctcacccggcgtgggagctcagggaggcagtgctgccgatgttataagagcaggtgctgactgggtgatagtcggacgaagcatctataattccgattctccggcagaagctgcaaagaagatatgcgatgaaatgaattgttga

SEQ ID NO: 16821 - protein, 215 aa, Methanococcoides burtonii DSM 6242
MEKKNRLILALDVTDRENALRIANEVSDYVDSIKVGYPLVLGEGLSIVKELVEIAPVIADFKVADIPNTDRLICEHVFNAGAAGIITHGFTGRDSLDSCVKVANEFGTDVYVVTEMSHPGGVEFFRPVAEDIASMAVEAGASGVVAPATRPERVKDIRKIIGEELSIISPGVGAQGGSAADVIRAGADWVIVGRSIYNSDSPAEAAKKICDEMNC

SEQ ID NO: 16822 - DNA, 747 bp, Methylobacillus flagellatus KT
  CDS (1)..(747): transl_table=11
atgcaacgcgtgggaatctctctctcccgaaaccaaagaatccgccgtatgaccgacccaaagatcattgtcgcccttgattaccctgatgctgcacacgccctggggctagcccgccagcttgatccagcattgtgccgggtcaaggtagggaaggaattgttcaccgctgctggtccgcagctagtggaggcattaatcaagctcggctttggcgtgttcctagacctcaagtttcacgacatccccaatacggtcgccaaggcttgcgaagcagcaagcaagctgggcgtatggatgctcaatgtgcatgcttctggcggtagccagatgatgcaggctgcacgcgagggcgtagcgcggagtggccacgctccattgctaattgcagtgacggtattgaccagcatgaaccaggaggagctgtccgagctgggagtgaatgccccgatcgagcagcatgtattacacttggcaagactcagccagcaggcaggcctggatggtgtcgtctgttctgcccaggaggctccagcactgcgccgggcactgggtcatgatttttgcctggtgacgcctggtatccgccctgcggacgccgcgctcgacgaccaatcccgcgtggtgacgcccgccagggcgcttgccatgggctccaactacctggtgatgggccgtcccatcaccagggcagccgacccactagccacactggatcaaattcgggaatcaatcctaggaaaataa

SEQ ID NO: 16823 - protein, 248 aa, Methylobacillus flagellatus KT
MQRVGISLSRNQRIRRMTDPKIIVALDYPDAAHALGLARQLDPALCRVKVGKELFTAAGPQLVEALIKLGFGVFLDLKFHDIPNTVAKACEAASKLGVWMLNVHASGGSQMMQAAREGVARSGHAPLLIAVTVLTSMNQEELSELGVNAPIEQHVLHLARLSQQAGLDGVVCSAQEAPALRRALGHDFCLVTPGIRPADAALDDQSRVVTPARALAMGSNYLVMGRPITRAADPLATLDQIRESILGK

SEQ ID NO: 16824 - DNA, 1164 bp, Frankia sp. EAN1pec
  CDS (1)..(1164): transl_table=11
gtggggtgtcgggccacggctggacggatacgagatccgcaccgcctgtgtcagcgccggggtgccctgcatcaccaccattcagggcgccgccgcgtgcgtgcagggtatcgagtcgctcgtaaggggcgaactgggggtgcggccgctgcaggagtaccacgcggccctgcggtcgacctgggggacgacccccgagggactgccgggtgcgacctccggctcgggctcccgggcgccgggggcgcggccgggacccgcgccgggcgccgggtcgggatccggctcggccggcggggcgcccgcctcgaccgtggcggaccggtgacctcatcgggcgccccccgccggtggacgccaccggcgggccgcgccccgatcgcggtcgcgctcgacgctccggacgccgccaccgcgctgggctgggcccgcgaggtggcgccgcacgtcgccgtgctgaagatcggtctggagctcttctaccgggccgggccgacgatcgtgactgcgctgcgtgacgaagggctgctcgctccggctcggccggcggagcctgcggcgcctgctcgggtggtgagttccgtcacggggggtgatgtgacggacggctggggtgagtcgcacggctccgcggcgcccgagctcttcctcgacctgaagctccacgacataccggcgaccgtggccggcgggatgcgctcgctggccacgctggcacctcgcttcgtgaccgtgcatgcggccggcggcgcggccatggtgcgcgccgcggtcgacgccgggcccgatgttcatgtaaccgcggtcacggtgctgacgtcgctggacgccgccacgctcgccgccgtcgggctgtccggaccgccctcggacgccgtccgcaggctcgcggtgctcgctgtggaggccggtgcgcgggcgctcgtctgcagcccgaaagaggtctccatggtccgcgcggagcttggtgaaactgtgactctggtcacgcctggagtgcgtccagaggggtctgagcgggctgaccaggcccgggtcgccaccccggaacgggcactcgctgacggttcggacctcctcgtgatcggccgtccgatcacctccgcggccgatcgggccgtggccgccgccactatcgccaccagggttactccactccggtag

SEQ ID NO: 16825 - protein, 387 aa, Frankia sp. EAN1pec
MGCRATAGRIRDPHRLCQRRGALHHHHSGRRRVRAGYRVARKGRTGGAAAAGVPRGPAVDLGDDPRGTAGCDLRLGLPGAGGAAGTRAGRRVGIRLGRRGARLDRGGPVTSSGAPRRWTPPAGRAPIAVALDAPDAATALGWAREVAPHVAVLKIGLELFYRAGPTIVTALRDEGLLAPARPAEPAAPARVVSSVTGGDVTDGWGESHGSAAPELFLDLKLHDIPATVAGGMRSLATLAPRFVTVHAAGGAAMVRAAVDAGPDVHVTAVTVLTSLDAATLAAVGLSGPPSDAVRRLAVLAVEAGARALVCSPKEVSMVRAELGETVTLVTPGVRPEGSERADQARVATPERALADGSDLLVIGRPITSAADRAVAAATIATRVTPLR

SEQ ID NO: 16826 - DNA, 759 bp, Moorella thermoacetica ATCC 39073
  CDS (1)..(759): transl_table=11
ttgccaacactaatgtacctgcaggagatgatccgcatgcatgccaaggacaaaataatcgtcgccctggatgttcccgacctggctgccggggaaaagctggtggaccggctttccccctacgccggcatgtttaaagtcggcctggagtttttcaccgccgccgggccggcggccgtccggatggtaaaggagcgtggtggccgggtatttgccgacctgaagttccacgacatccccaacaccgtggccggagcggcgcgggccctggtgcgcctgggcgtggatatgctcaacgttcacgccgccggcggcaaggccatgctgcaggctgccgccgccgccgtccgggaggaggccgcggccttaaaccgcccggcgccggtaataatcgcggtcactgttttgaccagcctggacagggaagctctacgctgcgaggtgggtatcgagcgagaggtagaagaacaggtggcccgctgggcgctcctggcccgggaggccggcctggacggcgtagtagcctcgccccgggagatccgggccatccgggaggcctgcgggccggagttcgtcatcgtgaccccgggcgtgcgcccggctgggtccgaccggggcgaccagcgccgggtcatgaccccggccgaggccctgcgggagggcgcctcctacctggtcatcggccggcccatcaccgcggcccccgaccccgtcgccgccgcccgggccatcgcggcggaaatagagatggtgaaataa

SEQ ID NO: 16827 - protein, 252 aa, Moorella thermoacetica ATCC 39073
MPTLMYLQEMIRMHAKDKIIVALDVPDLAAGEKLVDRLSPYAGMFKVGLEFFTAAGPAAVRMVKERGGRVFADLKFHDIPNTVAGAARALVRLGVDMLNVHAAGGKAMLQAAAAAVREEAAALNRPAPVIIAVTVLTSLDREALRCEVGIEREVEEQVARWALLAREAGLDGVVASPREIRAIREACGPEFVIVTPGVRPAGSDRGDQRRVMTPAEALREGASYLVIGRPITAAPDPVAAARAIAAEIEMVK

SEQ ID NO: 16828 - DNA, 675 bp, Sphingopyxis alaskensis RB2256
  CDS (1)..(675): transl_table=11
atgacttcgcccatctatctcgccatcgacaccccgcatctcgacgccgctctgacgctggcgcaaaaggtgcggcatcatgtcggcgggctgaagctggggctcgagtttttctgcgccaacggccatcatggcgtccatgaaatggcgaagctcggcctgccgatcttcctcgacctgaagctgcacgacattccgaatacggtggcaaaggcgatccaggcgctgcgcccgctcgaacccgcgatcctgacggttcacgccgcgggcggccgcgcgatgctcgaagaagcgaaagcggttgcgggcaaggataccagagtgatcgccgtcaccgtgctcaccagcctcgacgcgcccgatcttgaagacatcggcctcaccggcacgccgcacgatcaggtcgtacgccttgccgcgctggcgcgtgaggccgggctcgacggcattgtctgttcgggtcaggaagtgaaatcggcgcgcaaggcgtggcccggcggcttcttcgtcgtccccggcgtgcgccccgcaaacggccggatcggcgaccagaaacgcatcgtcacgcccgcgcaggcgatgtccgacggcgcctcgatcctcgtcgtcggccgcccgatcacccagtcgtccgaccccgaccttgcggcgcgcgagattgaagcgacgctctga

SEQ ID NO: 16829 - protein, 224 aa, Sphingopyxis alaskensis RB2256
MTSPIYLAIDTPHLDAALTLAQKVRHHVGGLKLGLEFFCANGHHGVHEMAKLGLPIFLDLKLHDIPNTVAKAIQALRPLEPAILTVHAAGGRAMLEEAKAVAGKDTRVIAVTVLTSLDAPDLEDIGLTGTPHDQVVRLAALAREAGLDGIVCSGQEVKSARKAWPGGFFVVPGVRPANGRIGDQKRIVTPAQAMSDGASILVVGRPITQSSDPDLAAREIEATL

SEQ ID NO: 16830 - DNA, 702 bp, Shewanella amazonensis SB2B
  CDS (1)..(702): transl_table=11
atgagagacaagcccattctggttgcccttgattttgacaacaagtattcagcgttgcagttggttgataagctcgatcccgccatgtgccgcctcaaggtgggcaaggagatgttcactctgtttgggccagagctggtaaaagacatccaaaatcgtggtttcgacttattccttgaccttaaatttcacgatattcccaacaccgtggccaaggcggttgccgcagcggctgagcttggggtctggatggtcaacgtccacgcatcaggtggttttgccatgatggaagcggcgcgcaaagccttgctgccatacggcgacaatgcgccgctgttgattgccgtgactgtgcttacctccatgagcgatgaagatcttaagcttttgggaatcgacgttggtgctgctgagcacgtgaagcgtcttgccaaattaacccgtgacgcgggcctcgatggtgtggtgtgctcggcacaggaagccactatgcttaaagaactgtgtgggcgcgattttaaactcattaccccgggtatacgccctgaggggagtgaggccggcgatcagcatcgcatcatgacgcccgctcaggctctgcaagcaggctcggattatctggtgattggtcgtccgatcaccaagtccgcagatccactcaagactctgacggaaattcaccagtcaatccgcggaatataa

SEQ ID NO: 16831 - protein, 233 aa, Shewanella amazonensis SB2B
MRDKPILVALDFDNKYSALQLVDKLDPAMCRLKVGKEMFTLFGPELVKDIQNRGFDLFLDLKFHDIPNTVAKAVAAAAELGVWMVNVHASGGFAMMEAARKALLPYGDNAPLLIAVTVLTSMSDEDLKLLGIDVGAAEHVKRLAKLTRDAGLDGVVCSAQEATMLKELCGRDFKLITPGIRPEGSEAGDQHRIMTPAQALQAGSDYLVIGRPITKSADPLKTLTEIHQSIRGI

SEQ ID NO: 16832 - DNA, 717 bp, Enterococcus faecium DO
  CDS (1)..(717): transl_table=11
atgaatcaactagaccaacgaccaattattgcattagatttttcaactaggcaagaggtagaagactttcttcgatttttcccgaaagaagaaaaattgtttgtgaaaatcggaatggaattgttctaccaagaaggacctgaaatcgtacgttatctaaaagaggctggtcataatgtatttttagatctgaaacttcacgatattccgaatacggtcgaaaaagcaatgcggggattggcaaagcttggtgttgatctcacctgtgttcatgccgctggcggtattcgtatgatggaggcggcaatgcgaggattagaagaggggactccagaaggtggaaaacgtccgctacttctagctatcactcagcttacttctacaagtgaagaagaaatgcatgccgatcaactaatcgaagtttctttagaaaaaagtgtgatccattatgctagctgtgccaaaaaagcaggattagatggtgtggtttcttctgcttgggaagtagaagcgatcaaagaaatggcaggagacgaatttgtttgcttaactccgggtataagaccagaaggaacagtcgcaggagatcagacaagagtagtcacaccttctcaggcaaaaaagatcggctcaacttttatcgttataggtcgaccaatcactcagtcaactaatccttataaagcatatcaaacgattcaaacagaatggagctaa

SEQ ID NO: 16833 - protein, 238 aa, Enterococcus faecium DO
MNQLDQRPIIALDFSTRQEVEDFLRFFPKEEKLFVKIGMELFYQEGPEIVRYLKEAGHNVFLDLKLHDIPNTVEKAMRGLAKLGVDLTCVHAAGGIRMMEAAMRGLEEGTPEGGKRPLLLAITQLTSTSEEEMHADQLIEVSLEKSVIHYASCAKKAGLDGVVSSAWEVEAIKEMAGDEFVCLTPGIRPEGTVAGDQTRVVTPSQAKKIGSTFIVIGRPITQSTNPYKAYQTIQTEWS

SEQ ID NO: 16834 - DNA, 732 bp, Magnetococcus sp. MC-1
  CDS (1)..(732): transl_table=11
atgtccaagcaaccacccatctctgctataaaaaatatcccgtcgcgggatcgtttgatgtttgccatggatgtgcccgatagtgccacagccaaaaacctggcagaaaggctgggtggctctgtcacggtctataagctggggttggagctgtttctttcgggggactattttgagctggtggagtggatgctcaagcgggataaaaaggtttttgcggatctaaaactgtttgatattcccaagaccgtggagcgggccacccggcagttggcggggcgggggatccactatctcacggtgcatggtaatgatggcattttgcaggcggcggcctcggccaaaggggatatgaaaatcctgggtgtgacctcgttaaccagcctggaccggggggatttggatgacctaggctttcagtgtgatgtggaagcgttggttgcctcgcgggccaaacgggcgttgctgcatggctgtgatggggtgatctcgtcgggcttggaagcggcgagattgcgtgcggagttggaccacaaactgctggtgattacgccgggcattcggcctgtggaaaaccgtcccagtgatgaccaaaaacgggtggtcagcgtggagcaggcgtttgcgtttggtgccgaccatattgtggtgggtcgacctatccgggatgcggaagagcccgctaaagccgccgaggcgatccaacaaaccattgccgatctgtttagctaa

SEQ ID NO: 16835 - protein, 243 aa, Magnetococcus sp. MC-1
MSKQPPISAIKNIPSRDRLMFAMDVPDSATAKNLAERLGGSVTVYKLGLELFLSGDYFELVEWMLKRDKKVFADLKLFDIPKTVERATRQLAGRGIHYLTVHGNDGILQAAASAKGDMKILGVTSLTSLDRGDLDDLGFQCDVEALVASRAKRALLHGCDGVISSGLEAARLRAELDHKLLVITPGIRPVENRPSDDQKRVVSVEQAFAFGADHIVVGRPIRDAEEPAKAAEAIQQTIADLFS

SEQ ID NO: 16836 - DNA, 684 bp, Ferroplasma acidarmanus Fer1
  CDS (1)..(684): transl_table=11
atgcttgccttcgcatatctattatatacgcataataaatatacaacaatggaaagtaagattatatttgcgctggatgtttatgattacaatacagctatggaactggccagaactgttggagaaaaggtatttgcaataaaaattaactggcccgtaattctagaaaatgggataaaaattgtccgggacctttctaaatatgcaaatataatatgtgattttaaacttgctgatatagataatactgtgagcatgattacaacaaaggtaaaagaatatggcgggtatggtataatcagccattcatttaccgggttaaattcattgaaagctgtcgttaaaagcgctggaaatatgaaagtattttccgttgtttcaatgtcacaggagtcatatcttgacaatattacggaggaactcataaaaatatcaagggaggccggtgtttacgggctggttgcaccgggaaaccgcccctattaccttaaaaaagtcaaagaactttcagaaggattaaaaataatttccccgggtgtaggtgcccagggcggcgatatagtaaatgcaatgcttttagggtctgactatgtaataatcgggagatctatttacaactcccttgacccgctgggaacccttgaaggtttttccagcagtattaacaataaattaaataaatag

SEQ ID NO: 16837 - protein, 227 aa, Ferroplasma acidarmanus Fer1
MLAFAYLLYTHNKYTTMESKIIFALDVYDYNTAMELARTVGEKVFAIKINWPVILENGIKIVRDLSKYANIICDFKLADIDNTVSMITTKVKEYGGYGIISHSFTGLNSLKAVVKSAGNMKVFSVVSMSQESYLDNITEELIKISREAGVYGLVAPGNRPYYLKKVKELSEGLKIISPGVGAQGGDIVNAMLLGSDYVIIGRSIYNSLDPLGTLEGFSSSINNKLNK

SEQ ID NO: 16838 - DNA, 708 bp, Mesorhizobium sp. BNC1
  CDS (1)..(708): transl_table=11
atgccggctgacgaaatgcgcgggcgcctgatcgtcggcctcgacgtgccgacccttgcagaagccgagaaggtggtaagtgccctcggcgatacggtgtccttctacaagatcggttatcagctcgcttttgcgggcgggctcgatttcgccggcgacctgatccgatccggccggcaggtcttcctggacatgaagctgctcgacatcgacaacacggtggcaaagggcgtggaaaacatcgcccgaatgggcgtggcgatgctcaccttgcacgcctatcccaaagcgatgcgcgccgcggtggcagccgcggaaggctccggcctgtgcctgcttggggtcaccgtcctcacatccatggatgcgcaggatctgatcgatgcgggttacgaacacgacccgcagacactggtgctgcgccgtgccgagcaggcgcgggcggcgggcatgggcggcgtggtctgttcggcggtcgaggccgctttggtgcgcagcgtggttggtcccgatatggcggtggtaacgccaggcatcaggcccgccggtgctgatcacggcgaccagaagcgcgttgtcacgcccgccgatgcgattcgcgccggcgccagccatctcgtcgtcgcacgaccgatcgtcgctgcggatgatcccaaatccgccgccgaggccattttgcgggaaatgcatcgcgctgttggaaactag

SEQ ID NO: 16839 - protein, 235 aa, Mesorhizobium sp. BNC1
MPADEMRGRLIVGLDVPTLAEAEKVVSALGDTVSFYKIGYQLAFAGGLDFAGDLIRSGRQVFLDMKLLDIDNTVAKGVENIARMGVAMLTLHAYPKAMRAAVAAAEGSGLCLLGVTVLTSMDAQDLIDAGYEHDPQTLVLRRAEQARAAGMGGVVCSAVEAALVRSVVGPDMAVVTPGIRPAGADHGDQKRVVTPADAIRAGASHLVVARPIVAADDPKSAAEAILREMHRAVGN

SEQ ID NO: 16840 - DNA, 726 bp, Silicibacter sp. TM1040
  CDS (1)..(726): transl_table=11
atgaccagccccctcgcagatgaccgcctgatcgttgccatggatgttcccaacgcccttgaagggctcaaactggcggaacagctgggtgacgcggtctcattctacaaaatcggccttgggatgctcaccgggggcgggctggccctcgcaaatgagttgaagcaagagttaggtaaaaagatcttcctcgacatgaagctctttgacatcggggccaccgtggaaaacgcggtgcgcggattggcgcagttcgatctcgacttcctgaccgtgcacggcgacccctatgtggtgcgcgccgcaaaagaaggggctgcgggcaaggatctgaagatcctcgccgtgacaatccttacgtcgctggatcgcgacgatctggatggggcgatgatcaaatccggtgagatcaaagatctggtgcaagagcgcgccggcaaggcgttctcggctggcgcagatggcgtcattgcaagcccgcaggaagccgccatgatccgctccctgcccgaagcagaaggcaagctgatcgtcactcctggtgtgcgcccggtgggcgctgaccttggcgaccagaagcgcgttacaaccccggcgcaggctcttgcttccggcgttgaccacatcgttgtcggtcgcccgatctggcaggcggaagcaccccgggtagcggcagagtcaattctgcaagagatgaacagcccgcaggcgaaagcgccgaactga

SEQ ID NO: 16841 - protein, 241 aa, Silicibacter sp. TM1040
MTSPLADDRLIVAMDVPNALEGLKLAEQLGDAVSFYKIGLGMLTGGGLALANELKQELGKKIFLDMKLFDIGATVENAVRGLAQFDLDFLTVHGDPYVVRAAKEGAAGKDLKILAVTILTSLDRDDLDGAMIKSGEIKDLVQERAGKAFSAGADGVIASPQEAAMIRSLPEAEGKLIVTPGVRPVGADLGDQKRVTTPAQALASGVDHIVVGRPIWQAEAPRVAAESILQEMNSPQAKAPN

SEQ ID NO: 16842 - DNA, 723 bp, Nitrobacter hamburgensis X14
  CDS (1)..(723): transl_table=11
atgaccgattcgcattatctcgaccgcgctcgtgaaaagctgattgtggctctcgatttttgggaggttgaggacgccaggaagcttgttcggaagctgggtgacgaggtctctttttacaaagtcggtctgggtctccagctcgttggcggaaacgagtttgccaaggagcttattgtcgagggcaagcgggtcttcctagattacaagtactacgacatcgaagagaccgttcaacgcgcggtcgcacaagcagccgaattgaaaatcacgttcctgaccgtgcacggcgtcgcgagcatcatgaaagccgccgtcgccggccgcggcaactccgacatgaagattctcggcgtcaccgtgctgacgagcatggatgccgaggacatcaaggagatgggcttcgacggcaaagtcgaagaccttgtcattgcccgcgcgaagaaagcgcttgaggttggggtcgacggcgtcgtcgcgtcggcgctggaagccgccgagcttcgaaaacagacgagcaacaagctgatgatcgtgtcgcccggtatccgcccgagcggcggcgccaggcacgatcagaagcgggtggccacaccgtttgaagccatacgggcgggagccgattatctggtgttgggcagacccatttacgcggcggacgatccgaaagccgccgcgcaagcgatcatccaggagatggcggacgcgctgcgcccggattga

SEQ ID NO: 16843 - protein, 240 aa, Nitrobacter hamburgensis X14
MTDSHYLDRAREKLIVALDFWEVEDARKLVRKLGDEVSFYKVGLGLQLVGGNEFAKELIVEGKRVFLDYKYYDIEETVQRAVAQAAELKITFLTVHGVASIMKAAVAGRGNSDMKILGVTVLTSMDAEDIKEMGFDGKVEDLVIARAKKALEVGVDGVVASALEAAELRKQTSNKLMIVSPGIRPSGGARHDQKRVATPFEAIRAGADYLVLGRPIYAADDPKAAAQAIIQEMADALRPD

SEQ ID NO: 16844 - DNA, 705 bp, Paracoccus denitrificans PD1222
  CDS (1)..(705): transl_table=11
atgacccaaacccccgatgaacgcctgatcgtggcgctggacgtgccgaacgcgctggccgggcttgagctggccgaaaagatcggcgatgccgccggcttctacaagatcggcctgggcatgctgaccggcggcgggctggcgctggccaacgagctgaagcaggaacacggcaagcgcatcttcctggacatgaagttcttcgacatcggcgccacggtcgaggcggcggtccgcggcatcgcgcaatacgacctcgatttcctgaccgtgcatggcgatccgcatgtggtgcgggcggcaaagcagggggcaagcggttcggggctgaagatcctggcggtgacgatcctgacctcgctggaccgcgccgacctcgatgccgggctgatcgtgccgggcgacgtggccgagatcgtggccacccgcgccgcccgcgccttcgaggccggggccgatgggatcatcgccagcccgcgcgaggccgcggcgatccgcgcgctgcccgaggcggcgggccggctgatcgtgacccccggcgtgcgcccggcgggcagcgatgccggcgaccagaagcggatcgagacccccgccaccgccatcgccaacggcgccgaccatatcgtcgtcggccggccgatctggcaggcggcggacccgcgcgccgcggcacaggcgatcgcggcggaactggccgggctctga

SEQ ID NO: 16845 - protein, 234 aa, Paracoccus denitrificans PD1222
MTQTPDERLIVALDVPNALAGLELAEKIGDAAGFYKIGLGMLTGGGLALANELKQEHGKRIFLDMKFFDIGATVEAAVRGIAQYDLDFLTVHGDPHVVRAAKQGASGSGLKILAVTILTSLDRADLDAGLIVPGDVAEIVATRAARAFEAGADGIIASPREAAAIRALPEAAGRLIVTPGVRPAGSDAGDQKRIETPATAIANGADHIVVGRPIWQAADPRAAAQAIAAELAGL

SEQ ID NO: 16846 - DNA, 696 bp, Shewanella denitrificans OS-217
  CDS (1)..(696): transl_table=11
atgaacaccaacccaattttagtcgccctagattttgatgataaagccgctgcactgcgcttaattgaccagttagatcctagtctttgccgtttaaaggttggtaaagaaatgtttaccctgtttggtcctcagttagtgcgtgatatccatgatcgaggttttgatttgtttctggaccttaaatttcatgacattcctaataccgtggccaaagccgtgagcgccgcagcagaacttggggtgtggatgactaatgtgcatgccagcggtggacttgccatgatgcaggcggctaaaaaagccctcgagccctatggcgataaagcccccttgttgattgcagttactgtgctgacgtccatgagtgatgaagacttagccttgcttgggattaatgtgcccacagttgagcatgtgctgagacttgcaaaactcagccaagatgcaggtcttgatggcgtagtatgttcggctcaagaagccaagctgcttaagcacaattttggcgccgattttaccttagtgaccccaggtattcgccctgttggcagcgaaatcggcgaccaacacagagtgatgacgccgcctcaagcactgcaagcaggttctgattttctggtgataggcagacccattactcaggcaagcgatcccttagcggcactaaaagcaatccatgaatcattggtttaa

SEQ ID NO: 16847 - protein, 231 aa, Shewanella denitrificans OS-217
MNTNPILVALDFDDKAAALRLIDQLDPSLCRLKVGKEMFTLFGPQLVRDIHDRGFDLFLDLKFHDIPNTVAKAVSAAAELGVWMTNVHASGGLAMMQAAKKALEPYGDKAPLLIAVTVLTSMSDEDLALLGINVPTVEHVLRLAKLSQDAGLDGVVCSAQEAKLLKHNFGADFTLVTPGIRPVGSEIGDQHRVMTPPQALQAGSDFLVIGRPITQASDPLAALKAIHESLV

SEQ ID NO: 16848 - DNA, 834 bp, Aspergillus oryzae
  CDS (1)..(834)
atgtcttccaagtcgcaattgacctacagcgcacgcgctagcaagcaccccaatgcgctcgtaaagaagctcttcgaggttgccgaggccaagaaaaccaatgtcaccgtttccgccgacgtgacaaccaccaaagagctgctggatttggctgaccgactcggtccgtacattgccgtgatcaaaactcacatcgatatcctctccgatttcagcgaagaaaccatcaccggtctgaaggcccttgcagagaagcacaatttcctcatcttcgaagatcgcaagttcatcgatatcggaaacacagtccaaaagcagtaccatggcggcactctgcgtatctctgagtgggcccacatcatcaactgcagtattctgcccggtgagggtatcgtcgaggctctggcccagactgcttcggccgaggacttcccctacggctccgagaggggccttttgatccttgcggagatgacctccaagggatctttggctaccggtcagtatactacttcttctgttgactatgctcggaagtataagaagtttgtgatgggattcgtctcgacacgtcaccttggcgaggttcagtctgaagttagctcgccttcggaggaggaagattttgtcgtcttcacgacaggtgtcaacctctcctcgaagggtgacaagctgggacagcagtaccaaactcctgagtcggctgttggacgcggtgccgactttattattgctggccgtggaatttatgctgctcctgatcccgtggaggcggcgaaccagtaccagaaggagggatgggatgcatacctgaagcgtgttggtgcgcaataa

SEQ ID NO: 16849 - protein, 277 aa, Aspergillus oryzae
MSSKSQLTYSARASKHPNALVKKLFEVAEAKKTNVTVSADVTTTKELLDLADRLGPYIAVIKTHIDILSDFSEETITGLKALAEKHNFLIFEDRKFIDIGNTVQKQYHGGTLRISEWAHIINCSILPGEGIVEALAQTASAEDFPYGSERGLLILAEMTSKGSLATGQYTTSSVDYARKYKKFVMGFVSTRHLGEVQSEVSSPSEEEDFVVFTTGVNLSSKGDKLGQQYQTPESAVGRGADFIIAGRGIYAAPDPVEAANQYQKEGWDAYLKRVGAQ

SEQ ID NO: 16850 - DNA, 1263 bp, Candida tropicalis
  CDS (299)..(1099)
ttgactttcttcaattttggttccattatattattttcggtctattatcttttgattatcttttattattatttttaaatacttttttttttttagttttgcgtttttgattccgtatatattttttatttagattataatatactttcaaaaatatttttataacagttttcttttgtgtaacattcacaaataatccgcacatttctccattcagacaaactaactaagcaaaaaaaagaaaatttttttttacgaaggttcaaaccaaaaccatatacatcacatcatcatcacaatggtatcaaccaaaacatacaccacaagagcatcgactcacccatcaccagtcgcacaacgtcttttccacttaatggacaccaaaaagaccaatctctgtgcatcagtcgacgttcaaaccacatccgaattcctttccttaatcgacaaactcggtccatatatctgtttagtcaagacccacatcgacataatcgacgacttcacctacgaggggaccattgttccattattggaattggcacggaagcataactttatgattttcgaagatcgtaagtttgcagatatcggaaacacggttaagcatcagtacacttccggggtgtacaagatcagttcctggagtgacattaccaatgcgcatggtgtcactggtgctggtgtcgttgatggtttgaaacagggtgcgttagaaacaacgaaggaaccaaggggtttgttgatgttggctgagttgtcttcgaaagggtcattggcgtatggtgagtatactgagaagacggttgagattgctaagctggataaggagttcgtgattgggtttattgctcaacatgatatgggtggacatgatgaagggtttgattggattgttatgactccaggggttggtttggacgataaaggtgatggattgggtcaacagtatagaacagttgatgaggttgtgagtactggtactgatgtgattattgttggaagagggttgtttggtaaaggaagagatccagaagttgaaggtaagagatatagagatgctggttggaatgcttatttgaaaagaaccggacaataaataaaataaataaataattttgcttttctataaacagtttataataaaaagtgtttaagagtctaaaacttcatcataatcttcgaaattatctgcaagtttcgttctcatgatttcaaataccaataatgcaatcgaagtagcggggattgtggttaatgcat

SEQ ID NO: 16851 - protein, 266 aa, Candida tropicalis
MVSTKTYTTRASTHPSPVAQRLFHLMDTKKTNLCASVDVQTTSEFLSLIDKLGPYICLVKTHIDIIDDFTYEGTIVPLLELARKHNFMIFEDRKFADIGNTVKHQYTSGVYKISSWSDITNAHGVTGAGVVDGLKQGALETTKEPRGLLMLAELSSKGSLAYGEYTEKTVEIAKLDKEFVIGFIAQHDMGGHDEGFDWIVMTPGVGLDDKGDGLGQQYRTVDEVVSTGTDVIIVGRGLFGKGRDPEVEGKRYRDAGWNAYLKRTGQ

SEQ ID NO: 16852 - DNA, 693 bp, Candidatus Pelagibacter ubique HTCC1062
  CDS (1)..(693): transl_table=11
atgatgaataaaaatatctttgttgcttgtgatacatcaagcttaaaagaaataaaaaaaataattagcgatacgaaaactaataaacttcaaataattccaaaatttggcttacagttcttttattcaaaaagtgggagagcttttcttcaaaattttaagagagattatttcttagatttaaaaataaatgatattccacaaactgctttatctgcaatggatagtttaaaagatttaaagaaatgtaaatatattacagttcatgtaagcggtggccttgaaatgcttaaagctattacaaaaaaagctaaatcaattaacaaaaatttaaaagtattaggagttacaattttaacaagccttaacaaaaaatctcttgaagaaattggtcacaccaagaccgtagagcagctagtattaaaacaagctggtcttataaaaaaatcaggtgcagctggaattgtgtgttctgcacaagaagcaaaaatagttaggaaaaaatacaaaaatttatttattgttacgccaggaataaggctacctggagatgatgcaaatgatcaatctagagtaatgactcctaatgatgcttttaaaaataaagtttctggtattgtaatgggaaggtcattaataaagggtaatatcaaaaacaacattaaaagattaattaatcacttaaatcaatga

SEQ ID NO: 16853 - protein, 230 aa, Candidatus Pelagibacter ubique HTCC1062
MMNKNIFVACDTSSLKEIKKIISDTKTNKLQIIPKFGLQFFYSKSGRAFLQNFKRDYFLDLKINDIPQTALSAMDSLKDLKKCKYITVHVSGGLEMLKAITKKAKSINKNLKVLGVTILTSLNKKSLEEIGHTKTVEQLVLKQAGLIKKSGAAGIVCSAQEAKIVRKKYKNLFIVTPGIRLPGDDANDQSRVMTPNDAFKNKVSGIVMGRSLIKGNIKNNIKRLINHLNQ

SEQ ID NO: 16854 - DNA, 702 bp, Pseudomonas fluorescens
  CDS (1)..(702): transl_table=11
atgtccgcctgccagactcctatcatcgtcgccctggatttccccacccgtgacgccgcactgaaactggccgatcaactggaccccaaactgtgccgggtcaaggtcggcaaggagctgttcaccagctgcgccgccgagattgtcgggaccctgcgggacaagggtttcgaagtgttcctggacctgaagttccacgatattcccaacaccaccgccatggcggtcaaggccgccgcagaaatgggcgtgtggatggtcaatgtgcactgctccggcggcctgcgcatgatggctgcctgccgcgaagtgctggaccagcgcagcggccccaagccgttgctgatcggcgtcaccgtgcttaccagcatggagcgtgaagacctggccggtatcggcctggacatcgagccccaggagcaggtgctgcgcctggctgccctggcgcagaaagccggcatggacggcctggtgtgctcggccctggaagcccaggccctgaagagcgcccatccgtccctgcaactggtgaccccggggattcgaccggcgggcagcgcccaggacgaccagcggcggatcctcaccccgcgccaggccctggatgccggctccgattacctggtgatcggtcgccccatcagccaggcggcagatccggccaaggccctggccgacgtcgtggccgaactggccctgtaa

SEQ ID NO: 16855 - protein, 233 aa, Pseudomonas fluorescens
MSACQTPIIVALDFPTRDAALKLADQLDPKLCRVKVGKELFTSCAAEIVGTLRDKGFEVFLDLKFHDIPNTTAMAVKAAAEMGVWMVNVHCSGGLRMMAACREVLDQRSGPKPLLIGVTVLTSMEREDLAGIGLDIEPQEQVLRLAALAQKAGMDGLVCSALEAQALKSAHPSLQLVTPGIRPAGSAQDDQRRILTPRQALDAGSDYLVIGRPISQAADPAKALADVVAELAL

SEQ ID NO: 16856 - DNA, 693 bp, Staphylococcus haemolyticus
  CDS (1)..(693): transl_table=11
atgaaagatttacctatcatagcattagatttcgaatcggcaactaaagttaatacattcttggaccaatttgatgaaccacttttcgtgaaaattggaatggaacttttctatcaagcgggccccgatttgattaaatcgattaaatctcgtggccatgacatattcttagatttgaagctacatgatattccaaacacggttgaaaaagcaatggaaggcttaggaaagttagatgtagacttagttaatgtgcatgcagctggaggtacagacatgatgaaagctgcagtaaggggtttgcacaaatatagtaatgatacaaagatcattgctgtgacgcaattaacatctacaacagaagaaatgctacgtaatgaacaaaacattcagacgacgattgaagaagcagtgttaaactatgctactttaacacaacaagcaggtctagatggtgtggtttgttctccacttgaagcagaattgctaacaaacaaattaggttctaatttcttaaaagttacaccaggcattagaccacagggggcagctgtagatgatcaaaaacgtattactacacctgaagatgctaaacaattaggggcaacacatatcgtagttgggcgacctatcacccaaagcgagaatcctgtggaaagttatcatactattaaagaaagttggttaggttaa

SEQ ID NO: 16857 - protein, 230 aa, Staphylococcus haemolyticus
MKDLPIIALDFESATKVNTFLDQFDEPLFVKIGMELFYQAGPDLIKSIKSRGHDIFLDLKLHDIPNTVEKAMEGLGKLDVDLVNVHAAGGTDMMKAAVRGLHKYSNDTKIIAVTQLTSTTEEMLRNEQNIQTTIEEAVLNYATLTQQAGLDGVVCSPLEAELLTNKLGSNFLKVTPGIRPQGAAVDDQKRITTPEDAKQLGATHIVVGRPITQSENPVESYHTIKESWLG

SEQ ID NO: 16858 - DNA, 825 bp, Coccidioides posadasii
  CDS (1)..(825)
atggcctccaaatcacaattcccgtacgaagaccgtgcgcgcgaccatcccaatccacttgcacgacgattattccagattgcgaccgagaaacagtcaaatgtcgtggtctcggccgatgtcacaactacaaaggagctccttgacctggctgacagactcggcccctacatggtcgttctaaaaactcacatcgatatcctcgccgacttctccgccgaaaccataaccggactccaatccctttcccagaagcacaacttcctgatctttgaggaccggaaattcgttgatattggcaacacagtgcaaaaacaataccatgggggcgcactccacatttcggaatgggctcatatcgttaatgcaaccgtgcttccgggcccaggtatcatagatgccctagcgcaagttgcttctgcaccagacttcccccacgcttcagacagagggctcctgatcttggcgacgatgacatcaaagggtagtcttgctactggtcagtatactgagttgtcggttgagctggcgcggaagtacaagggctttgtcctaggcttcgtggccagcaggtccttagaaggagttgaaacggctggaaaggcggatgatgaggattttgtcctcttcacgacaggtgttaaccttgcttccaagggtgatgcattgggacagcagtatcagacccctgaatcagccattggaggcggtgcggactttattatcagtggacgcgggatctatgcggctcctgacccggttgatgccgctaggcggtatcaaaaagcgggctgggatgcttatttgaaaagagtgggcagataa

SEQ ID NO: 16859 - protein, 274 aa, Coccidioides posadasii
MASKSQFPYEDRARDHPNPLARRLFQIATEKQSNVVVSADVTTTKELLDLADRLGPYMVVLKTHIDILADFSAETITGLQSLSQKHNFLIFEDRKFVDIGNTVQKQYHGGALHISEWAHIVNATVLPGPGIIDALAQVASAPDFPHASDRGLLILATMTSKGSLATGQYTELSVELARKYKGFVLGFVASRSLEGVETAGKADDEDFVLFTTGVNLASKGDALGQQYQTPESAIGGGADFIISGRGIYAAPDPVDAARRYQKAGWDAYLKRVGR

SEQ ID NO: 16860 - DNA, 753 bp, Desulfovibrio vulgaris
  CDS (1)..(753): transl_table=11
atggccgaacttgtcattgcgctggactacccgaccatggatgcggccctggccacggcccgcgcgctgcgcggcgcgaccgatacggcgggcgacgcagggggccgcctgtggatgaaggtggggctggagctgttcaccgccagcgggcccgaggtggtggcccgactgaaggacatgggctttcccgtgttcctggacctgaagtttcacgacattcccaacacggtgcgcggggcggtgcgttccgccgtggccaccggggcggacatgtgcaacatccacctgcccggcggcgagcgcatgtgccgcgcggcggtggagggcctggccgagggcgcggcggcgcgcggacacggggcggccccgatcctgctgggggtcaccgtgctgaccagcgtggccccgggcgagttgcccggcggggccgatccttccgcagaggcggcccgcctggccgtgtgcggccgggagtggggcctgggcggcgtggtctgttcggggtacgaagccgcgggcatcaagcagcgttgcgggcgcgatttcatctgcctgacgccgggcatccggcctgccgccccccagaggagcggttccggcgatgacgaccagcgccgggtgatgaccccggcggaggccgtgcgggccggttccgactatctggtggtggggcgcccggtgaccggcgcggcaggacctgacggcccggcggaagcggcgcggcgcatccttgcggagatgcgcggggcctga

SEQ ID NO: 16861 - protein, 250 aa, Desulfovibrio vulgaris
MAELVIALDYPTMDAALATARALRGATDTAGDAGGRLWMKVGLELFTASGPEVVARLKDMGFPVFLDLKFHDIPNTVRGAVRSAVATGADMCNIHLPGGERMCRAAVEGLAEGAAARGHGAAPILLGVTVLTSVAPGELPGGADPSAEAARLAVCGREWGLGGVVCSGYEAAGIKQRCGRDFICLTPGIRPAAPQRSGSGDDDQRRVMTPAEAVRAGSDYLVVGRPVTGAAGPDGPAEAARRILAEMRGA

SEQ ID NO: 16862 - DNA, 789 bp, Mortierella alpina
  CDS (1)..(789)
atgtccgcctcaaagtcatacctcgagcgctcgaagctccactccaaccctacagccaaggccttcttggagctcatggagcgcaagaagtccaacctgtcggtggctgctgatctcacctccaaggctgcattgattgaattggccgacaaagtcgggccttacatttgtctgctcaagactcacatcgatgttgttgacgatttcgatcaggatttggtggatcagctcacggcgttggctaagaagcacgactttatgatctttgaggaccgcaagtttgctgatatcggcaacacggtcaagcttcagtacagctcgggagtgtacaagattgcctcttggtccgatattaccaatgcgcacactgttcctggcgagggcatcatccagggacttcgcgaggttggattgcccctgaaccgctgcttgctcctgttggcagagatgtcgtctgcaggaacattggctaagggcgactacaccacgacgacggttgagctggcgcgcaagtacaaggattttgtggttggattcattgccatgtcaagatatgaggacaaggagggcgacgactttatctacatgacacccggcgttggactggaccagacctcggatgggttgggtcagcagtggaagcacccacgggaggttgtttatgatcgcggatgcgatgtcatcattgttggacgtggcatctacgggaagggcagagaccccgccaaggaggccaagcggtatcaggaggctggctggaacgcctatttggagaggatctccaagtaa

SEQ ID NO: 16863 - protein, 262 aa, Mortierella alpina
MSASKSYLERSKLHSNPTAKAFLELMERKKSNLSVAADLTSKAALIELADKVGPYICLLKTHIDVVDDFDQDLVDQLTALAKKHDFMIFEDRKFADIGNTVKLQYSSGVYKIASWSDITNAHTVPGEGIIQGLREVGLPLNRCLLLLAEMSSAGTLAKGDYTTTTVELARKYKDFVVGFIAMSRYEDKEGDDFIYMTPGVGLDQTSDGLGQQWKHPREVVYDRGCDVIIVGRGIYGKGRDPAKEAKRYQEAGWNAYLERISK

SEQ ID NO: 16864 - DNA, 1392 bp, Cyanidioschyzon merolae
  CDS (1)..(1392)
atggagcagcttgccaaggatctttttgagataggtgcggtcaagtttggcacgttcaaactcaagtctgggatagcgtctccattctatgtcgatctgcgcgttgctgtctcgtatcctcgagttctgagaagcattgcggctctgtacctagagtgcttgcaggacttttctggcgctttcgacgttatttgcggggttccatacactgcgctcccttttgcgacagcaatggctgtgcagggagacttacctatggttatgtgtcgaaaggaggtcaaagaccatggaacacggcgagttgttgaaggtgctttcacacaaggctctcgttgcttaataatcgaggacgttgttacaagtggttcaagtattctggaagttgtgggcgcattgcgcgcagagggtctcaaagtggatcacgcgatcgtcttgcttgatagggagcaaggcgggtgtgaggcgcttctcggccagggaatagggctccgatctgttttccgcatcagcgacctcgttgggacgctgcggaatttgaacttgcttgagccggggaaggtggatatgattctagattttattcgcacggcccgcgcagcatcagatgttaagcgccccgaaacaaacgttccatccgcattgccagtcgccgcatcaagttcttccccggtgcgagatcaactttactcaatcgcagaaaaaaagagaagcatattatgcgttgcggcagacgtacaatcgactaaggagcttcttggaattgcagatgcagtaggcccccacatctgtgttctgaagttgcacgccgatattatccaggactggacgacggacacatcaagacgccttcgagagctcgcggacaaacacagtttcatgctttttgaggatcgaaaattcgctgacataggaaacacggttgttgcacagttcagcgcaggcgtacatcggatctcttcctgggcggacattgtcaatgcacacgccatcccgggccctggactgattgagggcctgcgccacgcttgcgcaatttccggcagaatgattggcctcctgttagtcgcacaaatgtccagcaaagggaacttgattgacgagagatacactgctacatgcctgcggatggcccgcgaagcgtttccgttctgtatcggcttcattgcccaggagcgtctggacccgacagggaagctctttgtgatggcgcctggtgtgcaactggattcaaagggcgatcaattaggccaacagtacaattcaccacagtatctgctgaagcgcaagggtgtcgacttccttatcgttggccgcggtatctacgggagtgaagagccagcaaaggcggcccagatgtacaaagagttgtcgtggagcgtccttcacggctaa

SEQ ID NO: 16865 - protein, 463 aa, Cyanidioschyzon merolae
MEQLAKDLFEIGAVKFGTFKLKSGIASPFYVDLRVAVSYPRVLRSIAALYLECLQDFSGAFDVICGVPYTALPFATAMAVQGDLPMVMCRKEVKDHGTRRVVEGAFTQGSRCLIIEDVVTSGSSILEVVGALRAEGLKVDHAIVLLDREQGGCEALLGQGIGLRSVFRISDLVGTLRNLNLLEPGKVDMILDFIRTARAASDVKRPETNVPSALPVAASSSSPVRDQLYSIAEKKRSILCVAADVQSTKELLGIADAVGPHICVLKLHADIIQDWTTDTSRRLRELADKHSFMLFEDRKFADIGNTVVAQFSAGVHRISSWADIVNAHAIPGPGLIEGLRHACAISGRMIGLLLVAQMSSKGNLIDERYTATCLRMAREAFPFCIGFIAQERLDPTGKLFVMAPGVQLDSKGDQLGQQYNSPQYLLKRKGVDFLIVGRGIYGSEEPAKAAQMYKELSWSVLHG

SEQ ID NO: 16866 - DNA, 810 bp, Cryptococcus humicola
  CDS (1)..(810)
atggccccgcaccccgtcaccaccaagacgtacgcctcgcgcgcggcgtcgcaccccaaccccaccgcccgccgcgtcctcgagacgatggagcgcaaaaagacaaacctctgcgtgtcggtcgacgtgacaaagtcggccgagatcctcgacattgtccgccaggtcgcgccctacgtctgcatggtcaagacccacatcgacattgtcgaggacttcaccatcgacctcgccaacgagctcaagcgcctcgccgacgagctcgactttgtcattttcgaggaccgcaagtttgccgacattggcaacacggtcgagcttcagtacagcgccggtgtgcacaagatcgcctcgtggtctcacctcaccaacgcccacgtcgtccccggccccggcatcatcaccggcctcggagccgtcggcaagccgctcggcaacgccctcatcctgctcgccgagatgagctcggccggcaacctcgccagcggcgagtacactgagaaggccgtccagatggcccgtgaggccggccttgactgggtcgtcggctttatcgccatgcaccgtgtcgacaaggccgacgaccccgacttcctcgtcatcactcccggtgtcggtctcgacgtcaagggcgacggccgtggccagcagtaccgtaccccgcacgaggtcgtctacgactcgggctgcgatgtcatcatcgtcggccgcggcatctacaagaacaaggatgccgtcgcgtccgaggccaagaggtatcaggaggccggatggaaggcctacgaggaccgcctgcagcgtactgcttag

SEQ ID NO: 16867 - protein, 269 aa, Cryptococcus humicola
MAPHPVTTKTYASRAASHPNPTARRVLETMERKKTNLCVSVDVTKSAEILDIVRQVAPYVCMVKTHIDIVEDFTIDLANELKRLADELDFVIFEDRKFADIGNTVELQYSAGVHKIASWSHLTNAHVVPGPGIITGLGAVGKPLGNALILLAEMSSAGNLASGEYTEKAVQMAREAGLDWVVGFIAMHRVDKADDPDFLVITPGVGLDVKGDGRGQQYRTPHEVVYDSGCDVIIVGRGIYKNKDAVASEAKRYQEAGWKAYEDRLQRTA

SEQ ID NO: 16868 - DNA, 831 bp, Penicillium camembertii
  CDS (1)..(831)
atgtcgtccaagtcgcaattgacttacagcgcccgcgctcaatcgcaccccaatcctcttgcgcgcaagcttttccaagtcgctgaagaaaagaagagcaatgtgaccgtctccgctgacgtgaccacgacaaaggagctcctggacctcgccgaccgccttggcccctacatcgccgtgatcaaaacccacatcgacatcctctccgacttcagccaagaaacaatcgacggcctgaacgccctagcccaaaagcacaacttcctcatcttcgaagaccgcaaattcatcgacatcggcaacacagtccagaaacagtaccacaacggcaccctccgcatctcggaatgggcccacataatcaactgctccgtccttcctggcgagggcatcgtccaggccctcgcacaaaccgcccaggccactgacttcccctacggctccgagcgcggcctcctcatcctcgccgagatgacctccaagggatccctcgcaacaggctcctacacctccgcctccgttgacatcgcgcgcaagtaccccagctttgttctgggctttgtctccacccgctcgttgggtgaggtcgagtctactgaggcgcccgcccagggcgaggacttcgtcgtcttcaccactggtgtcaacctctcgtctaagggcgataagctcggtcagcagtaccagacaccgcagtcggctattggccgcggtgccgacttcattatctctggtcgtggtatctatgccgctgcggaccctgttgaggctgctaagcagtaccagcaacagggatgggaggcgtatctggcccgcgtgggcgcgcaatag

SEQ ID NO: 16869 - protein, 276 aa, Penicillium camembertii
MSSKSQLTYSARAQSHPNPLARKLFQVAEEKKSNVTVSADVTTTKELLDLADRLGPYIAVIKTHIDILSDFSQETIDGLNALAQKHNFLIFEDRKFIDIGNTVQKQYHNGTLRISEWAHIINCSVLPGEGIVQALAQTAQATDFPYGSERGLLILAEMTSKGSLATGSYTSASVDIARKYPSFVLGFVSTRSLGEVESTEAPAQGEDFVVFTTGVNLSSKGDKLGQQYQTPQSAIGRGADFIISGRGIYAAADPVEAAKQYQQQGWEAYLARVGAQ

SEQ ID NO: 16870 - DNA, 831 bp, Penicillium nalgiovense
  CDS (1)..(831)
atgtcgtccaagtcgcaattgacctacagcgcccgcgcccaatcgcaccccaatcccctcgcgcgcaagcttttccaagtagccgaggagaagaggagcaatgtcactgtctccgctgacgtgaccacaacaaaggagctcctggacctcgccgaccgccttggcccctacatcgccgtgattaaaacacacattgacatcctctccgacttcagccaagaaacaatcgatggcctgaacgccctagcccaaaagcacaacttcctcatcttcgaagaccgcaaattcatcgacatcggcaacacagtccagaaacagtaccacaacggcaccctccgcatctccgaatgggcccatataattaactgctccatcctacccggtgagggcatcgtcgaggccctcgcgcaaaccgcccaggctactgacttcccctacggctccgagcgcggtctcctcatcctcgccgagatgacctcgaagggatccctcgcaacaggcgcctacacctccgcctccgtcgacatcgcgcgcaagtaccccagtttcgtgctgggctttgtctcgacccggtctctcggcgaggtcgagtctacagaggcgcccgcgcagggcgaagacttcgtcgtcttcaccactggcgtcaacctctcgtctaaaggcgataagctcggtcagcagtaccagacgccgcagtcggctgttggccgcggtgctgactttattatctctggtcgtggtatctacgccgctgccgaccctgttgaggccgctaagcagtaccagcagcagggctgggaggcgtatctggcccgcgtgggtgcgcaatag

SEQ ID NO: 16871 - protein, 276 aa, Penicillium nalgiovense
MSSKSQLTYSARAQSHPNPLARKLFQVAEEKRSNVTVSADVTTTKELLDLADRLGPYIAVIKTHIDILSDFSQETIDGLNALAQKHNFLIFEDRKFIDIGNTVQKQYHNGTLRISEWAHIINCSILPGEGIVEALAQTAQATDFPYGSERGLLILAEMTSKGSLATGAYTSASVDIARKYPSFVLGFVSTRSLGEVESTEAPAQGEDFVVFTTGVNLSSKGDKLGQQYQTPQSAVGRGADFIISGRGIYAAADPVEAAKQYQQQGWEAYLARVGAQ

SEQ ID NO: 16872 - DNA, 1437 bp, Zea mays
  CDS (1)..(1437)
atggccatggacgccgcagcgctggagtcgctcatcctggacctccacgccattgaggcagtgaagctgggctccttcgtgctcaagtccggcatcacctcccccatctatctggacctccgcgcgctcgtcttccacccgcgcctgctctccgccgtctcctcgctcctccacgcgctccccgccacgcgcccctacggcctcgtctgcggcgtcccctacacggcgctccccatcgccgccgtcctctccgtcgaccgctccgtccccatgctcatgcgccgcaaggaggccaaggcccatggcaccgccaagtccatcgagggctccttccgccccggggacaccgtcctcatcatcgaggacctcgtcaccagcggcgcctccgtgctcgaaaccgccgccccgctccgcgcagagggcctccttgtcgccgacgccgtcgtagtcgtcgaccgcgagcagggcgggagggagaacctcgccgctaacgggatcactctgcactcgctcatgaccctcaccgaggtgctcgccgtgctgctcaagcacgggaaggtgaccgaggagaaggcacatgaggtgaggcagttcctcgacgccaacaggaaggtggccgtgccgggggcggcgcctgttaaacccagggtgctcaggaagccattctcggagagggcgaaacttgccaacaaccctatggggaagaagctcttcgagctgatggaggccaagcagaccaacctgtgtgtcgctgctgatgttgggaccgcaaaggaactccttgagctggctgacaaggttggccctcaaatttgtatgttgaaaactcatgtggatatattatctgattttacaccagattttggctctaagctccgctcgattgctgagaagcacaactttttgatcttcgaagaccgcaagtttgctgacattgggaatacagtaaccatgcaatatgaaggtggaatattccgcatattggactgggctgatattgttaatgcgcatatagtttctggacctggaatcgtagatggcttgaagctgaagggttcgcctaaaggaagagggctacttctgctcgctgagatgagctctgccggcaatcttgctcatggagattacactgctgctgctgtaaagatcgctgagcaacattctgactttgtgatgggatttatatcagttaatcccgcatcttggtcagtaacaccatcaagcccggcgtttatccatgccacacctggagttcagatggtcgctggaggagatgatcttgggcaacaatacaacactcctgagtctgtgataaattacaggggcagtgacataatcatagttgggcgcgggattataaaggcgagcgatcctttgaagacggcatgtgagtaccgggtgcaagggtggcaggcatacaagaacagcttgctatga

SEQ ID NO: 16873 - protein, 478 aa, Zea mays
MAMDAAALESLILDLHAIEAVKLGSFVLKSGITSPIYLDLRALVFHPRLLSAVSSLLHALPATRPYGLVCGVPYTALPIAAVLSVDRSVPMLMRRKEAKAHGTAKSIEGSFRPGDTVLIIEDLVTSGASVLETAAPLRAEGLLVADAVVVVDREQGGRENLAANGITLHSLMTLTEVLAVLLKHGKVTEEKAHEVRQFLDANRKVAVPGAAPVKPRVLRKPFSERAKLANNPMGKKLFELMEAKQTNLCVAADVGTAKELLELADKVGPQICMLKTHVDILSDFTPDFGSKLRSIAEKHNFLIFEDRKFADIGNTVTMQYEGGIFRILDWADIVNAHIVSGPGIVDGLKLKGSPKGRGLLLLAEMSSAGNLAHGDYTAAAVKIAEQHSDFVMGFISVNPASWSVTPSSPAFIHATPGVQMVAGGDDLGQQYNTPESVINYRGSDIIIVGRGIIKASDPLKTACEYRVQGWQAYKNSLL

SEQ ID NO: 16874 - DNA, 921 bp, Oryza sativa
  CDS (1)..(921)
atgacgctcacggaggtgctcgccgtcctcgtgaagcgcgggaagctgggcgaggagaaggcccaggaggtgaagcgattcctcgacgcaaacaggaagatggctgtgccgggactgccggttaaaccgaaagtagttaggaaggcattttctgagagagctggattggcgacgaatccgatggggaggaagctgttcgagttgatggaggccaagcaaagcaacttgtgtgttgctgcagatgtcgggacagcaacagagctacttgatctcgccgataagattggtccagagatctgcatgttgaaaactcatgtggatatcttgtctgattttacaccggattttggccacaagctccgttcgattgctgagaggcacagctttttgatatttgaagaccgcaagtttgcagacattggaaacacagtaactatgcaatatgaaggaggaatattccgcatattagactgggctgatattgttaatgcacatatagtttctggacctggaattgtagaaggcttgaagctgaagggtctgccaaaaggaagagggttacttttgctttctgaaatgagttcagctggcaaccttgctcatggagattacactgctgcagccgtgaagattgctgagcaacattctgatattgtaattggatttatatcagtaaatcctgcatcttggtcagtgacgccgtcaagtccagcgttcatccatgctactcctggagttcagttggttgctgggggagactcgcttggtcaacagtacaacactccttactctgtcataaacgacagaggcagcgacataattatagtcggtcgtgggattataagggcgaacaatcctgctgagaccgcgagagagtaccgcatccaaggatggcatgcttaccaatccagcttatcatga

SEQ ID NO: 16875 - protein, 306 aa, Oryza sativa
MTLTEVLAVLVKRGKLGEEKAQEVKRFLDANRKMAVPGLPVKPKVVRKAFSERAGLATNPMGRKLFELMEAKQSNLCVAADVGTATELLDLADKIGPEICMLKTHVDILSDFTPDFGHKLRSIAERHSFLIFEDRKFADIGNTVTMQYEGGIFRILDWADIVNAHIVSGPGIVEGLKLKGLPKGRGLLLLSEMSSAGNLAHGDYTAAAVKIAEQHSDIVIGFISVNPASWSVTPSSPAFIHATPGVQLVAGGDSLGQQYNTPYSVINDRGSDIIIVGRGIIRANNPAETAREYRIQGWHAYQSSLS

SEQ ID NO: 16876 - DNA, 954 bp, Oryza sativa
  CDS (1)..(954)
atgaatgggatcacgctgcactcgctcatgaccctcacggaggtgctcgccgtgctgctcaagcacgggaaggtgaccgaggagaaggcgagggaggtaaggcagtttcttgacgccaataggaaggtgaccgttcccggagcggcgggcgccgttaagcccaaagcggtcaggaaggggtttgctgagagggctggattggccaagaacccgatggggaagaggcttttcgaggtgatggaggcaaagcagagcaatttatgtgttgctgccgatgtgggaactgcaaaggagctccttgagcttgcagagaaggttggtccagagatttgcatgctgaaaactcatgtggatatcttgtctgactttactccagattttggagctaagctttgctcgattgccgagaagcacaactttttgatatttgaagaccgcaagtttgctgacattggaaacacagtgactatgcaatatgaaggaggaatatttcgcatattagactgggctgatatcgtcaatgcccatataattcctggacctggaattgtggatggtctgaagcttaagggtttgccaaaaggaagagggctgcttttgcttgctgaaatgagctcggctggcaaccttgctcatggagagtacactgctgcagctgtaaagattgctgagcaacattctgattttgtaattggatttatatccgttaatccagcatcttggtcagttgcgccatcaagtccagcatttatccatgccactcctggagtgcagatggtttctggaggagatgctcttggtcaacagtacaatacccctcattctgttataaacgacagaggcagtgacataattatagtcggacgagggattataaaggcgagtaatccagccgagaccgcgagggagtaccgcatccaagggtggggagcataccaatccagcttgccatga

SEQ ID NO: 16877 - protein, 317 aa, Oryza sativa
MNGITLHSLMTLTEVLAVLLKHGKVTEEKAREVRQFLDANRKVTVPGAAGAVKPKAVRKGFAERAGLAKNPMGKRLFEVMEAKQSNLCVAADVGTAKELLELAEKVGPEICMLKTHVDILSDFTPDFGAKLCSIAEKHNFLIFEDRKFADIGNTVTMQYEGGIFRILDWADIVNAHIIPGPGIVDGLKLKGLPKGRGLLLLAEMSSAGNLAHGEYTAAAVKIAEQHSDFVIGFISVNPASWSVAPSSPAFIHATPGVQMVSGGDALGQQYNTPHSVINDRGSDIIIVGRGIIKASNPAETAREYRIQGWGAYQSSLP

SEQ ID NO: 16878 - DNA, 1437 bp, Dictyostelium discoideum
  CDS (1)..(1437)
atgaatattaaagaattagtattaaaattaatgaaattgatggcaattaaattaggagaatttaaattaaagagtggtattatttcaccaatttatattgatcttagagttacagtatcatcaccaccattgttagcagcaattgcagagatgatgtatcaaaaggtttataaatctggtaatgcacaagagacaccagcattagtatgtggtgtaccatatacagcattaccaattgcaacaggtatgtcaattgccaacaatattccaatggtagtacgtagaaaagaagccaaagcatatggtaccaaacaattgattgaaggtcgtttcaaagagggtgacaatgtattggttgttgaagatttagtaacaagtggtgcaagtgtacttgaaacagttagagatttaaattcagttggtttaaaagttacagacgtagtcgtgttattagatcgtcaagaaggtgccagacaagcacttgagaaacaaggctaccgtcttcactcagtctttacaatggaagagttaatcaacaccttaatcgaagctggtaaattaaccggccgtactttagagttggttcaatcattcttagacgccaatcgtaatgtagtagtaccattaccaccaacccttgccccaccagcaccagcaccaattgttattaataaaccatttgaagagagagctaaacttgcatcaaatccaatggcatctaaattattcacattaatgtcaagcaagaagaccaatcttgcagttgcagctgatttaactgataaacaacaacttttagatttagcagaatcaattggttcagaaatttgtgttttgaagacccatgttgatatcattgataattatgatgaagagtttattaaatcattgaaatgcatagcagcaaaacataatttcttgatttttgaagatagaaaattcgcagatattggaaacactgtgaaatatcaatttgagaatggtgtttataaaatctcaaaatgggcagtcatggtcaccgtacatggtgtcgcaggttcatccattgtcgatggtttcaaatcaggtttgaaagagtatggttcaggtttattattattggctcaaatgtcatcaaaaggttctttgtgtgttggtgattatacaactcaaatgattgaaatggcaaataataacaaagaggaggttatgggtttaatttgtcaagaacgattaccatcaatgactgatggtttggttttaatgactccaggtgttcaattcaattcaactggtgatgctatgggtcaacaatataatactccagaatatatcattaaagaaaagaatactgatgttatcattgttggtagaggtatttatcaaagtaatgatccaaaatctgttgcaaataaatatagaactgctgcttgggaaacttatcaatcaaaattttaa

SEQ ID NO: 16879 - protein, 478 aa, Dictyostelium discoideum
MNIKELVLKLMKLMAIKLGEFKLKSGIISPIYIDLRVTVSSPPLLAAIAEMMYQKVYKSGNAQETPALVCGVPYTALPIATGMSIANNIPMVVRRKEAKAYGTKQLIEGRFKEGDNVLVVEDLVTSGASVLETVRDLNSVGLKVTDVVVLLDRQEGARQALEKQGYRLHSVFTMEELINTLIEAGKLTGRTLELVQSFLDANRNVVVPLPPTLAPPAPAPIVINKPFEERAKLASNPMASKLFTLMSSKKTNLAVAADLTDKQQLLDLAESIGSEICVLKTHVDIIDNYDEEFIKSLKCIAAKHNFLIFEDRKFADIGNTVKYQFENGVYKISKWAVMVTVHGVAGSSIVDGFKSGLKEYGSGLLLLAQMSSKGSLCVGDYTTQMIEMANNNKEEVMGLICQERLPSMTDGLVLMTPGVQFNSTGDAMGQQYNTPEYIIKEKNTDVIIVGRGIYQSNDPKSVANKYRTAAWETYQSKF

SEQ ID NO: 16880 - DNA, 708 bp, Agrobacterium tumefaciens
  CDS (1)..(708): transl_table=11
atgaccgcgcgcgaaaaactcatcgtcgggctggatgttccgactgtgcagcaggcagaagacatcgtgtcgaaaatcggcgacgaggtcctgttctacaagatcggttatcagctggtattcgccgggggtcttgaattcgcgcgtgacctcgtccagagcggcaagaaggtctttctcgacatgaagctgctcgatatcgacaacaccgtcgcctcgggcgtcgaaaacatcgcccgcatgggcatgtcgatgctgacgctgcatgcctatcccaaagccatgcgtgctgccgtcaaggcggcggaaggctccggcctctgcctgctgggcgtcaccgtgctgacctccatggatgacagcgatctggtcgaggccggttacgcgtccgacgcgcgttcgctggtgctgcgccgggctgaacaggcacgcgaggccggtatgggcggcattgtctgttcggcggaagaatcgaccgctgtgcgtgaaattctcggccccgaccttgccgtggtcacccccggcattcgccccgccggcgccgatcttggcgatcagaagcgggtgatgacgccctatgacgccatcaaggccggttcgagccatctggttgtcgcccgtcccatcgtcagggcggaagacccgaaagcggcggcccgcgccattctggacgatatgctgcgcgcgagttttccggccaatcagtaa

SEQ ID NO: 16881 - protein, 235 aa, Agrobacterium tumefaciens
MTAREKLIVGLDVPTVQQAEDIVSKIGDEVLFYKIGYQLVFAGGLEFARDLVQSGKKVFLDMKLLDIDNTVASGVENIARMGMSMLTLHAYPKAMRAAVKAAEGSGLCLLGVTVLTSMDDSDLVEAGYASDARSLVLRRAEQAREAGMGGIVCSAEESTAVREILGPDLAVVTPGIRPAGADLGDQKRVMTPYDAIKAGSSHLVVARPIVRAEDPKAAARAILDDMLRASFPANQ

SEQ ID NO: 16882 - DNA, 717 bp, Anabaena sp
  CDS (1)..(717): transl_table=11
atgagtaatgacaaaataattgtggctttggatgtgccagatacggagagtgcgatcgctctcattgataagctagagtcggtgactttttggaaggttgggttggaattgtttactagttccggccccagaattctagaagtactgaaatctagacaaaagcgcatctttctcgatttgaagtttcacgacatccccaatacggtggctggggcttgtcgtgcggcggctggttacggggtggatttgatgacaatccatgctacctctggtagagatgccctgaaggctgcaaaagaggcggtagaggaaggggctgcacaagctggtgtgaaaccgcccaagttaatcgctgtgacggtgttaaccagtatttctgccagacagttggcgttagatttgaaaattccttcagaattgccagaatatgctttagatatggctctaatggcgcaggagatggggttagatggggcagtgtgttcaccccaagaagtggcacatttacgccaaatttgcggggatgatttcgtgttggtttgtccgggggtacgcccaacatgggcagaagcgggagatcaaaagcgatcgctcaccccctcccaagccatccaagcaggggctgattatttagtgattggtcgtccaattactgctgctgctgaacctgagttagcctggaaacgcatttctcaagagttaacaacagtggtatga

SEQ ID NO: 16883 - protein, 238 aa, Anabaena sp
MSNDKIIVALDVPDTESAIALIDKLESVTFWKVGLELFTSSGPRILEVLKSRQKRIFLDLKFHDIPNTVAGACRAAAGYGVDLMTIHATSGRDALKAAKEAVEEGAAQAGVKPPKLIAVTVLTSISARQLALDLKIPSELPEYALDMALMAQEMGLDGAVCSPQEVAHLRQICGDDFVLVCPGVRPTWAEAGDQKRSLTPSQAIQAGADYLVIGRPITAAAEPELAWKRISQELTTVV

SEQ ID NO: 16884 - DNA, 696 bp, Aquifex aeolicus
  CDS (1)..(696): transl_table=11
atggcaagaatttgtgttgctctggacgtcccctgggaaagggctataaagatagtaaaagacctttacgacttctttgaaacatatccccttatcttaaaaatcggacacaagatttaccttgaaaagggcggagacgctgtaaaggaactcaaggaggactttccttacgaggtgttcctcgatttaaaactccatgacatcccttcggttgtaggacttgccgttgaaaagatcagtgaactgggaacggattacaccacggttcatctgctcggcggtccggaaatggtaaaggaagcggtaaagaacaagggaagcatgaaaatcctcggtgttactatactcacctcgcacgacgagaactacataaagtttttaaaaagcaactttgaagatataaagaacttcaccctttacctcgcaagagttggtatagaaaacggcgttgacggagttgtttgctcaggtgaagaagttgagttcttaaagaagaacatagaaaaggacttcatagcggtagttccgggaataaggattaaaaaggaaaagaggcacgaccagaagagggttctcacacccgcggaggcaaagaaaaggggagcagacgttatagtaatcggaagggaaattacagagagcaagaatcccgtctacgtggtagaaagggctctaaagatgatgggagagatatga

SEQ ID NO: 16885 - protein, 231 aa, Aquifex aeolicus
MARICVALDVPWERAIKIVKDLYDFFETYPLILKIGHKIYLEKGGDAVKELKEDFPYEVFLDLKLHDIPSVVGLAVEKISELGTDYTTVHLLGGPEMVKEAVKNKGSMKILGVTILTSHDENYIKFLKSNFEDIKNFTLYLARVGIENGVDGVVCSGEEVEFLKKNIEKDFIAVVPGIRIKKEKRHDQKRVLTPAEAKKRGADVIVIGREITESKNPVYVVERALKMMGEI

SEQ ID NO: 16886 - DNA, 804 bp, Ashbya gossypii
  CDS (1)..(804)
atgtcaacgaaatcttacgcagaaagggccaaggcacacaattcgccagttgctagaaagcttctggcattgatgcacgagaagaaaaccaatctctgcgcttcccttgatgtgcggacgtctagaaagcttctggagctagcagacacgctgggaccgcacatttgtctgctgaagacacatgtcgacatactgacggacttcgacatcgagacgacagtcaagccgctgcagcagcttgcggctaagcacaacttcatgatcttcgaggaccgcaagttcgctgacattggcaacacggttaagctgcagtactcctccggcgtgtaccgtatcgcggagtgggcggatattaccaatgcacacggcgtcaccggccccggtgtgatagccgggctgaaggaggctgcgaaactggcctcacaggaacccagggggttgctgatgctggcagagctctcttctcagggctctttggcgcgcggagactataccgcgggcgtcgttgaaatggcaaagctggacaaagactttgtgatcgggttcatcgcgcagcgtgacatgggtgggcgtgcagacggctttgactggctcatcatgaccccgggggttggcctggacgacaaaggagacggcctgggccagcagtaccgcacggtggatgaggtcgtcagcgacggtaccgatgtgatcattgttggcagagggctctttgacaagggaagagaccccaacgtcgagggtgcccgctaccgcaaggccggttgggaggcttacttgcgccgtattggcgagacttcgtag

SEQ ID NO: 16887 - protein, 267 aa, Ashbya gossypii
MSTKSYAERAKAHNSPVARKLLALMHEKKTNLCASLDVRTSRKLLELADTLGPHICLLKTHVDILTDFDIETTVKPLQQLAAKHNFMIFEDRKFADIGNTVKLQYSSGVYRIAEWADITNAHGVTGPGVIAGLKEAAKLASQEPRGLLMLAELSSQGSLARGDYTAGVVEMAKLDKDFVIGFIAQRDMGGRADGFDWLIMTPGVGLDDKGDGLGQQYRTVDEVVSDGTDVIIVGRGLFDKGRDPNVEGARYRKAGWEAYLRRIGETS

SEQ ID NO: 16888 - DNA, 837 bp, Aspergillus fumigatus
  CDS (1)..(837)
atgtcgtccaagtcgcaattgacttacggtgctcgagccagcaagcaccccaatcctctggcaaagagactttttgagattgccgaagcaaagaagacaaacgttaccgtctctgctgatgtgacgacaacccgagaactcctggacctcgctgaccgtctcggtccctacatcgccgtcatcaagacacacatcgacatcctcaccgatttcagcgtcgacactatcaatggcctgaatgtgctggctcaaaagcacaactttttgatcttcgaggaccgcaaattcatcgacatcggcaataccgtccagaagcaataccacggcggtgctctgaggatctccgaatgggcccacattatcaactgcagcgttctccctggcgagggcatcgtcgaggctctggcccagaccgcatctgcgcaagacttcccctatggtcctgagagaggactgttggtcctggcagagatgacctccaaaggatcgctggctacgggcgagtataccaaggcatcggttgactacgctcgcaaatacaagaacttcgttatgggtttcgtgtcgacgcgggccctgacggaagtgcagtcggatgtgtcttcagcctcggaggatgaagatttcgtggtcttcacgacgggtgtgaacctctcttccaaaggagataagcttggacagcaataccagactcctgcatcggctattggacgcggtgccgactttatcatcgccggtcgaggcatctacgctgctcccgacccggttgaagctgcacagcggtaccagaaagaaggctgggaagcttatatggccagagtatgcggcaagtcatga

SEQ ID NO: 16889 - protein, 278 aa, Aspergillus fumigatus
MSSKSQLTYGARASKHPNPLAKRLFEIAEAKKTNVTVSADVTTTRELLDLADRLGPYIAVIKTHIDILTDFSVDTINGLNVLAQKHNFLIFEDRKFIDIGNTVQKQYHGGALRISEWAHIINCSVLPGEGIVEALAQTASAQDFPYGPERGLLVLAEMTSKGSLATGEYTKASVDYARKYKNFVMGFVSTRALTEVQSDVSSASEDEDFVVFTTGVNLSSKGDKLGQQYQTPASAIGRGADFIIAGRGIYAAPDPVEAAQRYQKEGWEAYMARVCGKS

SEQ ID NO: 16890 - DNA, 834 bp, Aspergillus oryzae
  CDS (1)..(834)
atgtcttccaagtcgcaattgacctacagcgcacgcgctagcaagcaccccaatgcgctcgtaaagaagctcttcgaggttgccgaggccaagaaaaccaatgtcaccgtttccgccgacgtgacaaccaccaaagagctgctggatttggctgaccgactcggtccgtacattgccgtgatcaaaactcacatcgatatcctctccgatttcagcgaagaaaccatcaccggtctgaaggcccttgcagagaagcacaatttcctcatcttcgaagatcgcaagttcatcgatattggaaacacagtccaaaagcagtaccatggcggcactctgcgtatctctgagtgggcccacatcatcaactgcagtattctgcccggtgagggtatcgtcgaggctctggcccagactgcttcggccgaggacttcccctacggctccgagaggggccttttgatccttgcggagatgacctccaagggatctttggctaccggtcaatatactacttcttctgttgactatgcccggaagtataagaagtttgtgatgggattcgtctcgacacgtcaccttggcgaggttcagtctgaagttagctcgccttcggaggaggaagattttgtcgtcttcacgacaggtgtcaacctctcctcgaagggagacaagctgggacagcagtaccaaactcctgagtcggctgttggacgcggtgccgactttattattgctggccgtggaatttatgctgctcctgatcccgtggaggcggcgaagcagtaccagaaggagggatgggatgcatacctgaagcgtgttggtgcgcaataa

SEQ ID NO: 16891 - protein, 277 aa, Aspergillus oryzae
MSSKSQLTYSARASKHPNALVKKLFEVAEAKKTNVTVSADVTTTKELLDLADRLGPYIAVIKTHIDILSDFSEETITGLKALAEKHNFLIFEDRKFIDIGNTVQKQYHGGTLRISEWAHIINCSILPGEGIVEALAQTASAEDFPYGSERGLLILAEMTSKGSLATGQYTTSSVDYARKYKKFVMGFVSTRHLGEVQSEVSSPSEEEDFVVFTTGVNLSSKGDKLGQQYQTPESAVGRGADFIIAGRGIYAAPDPVEAAKQYQKEGWDAYLKRVGAQ

SEQ ID NO: 16892 - DNA, 813 bp, Aureobasidium pullulans
  CDS (1)..(813)
atgtcccgtcacgcaacaatcacccagtcataccaggagcgagcctcgctgcccaagacatcaccggtcgcctcgtacctcctacgattgatcgcagcgaagaagacaaatctctgtgtctcggcagatgtgtcgacaaccagagagctgctgcaactcgccgaagaggtcggcgactcaatatgcatgctcaagacacacgccgacatcattaatgactttggccctcgcaccatcgagggtctgaaagagattgctgccaagaagcacttcctcgtcttcgaggaccgcaagtttggcgacattggcagtaccgtgcaaaagcagttcactgccggccctctgcagatcgttcgctgggccaatatcatcaatgcccacatcttccctggccccgccatcatcactgctctctcgcaagcccgcccacgatgccgtcagttgttgatcctcgcagagatgagcagtgcaggcaacttgatgactggctcatacactgaacaatgtgttgtggaagcacgcaagaacccggagttcgtcatgggcttcatcgcacaacgcactctcaatgaacagcctggtgacaatttcatcaccatgactcctggcgtccagattggcgccactggagatggtctcggccaacagtacaacactccggaaaaggtcatcggcgaagctggcaccgacatcatcattgtcggccgcggtgtctacggtgctcaagataagagggccaaggccgaggaatacagagtcagagcatggaaggcatacgaggggaattggcgctgctactgcaacaaaaggtag

SEQ ID NO: 16893 - protein, 270 aa, Aureobasidium pullulans
MSRHATITQSYQERASLPKTSPVASYLLRLIAAKKTNLCVSADVSTTRELLQLAEEVGDSICMLKTHADIINDFGPRTIEGLKEIAAKKHFLVFEDRKFGDIGSTVQKQFTAGPLQIVRWANIINAHIFPGPAIITALSQARPRCRQLLILAEMSSAGNLMTGSYTEQCVVEARKNPEFVMGFIAQRTLNEQPGDNFITMTPGVQIGATGDGLGQQYNTPEKVIGEAGTDIIIVGRGVYGAQDKRAKAEEYRVRAWKAYEGNWRCYCNKR

SEQ ID NO: 16894 - DNA, 717 bp, Bacillus anthracis
  CDS (1)..(717): transl_table=11
atgtcacagtcgttaatcgttgcactagatttcccagggaaacaagatgtagaacaattcttgcgccactttgaaggggaagagttatttgtcaaagttggtatggagttattttacaaagaaggccctgcgattattacgtacttaaaagaaaaaggacataaaatctttctagatttaaaacttcatgatattccgaatacagtaaaaagcgctatgcgtagcctagctagtctagatgtagatatggtaaatgttcatgctggtgggggaagcagtatgatgaaagctgcgattgagggattagaggaaggtaagcaagaaggaaaagagagaccgatttgtattgcagttacacaactaacaagcacttcggaaactatgatgaaaaaagagattggcattgagaaaacgttagaagaagcggttgctcattatgcaaaactaacgaaagaaagtggacttgatggcgttgtttgctcaacacttgaagttccaaaattacgtgaagtatgcggaagtgaatttgtaacagtaacaccggggattcgtcttgcaagcgatgatgtaaatgaccaggtgcgcgtagcaacaccgaaacgtgcgagggaacttggctcaagctatatcgtagttggacgtagtattacaaaagcagaaaatccgcttgaagcgtataaaacagtaaaacaacagtgggaaggtgtaacagtatga

SEQ ID NO: 16895 - protein, 238 aa, Bacillus anthracis
MSQSLIVALDFPGKQDVEQFLRHFEGEELFVKVGMELFYKEGPAIITYLKEKGHKIFLDLKLHDIPNTVKSAMRSLASLDVDMVNVHAGGGSSMMKAAIEGLEEGKQEGKERPICIAVTQLTSTSETMMKKEIGIEKTLEEAVAHYAKLTKESGLDGVVCSTLEVPKLREVCGSEFVTVTPGIRLASDDVNDQVRVATPKRARELGSSYIVVGRSITKAENPLEAYKTVKQQWEGVTV

SEQ ID NO: 16896 - DNA, 735 bp, Bacillus caldolyticus
  CDS (1)..(735): transl_table=11
gtgcacacgccgttcattgtcgcgcttgatttcccatcaaaacaagaggtggagcggtttttgcggccgtttgccggaacgccgctgttcgtcaaagtcggcatggagctgtactatcaggaaggtccagccatcgtcgcgtttctcaaagaacaaggacatgccgtctttttagacttaaaactgcatgacatcccaaatacggtgaaacaggcgatgaaagggctcgcccgtgtcggcgccgatttggtgaacgtccacgccgccggcggccggcgcatgatggaagcggcgatcgaggggcttgacgccggcacgccaagcggaagaatgcggccgcgctgcatcgctgtcacccagctgacaagcacggacgagcgaatgcttcatgaggagctgtggatttcccgcccgcttgcggaaacagtcgcccattacgccgccttggcgaaagagagcggccttgacggcgtcgtctgttcagcgaacgaagcggcgttcatcaaagaacggtgcggcgcctcgttccttgccgtcaccccgggtatccgctttgctgatgatgcggcgcacgaccaagtgcgcgtcgtcaccccaaggaaagcgcgtgcgcttggttctgactacatcgtcgtcggccgcagcctcacccgcgccgccgatccgctcggggcgtatgcccgcctgcaacacgaatggaacggaggagagagagagtcaactacccccacttag

SEQ ID NO: 16897 - protein, 244 aa, Bacillus caldolyticus
MHTPFIVALDFPSKQEVERFLRPFAGTPLFVKVGMELYYQEGPAIVAFLKEQGHAVFLDLKLHDIPNTVKQAMKGLARVGADLVNVHAAGGRRMMEAAIEGLDAGTPSGRMRPRCIAVTQLTSTDERMLHEELWISRPLAETVAHYAALAKESGLDGVVCSANEAAFIKERCGASFLAVTPGIRFADDAAHDQVRVVTPRKARALGSDYIVVGRSLTRAADPLGAYARLQHEWNGGERESTTPT

SEQ ID NO: 16898 - DNA, 717 bp, Bacillus cereus
  CDS (1)..(717): transl_table=11
atgtcacagtcgttaatcgttgcactagattttccagggaaacaagaagtagaacaattcttacaccactttgaaggggaagagttatttgtcaaagtaggtatggagttattttacaaagaaggccctgcgattattacgtacttaaaagaaaagggacataagatcttcttagatttaaaacttcatgatattccgaatacagtaaaaagcgctatgcgtagcctagctagtctagatgttgatatggtaaatgttcatgctgctgggggaagcagcatgatgaaagctgcgattgagggattagaggaaggtaagcaagaaggaaaagagagaccgatttgtattgcagttacacaactaacaagcacttcggaagctatgatgaaaaaagagatcggcattgagaaaacgttagaagaagcggttgctcattatgcaaaattaacgaaagaaagtggacttgatggcgttgtttgttcaacacttgaagttccaaaattacgtgaagtatgcggaaatgaatttgtaacagtaacaccggggattcgtcttgcaagcgatgatgtaaatgaccaagtgcgcgtagcaacaccgaaacgtgcgagggaacttggctcaagctacatcgtagttggacgtagtattacaaaagcagaaaatccgcttgaagcgtataaaacagtaaaacaacagtgggaaggtgtaacagtatga

SEQ ID NO: 16899 - protein, 238 aa, Bacillus cereus
MSQSLIVALDFPGKQEVEQFLHHFEGEELFVKVGMELFYKEGPAIITYLKEKGHKIFLDLKLHDIPNTVKSAMRSLASLDVDMVNVHAAGGSSMMKAAIEGLEEGKQEGKERPICIAVTQLTSTSEAMMKKEIGIEKTLEEAVAHYAKLTKESGLDGVVCSTLEVPKLREVCGNEFVTVTPGIRLASDDVNDQVRVATPKRARELGSSYIVVGRSITKAENPLEAYKTVKQQWEGVTV

SEQ ID NO: 16900 - DNA, 705 bp, Bacillus halodurans
  CDS (1)..(705): transl_table=11
atgatacgaccattgatcattgccctagatgtagaaaaccgacagaacatgcaggaactgctcaagacacttccaaaacctctgttcgtaaaagtagggatggagttgttttacagtgaaggcccagctgtgattgagcaactaaaggatgaaggacatcaagtgtttctcgatttaaagctgcacgacattccgaacacggtaaagcgagcgatgcgacaactagccacactcggagttgacatcgtgaacgttcacgtagcaggaggagtaaacatgatggctgcggcacgggaaggactggaagctgggacagtggacggccgtaaccgtccgaagctcatcggtgtgacacagcttacaagtacaaatgaggctatgctacaaaaagagctgctcattcagtccaacatgaacggggcagtgtctcattatgctcggcttgcaaaggaggccggactggatggggttgtctcgtccgcccaagaggttcctattattcacgagcattgcggtccgtcttttttgaccgtcacaccagggattcgtttaaaagaggatgacaaaggggatcaaacgcgaattgttaccccggaagaagcgcggacattagggagctgggctatcgttgtcggtcgcagtatcacggcggctccagatcctgctgccgcctatgaaatcatacgcaagcaatgggagggttaa

SEQ ID NO: 16901 - protein, 234 aa, Bacillus halodurans
MIRPLIIALDVENRQNMQELLKTLPKPLFVKVGMELFYSEGPAVIEQLKDEGHQVFLDLKLHDIPNTVKRAMRQLATLGVDIVNVHVAGGVNMMAAAREGLEAGTVDGRNRPKLIGVTQLTSTNEAMLQKELLIQSNMNGAVSHYARLAKEAGLDGVVSSAQEVPIIHEHCGPSFLTVTPGIRLKEDDKGDQTRIVTPEEARTLGSWAIVVGRSITAAPDPAAAYEIIRKQWEG

SEQ ID NO: 16902 - DNA, 720 bp, Bacillus subtilis
  CDS (1)..(720): transl_table=11
atgaaaaacaacctgcccatcatcgcgcttgattttgcgtcagctgaagaaacacttgcgttcttagcgccttttcagcaagaaccgttatttgtaaaggttgggatggagcttttttatcaagaagggccatctatcgtgaaacaactaaaagaaagaaactgcgagctatttttagatctaaagcttcatgacatcccgactactgtaaacaaagcgatgaagcgccttgccagtcttggagtagacctcgtcaatgttcatgctgccgggggcaaaaaaatgatgcaggcagctctcgaaggcttagaagaaggtacgccggctggaaaaaaacgtccgtcacttatcgcggtaacccagctgacaagcacatctgaacaaatcatgaaagatgaactgctgatcgaaaagtctctgattgatacggttgtgcactacagcaaacaggcggaagaaagcggactggatggagtggtctgctctgttcatgaagcaaaagccatttaccaagcggtgtcgccttcatttctgactgtcactccggggatcagaatgtcagaggacgctgcgaatgaccaagttcgcgtagcgacgcctgccattgcaagagagaaaggttcatcagcgattgtagtaggacgctcgattacaaaagcggaagacccggtaaaagcctataaggctgtcagacttgaatgggagggaatcaaatcttga

SEQ ID NO: 16903 - protein, 239 aa, Bacillus subtilis
MKNNLPIIALDFASAEETLAFLAPFQQEPLFVKVGMELFYQEGPSIVKQLKERNCELFLDLKLHDIPTTVNKAMKRLASLGVDLVNVHAAGGKKMMQAALEGLEEGTPAGKKRPSLIAVTQLTSTSEQIMKDELLIEKSLIDTVVHYSKQAEESGLDGVVCSVHEAKAIYQAVSPSFLTVTPGIRMSEDAANDQVRVATPAIAREKGSSAIVVGRSITKAEDPVKAYKAVRLEWEGIKS

SEQ ID NO: 16904 - DNA, 711 bp, Bartonella bacilliformis
  CDS (1)..(711): transl_table=11
atgggagttgttgatgataacagcaatcgtgaacgccttattgttggattagatgttccgaatattaaacaagcagaaaaattggttacgcaattgggtgatgaggttagtttttataaaattggctatcagttagctttttctgggggaatggacttcgttcaagatcttattcaagcacgaaaaaaagtgttttttgatatgaaattgctcgatattgatcataccgttgcaagagctgtagaaaatattgccaaattaggtgtttcgatgctgactttgcatgcttatccaacagttatgaaagctgctgttgctgctgcaaaagggagtgatttatgtttgcttggggtgacggtgttaacatcaatggatgaagctgatttgcacaatgcgggttataaagatagcccaaaaaaattggcttttaaaagagctgagcaagcacgggaagccggcatgggtggaattgtttcttcagcgcttgaagccgcagctttacgaaaagtgatcggaagtgatatggctttggtcacaccggggattcgcccaatggggagtgataagggggatcaaaaacgggtgatggcaccaagacaagcgctagattctggtgctagccatcttgttgtcgcgcggccaattattcaagccgatgatcctttagtggcaacaaagaaaattttggcagaaatggctgatgggtgttaa

SEQ ID NO: 16905 - protein, 236 aa, Bartonella bacilliformis
MGVVDDNSNRERLIVGLDVPNIKQAEKLVTQLGDEVSFYKIGYQLAFSGGMDFVQDLIQARKKVFFDMKLLDIDHTVARAVENIAKLGVSMLTLHAYPTVMKAAVAAAKGSDLCLLGVTVLTSMDEADLHNAGYKDSPKKLAFKRAEQAREAGMGGIVSSALEAAALRKVIGSDMALVTPGIRPMGSDKGDQKRVMAPRQALDSGASHLVVARPIIQADDPLVATKKILAEMADGC

SEQ ID NO: 16906 - DNA, 714 bp, Bradyrhizobium japonicum
  CDS (1)..(714): transl_table=11
atgacgccagccgagatcgccccgaaggaccgcctgatcgttgcgctcgatctgccgagcgttgatgccgcggaggcgatgatcgcaaggctcggcgacagcgtcacgttctacaagatcggctatcgcctcgcctatgccggcggcttgccgctcgttgcgaggctcgcggacaagggcaagaaggtctttctcgatctcaagctgcacgacatcggcaacaccgtggcgcaaggcgtcgagagcatcaccaggctgggcgcgaccttcctcaccgtgcacgcttatccgcagaccatgaagggcgccgtcgaaggccgcggcggctcgaacctgaagatcctcgccgtcaccgtcctgacctcctacaacgaggacgatctgcacgcggcgggtttccggctcggcgtcgccgagctcgtcgaagcgcgcgcgcagcaggcgcaggtgcttggcatcgacgggctggtgtcgtcgcccgaggaggtgggcgccttgcgcaagatcgtcggccaccagatgagcctcgtcacgcccggcatccggccggcgggctcggcaagtggcgatcagaaacgcatcatgacgccgggccgcgcgatcaccgcgggcgccgattatctcgtcgtcgggcgcccggtggtggaagccgccgagcccaaggcgatcgcagacgccatccaggccgagatcgggcaggcgctgggagcatga

SEQ ID NO: 16907 - protein, 237 aa, Bradyrhizobium japonicum
MTPAEIAPKDRLIVALDLPSVDAAEAMIARLGDSVTFYKIGYRLAYAGGLPLVARLADKGKKVFLDLKLHDIGNTVAQGVESITRLGATFLTVHAYPQTMKGAVEGRGGSNLKILAVTVLTSYNEDDLHAAGFRLGVAELVEARAQQAQVLGIDGLVSSPEEVGALRKIVGHQMSLVTPGIRPAGSASGDQKRIMTPGRAITAGADYLVVGRPVVEAAEPKAIADAIQAEIGQALGA

SEQ ID NO: 16908 - DNA, 717 bp, Brucella melitensis
  CDS (1)..(717)
atgacgacagaattgcacgatgacgcatccgggcgcctgatcgtgggccttgacgtgccgacaattgccgaggcggaaaaggtggtcgaagaactgggcaatgctgtttccttctacaagatcggctatcagcttgtttttgccggtgggcttgatttcgccaaaagccttgtggcggcgcgcaaaaaagtcttcctcgacatgaagctgctcgatatcgacaacacgattgccaaaggcgtggaaaatgtcgcgaagatgggtgtttccatgctcacgcttcatgcctatccgaaggcaatgcgtgcggcggtggaagccgccagagggtcggacctatgccttttgggcgtgacggtcctgacctccatggacaatgccgatcttcgggaagccggttatttcgacaatgcggaaacgctggtgctgaaacgtgcccgtcaggcgcatgaggccggtatgggcggcattgtcgcctcggcggtggaggcgcaggccattcgccaggcggttggccccgatatggccatcgtcacaccgggcatccgcccggcagggagcgagaagggcgaccagaagcgcgtgatgacgccagccgatgccttgagggccggtgcgagccatctcatcgtggcgcgcccgatcgtgggcgcaccggatcgcaaggcggcagcccttgccatcctgaaggaaatgcgctcgattggaagaagttag

SEQ ID NO: 16909 - protein, 238 aa, Brucella melitensis
MTTELHDDASGRLIVGLDVPTIAEAEKVVEELGNAVSFYKIGYQLVFAGGLDFAKSLVAARKKVFLDMKLLDIDNTIAKGVENVAKMGVSMLTLHAYPKAMRAAVEAARGSDLCLLGVTVLTSMDNADLREAGYFDNAETLVLKRARQAHEAGMGGIVASAVEAQAIRQAVGPDMAIVTPGIRPAGSEKGDQKRVMTPADALRAGASHLIVARPIVGAPDRKAAALAILKEMRSIGRS

SEQ ID NO: 16910 - DNA, 717 bp, Brucella suis
  CDS (1)..(717)
atgacgacagaattgcacgatgacgcatccgggcgcctgatcgtgggccttgacgtgccgacaattgccgaggcggaaaaggtggtcgaagaactgggcaatgctgtttccttctacaagatcggctatcagcttgtttttgccggtgggcttgatttcgccaaaagccttgtggcggcgcgcaaaaaagtcttcctcgacatgaagctgctcgatatcgacaacacgattgccaaaggcgtggaaaatgtcgcgaagatgggtgtttccatgctcacgcttcatgcctatccgaaggcaatgcgtgcggcggtggaagccgccagagggtcggacctatgccttttgggcgtgacggtcctgacctccatggacaatgccgatcttcgggaagccggttattccgacaatgcggaaacgctggtgctgaaacgtgcccgtcaggcgcatgaggccggtatgggcggcattgtcgcctcggcggtggaggcgcaggccattcgccaggcggttggccccgatatggccatcgtcacaccgggcatccgcccggcagggagcgagaagggcgaccagaagcgcgtgatgacgccagccgatgccttgagggccggtgcgagccatctcgtcgtggcgcgcccgatcgtgggcgcaccggatcgcaaggcggcagcccttgccatcctgaaggaaatgcgctcgattggaagaagttag

SEQ ID NO: 16911 - protein, 238 aa, Brucella suis
MTTELHDDASGRLIVGLDVPTIAEAEKVVEELGNAVSFYKIGYQLVFAGGLDFAKSLVAARKKVFLDMKLLDIDNTIAKGVENVAKMGVSMLTLHAYPKAMRAAVEAARGSDLCLLGVTVLTSMDNADLREAGYSDNAETLVLKRARQAHEAGMGGIVASAVEAQAIRQAVGPDMAIVTPGIRPAGSEKGDQKRVMTPADALRAGASHLVVARPIVGAPDRKAAALAILKEMRSIGRS

SEQ ID NO: 16912 - DNA, 711 bp, Buchnera aphidicola subsp
  CDS (1)..(711): transl_table=11
gtgttgaatcctaatatttttcacatgccgaaaataatcattgcgttagatttctgtaataaaaagtccgctatgaaattagtaaatcttcttaatccatcaattttttatttaaaaattggaaaagaaatgtttacaattctaggttgcaaatttgtcaaagaattacaccaactaggatttaatatatttcttgatttaaaatttcatgatattccgaatactgtatttaacgctacaaaggcggcagctgatttagggatatggatgttaagtgttcatgcttctggtggtaaagaaatgctaatctcggcaaaaaaagcattaaaatcttttaaaaaagctcctttattgatagccgttacagcattaactagttttaaagaagaagcattaaaagaaattggaattaatatttcattaactgaatatattttaaaattatcaaaattatctaatgattgtggattagatggtattgtatgtccaggtaaagaagcaaagaaaatcaagtttttatttggaaataaatataaaattattacgccaggtattagaattgctaaagatttactatatgatcaaaataacattattactcctaaagaagcaaaagaatataaaatagattacatagtaataggacgttctattactatgtcaaaaaatccaattaaaaaattagatttaataataaaatcgatgcaataa

SEQ ID NO: 16913 - protein, 236 aa, Buchnera aphidicola subsp
MLNPNIFHMPKIIIALDFCNKKSAMKLVNLLNPSIFYLKIGKEMFTILGCKFVKELHQLGFNIFLDLKFHDIPNTVFNATKAAADLGIWMLSVHASGGKEMLISAKKALKSFKKAPLLIAVTALTSFKEEALKEIGINISLTEYILKLSKLSNDCGLDGIVCPGKEAKKIKFLFGNKYKIITPGIRIAKDLLYDQNNIITPKEAKEYKIDYIVIGRSITMSKNPIKKLDLIIKSMQ

SEQ ID NO: 16914 - DNA, 711 bp, Buchnera aphidicola subsp
  CDS (1)..(711): transl_table=11
gtgttatacactaacaattacaatattccaaaaattattattgctttagatttttacaataagaaagaagctatgacattagtagatcttcttgatccttctgttttttatttaaaaattggtaaggaaatgtttacaattttgggttttaaatttgtaaaagaactgcataagttaggctttaatgtatttcttgatttaaaatttcatgatattccaaatactgtatttaatgctacaaaagcagctgcagatttaggaatatggatgttaagtgttcatgcatctggtggtaaaaatatgcttctttcagcaaagaaagcgttaaaatcttttaaaaaacctcctttattaattgctgtcactatgttgactagtttaaaagaaaaagatttaaaagaaattggaattaaaatatcattaaaggactatattttaatattgtcaaagttatctaatgattgtggtttagatggaattgtctgtccaggaaaccaagcgaaaaaaataaaatcattatatggagataaatataaaattatcactccaggtattagattgtccagtgattcttcatttgatcaaaagcatattattactccaaaagaagcaaaagaatttcaaatagattacatagttataggacgttctattaccacttcaaaaaacccaattaaaaaattaaatcttataatagaatctatgcgataa

SEQ ID NO: 16915 - protein, 236 aa, Buchnera aphidicola subsp
MLYTNNYNIPKIIIALDFYNKKEAMTLVDLLDPSVFYLKIGKEMFTILGFKFVKELHKLGFNVFLDLKFHDIPNTVFNATKAAADLGIWMLSVHASGGKNMLLSAKKALKSFKKPPLLIAVTMLTSLKEKDLKEIGIKISLKDYILILSKLSNDCGLDGIVCPGNQAKKIKSLYGDKYKIITPGIRLSSDSSFDQKHIITPKEAKEFQIDYIVIGRSITTSKNPIKKLNLIIESMR

SEQ ID NO: 16916 - DNA, 711 bp, Buchnera aphidicola subsp
  CDS (1)..(711): transl_table=11
atgcacttaaaatctaattttaaaaatattaatatcattattgcgttagatttttttgatgaaaataaagctatgaaatttatttataatttaaatcctactatttatgcattaaaaataggtaatataatgtttactttatttggagttcgttttataaaaatattacaaaaattgggatttaaaatatttcttgatttaaaattttatgacatcccaaatacaatatttggggctatacaagcagttgctaatttaaatatatggatggttagtattcatatttctggaggaatacaaatgttaaaatcagctagattagcactaaaaccgtttaaaaataaaccgttgctgatgggagtaactattttgactagtttagataaaactgatatgtctaagttaggaattcagatatcattatcaaaatacatattgtctttagcaaaaatagcacataaatgtaatttagatggaattatttgctctggaacagaaatatcgaatataaaaaaacatattaatgtcaaaaactttaaaatattaactccaggaattagattaaatggatgttcttctaatgaccaaaaaaatgttacaactccaatgttagcaaaacaatataatgtcgactatattataattggaagaattgtcacatcttctcaaaatcctttaaaaacactagaattaatcagatcacaaatataa

SEQ ID NO: 16917 - protein, 236 aa, Buchnera aphidicola subsp
MHLKSNFKNINIIIALDFFDENKAMKFIYNLNPTIYALKIGNIMFTLFGVRFIKILQKLGFKIFLDLKFYDIPNTIFGAIQAVANLNIWMVSIHISGGIQMLKSARLALKPFKNKPLLMGVTILTSLDKTDMSKLGIQISLSKYILSLAKIAHKCNLDGIICSGTEISNIKKHINVKNFKILTPGIRLNGCSSNDQKNVTTPMLAKQYNVDYIIIGRIVTSSQNPLKTLELIRSQI

SEQ ID NO: 16918 - DNA, 840 bp, Campylobacter jejuni
  CDS (1)..(840): transl_table=11
atgaagctttgtgtcgcacttgatctttctacaaaagaagaatgcttacaacttgccaaagaattaaaaaatttagacatatggttaaaagtaggtttaagagcatatttaagagatggttttaaattcatagaagaacttaaaaaagttgatgattttaaaatatttcttgatcttaaatttcatgatattcccaacactatggcagatgcttgcgaagaagtatcaaaacttggtgttgatatgatcaatatccacgcaagtgctggaaaaatagccatacaagaagttatgacacggcttagcaaattttcaaaaagacctttagttttagcagtttctgctcttacgagttttgatgaagaaaatttctttagtatttatagacaaaaaattgaagaagctgtaattaatttttcaaaaatatcctatgaaaatggacttgatggtatggtatgctctgtttttgaaagcaaaaaaattaaagagcacacaagttcaaatttcttaacccttactcctggaattcgtccttttggagaaacaaatgatgatcaaaaacgtgttgctaatcttgcaatggctagagaaaatttgagtgattatatcgttgtgggaaggcctatatataaaaatgaaaatcctagggctgtatgtgaaaaaattttaaacaaaatacacagaaaaaatataagcgaaaacgatatagagcaaaattatgaagtaattcagcaaaaagaatgggatatgtgtaatcactttgaagaatggattaaaactcggcctgataaagaacatgctttaaaagaattttatgctaagtgtgggataaaatattga

SEQ ID NO: 16919 - protein, 279 aa, Campylobacter jejuni
MKLCVALDLSTKEECLQLAKELKNLDIWLKVGLRAYLRDGFKFIEELKKVDDFKIFLDLKFHDIPNTMADACEEVSKLGVDMINIHASAGKIAIQEVMTRLSKFSKRPLVLAVSALTSFDEENFFSIYRQKIEEAVINFSKISYENGLDGMVCSVFESKKIKEHTSSNFLTLTPGIRPFGETNDDQKRVANLAMARENLSDYIVVGRPIYKNENPRAVCEKILNKIHRKNISENDIEQNYEVIQQKEWDMCNHFEEWIKTRPDKEHALKEFYAKCGIKY

SEQ ID NO: 16920 - DNA, 801 bp, Candida maltosa
  CDS (1)..(801)
atggtatccaccaaaacatacaccacaagagcatcgactcatccatcaccagtcgcacaacgtcttttccacttaatggacaccaaaaaggccaatctctgtgcatcagtcgacgttcaaaccacatccgaattcctttccttaatcgacaaactcggtccatatatctgtttagtcaagacccacatcgacataatcgacgacttttcatatgaaggcactattgttccattattggaattggcacggaaacataactttatgattttcgaagatcgtaagtttgcagatatcggaaacacagtcaagcatcagtacacttccggggtgtacaagatcagttcctggagtgacatcaccaatgcgcatggtgtcactggtgctggtgttgttgatggtttgaaacagggtgcgttggaaactacgaaagaaccaaggggtttgttgatgttggcggagttgtcttcgaaaggatcattggcgtatggggagtatactgagaagacggttgagattgctaagctggataaggagttcgtgattgggtttattgctcaacgtgatatgggtggccatgatgaagggtttgattggattgttatgactccaggggttggtttggacgataagggtgatggtttgggtcaacagtatagaacagttgatgaggttgtgagtaccggtactgatgtgattattgttggaagaggattgtttggtaaaggaagagatccagaagttgaaggtaagagatatagagatgctggttggaatgcttatttgaaaagaaccggacaataa

SEQ ID NO: 16921 - protein, 266 aa, Candida maltosa
MVSTKTYTTRASTHPSPVAQRLFHLMDTKKANLCASVDVQTTSEFLSLIDKLGPYICLVKTHIDIIDDFSYEGTIVPLLELARKHNFMIFEDRKFADIGNTVKHQYTSGVYKISSWSDITNAHGVTGAGVVDGLKQGALETTKEPRGLLMLAELSSKGSLAYGEYTEKTVEIAKLDKEFVIGFIAQRDMGGHDEGFDWIVMTPGVGLDDKGDGLGQQYRTVDEVVSTGTDVIIVGRGLFGKGRDPEVEGKRYRDAGWNAYLKRTGQ

SEQ ID NO: 16922 - DNA, 702 bp, Caulobacter crescentus
  CDS (1)..(702): transl_table=11
atgaccgccgacccgcgcctgatcgtgccgctggacctgcccaccgtcgacgacgcccgcgccatggtcgagcgcctgggcgacgcggtcagcttctacaagatcggcctggagctgctggccagcgacggcatgggcctggctcacgacctgaaggcctcgggcaagtcgatctttctcgactggaagctccacgacatcggcgccacggtcgagcgctcggcccgggtcttggcgaccagcggctgcgacctcctgaccgtccacgccgaaccgcaggtgatgcaggcggcggtcaaggcgcgcggcgactcgtcgctgaagatcctggccgtgaccgtgctgaccagcctgaccgacgctgacctcgtggagatgggctacgccttcaccgcccgcgatctggtcgaacgccgcgtgcgccaggccctggcctgcggcgtcgacggcatcgtctcctcgccccacgaagcggccctggcccgcgagatcgccaacgacgcgggccagcccgagttcctgatcgtaacccccggcgtgcgccccgaatggtcggccaagaacgaccaggcccgcgccgccacgcccgccgacgccctgcgcgccggcgccacccacctggtctgcggccgcccgatcaccgcggccaacgacccgcgcgaggcggcgctcaaggtggtgacggagatggcggggatttag

SEQ ID NO: 16923 - protein, 233 aa, Caulobacter crescentus
MTADPRLIVPLDLPTVDDARAMVERLGDAVSFYKIGLELLASDGMGLAHDLKASGKSIFLDWKLHDIGATVERSARVLATSGCDLLTVHAEPQVMQAAVKARGDSSLKILAVTVLTSLTDADLVEMGYAFTARDLVERRVRQALACGVDGIVSSPHEAALAREIANDAGQPEFLIVTPGVRPEWSAKNDQARAATPADALRAGATHLVCGRPITAANDPREAALKVVTEMAGI

SEQ ID NO: 16924 - DNA, 744 bp, Chromobacterium violaceum
  CDS (1)..(744): transl_table=11
atgaatcctctgatcgcacagggcgaaagccggacgacgtccccggtggtggtggcgctggatttcgccgacgcggacggcgcgctcgccttcgccagccgcctggatccggcggaatgccggctgaaggtcggcaaggagctgttcacctccagcggccgccacttggtcgaatcgctggccgcgcgcggcttccaggttttcctggacatgaaattccacgacatccccaataccgtggcccaggcctgcaaggccgcggccgagtccggcgtgtggatggtcaacgtccacgcctccggcggccgccggatgatggaggccgcgcgcgaggcgctggccggctacagccagcgcccgctgctgatcgcggtgacggtgttgaccagcatggaggcgtcggacctggccgaggtcggcatcgccgccacgccgcaggagcacgtgctgcgcctggccacgctgacccgcgattgcggcctggacggcgtggtgtgctcggcgcaggaggccgcgatgctgaagctggcgctgggccgcgatttcaagctggtgacgccgggcatccgtctcgccgacagcgccggcgacgaccagcgccgcgtgatgacgccgaccgccgccttggccgccggctcggactatctggtgatcggccggccgatcacccgcgccgcggacccgttggccgcgctgcgcgccatcaatcaagacatttccgtattcctgggtaaacaatcatga

SEQ ID NO: 16925 - protein, 247 aa, Chromobacterium violaceum
MNPLIAQGESRTTSPVVVALDFADADGALAFASRLDPAECRLKVGKELFTSSGRHLVESLAARGFQVFLDMKFHDIPNTVAQACKAAAESGVWMVNVHASGGRRMMEAAREALAGYSQRPLLIAVTVLTSMEASDLAEVGIAATPQEHVLRLATLTRDCGLDGVVCSAQEAAMLKLALGRDFKLVTPGIRLADSAGDDQRRVMTPTAALAAGSDYLVIGRPITRAADPLAALRAINQDISVFLGKQS

SEQ ID NO: 16926 - DNA, 837 bp, Cladosporium fulvum
  CDS (1)..(837)
atgtcgtccaagtcgcaattgccctttagcacccgtgcctctaaccaccccaacccgctggctcggaagctgttcgaggtcgctgaagccaaaaagagcaatgtgacagtttccgccgatgtcaccaccaccaaggagctcctggacctggccgaccgtctcggaccctacattgccgtgatcaaaacacacatcgatatcttgtccgacttcggacccgagaccatcaatggcctgaacgcgctggccgagaagcacaactttctcatctttgaggaccgcaagttcatcgacatcggtaacaccgtccagaagcagtaccacggcggtgccctcaagatctccgagtgggcccacattatcaactgcgccgttctgccagccgagggcatcgtccaggctctggccgaaactgcacaggccgaggacttcccccatggttctgagcgcggtcttctgattctcgctgagatgacctccaagggctccttggctaccggagagtacacctctgcctcggttgactacgcgcggaaataccccagcttcgtgcttggcttcgtctcgacccgtgcgctgaccgaggtctcttcgaccgtcaccgctgccgacaacgaggacttcgtcgtcttcaccaccggtgtcaacctttcttctaagggcgacaagctcggacagcagtaccagaccccgcagtcggctattggccgcggtgccgactttatcatcgcgggacgtggaatctatactgctccagaccccgtcgaggcagccaagcaataccagcagcagggatgggaagcctatctggctcgtgttggcggtgccagccaataa

SEQ ID NO: 16927 - protein, 278 aa, Cladosporium fulvum
MSSKSQLPFSTRASNHPNPLARKLFEVAEAKKSNVTVSADVTTTKELLDLADRLGPYIAVIKTHIDILSDFGPETINGLNALAEKHNFLIFEDRKFIDIGNTVQKQYHGGALKISEWAHIINCAVLPAEGIVQALAETAQAEDFPHGSERGLLILAEMTSKGSLATGEYTSASVDYARKYPSFVLGFVSTRALTEVSSTVTAADNEDFVVFTTGVNLSSKGDKLGQQYQTPQSAIGRGADFIIAGRGIYTAPDPVEAAKQYQQQGWEAYLARVGGASQ

SEQ ID NO: 16928 - DNA, 711 bp, Coxiella burnetii
  CDS (1)..(711)
atggaaaaaccagacccaaaagttattgtggccatcgatgctgggacggtggagcaagcccgagcacaaataaacccattaacccctgaattatgtcaccttaaaatcggcagtattctatttacacgttacgggccggcatttgtcgaggaattaatgcagaaagggtatcgcatttttctcgatttgaaattttatgatattccacaaacggtggcaggcgcttgccgagcggtcgcagagcttggcgtgtggatgatgaatattcatatatccggtggacgcacgatgatggaaacggtcgtgaatgcgttgcaatcaattactttaaaggaaaaacctttattaatcggggtcactattttaacaagcctagacggtagtgatttaaaaacattagggatacaagagaaggttcctgatatcgtttgtcgtatggcaacccttgccaaaagcgctgggttggatggggtggtttgttcagctcaagaggcggcattgctgcgtaaacaattcgatagaaattttttgttagttactcctggcatccgtttagaaaccgatgaaaaaggtgatcaaaaacgtgtaatgactccacgagcggctatccaagctggcagtgattatttagtaattggcaggcccatcacgcaatccacagatcctttaaaggcattagaggctattgataaagatattaagacccgttga

SEQ ID NO: 16929 - protein, 236 aa, Coxiella burnetii
MEKPDPKVIVAIDAGTVEQARAQINPLTPELCHLKIGSILFTRYGPAFVEELMQKGYRIFLDLKFYDIPQTVAGACRAVAELGVWMMNIHISGGRTMMETVVNALQSITLKEKPLLIGVTILTSLDGSDLKTLGIQEKVPDIVCRMATLAKSAGLDGVVCSAQEAALLRKQFDRNFLLVTPGIRLETDEKGDQKRVMTPRAAIQAGSDYLVIGRPITQSTDPLKALEAIDKDIKTR

SEQ ID NO: 16930 - DNA, 738 bp, Escherichia coli O6
  CDS (1)..(738)
atgacgttaactgcttcatcttcttcccgcgctgttacgaattctcctgtagttgttgcccttgattatcataatcgcgatgccgcgatggcctttgtcgacaagatcgacccacgcgattgtcgtctgaaggtcggcaaagagatgtttacattgtttgggccacagtttgtgagcgaacttcaacagcgtggttttgatatctttcttgacctgaaattccacgatattcccaacactgcagcacacgctgtcgctgctgcggctgacttaggcgtgtggatggtgaatgttcatgcctccggtggggcgcgtatgatggccgcagcgcgtgaggcactggttccgtttggcaaagatgcaccgcttttgattgctgtgacagtgttgaccagcatggaagccagcgacctggccgatcttggcgtgacactgtcacctgcagattatgcagaacgtctggcggcactgacgcaaaaatgtggccttgatggtgtggtgtgttctgctcaggaagctgtgcgctttaaacaggtattcggtcaggagttcaaactggttacgccgggcattcgtccgcaggggagtgatgctggtgaccagcgccgcattatgacgccagaacaggcgttgtcggctggtgttgattatatggtgattggtcgcccggtaacgcaatcggtagatccagcgcagacgctgaaagcgatcaacgcctctttacagcggagtgcatga

SEQ ID NO: 16931 - protein, 245 aa, Escherichia coli O6
MTLTASSSSRAVTNSPVVVALDYHNRDAAMAFVDKIDPRDCRLKVGKEMFTLFGPQFVSELQQRGFDIFLDLKFHDIPNTAAHAVAAAADLGVWMVNVHASGGARMMAAAREALVPFGKDAPLLIAVTVLTSMEASDLADLGVTLSPADYAERLAALTQKCGLDGVVCSAQEAVRFKQVFGQEFKLVTPGIRPQGSDAGDQRRIMTPEQALSAGVDYMVIGRPVTQSVDPAQTLKAINASLQRSA

SEQ ID NO: 16932 - DNA, 714 bp, Enterococcus faecalis
  CDS (1)..(714): transl_table=11
atgcacgatagaccaattattgcgttagattttcccacgcaaaaagaagtggctgtttttttagaaaaatttcctaaggaagaagccttgtttgttaaagtggggatggaacttttttacgcagaaggaccagcgattgttcgctggcttaaagaacaaggacacgatgttttcttggatttaaaattacatgatattccgaatactgtggaaaaagcgatgacaaatttagcaaaattaggcgttgccattactaatgtccatgcagcagggggcgttcgaatgatgcaagcagctaaggaaggtctaatcaaagggactcagccaggcgctaaggttcctgagttaattgctgtaacccagttgacttctactagtgaagaagagatgcaccatgatcaattaatcaacgttcctttagagacaagtgtcattcattatgctaaatgtgcggaaaaagcgggtctggatggtgtggtttgttcagcattagaagcacgtggtattcaagaagcaaccaagcagacgtttatttgcttaacacctggtattcgtccagcaggaagtgcagtaggtgaccaacaacgggtcgttacgccgcaacatgctcgcgaaattgggtccacatatatcgttgttggccgacctattacccaagcagaaaatccttatgaagcctatcaagaaatcaaaaaagactggagcgaaaagtaa

SEQ ID NO: 16933 - protein, 237 aa, Enterococcus faecalis
MHDRPIIALDFPTQKEVAVFLEKFPKEEALFVKVGMELFYAEGPAIVRWLKEQGHDVFLDLKLHDIPNTVEKAMTNLAKLGVAITNVHAAGGVRMMQAAKEGLIKGTQPGAKVPELIAVTQLTSTSEEEMHHDQLINVPLETSVIHYAKCAEKAGLDGVVCSALEARGIQEATKQTFICLTPGIRPAGSAVGDQQRVVTPQHAREIGSTYIVVGRPITQAENPYEAYQEIKKDWSEK

SEQ ID NO: 16934 - DNA, 714 bp, Fusobacterium nucleatum subsp
  CDS (1)..(714): transl_table=11
atgaaaaaagaagttataatagcacttgattttccaacattagaaaaaactttagaatttttagataaattcaaagaagaaaaattatttgtaaaagttggaatggaattatatttacaaaatggaccaatagtaatagatgaaatcaaaaaaagaggacataaaattttcttagatttaaaattacatgatattccaaatactgtttactctgctgtgaaagggttagctaaatttaatatagatattttaactgtccatgcagctggtggttctgaaatgctaaaaggagctaaaagagctatgacagaagcaggagtaaatacaaaggttattgctataactcaacttacttctacaagtgaagaagatatgagaaaagaacaaaacattcaaacaagcatagaagaatctgttttaaactatgctagacttgcaaaagaaagtggagttgatggagtggtttcttctgttcttgaaacaaagaaaattagagaacaaagtggagaagagtttattataataaacccaggaataagattagcagaagattcaaaaggtgaccaaaaaagagtagctactccaatagatgctaatagagatggagctagttatattgtcgttggtagatcaataactggaaatgaaaatccagaagaaagatatagacttataaaaaatatgtttgaaatgggggataaatatgttgaatag

SEQ ID NO: 16935 - protein, 237 aa, Fusobacterium nucleatum subsp
MKKEVIIALDFPTLEKTLEFLDKFKEEKLFVKVGMELYLQNGPIVIDEIKKRGHKIFLDLKLHDIPNTVYSAVKGLAKFNIDILTVHAAGGSEMLKGAKRAMTEAGVNTKVIAITQLTSTSEEDMRKEQNIQTSIEESVLNYARLAKESGVDGVVSSVLETKKIREQSGEEFIIINPGIRLAEDSKGDQKRVATPIDANRDGASYIVVGRSITGNENPEERYRLIKNMFEMGDKYVE

SEQ ID NO: 16936 - DNA, 714 bp, Gloeobacter violaceus
  CDS (1)..(714): transl_table=11
atgggtggtgccgaacgggtgatcgtggccctcgatctcgcggacgcccaggcggcccgcgccctggtggagcgcgccccggccgtgcgcttctggaaagtcggactggaactattcaccgccgccggtccgggcctgatcgaatggctcaaagcgcgcgggtgccgggtgtttctcgatctcaaatttcacgatattcccaacacggtggccggggcctgccgggcggccacccgcctgggggtggacctgctcaccgtgcatgcgacggggggacaaccgatgctgatggcggcggtctccgcctgcacaggcgaagcggcccgcctcgggagccccgccccggcggtgctggcggtgaccctgctcaccagcctggacgcgcagctgctcgaacagcagctcttggtcaatgtcggggtaagcggctatgtggagcacctcgcggtcctggccgtgtcaagcggtgtgcagggggtggtctgctcgcctctggagacggccctgctgcgcgagcgctgcggaaacgattttctgatcgtcaccccgggcattcgcccgggtgggagcggcgaaggcgaccagcgccgcaccctaacccccggcgaagcgtttgcccggggcgccgactacctggtggtgggccgcccggtgacgaccgcccccgatccccaggtcgcattcaaggccatcgtcgcggaggtcggcggatga

SEQ ID NO: 16937 - protein, 237 aa, Gloeobacter violaceus
MGGAERVIVALDLADAQAARALVERAPAVRFWKVGLELFTAAGPGLIEWLKARGCRVFLDLKFHDIPNTVAGACRAATRLGVDLLTVHATGGQPMLMAAVSACTGEAARLGSPAPAVLAVTLLTSLDAQLLEQQLLVNVGVSGYVEHLAVLAVSSGVQGVVCSPLETALLRERCGNDFLIVTPGIRPGGSGEGDQRRTLTPGEAFARGADYLVVGRPVTTAPDPQVAFKAIVAEVGG

SEQ ID NO: 16938 - DNA, 693 bp, Haemophilus ducreyi
  CDS (1)..(693): transl_table=11
atggacaataaaattattgttgccttagattatgaaactgaaaatgaagcattgaattttatagatcaggttgatccgtcactttgtcgcttgaaagtgggtaaagaaatgtttacaacgttaggtgctcactttgttaaacagcttcacgacagaaaatttgatgtttttcttgatttaaaatatcacgatattccaaatactgtggcaagggctgtgcgttcagccgctgatttaggggtatggatggttgatttacatgcgtcaggtggattaacaatgatggaggaagcaaaaaaaattcttgagccttatggtaaggatgcgcctttattaattgcggtgacggtattaacaagtatggaagatttagatttgttacaaattggtattaatgcttctccgatggaacaggtgattcggttatcccaccttgcaaaacgtgcgggactagatggtgtagtctgttctccacaagaggtagaagtgttaagaacgcattgtggtgatgattttaaacttgtgacaccgggtattcgtccagccggttcagattttggtgatcaacgtcgtgtaatgacacccaaacaggctattcaaacgggggctgattttttagttattggtcgtcctattactcaagcacaagaacctttatccattttaaaagccattaatgcttcaattgcataa

SEQ ID NO: 16939 - protein, 230 aa, Haemophilus ducreyi
MDNKIIVALDYETENEALNFIDQVDPSLCRLKVGKEMFTTLGAHFVKQLHDRKFDVFLDLKYHDIPNTVARAVRSAADLGVWMVDLHASGGLTMMEEAKKILEPYGKDAPLLIAVTVLTSMEDLDLLQIGINASPMEQVIRLSHLAKRAGLDGVVCSPQEVEVLRTHCGDDFKLVTPGIRPAGSDFGDQRRVMTPKQAIQTGADFLVIGRPITQAQEPLSILKAINASIA

SEQ ID NO: 16940 - DNA, 693 bp, Haemophilus influenzae
  CDS (1)..(693): transl_table=11
atgacaagtaaaattattgtggcattggatttcgagaaagaagcagaggctcttgctttagttgatcaaattgatccaagtttgtgtcgattaaaagtgggtaaagaaatgtttactacacttggtattaattttgtaaaacaattacatcaacgtaattttgatgtttttttggatctgaaatatcacgatattccaaatacggtagcaagagcagttcgttctgctgctgatttaggcgtatggatggtggatttacacgcaagtggtggcttgcgtatgatggaagacgcaaagaaaattcttgaaccttatgggaaagatgcgccattgcttattgctgtgacggtattaaccagtatggaagacttggatttattacaaattgggattaatgcatcgccaatggaacaagttttacgcttagctcatttaacccaacgggcaggtttggatggtgtggtttgctctccgcaagaagttgaaattttacgtaatgcttgtggagaagactttaaattagtgaccccagggattcgtccaataggaactgattttggcgatcaacgacgtgtaatgacacctaccgcagcaattcgtgctggttcagattatttagttattggacgcccaataactcaagcggataatcctgcggaggttctccgttctattaatgtatctattgggtaa

SEQ ID NO: 16941 - protein, 230 aa, Haemophilus influenzae
MTSKIIVALDFEKEAEALALVDQIDPSLCRLKVGKEMFTTLGINFVKQLHQRNFDVFLDLKYHDIPNTVARAVRSAADLGVWMVDLHASGGLRMMEDAKKILEPYGKDAPLLIAVTVLTSMEDLDLLQIGINASPMEQVLRLAHLTQRAGLDGVVCSPQEVEILRNACGEDFKLVTPGIRPIGTDFGDQRRVMTPTAAIRAGSDYLVIGRPITQADNPAEVLRSINVSIG

SEQ ID NO: 16942 - DNA, 684 bp, Helicobacter pylori J99
  CDS (1)..(684): transl_table=11
atgcaattatgtgtcgcattagatttagaaaaaaaagaggacaatctttctttattgcaagaattaaagggcttagatttatgggctaaagtggggcttagatcttttataagagacggggcgacttttttagatgaaatcagaaagattgatgggaattttaagatttttttggatttgaagctctatgatattccttataccatggcaaatgccgcgctagaatgcgcgaaattagacattgacatgctcaccgtgcatttaagcagcgctaaaagcgcgctaaccattttaatgcaacgcctgaacgctcttaaaaaacgccccttaatcatgggcgtgagcgctttaacgagctttagcgaagaggaatttttgatggtgtataacgcccctttaaaaactcaagcaatcacattaagcgctataggcaaagagagcgggattgatggggtggtgtgttcggtgtttgaaagtttagcgattaaagaggctttaggtaagggctttttgactttaacccctggcataaggctggataaaaacgataaagaagatcaagaaagggtggcgaacgctaaagaagccaaacaaaatttaagcgattttatcgtggtaggccgccccatttatcaagctaaagagcctagagaagtggttttagagcttttaaaggattgttaa

SEQ ID NO: 16943 - protein, 227 aa, Helicobacter pylori J99
MQLCVALDLEKKEDNLSLLQELKGLDLWAKVGLRSFIRDGATFLDEIRKIDGNFKIFLDLKLYDIPYTMANAALECAKLDIDMLTVHLSSAKSALTILMQRLNALKKRPLIMGVSALTSFSEEEFLMVYNAPLKTQAITLSAIGKESGIDGVVCSVFESLAIKEALGKGFLTLTPGIRLDKNDKEDQERVANAKEAKQNLSDFIVVGRPIYQAKEPREVVLELLKDC

SEQ ID NO: 16944 - DNA, 684 bp, Helicobacter pylori
  CDS (1)..(684): transl_table=11
atgcaattatgtgtcgcattggatttagaaaaaaaagaggacaatctttctttattgcaagaattgaagggcttagatttatgggctaaggtggggcttagatcttttataagagacggggctgtttttttagatgaaatcagaaagattgatgaaaattttaagatttttttggatttgaagctctatgatattccttataccatggcaaatgccgcactagaatgcgcgaaattagacattgacatgctcaccgtgcatttaagcagcgctaaaagcgcgctaacagctttaatgcaacgcctgaacgctcttaaaaaacgccccttgattatgggcgtgagcgctttaaccagctttagcgaagaggaatttttgatggtgtataacgcccctttaaaaactcaagcgattaaattgagtgctatgggtaaagagagcgggattgatggggtggtgtgttcggtgtttgaaagtttagcgattaaagaggctttaggtaaggactttttgactttaacccctggcataaggctggatcaaaatgataaagaggatcaagaaagggtggcgaacgctaaagaagccaaacaaaatttaagcgattttatcgtggtgggccgccccatttatcaagctaaagagcctagagaagtggttttagagcttttaaaggattgttaa

SEQ ID NO: 16945 - protein, 227 aa, Helicobacter pylori
MQLCVALDLEKKEDNLSLLQELKGLDLWAKVGLRSFIRDGAVFLDEIRKIDENFKIFLDLKLYDIPYTMANAALECAKLDIDMLTVHLSSAKSALTALMQRLNALKKRPLIMGVSALTSFSEEEFLMVYNAPLKTQAIKLSAMGKESGIDGVVCSVFESLAIKEALGKDFLTLTPGIRLDQNDKEDQERVANAKEAKQNLSDFIVVGRPIYQAKEPREVVLELLKDC

SEQ ID NO: 16946 - DNA, 714 bp, Lactococcus lactis subsp
  CDS (1)..(714): transl_table=11
atgcaagaaaatagacctgtcattgcccttgatttccctgaattctcagacgtaaaagattttctcgaaaaatttgatccgtcagaacaattgtatattaaactaggaatggaacttttttacacggctggaccccaagtcgtttactatgtaaaatcgctcggccacagtgtattccttgatttaaaactccatgatattccaaacaccgttgaatcctcaatgcatgttttagcacgtttgggagtggatatggttaatgttcacgccgctggtggtgttgaaatgatggtcgcggctaaacgcggtttagaggctggaacgccagttggacggcaaaggccaaaattaattgctgtcacacaattaacctcaacttctgaggaaattatgcaaaatgaccaaaaaattatgactagtcttgaagaatcggttattaattacgcacaaaaaaccgctcaagcaggacttgacggtgtcgtttgttcggcacatgaagttgaaaaaattaaagcagcgacatcgaaagaattcatttgtctcacaccgggaattcgcccagaaggtgcaagtaaaggcgaccaaaaacgagtaatgacacctaaagaagcaagaacaattggttcagattatattgttgtcggccgtccaattacccaagcaaaagatccagtagctagctatcatgcgataaaagcagaatggaatcgataa

SEQ ID NO: 16947 - protein, 237 aa, Lactococcus lactis subsp
MQENRPVIALDFPEFSDVKDFLEKFDPSEQLYIKLGMELFYTAGPQVVYYVKSLGHSVFLDLKLHDIPNTVESSMHVLARLGVDMVNVHAAGGVEMMVAAKRGLEAGTPVGRQRPKLIAVTQLTSTSEEIMQNDQKIMTSLEESVINYAQKTAQAGLDGVVCSAHEVEKIKAATSKEFICLTPGIRPEGASKGDQKRVMTPKEARTIGSDYIVVGRPITQAKDPVASYHAIKAEWNR

SEQ ID NO: 16948 - DNA, 714 bp, Lactococcus lactis subsp
  CDS (1)..(714): transl_table=11
atgcaagaaaatagacctgttattgccctagatttcccagaattctcagatgtgaaagatttccttgaaaaatttgacccatctgaaaaactctacatcaaacttggtatggaacttttttataccgccggcccacaagtagtatattatgtgaaatcgctcggtcatagcgttttccttgatttaaaacttcatgatattccaaatacagttgaatcatccatgcgtgttttagcccgtttgggagttgatatggtcaatgttcacgctgctggcggggttgagatgatggttgcagctaaacgcggtttagaagcagggactccaattggacgtcaaagaccaaaactaattgccgttacgcaattaacctcgacttctgaggaaattatgcaaaatgaccaaaaaattatgaccagtcttgaagaatctgttattaattacgcacaaaaaacagcccaagccggacttgatggtgtcgtttgctccgctcatgaagttgaaaaaattaaagcggcaacatcaaaagaattcatttgtttaacaccgggaattcgtccagaaggagcaagtaaaggcgaccaaaaacgagtaatgacaccaaaagaagcaagaacaattggttcagattacattgttgttggtcgaccaattacacaagcaaaagaccctgtttcagcttatcatgcgataaaggaagaatggaatcaataa

SEQ ID NO: 16949 - protein, 237 aa, Lactococcus lactis subsp
MQENRPVIALDFPEFSDVKDFLEKFDPSEKLYIKLGMELFYTAGPQVVYYVKSLGHSVFLDLKLHDIPNTVESSMRVLARLGVDMVNVHAAGGVEMMVAAKRGLEAGTPIGRQRPKLIAVTQLTSTSEEIMQNDQKIMTSLEESVINYAQKTAQAGLDGVVCSAHEVEKIKAATSKEFICLTPGIRPEGASKGDQKRVMTPKEARTIGSDYIVVGRPITQAKDPVSAYHAIKEEWNQ

SEQ ID NO: 16950 - DNA, 714 bp, Lactobacillus plantarum
  CDS (1)..(714): transl_table=11
atgaagcgaccaattatcattgcgttagattttcccaccgccgaacgggccttagcttttttagaccaatttccggctgatttacatgtcactgtcaaaatcggcatggagttattttatgcagcgggaccgagtattgtgacggacgtgcaagctcgcggccatgcggttttcttagatttgaaactacatgatattcccaataccgtcgaatccgcaatgcgggtgatcgggcggttaggggtaacctatacaacggttcatgctgcgggtgggcacgtgatgctttcagccgccaaacgaggattggtcgcgggtgcaatggccgctggagtcactgcccccaagttattagcgattacgcagttaacttcgactaatcaagctattttgaatcaggaccagcaaatcatgggaacggttcgggcgagtgtcgtgcattatgccaaactagcacgggcgagtgactgtgatggcgtcatttgttccgcccaagaagttcaggcgattcatacggccgtcggtgctgattttctcggaattacgccgggaattcggccagcgtcggcgcagtcagatgaccagcaacgggtgatgacaccggctgccgctgctaaggctgggagcaacggtctcgtcatcgggcggccaattacgcaggctgcagaaccagttcaagcttaccgagatattatgacagaatggagtaactaa

SEQ ID NO: 16951 - protein, 237 aa, Lactobacillus plantarum
MKRPIIIALDFPTAERALAFLDQFPADLHVTVKIGMELFYAAGPSIVTDVQARGHAVFLDLKLHDIPNTVESAMRVIGRLGVTYTTVHAAGGHVMLSAAKRGLVAGAMAAGVTAPKLLAITQLTSTNQAILNQDQQIMGTVRASVVHYAKLARASDCDGVICSAQEVQAIHTAVGADFLGITPGIRPASAQSDDQQRVMTPAAAAKAGSNGLVIGRPITQAAEPVQAYRDIMTEWSN

SEQ ID NO: 16952 - DNA, 702 bp, Listeria innocua
  CDS (1)..(702): transl_table=11
atgaataaaccaattatcgcgctagattttcaaacttaccaagaagtagaggcttttttagcccagttttccggagaatctttatccgtaaaagtcggtatggaacttttttatagtaacggtccagccattgttgaaaaaataaagcaacaaaatcatgctatttttctagatttgaaactccacgatattccaaatacggtcaaaagtgcgatgattggtttggcaaaactaggtgttgatatggtgaatgttcatgcatcaggcggaaagaaaatgatggaagctgctcgtgaaggtcttgaaataggttcaacaagtggcaaacgtccaaaacttatcgcagtgacacaacttactagtacaagtgaaaccgacatgcaaaaggaacaattagtaaaggctagtcttcttgaatcagtgctacattacagtgatttaaccaaacaagcagggctagatggtgttgtctgctcagcactcgaagcagacgaaattaaactacaaaatggttctgactttttacgcgtaacgccaggtattcgattagcaagtgatgcgacagacgatcaaatccgcgtcgtaacacctgaaaaagctcgttcgattggatcatcgaatatcgtcgttggtcgctctatcactcgagcaaacgacccagtagcagcatataatcaagttttgaaggagtggaatgcatga

SEQ ID NO: 16953 - protein, 233 aa, Listeria innocua
MNKPIIALDFQTYQEVEAFLAQFSGESLSVKVGMELFYSNGPAIVEKIKQQNHAIFLDLKLHDIPNTVKSAMIGLAKLGVDMVNVHASGGKKMMEAAREGLEIGSTSGKRPKLIAVTQLTSTSETDMQKEQLVKASLLESVLHYSDLTKQAGLDGVVCSALEADEIKLQNGSDFLRVTPGIRLASDATDDQIRVVTPEKARSIGSSNIVVGRSITRANDPVAAYNQVLKEWNA

SEQ ID NO: 16954 - DNA, 702 bp, Listeria monocytogenes serotype 4b
  CDS (1)..(702): transl_table=11
atgaataaaccaattatcgcgctagatttccagacttacgaagaagtagagacctttttagccaaattttcgggagaaacgctatccgtgaaagtcggcatggaacttttttatagcaacggtccaatcattgttgaaaaaataaagcaacaacatcatgaaatcttcttggatttaaaactgcatgacatcccaaacactgtcaaaagtgcgatgattggcttggcaaaactaggcgtagatatggttaatgtacatgcggctggtgggaagaaaatgatggaagctgccagggaaggtctggaaataggttcttcaagtggcaaacgtccaaaaattattgccgtaactcaactgacaagtacaagtgagacagacatgcaaacagaacaattaataaaaacaagtctacttgaatccgtcatgcattatagcaatttatcgaaacaagctggtttagacggcgtcgtttgctccgcgctagaagcagaagatattaaacaacaaaatggcgctgattttttacgtgtaacaccaggcatccgattagcaagcgacgcagccgacgatcaaattcgtgtcgtaacaccagaaaaagcgcgtttgattggttcgtcaaacattgtcgttggtcgttccatcacgcgcgcaaacgacccggtagaagcgtataatcaagttttaaaggagtggaatgcatga

SEQ ID NO: 16955 - protein, 233 aa, Listeria monocytogenes serotype 4b
MNKPIIALDFQTYEEVETFLAKFSGETLSVKVGMELFYSNGPIIVEKIKQQHHEIFLDLKLHDIPNTVKSAMIGLAKLGVDMVNVHAAGGKKMMEAAREGLEIGSSSGKRPKIIAVTQLTSTSETDMQTEQLIKTSLLESVMHYSNLSKQAGLDGVVCSALEAEDIKQQNGADFLRVTPGIRLASDAADDQIRVVTPEKARLIGSSNIVVGRSITRANDPVEAYNQVLKEWNA

SEQ ID NO: 16956 - DNA, 702 bp, Listeria monocytogenes
  CDS (1)..(702): transl_table=11
atgaataaaccaattatcgcgctagatttccagacttacgaagaagtagagacctttttagccaaattttcaggagaaacgctatccgtgaaagttggcatggaacttttttatagcaacggtccagtcattgttgaaaaaataaagcaacaaaatcatgaaatcttcttagatttaaaactgcatgacatcccgaacactgtcaaaagtgcgatgattggcttggcaaaactaggcgttgatatggttaatgtacacgcggctggtgggaagaaaatgatggaagctgccaaggaaggtctggaaataggttctccaagtggcaaacgtccaaaaattatcgccgtaacacaactgacaagtacaagtgagacagacatgcaaacggaacaattaataaaaacaagtctgcttgaatccgtcatgcattatagcaatttatcgaaacaagctggtttagacggtgtcgtttgctccgcgctagaagcagaagatattaaacaacaaaatggcgctgattttttacgtgtaacaccaggcatccgactggcaagtgacacggcagacgatcaaattcgtgtcgtaacaccagaaaaagcacgtttgattggctcgtcaaacattgtcgttggtcgttccatcacgcgcgcaaacgacccggtagcagcgtataatcaagttttaaaggagtggaatgcatga

SEQ ID NO: 16957 - protein, 233 aa, Listeria monocytogenes
MNKPIIALDFQTYEEVETFLAKFSGETLSVKVGMELFYSNGPVIVEKIKQQNHEIFLDLKLHDIPNTVKSAMIGLAKLGVDMVNVHAAGGKKMMEAAKEGLEIGSPSGKRPKIIAVTQLTSTSETDMQTEQLIKTSLLESVMHYSNLSKQAGLDGVVCSALEAEDIKQQNGADFLRVTPGIRLASDTADDQIRVVTPEKARLIGSSNIVVGRSITRANDPVAAYNQVLKEWNA

SEQ ID NO: 16958 - DNA, 666 bp, Methanosarcina acetivorans
  CDS (1)..(666)
atggaaaggaatacctgtatgatccttgctctggacgtaaccgacagggaagaagcgctgaaaattgcagaagacgtctgggaattcgtggacgcaataaaggtaggctaccctctcatacttgccacagggctcgggattatcagggaacttgccgagttcgctccggtaatagccgatttcaaagttgccgatatccccaacaccaaccgccttatctgcgaccaggtctttgaagccggagccgatgcagtcatcgcacagggctttacaggcagggacagccttgatgcctgcattgaaatcgcttccgaatacagaaaggacgtcttcgttgtgagcgaaatgagccaccccggcggtgccgatttcatgcagccggttgcagaagcaattgcaaaaatggcgcttgaagcaggagctttcgggcttgtcgcccctgctacccgtcccaaaagagtgaagaaaatcaggagaatcatcggggacaaactcacaatcatctcccccggtgtgggtgcccagggcggaaaagcctcggacgttattgctgccggcgcagactgggtgatagtgggtaggagcatctacaaggcagaatccccaaaagaagctgccaggcagattgccgaggaaattcaggctgagctccggggagaatactga

SEQ ID NO: 16959 - protein, 221 aa, Methanosarcina acetivorans
MERNTCMILALDVTDREEALKIAEDVWEFVDAIKVGYPLILATGLGIIRELAEFAPVIADFKVADIPNTNRLICDQVFEAGADAVIAQGFTGRDSLDACIEIASEYRKDVFVVSEMSHPGGADFMQPVAEAIAKMALEAGAFGLVAPATRPKRVKKIRRIIGDKLTIISPGVGAQGGKASDVIAAGADWVIVGRSIYKAESPKEAARQIAEEIQAELRGEY

SEQ ID NO: 16960 - DNA, 642 bp, Methanococcus jannaschii
  CDS (1)..(642)
atgccaaagttaatgttagctcttgacgttttggatagagatagagctttaaaaatagtagaagatgttaaagattacgttgatgctataaaagttggatatcctttagttttatctactgggacagaaattataaaagaaataaaaaaactttgtaataaagaggttatagctgattttaaggttgcagacatcccagcaacaaatgagaagatagcaaaaataacattaaaatatgctgatggaataatagttcatggttttgttggagaggattcagttaaagcagtgcaagatgttgctaaaaagctaaacaaaaaggtaataatggttactgaaatgagccatccaggggctgttcaatttctacagccaatagcagataaattgtcagagatggctaaaaaactaaaagttgatgctatagttgctccatcaacaaggcctgaaaggcttaaagaaattaaagaaattgcagaattgccagtaataacaccaggagtcggagctcagggagggaagattgaggatattttaaatattttagatgagaatgattacgtcattgttggaagggcaatctatcaatcacaaaatcctaaagaagaggctaaaaaatataaagaaatgctaaataagtga

SEQ ID NO: 16961 - protein, 213 aa, Methanococcus jannaschii
MPKLMLALDVLDRDRALKIVEDVKDYVDAIKVGYPLVLSTGTEIIKEIKKLCNKEVIADFKVADIPATNEKIAKITLKYADGIIVHGFVGEDSVKAVQDVAKKLNKKVIMVTEMSHPGAVQFLQPIADKLSEMAKKLKVDAIVAPSTRPERLKEIKEIAELPVITPGVGAQGGKIEDILNILDENDYVIVGRAIYQSQNPKEEAKKYKEMLNK

SEQ ID NO: 16962 - DNA, 663 bp, Methanosarcina mazei
  CDS (1)..(663): transl_table=11
atggaacgaaatacatgtatgatccttgcccttgatgtgactgagagggaagaagcgctgaagattgcagaaaatgtccgggaatttgtggatgcaataaaagtgggataccctctaattcttgccaccgggcttgatattattagagagcttgccagatttgccccggtcatagctgacttcaaggttgcagatatccctaacaccaaccgtcttatctgcgaacaggtctttaaagccggagccgatgcggtcattgtgcagggctttactggcagggacagccttgatgcctgcattgaagttgcttccaaatacggaaaagatgtttttgttgtaagcgaaatgagccacccgggaggagccgagttcctgcagtcagcagcagaagcgattgcaaaaatggcagttgaagccggagctttcgggcttgttgctccagccacacgtccggaaagggtaaaagagataagaaaaattatcggagacaggcttaccattatctctccgggtgtgggtgcccagggaggaaaagcctctgacgttatctctgcaggggcagactgggtgattgtaggaagaagcatttacaaggcggaatctccaaaagaggctgcctgcgagattgctgaagaaattcaggctgagctccgcggaaagtaa

SEQ ID NO: 16963 - protein, 220 aa, Methanosarcina mazei
MERNTCMILALDVTEREEALKIAENVREFVDAIKVGYPLILATGLDIIRELARFAPVIADFKVADIPNTNRLICEQVFKAGADAVIVQGFTGRDSLDACIEVASKYGKDVFVVSEMSHPGGAEFLQSAAEAIAKMAVEAGAFGLVAPATRPERVKEIRKIIGDRLTIISPGVGAQGGKASDVISAGADWVIVGRSIYKAESPKEAACEIAEEIQAELRGK

SEQ ID NO: 16964 - DNA, 666 bp, Methanosarcina thermophila
  CDS (1)..(666)
atggaaaagaatacctgtatgatccttgccctggacgtaaccgacagggacgaagcgctgaagattgcagaagacgtctgggaattcgtggacgcaataaaggtaggctaccctctcatacttaccactgggcttgggatcatcagggaacttgccgagttcgccccggtaatagccgatttcaaggttgccgatattcccaacaccaaccgccttatctgcgatcaggtctttgaagccggagctgatgcggtcatcgttcagggctttacaggcagagacagccttgatgcctgcattgaaattgcttccgaatacagaaaggacgtcttcgttgtaagcgaaatgagccaccctgggggagccgagttcctgcagccagccgcagaatcaattgcaaagatggcccttgaagcgggagctttcgggcttgtcgccccggccacccgtcccgaaagagtgaggaaaatcaggaggatcatcggggacaaactcaccattatatctcccggagtaggtgcccagggaggaaaagcctcggacgtgattgctgcagggacagactgggtaatcgtgggaaggagcatctacaaagcagagtctcctaaagaagctgcacgtgagattgctgaggaaattcaggctgagctcagaggagagtactga

SEQ ID NO: 16965 - protein, 221 aa, Methanosarcina thermophila
MEKNTCMILALDVTDRDEALKIAEDVWEFVDAIKVGYPLILTTGLGIIRELAEFAPVIADFKVADIPNTNRLICDQVFEAGADAVIVQGFTGRDSLDACIEIASEYRKDVFVVSEMSHPGGAEFLQPAAESIAKMALEAGAFGLVAPATRPERVRKIRRIIGDKLTIISPGVGAQGGKASDVIAAGTDWVIVGRSIYKAESPKEAAREIAEEIQAELRGEY

SEQ ID NO: 16966 - DNA, 687 bp, Methanobacterium thermoautotrophicum
  CDS (1)..(687): transl_table=11
ttgagatcccggagagttgatgttatggacgttatgaacagacttatacttgcaatggacctcatgaaccgggatgatgccctcagggtcaccggagaggtcagggaatacatagacacggtcaagatagggtacccccttgtactctcagagggtatggatatcattgctgagttcagaaagagatttggctgcagaatcatagccgacttcaaggttgcagatatacccgagaccaatgaaaagatatgccgggccaccttcaaggcgggggctgatgccataatagtccacggattccggggagcagacagtgtcagggcctgcctcaatgtcgcagaggaaatgggacgtgaggtcttcctcctgacagagatgtcacacccaggggcagagatgttcatacagggcgctgcagatgaaatagccagaatgggggtcgatcttggtgtcaaaaattatgttggcccatccacaagacctgaaaggctttcaaggctgagggaaatcataggtcaggattcatttctcatatcccccggtgtgggagcccagggaggagacccaggggagaccctcaggttcgcagatgccataatagttggaagatccatctaccttgcagataaccctgcagctgcagcagcagggataatagaatccattaaagaccttctgaatccctga

SEQ ID NO: 16967 - protein, 228 aa, Methanobacterium thermoautotrophicum
MRSRRVDVMDVMNRLILAMDLMNRDDALRVTGEVREYIDTVKIGYPLVLSEGMDIIAEFRKRFGCRIIADFKVADIPETNEKICRATFKAGADAIIVHGFRGADSVRACLNVAEEMGREVFLLTEMSHPGAEMFIQGAADEIARMGVDLGVKNYVGPSTRPERLSRLREIIGQDSFLISPGVGAQGGDPGETLRFADAIIVGRSIYLADNPAAAAAGIIESIKDLLNP

SEQ ID NO: 16968 - DNA, 696 bp, Mycoplasma penetrans
  CDS (1)..(696): transl_table=4
atgagtaatagagaagttattattgctttagattttgatagtttagataaaacttgtaaattcttaaatttatttgagaatcaaaatttatttgtaaaaataggaatggaattgttttatcaaaatggtttacaagtattacatgaaatcaaaaatagaggtcataaaatctttttagatttaaaactacatgatattccaaatactgtttatcatgcagttaaaggactaatgaaatttgatgttgatattataactgttcactgtgcaggtggtcttacaatgttaaaccaagcaaagcaagcagtttttgatcaaaacaaaaatactaaaataattggaataactcaactaacttctacaagtgaaacagaaatgcaaactcagcaaaagatttcaacttcattacaagattcagttttaaattatgcgaaattagctaaagaagcaaatatagatggggttgtaagttcagtatgagaaactaaaaaaattaaagaacaaaatggtaataattttttagttatcaatcccggaataaggttagaaaaagatgatagtggagatcaaaaaagagtagcaagtccactagatgctaaaaatcaattagctgattttatagtggttggtagaccaattacaaaagataacaacccattagaaaaatatttagaaattaaaagaatgtttgtttag

SEQ ID NO: 16969 - protein, 231 aa, Mycoplasma penetrans
MSNREVIIALDFDSLDKTCKFLNLFENQNLFVKIGMELFYQNGLQVLHEIKNRGHKIFLDLKLHDIPNTVYHAVKGLMKFDVDIITVHCAGGLTMLNQAKQAVFDQNKNTKIIGITQLTSTSETEMQTQQKISTSLQDSVLNYAKLAKEANIDGVVSSVWETKKIKEQNGNNFLVINPGIRLEKDDSGDQKRVASPLDAKNQLADFIVVGRPITKDNNPLEKYLEIKRMFV

SEQ ID NO: 16970 - DNA, 741 bp, Neisseria meningitidis serogroup A
  CDS (1)..(741): transl_table=11
atgaatcctttaatctccgacttccaaactccgcaacaacgcacccccgttatcgtcgcccttgatttttccaacgaaaaagacacgctcggattcgtccgcaaccttgacccgacattgtgtcaaatcaaaatcggcaaagagctgtttaccgcgacgggacgcaatttggcagaaagcttaatcaatcaaggtttcaaacttttcctcgatttgaaataccacgatattccccacaccgtcgcgcaagcctgcaaagtcgctgccgatatgggcgtttggatggtcgatatgcacgcatcgggcggccgccgtatgatggaagccgcagcagaagccgttgccggatacggcacgaagccgctcttaatcggcgtaaccgtgttgaccagcatggaacaaagcgatttggcggaaatcggtttgaacaccgcccctgaagaacaagtcatccgcttggcgaaactggcgcaaagttcgggcttggacggcgtggtctgttccgcccaagaagccgcgccgctgcgccgcgaattgggacaggattttgtcttggtcacgcccggcatccgcttggacgttgccgacaataatgatgaccagcgccgcatcatgacaccggccgaagccttggctgccggttcgacttatttggtaatgggtcgtcctgtaacccaagctgccgatccggtagccgtattgcgcgaagtgaaccgcgtggcaaaccttgaagcaaactga

SEQ ID NO: 16971 - protein, 246 aa, Neisseria meningitidis serogroup A
MNPLISDFQTPQQRTPVIVALDFSNEKDTLGFVRNLDPTLCQIKIGKELFTATGRNLAESLINQGFKLFLDLKYHDIPHTVAQACKVAADMGVWMVDMHASGGRRMMEAAAEAVAGYGTKPLLIGVTVLTSMEQSDLAEIGLNTAPEEQVIRLAKLAQSSGLDGVVCSAQEAAPLRRELGQDFVLVTPGIRLDVADNNDDQRRIMTPAEALAAGSTYLVMGRPVTQAADPVAVLREVNRVANLEAN

SEQ ID NO: 16972 - DNA, 741 bp, Neisseria meningitidis serogroup B
  CDS (1)..(741): transl_table=11
atgaatcctttaatctccgacttccaaactccgcaacaacgcacccccgttatcgtcgcccttgatttttccaacgaaaaagacacgctcggattcgtccgcaaccttgacccgacattgtgtcaaatcaaaatcggcaaagagctgtttaccgcgacgggacgcaatttggcagaaagcttaatcaatcaaggtttcaaacttttcctcgatttgaaataccacgatattccccacaccgtcgcgcaagcctgcaaagtcgctgccgatatgggcgtttggatggtcgatatgcacgcatcgggcggccgccgtatgatggaagccgcagcagaagccgttgccggatacggcacgaagccgctcttaatcggcgtaaccgtgttgaccagcatggaacaaagtgatttggcggaaatcggtttgaacaccgcccctgaagaacaagtcatccgcttggcaaaactggcgcaaagttcgggcttggacggcgtggtctgttccgcccaagaagccgcgccgctgcgccgcgaattgggacaggattttgtcttggtcacgcccggcatccgcttggacgttgccggcaataatgatgaccagcgccgcatcatgacaccggccgaagccttggctgccggttcgacttatttggtaatgggtcgtcctgtaacccaagctgccgatccggtagccgtattgcgcgaagtgaaccgcgtggcaaaccttgaagcaaactga

SEQ ID NO: 16973 - protein, 246 aa, Neisseria meningitidis serogroup B
MNPLISDFQTPQQRTPVIVALDFSNEKDTLGFVRNLDPTLCQIKIGKELFTATGRNLAESLINQGFKLFLDLKYHDIPHTVAQACKVAADMGVWMVDMHASGGRRMMEAAAEAVAGYGTKPLLIGVTVLTSMEQSDLAEIGLNTAPEEQVIRLAKLAQSSGLDGVVCSAQEAAPLRRELGQDFVLVTPGIRLDVAGNNDDQRRIMTPAEALAAGSTYLVMGRPVTQAADPVAVLREVNRVANLEAN

SEQ ID NO: 16974 - DNA, 696 bp, Nitrosomonas europaea
  CDS (1)..(696): transl_table=11
atgaatgacccgcgtatcatcgtcgcactggattttcccgatcagtgtacagcattgaattttgctgccgggctggatagtacgctttgccgggtcaaggtcgggaaagagctgtttactctggcgggtccgcaattggtcgagaaattgatgaaactgggtttcgatgtatttctcgatctgaaattccatgatattcccaatacggttgctgcagcttgcagtgctgcatcaagccttggtgtatggatggtcaatgtacacgcgctgggagggagtaaaatgctgcttgcagcccgacaggccctggatgggaaaagaaccagactcattgccgttaccctgctcaccagcctgaatcagaatgatttgagtgagttgggtatagctgatacaccggaaacaatggtgcagcgactggctttgcttgcccagcgttgtggcctggacggtgtggtttgttcagcgctggaagcggtgagtctgagagaagtgactggtgaggatttttgtctggtcactccgggtatccgatcattcggtgacggtaacgatgatcaggcgaggattgcaacaccggcaatggcaatacgtagtggggccagctatcttgtgatcggcagacccatcacccgatcaccggatccgctcggagcactccgtcgattcaatgacgaggtcgcttcagttttatga

SEQ ID NO: 16975 - protein, 231 aa, Nitrosomonas europaea
MNDPRIIVALDFPDQCTALNFAAGLDSTLCRVKVGKELFTLAGPQLVEKLMKLGFDVFLDLKFHDIPNTVAAACSAASSLGVWMVNVHALGGSKMLLAARQALDGKRTRLIAVTLLTSLNQNDLSELGIADTPETMVQRLALLAQRCGLDGVVCSALEAVSLREVTGEDFCLVTPGIRSFGDGNDDQARIATPAMAIRSGASYLVIGRPITRSPDPLGALRRFNDEVASVL

SEQ ID NO: 16976 - DNA, 696 bp, Oceanobacillus iheyensis
  CDS (1)..(696): transl_table=11
atgaccatgtttgtagcactagattttcctgattggaaacaaacagaggcatttctatataaaaatgaattgcaaggtgttcctgttaaagttggtatggaactgttttataaagagggccctagcgtaattgagaaattaaaaaggaataatcactctatttttttagatcttaaattacatgacataccaaatacagtccatcgagcaatgaaaaatattgcttccttaggggtcgatttagttacaatacatacacttggcggaagtgaaatgattgctcaggcgaagcgtggacttgaacattcacaaacaaaactgattgcagtaaccctgttaacatcggtagatgaagaagtagttcaacatcaattacgtttacctggaaatattccagcaaatgttgctcatttagcgagcttagcaaaagctaatggagcggatggagtcgttagctctgtacatgaagtagcttctatcaaaaaaacttgtgatacatctttcttaacgttaaccccaggaatacgatttgatagttcggatgttcatgatcaaaaacgtgttgcgacaccagaaatggcaaatcaagttggaagtgactttatcgtagtaggtagagcgattacgcaatctgatcatccttatacagcatatatggaagcaaagaaacgatgggaggaagcttcggatgaataa

SEQ ID NO: 16977 - protein, 231 aa, Oceanobacillus iheyensis
MTMFVALDFPDWKQTEAFLYKNELQGVPVKVGMELFYKEGPSVIEKLKRNNHSIFLDLKLHDIPNTVHRAMKNIASLGVDLVTIHTLGGSEMIAQAKRGLEHSQTKLIAVTLLTSVDEEVVQHQLRLPGNIPANVAHLASLAKANGADGVVSSVHEVASIKKTCDTSFLTLTPGIRFDSSDVHDQKRVATPEMANQVGSDFIVVGRAITQSDHPYTAYMEAKKRWEEASDE

SEQ ID NO: 16978 - DNA, 702 bp, Pasteurella multocida
  CDS (1)..(702): transl_table=11
atgacgagtaaaatcattgttgcactagattatgaaaaagaagaagaggcattgtgtttagttgatcaaattgatccgagcttatgtcgtttgaaagtcggtaaagaaatgtttactacattagggacgaaatttgtcaaagcattacatgatcgcaactttgatgtgtttttagatttaaaatttcatgatattccaaatactgtagcaagagcggtgcgttctgcggcagatttaggggtttggatggttgatttacatgccagcggtggtttgcgtatgatggaggaggcgaagaaaattcttgaaccttatggtaaagacgcgcctcttttaattagtgtgacggtattaaccagtatggaagatctagatttattgcaaattggcattaatgcttctccgatggaacaagtaatccgtttagccaatctaacacagcgtgctggattagatggcgtagtttgttctccgcaagaagtggaaattttacgcgctaactgtggtaaagattttaaactgattacgccgggaattcgcccaatcggcagtgattttggtgatcagcgtcgcgtaatgacaccagcgggggcaattcaagcaggttctgactatttagtaattggtcgtccaattacacaagcagataacccagcagaagtgctcaaatcaatcaatgcttctttacctgtgaatagataa

SEQ ID NO: 16979 - protein, 233 aa, Pasteurella multocida
MTSKIIVALDYEKEEEALCLVDQIDPSLCRLKVGKEMFTTLGTKFVKALHDRNFDVFLDLKFHDIPNTVARAVRSAADLGVWMVDLHASGGLRMMEEAKKILEPYGKDAPLLISVTVLTSMEDLDLLQIGINASPMEQVIRLANLTQRAGLDGVVCSPQEVEILRANCGKDFKLITPGIRPIGSDFGDQRRVMTPAGAIQAGSDYLVIGRPITQADNPAEVLKSINASLPVNR

SEQ ID NO: 16980 - DNA, 747 bp, Photorhabdus luminescens subsp
  CDS (1)..(747): transl_table=11
atgacatctcataccttaacatcgttcggtagacagattagctcgcctgtcattgttgctttagattacgacaatcaggatacggcgctggcttttgccgataaaattgatccacaggattgccgtctgaaagtaggtaaagagatgtttaccttacatggtccgcagtttgttaagttgctgcaccaacgtggttttgaagtatttctagatttgaaattccatgatattcctaataccaccgccagagcggtagctgccgctgctgagatgggggtttggatggtaaacgtacatgctagtggcggcaccagaatgatgacagcggcgaaagaggcgctgctgccttatggtcatgatgctccattgttaattgctgtcacggtattaaccagcatggaacaatcggatctgcaaggtattgggattgatatgacaccagcgcaacaggctgaaaggttggcaaaactgactcaggcatgtgggctggatggtgtggtttgttctgcacatgaagctcagcaactgaaaaaggtttgtggtcagcattttcaattagttactcccggaattcgcccgacgggcagtgatgtgggtgatcagcgccgtatcatgacgccagaacaggcggtattggctggcgttgattatatggtcattggccgtccgattacccgtgccgccgatcctgcggccgcattgcgtcaaattaatcaatctattgcgggagtgattaatgcaagataa

SEQ ID NO: 16981 - protein, 248 aa, Photorhabdus luminescens subsp
MTSHTLTSFGRQISSPVIVALDYDNQDTALAFADKIDPQDCRLKVGKEMFTLHGPQFVKLLHQRGFEVFLDLKFHDIPNTTARAVAAAAEMGVWMVNVHASGGTRMMTAAKEALLPYGHDAPLLIAVTVLTSMEQSDLQGIGIDMTPAQQAERLAKLTQACGLDGVVCSAHEAQQLKKVCGQHFQLVTPGIRPTGSDVGDQRRIMTPEQAVLAGVDYMVIGRPITRAADPAAALRQINQSIAGVINAR

SEQ ID NO: 16982 - DNA, 723 bp, Prochlorococcus marinus
  CDS (1)..(723): transl_table=11
atgactctttcttttaagcctgaagataaattaattcttgctcttgatggcatgagtggagctgaagtgtttatgttgatagaaaaattacctaatttgatttgggtcaaagtaggtttggaattgtttactttgctaggccctcaaatcattaatcagcttagagatcgaggaaagaaggtttttttagatcttaaatttcatgatattcctactactatgggacgtgcttgttatcaagctgcaaagactggtgcggaattgatcacagttcatgcatgtgcagggaaaaaaggtattgaagaggctaataaatccgcagttaaaggagctaaagaagtaggtttgcctccccctagtcttttggcggttactgttttaacaagttggggatcaaaagattttgttcaagagcttgggatccaacaatctttggatcaaagagtctctttgttagcgaatttagcttcttcagcaggtattcaaggttgcatatgttcccctttagaagtaatgaaactgcgaaaagattttcccgaaccttttcaattaattactccgggcattcgttcttgcggagagaatattaatgatcagaataggattatgactcctttagaggcaattgatgcaggctcctctaagttagttataggtagagaagttactagttcagaaaacccttcagatgcttttaatagaatttgttctcaattaatttga

SEQ ID NO: 16983 - protein, 240 aa, Prochlorococcus marinus
MTLSFKPEDKLILALDGMSGAEVFMLIEKLPNLIWVKVGLELFTLLGPQIINQLRDRGKKVFLDLKFHDIPTTMGRACYQAAKTGAELITVHACAGKKGIEEANKSAVKGAKEVGLPPPSLLAVTVLTSWGSKDFVQELGIQQSLDQRVSLLANLASSAGIQGCICSPLEVMKLRKDFPEPFQLITPGIRSCGENINDQNRIMTPLEAIDAGSSKLVIGREVTSSENPSDAFNRICSQLI

SEQ ID NO: 16984 - DNA, 738 bp, Prochlorococcus marinus
  CDS (1)..(738): transl_table=11
atgacctcgccattgactcctgccgatcaactgatcattgctcttgatggcatggagcgggctgaggcccttgcattcatctcaaagttgccagaggtcagttgggtcaaggtgggactggaactgtttgttagtgcggggccagaggttttggctgatctacgggagcaagggttgcagatttttcttgatctaaagtttcacgatatccctgccaccattgcaggagcttgtcgccgagcggcgagctttggcgctgagttgatcacggtgcatgcctgtgctggccgtgctgctcttgctgaagctcaggctgctgcttgcgagggggctgcggaggttggcttgtcagcaccccggctgttggccgttactgtgctcaccagttgggatcagaagcgtctagcgaatgagctgtgcattcctcagtctcttcaggccagggtggagtggttggctgagttggcagcggagtcagggttgggcggctgcgtgtgttctccctgggaggtcagcggcttacgccgacttcatccctcgccatttgagttggtgactcctggtattcgcccctcgggggctgaattggcggatcaggtcagggtcatgagtcctgcagcggcgttgaatgcaggagcttcacgtttggtgattggcaggccgattacccgtgctgttgatccggcagaagcgtttgcacgctgctgccttgagattgaacagcgtcagctggactga

SEQ ID NO: 16985 - protein, 245 aa, Prochlorococcus marinus
MTSPLTPADQLIIALDGMERAEALAFISKLPEVSWVKVGLELFVSAGPEVLADLREQGLQIFLDLKFHDIPATIAGACRRAASFGAELITVHACAGRAALAEAQAAACEGAAEVGLSAPRLLAVTVLTSWDQKRLANELCIPQSLQARVEWLAELAAESGLGGCVCSPWEVSGLRRLHPSPFELVTPGIRPSGAELADQVRVMSPAAALNAGASRLVIGRPITRAVDPAEAFARCCLEIEQRQLD

SEQ ID NO: 16986 - DNA, 720 bp, Prochlorococcus marinus subsp
  CDS (1)..(720): transl_table=11
atgaaaaaatttaatacagaagaaaaaataatattagctattgatggattagatatatttcaagcaaaagtattgctagaaagatgtcccaatattaaatgggtaaaagttggcttagaactttttacgagggagggacctagtgtaataaaaattttgaaaaatttaaataaaaaaatattcttagatcttaaatttcacgatattcctaatactatgagcgctgcttgttatgaggtgtccaaactcggagttgatattatttctgttcatgcttcagcaggttctaaagctcttactgcatcaaaaaaagcatctttagaaggagcaaaaatagctactgtaaatgctccttgtgttatagggataactgttttaactagcttatctagtgaagaattccaaactgatcttgatagaaaaaactcgattgaggaaaatgttatcagacttgcaaaattgtctttcgatgctggattagatggatgcgtttgttctcctttggaggcaaaaatattgagatcaatgtataaaaataatttcgaattaataacacctggtattaggacaaatattcaaaaaaaagatgatcaaaatagaataatgactccttttgaagcaataagtaatggatcttctaaattggttattggaagagctattacaaaagcaaaagatcccaataaggcttttttggatatctgcgagtctatttgttaa

SEQ ID NO: 16987 - protein, 239 aa, Prochlorococcus marinus subsp
MKKFNTEEKIILAIDGLDIFQAKVLLERCPNIKWVKVGLELFTREGPSVIKILKNLNKKIFLDLKFHDIPNTMSAACYEVSKLGVDIISVHASAGSKALTASKKASLEGAKIATVNAPCVIGITVLTSLSSEEFQTDLDRKNSIEENVIRLAKLSFDAGLDGCVCSPLEAKILRSMYKNNFELITPGIRTNIQKKDDQNRIMTPFEAISNGSSKLVIGRAITKAKDPNKAFLDICESIC

SEQ ID NO: 16988 - DNA, 699 bp, Pseudomonas aeruginosa
  CDS (1)..(699): transl_table=11
atgtccgcctgccagtcccccatcatcgtcgccctggatttccccacccgtgaggccgccctggcgctggccgatcagctggacccgaaactgtgccgggtgaaggtcggcaaggaactcttcaccagttgtgccgcgggtatagtcgagaccttgcgtggcaagggcttcgaggtgttcctcgacctgaaattccacgacatcccgaacaccacggcgatggcggtgaaggccgccgccgagatgggcgtgtggatggtcaacgtgcactgctccggcggcctgcgcatgatggccgcctgccgcgagacgctggaggccttcagcgggcccaggccgttgctcatcggcgtgaccgtgctgaccagcatggagcgcgaggacctggcgggcatcggcctcgacatcgagccccaggagcaggtgttgcgcctcgccgccctggcgcagaaggccggcatggacggcctggtctgctcggcccaggaagcgccggcgctgaaggccgcccatccgggcctgcaactggtcacgccgggcatccgcccggccggcagcgcccaggacgaccagcggcgcatcctcaccccgcgccaggccctggacgccggctccgattacctggtgatcggccggccgatcagccaggccgccgacccggccaaggcgctggcggcgatcgtcgccgaactgggctga

SEQ ID NO: 16989 - protein, 232 aa, Pseudomonas aeruginosa
MSACQSPIIVALDFPTREAALALADQLDPKLCRVKVGKELFTSCAAGIVETLRGKGFEVFLDLKFHDIPNTTAMAVKAAAEMGVWMVNVHCSGGLRMMAACRETLEAFSGPRPLLIGVTVLTSMEREDLAGIGLDIEPQEQVLRLAALAQKAGMDGLVCSAQEAPALKAAHPGLQLVTPGIRPAGSAQDDQRRILTPRQALDAGSDYLVIGRPISQAADPAKALAAIVAELG

SEQ ID NO: 16990 - DNA, 702 bp, Pseudomonas putida
  CDS (1)..(702): transl_table=11
atgtccgcctgccagacgcccctgatcgtcgccctggatttccctacccgtgaggccgccctgaagctggctgaccagcttgaccctgcgctgtgccgggtgaaggttggcaaggagctgttcaccagcagcgcttcgggcattgtcgaaaccctgtgtgacaagggcttcgaagtgttcctggacctcaagttccacgacattcccaacaccaccgccatggcggtaaaggctgccgccgagatgggcgtgtggatggtcaacgtgcattgctccgggggcctgcgcatgatggcggcctgccgtgaagagctggccaagcgcagcggcccgcagccgttgctgattggcgtgaccgtgctgaccagcatggagcgtgaagacctggccggcattggcctggatgtcgacccccaagagcaagtgctgcgtttggcggcgctggcggaaaaagcgggtatggacggtttggtgtgctcggcgctcgaggccccggcactgaaggcggcgcacccctcgctgcaattggtgaccccgggcattcgcccggcgggcagcgcgcaggatgaccagcgccgtatcctcaccccacgccaggcactggatgccggttcggactacctggtaatcggccggccgatcagccaggctgcagaccctgcgcaagcgttggcagcggtggtggcggagatccgtgggtaa

SEQ ID NO: 16991 - protein, 233 aa, Pseudomonas putida
MSACQTPLIVALDFPTREAALKLADQLDPALCRVKVGKELFTSSASGIVETLCDKGFEVFLDLKFHDIPNTTAMAVKAAAEMGVWMVNVHCSGGLRMMAACREELAKRSGPQPLLIGVTVLTSMEREDLAGIGLDVDPQEQVLRLAALAEKAGMDGLVCSALEAPALKAAHPSLQLVTPGIRPAGSAQDDQRRILTPRQALDAGSDYLVIGRPISQAADPAQALAAVVAEIRG

SEQ ID NO: 16992 - DNA, 627 bp, Pyrococcus abyssi
  CDS (1)..(627): transl_table=11
gtgatagttctagctttggacgtttacgatgaggatagagctttgaagatagccgaggagacgaaggattacgttgcaatgattaaggtcaactggccactaataattgggagtggattggatataataaggaagctcaaagataggactggactaaagattatagccgatttgaagttagccgatataccgaatactaataagctcatagctaggaaagtttacgaagcgggtgccgattacataatagttcatccattcgtgggaagggacagcgttgaggcggttaatgagctcggggagataatcttagttgttgagatgagccatcccggggctttggagttcataaacccactaacggataagttcatagagctcgccaacgatgttgagccatttggggttatagctccaggaactaggcctgagagggttaaatatatccgagagaggcttaaggagggcgtgaagatacttactcctgggataggggcccagggaggaaaggctaaggaagcgatagaggctggggcagattacgtaatcgttggaaggtcaatttacaacgctccaaatcctagagaagctgcaagggaaatatacgatgaaataaggggtgagtga

SEQ ID NO: 16993 - protein, 208 aa, Pyrococcus abyssi
MIVLALDVYDEDRALKIAEETKDYVAMIKVNWPLIIGSGLDIIRKLKDRTGLKIIADLKLADIPNTNKLIARKVYEAGADYIIVHPFVGRDSVEAVNELGEIILVVEMSHPGALEFINPLTDKFIELANDVEPFGVIAPGTRPERVKYIRERLKEGVKILTPGIGAQGGKAKEAIEAGADYVIVGRSIYNAPNPREAAREIYDEIRGE

SEQ ID NO: 16994 - DNA, 636 bp, Pyrococcus furiosus
  CDS (1)..(636): transl_table=11
atgattgtactagcgttggacgtgtatgagagagaaaaggccttaagcatagcggaagatgttaaagattacatttcaatgataaaggtgaactggcccctgataattggaagtggtcttggagttatttcagagctaaagaagaaaacaggcctcccgataatagcggatctaaagctggcagacatcccaaacacaaataggttgatagcaaagaaagtttatgatgctggggcggattatataatactccattcctttgtagggagggacagcgtaaaggcagtgaaggagctaggagaaattataatgatagttgagatgagccatcctggggccttagaattcataaacccactcaccgacaagttcatagacatggccaatgaaataaagcctttcggcgtcatagcgccaggaaccaggccagagagaattagatacattagagagaggctgagtaaagacataaaagtgcttaccccaggaattggagcccaaggaggatcgccagtggaggcgttgaaagctggagcagattacatcatcattggaagggccatatacaatgctgaaaggcccagggaagccgctaagaagattttcgaggaggtgaaagaatggagctcaagataa

SEQ ID NO: 16995 - protein, 211 aa, Pyrococcus furiosus
MIVLALDVYEREKALSIAEDVKDYISMIKVNWPLIIGSGLGVISELKKKTGLPIIADLKLADIPNTNRLIAKKVYDAGADYIILHSFVGRDSVKAVKELGEIIMIVEMSHPGALEFINPLTDKFIDMANEIKPFGVIAPGTRPERIRYIRERLSKDIKVLTPGIGAQGGSPVEALKAGADYIIIGRAIYNAERPREAAKKIFEEVKEWSSR

SEQ ID NO: 16996 - DNA, 627 bp, Pyrococcus horikoshii
  CDS (1)..(627)
atgatagttttggccttagatgtttatgaaggagaaagggccattaaaatagctaaaagtgttaaggattacatttcgatgataaaggttaactggccactcattcttggaagtggagtggatataataagaagacttaaggaggagacaggagttgagataatagctgatcttaagcttgctgacataccgaatactaataggttgatagcaagaaaggtctttggggctggagcggactatgtaatagtgcataccttcgttggtagggatagcgtaatggcagtgaaggagcttggggaaataataatggtggttgaaatgagccatcctggagcactcgagttcattaatcctttaacagatagattcatagaagtcgcaaatgaaattgagccttttggggttatagctcctgggacaaggcctgagagaattggatacattagggatagattgaaggaagggataaagattctcgcccctgggataggggcccagggtggtaaagctaaggatgctgttaaagctggagcggattatataatagtgggaagggcaatatataacgctccaaatccaagagaagcagcaaaagcgatatacgatgaaataagaggtgtttag

SEQ ID NO: 16997 - protein, 208 aa, Pyrococcus horikoshii
MIVLALDVYEGERAIKIAKSVKDYISMIKVNWPLILGSGVDIIRRLKEETGVEIIADLKLADIPNTNRLIARKVFGAGADYVIVHTFVGRDSVMAVKELGEIIMVVEMSHPGALEFINPLTDRFIEVANEIEPFGVIAPGTRPERIGYIRDRLKEGIKILAPGIGAQGGKAKDAVKAGADYIIVGRAIYNAPNPREAAKAIYDEIRGV

SEQ ID NO: 16998 - DNA, 642 bp, Pyrococcus kodakaraensis
  CDS (1)..(642): transl_table=11
atggaggagagcaggctcattctggcgctcgacgtttatgatagggagagggcacttgagatagcggagtgcacagcagattacctctgggcaattaaggtaaactggcccctcatcatcggttccggattgaagataatcaccgagctcaagcaggtcacagggcttccgataatagccgacctcaaactcgctgatatccccaacacgaacagactgatagcgagtaaagtattcgaggctggggcagactacataattgcccacggcttcgtaggcagggacagcgttgaggccgttatggagcttggaaaaacgatcatcgttgtcgagatgagccatcccggagctaaagagttcattcagcccgtcaccgacaagctgatcgaacttgcaaacgagctggaacccttcggcgtaatagctcctgcgaccaggccggagcgggtctcgtacatccgttcaaggctcgagagggggataaggattttgactcccggagtgggtgcccagggtgggaaagccagtgatgccatcaaggccggtgctgactacgtgatagtcgggcgctcgatctacggcagtaataacccgcgcgaggcagcaaggagactctatgaggaaattctggaggtggtttga

SEQ ID NO: 16999 - protein, 213 aa, Pyrococcus kodakaraensis
MEESRLILALDVYDRERALEIAECTADYLWAIKVNWPLIIGSGLKIITELKQVTGLPIIADLKLADIPNTNRLIASKVFEAGADYIIAHGFVGRDSVEAVMELGKTIIVVEMSHPGAKEFIQPVTDKLIELANELEPFGVIAPATRPERVSYIRSRLERGIRILTPGVGAQGGKASDAIKAGADYVIVGRSIYGSNNPREAARRLYEEILEVV

SEQ ID NO: 17000 - DNA, 705 bp, Rhizobium fredii
  CDS (1)..(705): transl_table=11
atgagcacaagcgcgcgcgaccggctgatcgtcggcctcgaccttccgacgatcgccgaggcggaaaggatcgtctcgacgcttggcgacgatgtcgccttctacaagatcggctatcagctcgccttcgccggcggtctggaattcgcccgcgatctggcggcgagcggcaagaaggtcttcctcgacatgaagctgctcgacatcgacaatacggtggcgaagggcgttgagaacatcgtcaggatgggcatgtcgatgctgacgctgcacgcctatccgaaggcgatgaaggcggccgtcgacgcggcgaagggctccgatctctgcctgctcggcgtcacggtgctgacctcgatggacgcgcaggacgtcatcgatgccggctacggctccgatccgcatactctggtgctgcgcagggccgaacaggcgcgcgcggccggcatgggcggcatcgtctgctcggccgaggaagccaccgccgtgcgccgcatcatcggcgcggagatggcggtggtgacgcccggcattcgccccaccggtgcggagaaaggcgaccagaaacgggtgatgacgccggccgaggcgatccgcgccggatcgagccacctcgtcgtcgcccggccgatcgtcaaggcggccgatccgcttagtgccagccgcgccatcctggcggagatggagggcgtcctctcagcctga

SEQ ID NO: 17001 - protein, 234 aa, Rhizobium fredii
MSTSARDRLIVGLDLPTIAEAERIVSTLGDDVAFYKIGYQLAFAGGLEFARDLAASGKKVFLDMKLLDIDNTVAKGVENIVRMGMSMLTLHAYPKAMKAAVDAAKGSDLCLLGVTVLTSMDAQDVIDAGYGSDPHTLVLRRAEQARAAGMGGIVCSAEEATAVRRIIGAEMAVVTPGIRPTGAEKGDQKRVMTPAEAIRAGSSHLVVARPIVKAADPLSASRAILAEMEGVLSA

SEQ ID NO: 17002 - DNA, 714 bp, Rhizobium loti
  CDS (1)..(714): transl_table=11
atgcaggccaaatccatccaggcccagtccatccaggaaagactgatcgtcggcctcgacctaccgaccgtgcgggaagccgagcaggcggtgcgcgaactcgacggcgtcgtctccttctacaagatcggctatcagctggctttcgccggcgggctcgactttgccagggaactggccagcggcgggacaaagatcttcctcgacatgaagctgctcgacatcgaccacacggtggccaagggcgtcgagaacatcgtcaagatgggcatgaccatgctgaccatccacgcctatcccaaggcgatgcgcgcggcggtggaagcggccaggggcagtgacctttgcctgctcgccgtcagcgtgctgacctcgatggacgagcaggacatgatcgatgtcggctatgaatatgacccgcacacgctggtgctgcggcgctctgaacaagcgctgcatgccggcatgggcggcatcgtctgctcggcggcggaggcagaagcggtgcgccgcatcgttggccccgacatggcggtggtgacacccggcatccggccggccggcagcgaccatggcgaccagaaacgcgtggtgacgccggcgcaagcgatccgcaacggcgccagccatcttgtggtggcccgcccgatcgtcgcggcaagcgaccgccgcgcggcggcgcaggcgatcctcgacgaaatgcgctctgcatag

SEQ ID NO: 17003 - protein, 237 aa, Rhizobium loti
MQAKSIQAQSIQERLIVGLDLPTVREAEQAVRELDGVVSFYKIGYQLAFAGGLDFARELASGGTKIFLDMKLLDIDHTVAKGVENIVKMGMTMLTIHAYPKAMRAAVEAARGSDLCLLAVSVLTSMDEQDMIDVGYEYDPHTLVLRRSEQALHAGMGGIVCSAAEAEAVRRIVGPDMAVVTPGIRPAGSDHGDQKRVVTPAQAIRNGASHLVVARPIVAASDRRAAAQAILDEMRSA

SEQ ID NO: 17004 - DNA, 705 bp, Rhizobium meliloti
  CDS (1)..(705): transl_table=11
atgagcacaagcgcgcgcgaccggctgatcgtcggccttgatcttccaacggtgaccgaggccgagaaaatcgtctcgacgctcggcgaggaagtcctcttctataagatcggctatcaactggccttcgccggcggcctcgacttcgcgcgcgatctcgccgcgagcggcaagcaggtcttcctcgacatgaagctgctcgacatcgacaacacggtggccaagggcgtggagaacatcgtcaagatgggcgtgtcgatgttgacgctgcacgcctatccgaaggcgatgaagtcggcggtcgaagcggccaggggctcgaacctctgccttcttggcgtgacggtgctcacctcgatggacgaacaggacgtcatcgatgccggttatgaatatgatccgcacagcctggtcctgcgccgcgccgaacaggcccgcgccgcaggcatggggggcatcgtctgctcggcggaggaggccgccgccgtgcgaaagatcatcggcggcgacatggcgctggtgacgccgggcatccgcccggccggtgcggaaaaaggcgaccagaagcgggtgatgacgccggccgacgcgcttcgcgccggctcgagccacctcgtcgtcgggcggccgatcgttgccgcgcccgaccctctcgcagcaagccgcgcgatcctggccgaaatggagagcgccctctcccgttga

SEQ ID NO: 17005 - protein, 234 aa, Rhizobium meliloti
MSTSARDRLIVGLDLPTVTEAEKIVSTLGEEVLFYKIGYQLAFAGGLDFARDLAASGKQVFLDMKLLDIDNTVAKGVENIVKMGVSMLTLHAYPKAMKSAVEAARGSNLCLLGVTVLTSMDEQDVIDAGYEYDPHSLVLRRAEQARAAGMGGIVCSAEEAAAVRKIIGGDMALVTPGIRPAGAEKGDQKRVMTPADALRAGSSHLVVGRPIVAAPDPLAASRAILAEMESALSR

SEQ ID NO: 17006 - DNA, 792 bp, Rhizomucor pusillus
  CDS (1)..(792)
atgaacactttcaagacctacgctgatcgcgctgcacgacatcccaatggttgcgctaaagctctgtttgagctcatggagcgtaagcagacgaatctgtctatcgctgccgacgtgaccacaaagaaagaactccttcacattgctgatgcctgtggaccttacatctgcattctaaagacacacattgatatcattgatgactttgacgaagaccttgttgcgcagctgtgcgagttggcaaagaagcacgacttcttgttatttgaggatcgcaagtttgcggatatcggcaacacggtcaagcatcagtacggaaaaggtgtttacaagatcgcttcctgggcacacattacgaacgcccacaccgtgcctggcgaaggtatcatcaccggattgcgcgaagtcggtcttcctctcggtcgaggactgttgttattagctgaaatgtcatccaagggtgcattgactaagggcagctacacgaccgaatccgtcgagatggcacgacgtaaccaagactttgtttttggatttattgcccagcacaagatgaacgaaaaagacgatgaagatttcgttgtcatggcacctggtgtcggactggatgtcaagggagatggactcggtcagcaatatagaacgccttaccaggtcattgttgagtctggatgcgatgtcattatcgtgggacgtggtatctatggcaaccccgaccagatcgagttccaggcaaagcgttacaaggaagctggatggaacgcgtacttggaacgtgtacaaaagcattag

SEQ ID NO: 17007 - protein, 263 aa, Rhizomucor pusillus
MNTFKTYADRAARHPNGCAKALFELMERKQTNLSIAADVTTKKELLHIADACGPYICILKTHIDIIDDFDEDLVAQLCELAKKHDFLLFEDRKFADIGNTVKHQYGKGVYKIASWAHITNAHTVPGEGIITGLREVGLPLGRGLLLLAEMSSKGALTKGSYTTESVEMARRNQDFVFGFIAQHKMNEKDDEDFVVMAPGVGLDVKGDGLGQQYRTPYQVIVESGCDVIIVGRGIYGNPDQIEFQAKRYKEAGWNAYLERVQKH

SEQ ID NO: 17008 - DNA, 738 bp, Salmonella typhi
  CDS (1)..(738): transl_table=11
atgacgtttactgcttcatcttcttcctgcgctattactgaatcgcctgtcgttgtggcgttggattaccatgaacgcgataaagccctggcgtttgtcgataaaatcgatcctcgcgattgtcgcttaaaagtgggcaaagagatgttcacgctgtttggtccacaactcgttcgggatctccagcaacgtgggtttgatgtctttcttgatctaaaatttcatgatattcccaacaccacggcccgggcagtcgccgcagcggcagacctgggcgtttggatggtaaacgttcacgcgtctggtggggcgagaatgatggccgcagcgcgcgacgcgctggcgccattcagtaaagatgcgccgttgctcattgccgtgaccgtgttgaccagtatgggaaccagcgatctacacgatctgggcgtgacgttgtcaccggcggaacatgcggagcggctggcgcgcctgacgcagcaatgcgggctggatggcgtggtctgttccgctcaggaagctgtcagatttaaacaggcctttggcgctgcatttaagctggtgacgccgggcattcggcccgcaggcagcgaggcaggcgaccagcgacgcattatgacgcccgaacaggcattatccgctggcgtcgactatatggtgattggccgcccggttacgcaatcggtagatccggcgcaaacgctgaaggatattaacgcgtcactgaaacgggaggcataa

SEQ ID NO: 17009 - protein, 245 aa, Salmonella typhi
MTFTASSSSCAITESPVVVALDYHERDKALAFVDKIDPRDCRLKVGKEMFTLFGPQLVRDLQQRGFDVFLDLKFHDIPNTTARAVAAAADLGVWMVNVHASGGARMMAAARDALAPFSKDAPLLIAVTVLTSMGTSDLHDLGVTLSPAEHAERLARLTQQCGLDGVVCSAQEAVRFKQAFGAAFKLVTPGIRPAGSEAGDQRRIMTPEQALSAGVDYMVIGRPVTQSVDPAQTLKDINASLKREA

SEQ ID NO: 17010 - DNA, 738 bp, Salmonella typhimurium
  CDS (1)..(738): transl_table=11
atgacgtttactgcttcatcttcttcctgcgctattactgaatcgcctgtcgttgtggcgttggattaccatgaacgcgataaagccctggcgtttgtcgataaaatcgatcctcgcgattgtcgcttaaaagtgggcaaagagatgttcacgctgtttggtccacagctcgttcgggatctccagcaacgtgggtttgatgtctttcttgatctaaaatttcatgatattcccaacaccacggcccgggcggtcgccgctgcggcagacctgggcgtctggatggtaaacgttcacgcgtctggcggggcgagaatgatggccgcagcgcgcgacgcgctggcgccattcagtaaagatgcgccgttgctcattgccgtgaccgtgttgaccagtatggaaaccagcgatctacacgatctgggcgtgacgttgtcaccggcggaacatgcggagcggctggcgcgcctgacgcagcaatgcgggctggatggcgtggtctgttccgctcaggaagctgtcagatttaaacaggcctttggcgctgcatttaagctagtgacgccgggcattcggcccgcaggcagcgaggcaggcgaccagcgacgcattatgacgcccgaacaggcattatccgctggcgttgactatatggtgattggccgcccggttacgcaatcggtagatccggcgcaaacgctgaaggatattaacgcgtcactgaaacgggaggcataa

SEQ ID NO: 17011 - protein, 245 aa, Salmonella typhimurium
MTFTASSSSCAITESPVVVALDYHERDKALAFVDKIDPRDCRLKVGKEMFTLFGPQLVRDLQQRGFDVFLDLKFHDIPNTTARAVAAAADLGVWMVNVHASGGARMMAAARDALAPFSKDAPLLIAVTVLTSMETSDLHDLGVTLSPAEHAERLARLTQQCGLDGVVCSAQEAVRFKQAFGAAFKLVTPGIRPAGSEAGDQRRIMTPEQALSAGVDYMVIGRPVTQSVDPAQTLKDINASLKREA

SEQ ID NO: 17012 - DNA, 795 bp, Schizosaccharomyces pombe
  CDS (1)..(795)
atggatgctagagtatttcaaagctattcagctagagctgaggggatgaaaaatcccattgccaaggaattgttggctttgatggaagaaaagcaaagcaacttgtcagtcgcggtcgatttgacgaagaaatccgaaatcttagaattggtagataaaattggaccctatgtctgtgttatcaagacacatattgacgttgtcgaggatttcgaccaggatatggtagaaaaactggtggccttaggtaaaaagcatcgttttcttatctttgaggatcgcaaattcgcagacattggaaataccgtcaagctacaatatgcatctggtgtgtacaaaattgcttcttgggctcatatcacaaattgccatacagtgccaggcgagggtattatacaaggcctcaaagaagttggtttacctttgggacgtggtctcttgcttttggctgaaatgtcttccaaaggctctttggctactggttcctacacagagaaaaccttagaatggtttgagaagcataccgatttttgctttggctttatagctggtcgtcgatttcctaaccttcaaagcgactacataactatgtcccctggtatcggcttggatgttaaaggagacgggctgggacagcaatatcgtactcctgaagaagtgattgtaaactgcggtagcgatatcatcattgttggtcgtggagtctatggagctggtcgtaatcctgttgtcgaagccaagagatatagagaagctggttggaaggcatatcagcaaagactttctcagcattaa

SEQ ID NO: 17013 - protein, 264 aa, Schizosaccharomyces pombe
MDARVFQSYSARAEGMKNPIAKELLALMEEKQSNLSVAVDLTKKSEILELVDKIGPYVCVIKTHIDVVEDFDQDMVEKLVALGKKHRFLIFEDRKFADIGNTVKLQYASGVYKIASWAHITNCHTVPGEGIIQGLKEVGLPLGRGLLLLAEMSSKGSLATGSYTEKTLEWFEKHTDFCFGFIAGRRFPNLQSDYITMSPGIGLDVKGDGLGQQYRTPEEVIVNCGSDIIIVGRGVYGAGRNPVVEAKRYREAGWKAYQQRLSQH

SEQ ID NO: 17014 - DNA, 696 bp, Shewanella oneidensis
  CDS (1)..(696): transl_table=11
atgacgactaaacctatcctcgtagcgcttgattacgataataaaaaccatgctttacaattgatagatcaactcgatcccaacatgtgtcgcctgaaagtcggcaaagaaatgtttaccctgtttggcccacaactggtgaaagatatccacgaacgtggctttgatcttttccttgacttaaagtttcacgatattcccaatactgttgctaaagcagtcactgctgcagcggaacttggcgtgtggatgacaaacgtccatgccagcggtggcttggccatgatggaagcggcaaaaaaggctttgcagccatacggtaaagaggcgccaatgctgattgccgtgacggtattaacctcaatgagcgatgaagaccttaaattgataggtattgatgtgcctgcatttgagcatgttcagcgtttagctaaattgactaaacaggcagaacttgatggtgttgtctgttcggcccaagaggcgagcatacttaagtcactattaggtcaagactttaaattgattaccccaggcattcgacctgtcggtagtgatgttggtgaccaacaccgcgtgatgacgccgcctgaggcgcttgccgccggtgctgattatttagtgattggtcgtccgatcactaaggcgactgatcctctggctgcgctgcaggccattcaccagtcattggtttag

SEQ ID NO: 17015 - protein, 231 aa, Shewanella oneidensis
MTTKPILVALDYDNKNHALQLIDQLDPNMCRLKVGKEMFTLFGPQLVKDIHERGFDLFLDLKFHDIPNTVAKAVTAAAELGVWMTNVHASGGLAMMEAAKKALQPYGKEAPMLIAVTVLTSMSDEDLKLIGIDVPAFEHVQRLAKLTKQAELDGVVCSAQEASILKSLLGQDFKLITPGIRPVGSDVGDQHRVMTPPEALAAGADYLVIGRPITKATDPLAALQAIHQSLV

SEQ ID NO: 17016 - DNA, 738 bp, Shigella flexneri
  CDS (1)..(738): transl_table=11
atgacgttaactgcttcatcttcttcccgcgccgttacgaattctcctgtggttgttgcccttgattatcataattgtgatgacgcgctgtcctttgtcgacaagatcgacccacgcgattgtcgtctgaaggtcggtaaagagatgtttacattgtttgggccacagtttgtgcgcgaacttcaacagcgtggttttgatatctttcttgacctgaaattccacgatatccccaacactgcagcgcacgctgtcgctgctgcagctgacttaggcgtgtggatggtgaatgttcatgcctccggtggggcgcgtatgatgaccgcagcgcgtgaggcactggttccgtttggcaaagatgcaccgcttttgattgctgtgacagtgttgaccagcatggaagccagcgacctggccgatcttggcgtgacactgtcacctgcagattatgcagaacgtctggcagcactgacgcaaaaatgtgaccttgatggtgtggtgtgttctgctcaggaagctgtgcgctttaaacaggtattcggtcaggagttcaaactggttacaccgggcattcgtccgcaggggagtgaagctggtgaccagcgccgcattatgacgccagaacaggcgttggcggctggtgttgattatatggtgattggtcgcccggtaacgcaatcggtagatccagcgcagacactgaaagcgatcaacgcctctttacagcggagtgcatga

SEQ ID NO: 17017 - protein, 245 aa, Shigella flexneri
MTLTASSSSRAVTNSPVVVALDYHNCDDALSFVDKIDPRDCRLKVGKEMFTLFGPQFVRELQQRGFDIFLDLKFHDIPNTAAHAVAAAADLGVWMVNVHASGGARMMTAAREALVPFGKDAPLLIAVTVLTSMEASDLADLGVTLSPADYAERLAALTQKCDLDGVVCSAQEAVRFKQVFGQEFKLVTPGIRPQGSEAGDQRRIMTPEQALAAGVDYMVIGRPVTQSVDPAQTLKAINASLQRSA

SEQ ID NO: 17018 - DNA, 693 bp, Staphylococcus aureus
  CDS (1)..(693): transl_table=11
atgaaagatttaccaattattgcattagattttgaatcaaaagaaaaagtaaatcaatttttagatttatttgatgaatcattattcgtaaaagtaggtatggaacttttttatcaagaaggtcctcaattaattaatgagataaaagaaagaggccatgatgtatttttagatttaaaactgcatgatattcctaatacagttggtaaggcgatggaaggactagctaaattgaatgttgatctggtaaatgttcatgctgctggtggcgtaaaaatgatgtctgaggccattaaaggattaagaaaacataatcaacatacaaaaattattgcagtaacacagcttacgtcaacaacagaagacatgttacgacacgaacaaaatatacaaacatcgattgaagaggccgttttaaattatgccaagttagcaaatgcagctggtttagatggcgttgtttgttcacctcttgaaagtcgtatgttgactgaaaagttaggtacatcatttttaaaagtaacaccaggtattagacctaaaggtgcatctcaagatgaccaacaccgtattacgacaccggaagaagcaagacagcttggttcgacgcatattgtagtcggtagaccgattacacaaagtgacaatccagtcgaaagttatcataaaattaaagaaagttggttagtataa

SEQ ID NO: 17019 - protein, 230 aa, Staphylococcus aureus
MKDLPIIALDFESKEKVNQFLDLFDESLFVKVGMELFYQEGPQLINEIKERGHDVFLDLKLHDIPNTVGKAMEGLAKLNVDLVNVHAAGGVKMMSEAIKGLRKHNQHTKIIAVTQLTSTTEDMLRHEQNIQTSIEEAVLNYAKLANAAGLDGVVCSPLESRMLTEKLGTSFLKVTPGIRPKGASQDDQHRITTPEEARQLGSTHIVVGRPITQSDNPVESYHKIKESWLV

SEQ ID NO: 17020 - DNA, 699 bp, Staphylococcus epidermidis
  CDS (1)..(699): transl_table=11
atgagtgtgagaaatctacccattatagcattagattttaaatcagcagacgaggttcatacatttttaaataaatttaatgaaccgttatgcgtcaaaattgggatggagttattttatcaaacagggccagctttaattaagtccattaaaaaaagaggtcatgatatctttttagatttaaaattacatgacatacctaatactgtgagtaaagcaatggaaggcttagcacgtttagatgtagatttagtcaatgttcatgctgccggtggtattaaaatgatggaagaagctaaaaaagggttaagaaaacataatgctgatattaaaatcattgcagttactcaattaacttcaactactgaaacacaattacatgaagaacaaaatattcaaacctcaatagaggaggcagttttaaattatgctcgtcttactaaaaaagctggtttagacggtgtcgtatgttctcctcttgaggctgagatgatttctaaagaactaggtactgactttttaaaagtgacaccaggtattcgcccgaaaggcgcagctcgtaatgatcaacaacgaattacaacaccagaggaagctaaaaccttggggtcaacacatatcgtagtaggtcgacctatcactcaaagtgagcatccaattgacagttatcataaaataaaagaaagttggttaagttaa

SEQ ID NO: 17021 - protein, 232 aa, Staphylococcus epidermidis
MSVRNLPIIALDFKSADEVHTFLNKFNEPLCVKIGMELFYQTGPALIKSIKKRGHDIFLDLKLHDIPNTVSKAMEGLARLDVDLVNVHAAGGIKMMEEAKKGLRKHNADIKIIAVTQLTSTTETQLHEEQNIQTSIEEAVLNYARLTKKAGLDGVVCSPLEAEMISKELGTDFLKVTPGIRPKGAARNDQQRITTPEEAKTLGSTHIVVGRPITQSEHPIDSYHKIKESWLS

SEQ ID NO: 17022 - DNA, 702 bp, Streptococcus agalactiae serotype III
  CDS (1)..(702): transl_table=11
atgttagaaaaatgccctatcatcgccttagatttttctgatttggcttctgtaacaacttttttagaacattttccaaaagaagaattgctttttgtcaaaataggaatggagctttattattccgaaggtccctcaattattagatatattaaatccttaggacatcgcatttttttggatttaaaattacatgatatccctaatacagttcgatcatctatgtctgtcttagccaaattaggcattgatatgactaatgtgcatgctgcaggaggagtcgaaatgatgaaagcagctagagaaggtttgggggagggtccaatactattagcagtgacacaattaacctcgacttcacaagaacaaatgcaggtggatcaacatattaacttaagtgtagttgattcggtttgccattatgctcaaaaagctcaagaagcaggcttagatggagtagtcgcatcggctcaagaggtaaagcaaatcaagaaacagactaacgaacatttcatttgcttaacgcctggtatcagacctccacaaaccaatcagttagatgatcaaaaaagaacgatgactcctgagcaagcacgtatagttggggctgattatatcgttgtgggaagacctataacgaaagcagaaaatccatatcaagcatatctagagataaaagaagaatggaatcgtattaaataa

SEQ ID NO: 17023 - protein, 233 aa, Streptococcus agalactiae serotype III
MLEKCPIIALDFSDLASVTTFLEHFPKEELLFVKIGMELYYSEGPSIIRYIKSLGHRIFLDLKLHDIPNTVRSSMSVLAKLGIDMTNVHAAGGVEMMKAAREGLGEGPILLAVTQLTSTSQEQMQVDQHINLSVVDSVCHYAQKAQEAGLDGVVASAQEVKQIKKQTNEHFICLTPGIRPPQTNQLDDQKRTMTPEQARIVGADYIVVGRPITKAENPYQAYLEIKEEWNRIK

SEQ ID NO: 17024 - DNA, 702 bp, Streptococcus agalactiae serotype V
  CDS (1)..(702): transl_table=11
atgttagaaaaatgccctatcattgccttagatttttctgatttggcttctgtaacaacttttttagaacattttccaaaagaagaattgctttttgtcaaaataggaatggagctttattattccgaaggtccctcaattattagatatattaaatccttaggacatcgcatttttttggatttaaaattacatgatatccctaatacagttcgatcatctatgtctgtcttagccaaattaggcattgatatgactaatgtgcatgctgcaggaggagtcgaaatgatgaaagcagctagagaaggtttggggaagggtccaatactattagcagtgacacaattaacctcgacttcacaagaacaaatgcaggtggatcaacatattaacttaagtgtagttgattcggtttgccattatgctcaaaaagctcaagaagcaggcttagatggagtagtcgcatcggctcaagagggaatgcaaatcaagaaacagactaacgaacatttcatttgcttaacgcctggtatcagacctccacaaaccaatcagttagatgatcaaaaaagaacgatgactcctgagcaagcacgtatagttggggctgattatatcgttgtgggaagacctataacgaaagcagaaaatccatatcaagcatatctagagataaaagaagaatggaatcgtattaaataa

SEQ ID NO: 17025 - protein, 233 aa, Streptococcus agalactiae serotype V
MLEKCPIIALDFSDLASVTTFLEHFPKEELLFVKIGMELYYSEGPSIIRYIKSLGHRIFLDLKLHDIPNTVRSSMSVLAKLGIDMTNVHAAGGVEMMKAAREGLGKGPILLAVTQLTSTSQEQMQVDQHINLSVVDSVCHYAQKAQEAGLDGVVASAQEGMQIKKQTNEHFICLTPGIRPPQTNQLDDQKRTMTPEQARIVGADYIVVGRPITKAENPYQAYLEIKEEWNRIK

SEQ ID NO: 17026 - DNA, 693 bp, Streptococcus mutans
  CDS (1)..(693): transl_table=11
atgcgtgaaccccgtcccttaattgctcttgattttccttcttttgatgatgtgaaatccttcttagcacaattcccaccagaagagaaactttatgttaaaattggtatggaactctattatgctgtcggtccagagattgtgcgctatgtgaaaggtcttggccattcggtctttcttgatttaaaattgcatgatattcccaatacggtcaaatcagctatgaaggtgctatctgatcttggtgtagatatgactaatgttcatgcggctggcggtgttgaaatgatgaaggcagcgcgtgaaggtttgggaaaaggtccaaaactgatcgcggtgacccaattaacttcaacgtctgaagaacagatgcatgatttccaaaacattcaaaccagcttagcggagtcagttgttcattatgccaagaagactgcggaagctggtcttgatggagttgtctgctctgctcatgaagtggaagccatcaaatcagccacgtcgaatgattttgtctgtctaacaccgggtattcgtccagcgggctctgccattggtgaccaaaaacgcatcatgacaccagcagacgcacgtaccattggttcagactatatcgtgctaggacgccctatcacgcgagcagaggatccaatagccgcctatcaagcgattaaagctgaatggaatggctag

SEQ ID NO: 17027 - protein, 230 aa, Streptococcus mutans
MREPRPLIALDFPSFDDVKSFLAQFPPEEKLYVKIGMELYYAVGPEIVRYVKGLGHSVFLDLKLHDIPNTVKSAMKVLSDLGVDMTNVHAAGGVEMMKAAREGLGKGPKLIAVTQLTSTSEEQMHDFQNIQTSLAESVVHYAKKTAEAGLDGVVCSAHEVEAIKSATSNDFVCLTPGIRPAGSAIGDQKRIMTPADARTIGSDYIVLGRPITRAEDPIAAYQAIKAEWNG

SEQ ID NO: 17028 - DNA, 693 bp, Streptococcus pyogenes serotype M3
  CDS (1)..(693): transl_table=11
atgaaagaagaacgcccaattattgctttagacttttcatcatttgaggagactaaagcatttttagacttatttccagcagaagaaaagctatacgtgaaaattggtatggaattatattatgcgcaaggaccagatattgttcggtctatcaaatcgttagggcataatgtatttttggatttaaaattacatgatattccaaatactgttcgtgctgctatggcagttcttaaagaattagatattgatatggcaactgttcatgcagctggtggtgtagagatgctaaaagcagctcgagaaggactaggccaaggccctaccttaattgcggtaacgcagctaacttcaaccagtgaagaccaaatgcgtggtgatcaaaatattcaaacgagtcttttagagtctgttttgcattacagcaagggggcagctaaagctcagctagatggggtggtttgttcggcacaagaagtagaagctatcaaggcggtgacgcctacgggatttacttgcttaactcctggcattcgtcctaaaggcagtaatattggcgatcaaaaacgagtgatgactccaaaccaagcaagacgcattggaagtgattatattgtggtagggcgaccaattacccaggcaaaagacccagtggctgcttaccaagccataaaagctgagtgggcaggctaa

SEQ ID NO: 17029 - protein, 230 aa, Streptococcus pyogenes serotype M3
MKEERPIIALDFSSFEETKAFLDLFPAEEKLYVKIGMELYYAQGPDIVRSIKSLGHNVFLDLKLHDIPNTVRAAMAVLKELDIDMATVHAAGGVEMLKAAREGLGQGPTLIAVTQLTSTSEDQMRGDQNIQTSLLESVLHYSKGAAKAQLDGVVCSAQEVEAIKAVTPTGFTCLTPGIRPKGSNIGDQKRVMTPNQARRIGSDYIVVGRPITQAKDPVAAYQAIKAEWAG

SEQ ID NO: 17030 - DNA, 693 bp, Streptococcus pyogenes serotype M6
  CDS (1)..(693): transl_table=11
atgaaagaagaacgcccaattattgctttagacttttcatcatttgaggagactaaagcatttttagacttatttccagcagaagaaaagctatacgtgaaaattggtatggaattatattatgcgcaaggaccagatattgttcggtatatcaaatcgttagggcataatgtatttttggatttaaaattacatgatattccaaatactgttcgtgctgctatggcagttcttaaagaattagatattgatatggcaactgttcatgcagctggtggtgtagagatgctaaaagcagctcgagaaggactaggtcaaggccctaccttaattgcggtaacgcagctaacttcaaccagtgaagaccaaatgcgtggtgatcaaaatattcaaacgagtcttttagagtctgttttgcattacagcaagggggcagctaaagctcagctagatggggtggtttgttcggcacaagaagtagaagctatcaaggcggtgacacctacgggatttacttgcttaactcctggcattcgtcctaaaggcagtaatattggcgatcaaaaacgagtgatgactccaaaccaagcaagacgcattggaagtgattatattgtggtagggcgaccaattacccaggcaaaagacccagtggctgcttaccaagccataaaagctgagtgggcaggctaa

SEQ ID NO: 17031 - protein, 230 aa, Streptococcus pyogenes serotype M6
MKEERPIIALDFSSFEETKAFLDLFPAEEKLYVKIGMELYYAQGPDIVRYIKSLGHNVFLDLKLHDIPNTVRAAMAVLKELDIDMATVHAAGGVEMLKAAREGLGQGPTLIAVTQLTSTSEDQMRGDQNIQTSLLESVLHYSKGAAKAQLDGVVCSAQEVEAIKAVTPTGFTCLTPGIRPKGSNIGDQKRVMTPNQARRIGSDYIVVGRPITQAKDPVAAYQAIKAEWAG

SEQ ID NO: 17032 - DNA, 693 bp, Streptococcus pyogenes serotype M18
  CDS (1)..(693): transl_table=11
atgaaagaagaacgcccaattattgctttagacttttcatcatttgaggagactaaagcatttttagacttatttccagcagaagaaaagctatacgtgaaaattggtatggaattatattatgcgcaaggaccagatattgttcggtatatcaaatcgttagggcataatgtatttttggatttaaaattacatgatattccaaatactgttcgtgctgctatggcagttcttaaagaattagatattgatatggcaactgttcatgcagctggtggtgtagagatgctaaaagcagctcgagaaggactaggtcaagaccctaccttaattgcggtaacgcagctaacttcaaccagtgaagaccaaatgcgtggtgatcaaaatattcaaacgagtcttttagagtctgttttgcattacagcaagggggcagctaaagctcagctagatggggtggtttgttcggcacaagaagtagaagctatcaaggcggtgacacctacgggatttacttgcttaactcctggcattcgtcctaaaggcagtaatattggcgatcaaaaacgagtgatgactccaaaccaagcaagacgcattgaaagtgattatattgtggtagggcgaccaattacccaggcaaaagacccagtggctgcttaccaagccataaaagctgagtgggcaggctaa

SEQ ID NO: 17033 - protein, 230 aa, Streptococcus pyogenes serotype M18
MKEERPIIALDFSSFEETKAFLDLFPAEEKLYVKIGMELYYAQGPDIVRYIKSLGHNVFLDLKLHDIPNTVRAAMAVLKELDIDMATVHAAGGVEMLKAAREGLGQDPTLIAVTQLTSTSEDQMRGDQNIQTSLLESVLHYSKGAAKAQLDGVVCSAQEVEAIKAVTPTGFTCLTPGIRPKGSNIGDQKRVMTPNQARRIESDYIVVGRPITQAKDPVAAYQAIKAEWAG

SEQ ID NO: 17034 - DNA, 702 bp, Streptococcus pneumoniae
  CDS (1)..(702): transl_table=11
atgcgagaacatcgtccaatcattgctcttgattttcctagttttgaggcggtcaaggaatttttagctcttttcccagcagaagaaagcctttatctcaaggtagggatggagctttattacgcagcggggcctgagattgtgtcctacttaaaaggtttgggtcatagtgtctttttggatctcaaacttcatgacattcctaatacagtcaagtcagccatgaagatcttgtctcagcttggtgtcgatatgactaatgtccatgcggctggtggtgtagagatgatgaaggcggcgcgtgaaggtcttgggagtcaagccaaattgatcgctgtaactcagctcacatcaacgtcagaagctcagatgcaggagtttcaaaatatccaaaccagtctgcaagagtctgtgattcactatgccaagaagacagctgaagctggcttggatggtgttgtttgctcggctcaggaagtacaagtcatcaagcaggctaccaatccagattttatctgtctgacaccagggattcgtccagctggtgttgcagttggagatcaaaaacgagtcatgacacctgctgatgcctatcaaatcggcagtgactatatcgtagtgggacgtcccattacccaagctgaggatcctgttgcagcttatcatgccatcaaggatgaatggacacaggactggaattaa

SEQ ID NO: 17035 - protein, 233 aa, Streptococcus pneumoniae
MREHRPIIALDFPSFEAVKEFLALFPAEESLYLKVGMELYYAAGPEIVSYLKGLGHSVFLDLKLHDIPNTVKSAMKILSQLGVDMTNVHAAGGVEMMKAAREGLGSQAKLIAVTQLTSTSEAQMQEFQNIQTSLQESVIHYAKKTAEAGLDGVVCSAQEVQVIKQATNPDFICLTPGIRPAGVAVGDQKRVMTPADAYQIGSDYIVVGRPITQAEDPVAAYHAIKDEWTQDWN

SEQ ID NO: 17036 - DNA, 702 bp, Streptococcus pneumoniae
  CDS (1)..(702): transl_table=11
atgcgagaacatcgtccaatcattgctcttgattttcctagttttgaggcggtcaaggaatttttagctcttttcccagcagaagaaagcctttatctcaaggtagggatggagctttattacgcagcggggcctgagattgtgtcctacttaaaaggtttgggtcatagtgtctttttggatctcaaacttcatgacattcctaatacagtcaagtcagccatgaagatcctatctcagcttggtgtggatatgaccaatgttcatgcggctggtggtgtagagatgatgaaggctgcgcgtgaaggtcttggaagtcaagctaaattgatcgctgtaactcagctcacatcaacgtcagaagctcagatgcaggagtttcaaaatatccaaaccagtctgcaagagtctgtgattcactatgccaagaagacagctgaagctggcttggatggtgttgtttgctcggctcaggaagtacaagtcatcaagcaggctaccaatccagattttatctgtctgacaccagggattcgtccagctggtgttgcagttggagatcaaaaacgagtcatgacacctgctgatgcctatcaaatcggcagtgactatatcgtagtgggacgtcccattacccaagctgaggagcctgttgcagcttatcatgccatcaaggatgaatggacacaggactggaattaa

SEQ ID NO: 17037 - protein, 233 aa, Streptococcus pneumoniae
MREHRPIIALDFPSFEAVKEFLALFPAEESLYLKVGMELYYAAGPEIVSYLKGLGHSVFLDLKLHDIPNTVKSAMKILSQLGVDMTNVHAAGGVEMMKAAREGLGSQAKLIAVTQLTSTSEAQMQEFQNIQTSLQESVIHYAKKTAEAGLDGVVCSAQEVQVIKQATNPDFICLTPGIRPAGVAVGDQKRVMTPADAYQIGSDYIVVGRPITQAEEPVAAYHAIKDEWTQDWN

SEQ ID NO: 17038 - DNA, 741 bp, Synechococcus sp
  CDS (1)..(741): transl_table=11
ttggctccgtcgctcgcttctggccccgccgatcggatcatcgtggcccttgatggcatggcgcccgagcaggcgctgaggtttgcggctcagctggacggactgcgctgggtgaaggtgggtctggaattgtttgtgcaggccggcccagaggtggtggctcagctgcgggagcaggggttgcgggtgttcctggatctcaaatttcacgacatccccgcgacgatggcaggagcctgccggagggcggcggcgttgggggcggagctgatcacggtgcatgcctgcgccggcagtgaagcgctcaaggcggcccaggccgcggcggtggagggggcccagcaggctggtctcaacccgcccacgctgctggcggtgacggtgctcaccagttgggaggagcagcgactgcaacgggaactcgccattcagcaatccattggcgagcgggtgccggcgttggcgcagctgtcggcaacggcaggcatcggtggttgtgtctgctcacccttggaggccgcggcgttgcgggcccagcaccccgaaccgtttgccctggtcacgccggggattcgccccaaaggttctgcggtgggcgatcaggcccgggtgatgggaccggctgaagcgatagctgccggcgcgagccagctggtgatcggccgtccgatcaccaaagctgacgatcccagcgctgcctttgcggcctgttgcacccagttgctgggatcgattgattga

SEQ ID NO: 17039 - protein, 246 aa, Synechococcus sp
MAPSLASGPADRIIVALDGMAPEQALRFAAQLDGLRWVKVGLELFVQAGPEVVAQLREQGLRVFLDLKFHDIPATMAGACRRAAALGAELITVHACAGSEALKAAQAAAVEGAQQAGLNPPTLLAVTVLTSWEEQRLQRELAIQQSIGERVPALAQLSATAGIGGCVCSPLEAAALRAQHPEPFALVTPGIRPKGSAVGDQARVMGPAEAIAAGASQLVIGRPITKADDPSAAFAACCTQLLGSID

SEQ ID NO: 17040 - DNA, 696 bp, Synechocystis sp
  CDS (1)..(696): transl_table=11
atgaccccagaccaagtaattgttgccctagatgtgccggatttacccaaggcgatcgccttagtggatcgtttgccaggggtaggtttttggaaggtggggctggaattatttgtgggggcggggccggtcattttggcggagttaaaagaccggggtaaaaggatttttttggatctgaaattccatgacattcccaatacgatgttgggggcctgcctgtctgccagtcggtacgaagtggatttactcactctccatgccactgcgggaagtcaagctttaaccttagccgcccaagccatggccccattgccccatcctcccaaactgttggccattaccttgctcactagcattggcgatcgccagttacgggaagagttacaacaacccttagccgtggatgattacgtcaacgccatggcccggttggcccgaaatgctggcattgatggagcggtgtgttccccccaggaagtggctaaactgaggcaaacctgcggccctgaatttttactggttacccccggcgtgcggcctctctggtcggccccaggcgatcaacaacgggtcatgattcccgcccaggcgatcgccgctggggccaattatgtggtcattggtcgacccatcactgctgatcctagtcccgaagccgcttgggaaagattatgccaagaccttgctgtttaa

SEQ ID NO: 17041 - protein, 231 aa, Synechocystis sp
MTPDQVIVALDVPDLPKAIALVDRLPGVGFWKVGLELFVGAGPVILAELKDRGKRIFLDLKFHDIPNTMLGACLSASRYEVDLLTLHATAGSQALTLAAQAMAPLPHPPKLLAITLLTSIGDRQLREELQQPLAVDDYVNAMARLARNAGIDGAVCSPQEVAKLRQTCGPEFLLVTPGVRPLWSAPGDQQRVMIPAQAIAAGANYVVIGRPITADPSPEAAWERLCQDLAV

SEQ ID NO: 17042 - DNA, 645 bp, Thermoplasma acidophilum
  CDS (1)..(645)
atgtcggaatcaaggcttgtggttgcactagacctcacggacaaggatagagccctggaaatagccagatccataggaagacaggtgttcgccataaagataaactggcccctggtcctggcaggatccggatcgataataggcgagatcgcaagggtgtcgcgggttgtctgtgacttcaagatagcagatataccgaacacgaacagcataatagcaaaatttgcgagggatcagggagcatggggcataatatcgcattcattcacaggccttgaatcactgagatcggtcgtcgaagcatctggcgatactaaggtcttctcggttgtggccatgtcgcatcccggttcggatctcattaacgacaattaccggaagctgatggatatatctgagagggcaggcgtctacggctatatagcgcctggcaataaattatccgacctgtctgaaatacggaagcgcacgaaaaagaccataatgtctccaggcataggatcgcagggaggaagggcatcggatgccataaaggccggcgcggatctggttatagtcggaagatccatatacgaaagtgcagatccggtgacagcagcagaagccataaacgaggaaatagcaaaggccgttgaacaaaactag

SEQ ID NO: 17043 - protein, 214 aa, Thermoplasma acidophilum
MSESRLVVALDLTDKDRALEIARSIGRQVFAIKINWPLVLAGSGSIIGEIARVSRVVCDFKIADIPNTNSIIAKFARDQGAWGIISHSFTGLESLRSVVEASGDTKVFSVVAMSHPGSDLINDNYRKLMDISERAGVYGYIAPGNKLSDLSEIRKRTKKTIMSPGIGSQGGRASDAIKAGADLVIVGRSIYESADPVTAAEAINEEIAKAVEQN

SEQ ID NO: 17044 - DNA, 606 bp, Thermotoga maritima
  CDS (1)..(606): transl_table=11
atgacacctgttctcagtctggacatggaagatcctatcagattcatcgacgaaaacggcagtttcgaagtggtgaaggtgggtcacaacctcgccatacacgggaaaaagatcttcgacgagctcgcaaagagaaatttgaagataatcctcgacctgaagttctgcgatatcccttcaacggtggaacgttccataaagagctgggatcacccggcgatcataggtttcacagttcactcctgcgctggatacgaaagcgtggagagggctctcagtgcaacagacaaacacgtgttcgttgtggtgaaactcacttccatggaaggatccctcgaggattacatggacaggatagaaaaactgaacaagcttgggtgtgatttcgtgcttcccggtccatgggcaaaggctctgagagagaagataaaaggcaaaattctcgttcccggcatcagaatggaagtgaaagcagacgatcaaaaggacgtcgtaacgctcgaagagatgaagggaatagcgaattttgctgtgctcggaagagagatctacctgagcgaaaatcccagagaaaagatcaaaaggataaaggagatgagactgtga

SEQ ID NO: 17045 - protein, 201 aa, Thermotoga maritima
MTPVLSLDMEDPIRFIDENGSFEVVKVGHNLAIHGKKIFDELAKRNLKIILDLKFCDIPSTVERSIKSWDHPAIIGFTVHSCAGYESVERALSATDKHVFVVVKLTSMEGSLEDYMDRIEKLNKLGCDFVLPGPWAKALREKIKGKILVPGIRMEVKADDQKDVVTLEEMKGIANFAVLGREIYLSENPREKIKRIKEMRL

SEQ ID NO: 17046 - DNA, 660 bp, Thermoplasma volcanium
  CDS (1)..(660): transl_table=11
gtggataagagaattatagtagccttggatgttaaggaaaagaaaaaagctatagatattgcagaaagcctatcggacattgtatttgcttttaagataaactggcccttagtactatattcatctcctgaggttataggtgaaatttcgcaatatggtaaggttatatgtgactttaaagtggcagatatcccttatacgaactcgctaataacagagagagttcgggatcttggtgcatggggaataatatctcactcgtttcttggagaagaatcccttaaatccgtggtcaatgcagctaaaggcatgcatgtattttcagttgtggctatgtcgcatcctggctcagatatgataaactccaatgctatgcaactaatgaaactatccatagaatgtggggtttacggatttgttgcccctgcaaacaagattgatgacctaagaatgatcaggtctgcaacggacagagtaataatatcgccaggaataggagcacagggaggtgatccgtacacagctgttctgaatggatcggattatttaatagtgggccggagcgtttatgaaagcgataagccagagttagaggtttcaaagcttcagcaaactgccgagagagctattgaggacagggagagacttaaaaacagttaa

SEQ ID NO: 17047 - protein, 219 aa, Thermoplasma volcanium
MDKRIIVALDVKEKKKAIDIAESLSDIVFAFKINWPLVLYSSPEVIGEISQYGKVICDFKVADIPYTNSLITERVRDLGAWGIISHSFLGEESLKSVVNAAKGMHVFSVVAMSHPGSDMINSNAMQLMKLSIECGVYGFVAPANKIDDLRMIRSATDRVIISPGIGAQGGDPYTAVLNGSDYLIVGRSVYESDKPELEVSKLQQTAERAIEDRERLKNS

SEQ ID NO: 17048 - DNA, 795 bp, Torulaspora delbrueckii
  CDS (1)..(795)
atgtcggttgctacttatcaagagagggctgcaaagcatccaagtcctgtggcttcaaaacttttgaatttgatgcatgaaaagaagaccaatctatgtgcttcattagatgtgaataccaccgaagaattgcttaaattagtcgatactctaggtccttacatctgtttgttgaaaacacacatcgatatcatttctgatttttccattgatggtactgtgaagcctttgaaagaattggccaaaaagcacaactttatgatctttgaggacaggaaattcgccgatatcggtaacactgtcaagctacagtattcttcaggtgtctacagaattgccgagtgggctgatattacaaacgcccatggtgtcactggtgctgggatcgtcactgggttgaaacaagcggctcaagagactacaaacgaaccaagaggtctattaatgttggctgaactatcttctaaaggttctttggcccatggtgaatacacccaaggtactgtcgaaattgctaagacagacaaagatttcgtcattggattcattgcccaaagagacatgggaggaagagaagaaggatatgactggctaatcatgacaccaggtgttggcctagacgacaagggcgatgcgctgggtcaacagtacagaactgtcgatgaagttgtctctacggggtcagacatcatcattgtcggcagaggacttttcgccaagggaagagatccaagagtagaaggcgaacgttaccgtaaagccggctgggaagcatacgagaagagatgccagtaa

SEQ ID NO: 17049 - protein, 264 aa, Torulaspora delbrueckii
MSVATYQERAAKHPSPVASKLLNLMHEKKTNLCASLDVNTTEELLKLVDTLGPYICLLKTHIDIISDFSIDGTVKPLKELAKKHNFMIFEDRKFADIGNTVKLQYSSGVYRIAEWADITNAHGVTGAGIVTGLKQAAQETTNEPRGLLMLAELSSKGSLAHGEYTQGTVEIAKTDKDFVIGFIAQRDMGGREEGYDWLIMTPGVGLDDKGDALGQQYRTVDEVVSTGSDIIIVGRGLFAKGRDPRVEGERYRKAGWEAYEKRCQ

SEQ ID NO: 17050 - DNA, 696 bp, Vibrio cholerae
  CDS (1)..(696): transl_table=11
atgaacgacccaaaagtgattgttgcactggactatgacaatctggcggatgcgctcgcgtttgtggacaaaattgacccaagcacatgtcgactcaaagtgggtaaagagatgtttactctatttggtcctgattttgtccgtgagctgcataaacgaggtttttctgtgtttctggatcttaaatttcacgatattccgaatacctgttcaaaagcggtgaaagctgccgctgagcttggggtttggatggtgaatgtgcacgcgagtggtggcgagcgaatgatggcagcatcgcgtgagattctggagccgtatggtaaagagcgcccactgctgattggtgtcactgtattgaccagtatggaatctgccgatttacaaggtattggcatcttgagtgcgccacaagatcatgtgctgcgattagcaacgctcaccaaaaatgctggtcttgatggtgtggtatgctccgcacaagaggcatcactattgaagcaacatttggggcgtgaattcaaattggtgacgccaggaattcgtccagcgggttcagagcaaggcgatcaacgccgtattatgactccagcccaagccattgcctctggttcagattatctcgtgatcggtcgccctatcactcaagccgcacatcctgaagtggttctggaagagataaacagctctttagtttag

SEQ ID NO: 17051 - protein, 231 aa, Vibrio cholerae
MNDPKVIVALDYDNLADALAFVDKIDPSTCRLKVGKEMFTLFGPDFVRELHKRGFSVFLDLKFHDIPNTCSKAVKAAAELGVWMVNVHASGGERMMAASREILEPYGKERPLLIGVTVLTSMESADLQGIGILSAPQDHVLRLATLTKNAGLDGVVCSAQEASLLKQHLGREFKLVTPGIRPAGSEQGDQRRIMTPAQAIASGSDYLVIGRPITQAAHPEVVLEEINSSLV

SEQ ID NO: 17052 - DNA, 702 bp, Vibrio parahaemolyticus
  CDS (1)..(702): transl_table=11
atgatcgaccaaaaagttattgtcgcactggattatgataaccaagctgatgcgctagcgtttgtagatagaattgatcctgcgtcatgtcgcctaaaagtcggcaaggaaatgtttacgctatttggtcctgattttgtacgtgaactccacaaacgtggtttttctgtattcctggatttgaaatttcatgatatcccgaatacctgttcaaaagcggtacgcgctgctgctgagttaggtgtatggatggtgaacgttcatgcaagcggtggtgagcgtatgatgacagcatcacgtgagattcttgagccatatggtaaagatcgtccacttctgattggtgtaacggtattgactagcatggaacaaagtgacttggcaggtattggtctgaatgttgaaccgcaagagcaagtgattcgtctagcgacattgactaagaactcaggtctcgatggcgtagtgtgctctgcgcaagaatcttcactacttaaaaatgagctaggtaaagagtttaaactgatcactccaggaattcgtcctgctggttctgatcaaggcgaccaacgtcgtattatgacgccagttgatgctattcaagcgggttctgactaccttgttattggccgtccgatcactcaggcgacggaccctgctgccgtattgaaatctatcaacgacagcttagctagcaagtaa

SEQ ID NO: 17053 - protein, 233 aa, Vibrio parahaemolyticus
MIDQKVIVALDYDNQADALAFVDRIDPASCRLKVGKEMFTLFGPDFVRELHKRGFSVFLDLKFHDIPNTCSKAVRAAAELGVWMVNVHASGGERMMTASREILEPYGKDRPLLIGVTVLTSMEQSDLAGIGLNVEPQEQVIRLATLTKNSGLDGVVCSAQESSLLKNELGKEFKLITPGIRPAGSDQGDQRRIMTPVDAIQAGSDYLVIGRPITQATDPAAVLKSINDSLASK

SEQ ID NO: 17054 - DNA, 699 bp, Vibrio vulnificus
  CDS (1)..(699): transl_table=11
atgatcgaccaaaaagttattgtcgcactggattacgataatcaagccgatgcactggccttcgtagatagaattgatcctgcgtcatgtcgcctaaaagtaggcaaggaaatgtttactctatttggtcctgatttcgtacgtgaacttcacaaacgtggtttttctgtatttctagatctgaagtttcacgatatcccaaatacatgctcaaaagccgttcgagcagcagctgagttgggtgtctggatggtgaatgtacatgcaagtggtggtgaacgcatgatgacagcatctcgtgagattcttgaaccttatggtaaagatcgcccgttactgattggtgtgaccgtactcaccagcatggagcaaagcgacctagcaggcattggtttggacgttgcaccacaagaacacgtgattcgcttagctacgttgacgaagaattctggtttggatggtgttgtgtgttctgctcaagaatcctctctgctgaagaatgagctgggcaaagagtttaaattggttacgccaggtattcgcccgctcggctcagaacaaggagatcaacgtcgtatcatgacaccacttgaagcggtacaagcaggttctgattaccttgttatcggacggccaattacgcaggcagtagatcctgcggcagtcttgcaagctataaatacaagcctaaccaaatag

SEQ ID NO: 17055 - protein, 232 aa, Vibrio vulnificus
MIDQKVIVALDYDNQADALAFVDRIDPASCRLKVGKEMFTLFGPDFVRELHKRGFSVFLDLKFHDIPNTCSKAVRAAAELGVWMVNVHASGGERMMTASREILEPYGKDRPLLIGVTVLTSMEQSDLAGIGLDVAPQEHVIRLATLTKNSGLDGVVCSAQESSLLKNELGKEFKLVTPGIRPLGSEQGDQRRIMTPLEAVQAGSDYLVIGRPITQAVDPAAVLQAINTSLTK

SEQ ID NO: 17056 - DNA, 699 bp, Vibrio vulnificus
  CDS (1)..(699): transl_table=11
atgatcgaccaaaaagttattgtcgcactggattacgataatcaagccgatgcactggccttcgtagatagaattgatcctgcgtcatgtcgcctaaaagtaggcaaggaaatgtttacgctatttggtcctgatttcgtacgtgaacttcacaaacgtggtttttctgtatttctagatctgaagtttcacgatatcccaaatacatgctcaaaagccgttcgagcagcagctgagttgggtgtctggatggtgaatgtacatgcaagtggtggtgaacggatgatgacagcatctcgtgagattcttgagccttatggtaaagatcgcccgttactgattggtgtgaccgtactcaccagcatggagcaaagcgacctagcaggcattggtttgaacgttgcaccacaagatcacgtgattcgcttagctacgttgacgaagaattctggtttggatggtgttgtgtgttctgcgcaagaatcctctctgctgaagaatgagctgggcaaagagtttaaattggttacgccaggtattcgcccgctcggctcagaacaaggtgatcaacgtcgtatcatgacaccacttgaagcggtacaagcaggttctgattaccttgttatcggacggccaattacgcaggcagtagatcctgcggcagtcttgcaagctataaatacaagcctaaccaaatag

SEQ ID NO: 17057 - protein, 232 aa, Vibrio vulnificus
MIDQKVIVALDYDNQADALAFVDRIDPASCRLKVGKEMFTLFGPDFVRELHKRGFSVFLDLKFHDIPNTCSKAVRAAAELGVWMVNVHASGGERMMTASREILEPYGKDRPLLIGVTVLTSMEQSDLAGIGLNVAPQDHVIRLATLTKNSGLDGVVCSAQESSLLKNELGKEFKLVTPGIRPLGSEQGDQRRIMTPLEAVQAGSDYLVIGRPITQAVDPAAVLQAINTSLTK

SEQ ID NO: 17058 - DNA, 699 bp, Wigglesworthia glossinidia brevipalpis
  CDS (1)..(699): transl_table=11
atgaaactatctccaattattgtagctttagattattctaacccaaaaaaagctatatctttttctaaaaagatttccccagatcaatgccaattaaaaattggacatgaattatttattaattcaggattttttttaatcaactttttacaaaaaaatggatttaaaatttttttagatttaaagctttacgacattcctaatacaataaaaaaaacaatattttcgctagcaaaatttggaatatggatggttaatgttcatgctagtggaggatataatatgatgactgctgctaaagatgctttgtcacatataaataatcctccaaaacttattgcagttacagttcttactagcatggaaaaatcagatttaagcaaatcaaaaatttttacaaaaataataaatcatgtaattcatttatctaataacgcttataaatgtggattagatggtattgtatgctccccttgggaagctgaaaaagtaagaaaaaaatttggaaataattttattattgtaactcctggaataaggtttaaaaatacaaattataatgatcaaaaaagagtaatgaatccatacgacgctataaaatctggatctaattatatagtgattggtagacctattactaaatcaagcaacccatatttattattagaaaaaattttatcaaaattaaataatatttag

SEQ ID NO: 17059 - protein, 232 aa, Wigglesworthia glossinidia brevipalpis
MKLSPIIVALDYSNPKKAISFSKKISPDQCQLKIGHELFINSGFFLINFLQKNGFKIFLDLKLYDIPNTIKKTIFSLAKFGIWMVNVHASGGYNMMTAAKDALSHINNPPKLIAVTVLTSMEKSDLSKSKIFTKIINHVIHLSNNAYKCGLDGIVCSPWEAEKVRKKFGNNFIIVTPGIRFKNTNYNDQKRVMNPYDAIKSGSNYIVIGRPITKSSNPYLLLEKILSKLNNI

SEQ ID NO: 17060 - DNA, 687 bp, Wolinella succinogenes
  CDS (1)..(687): transl_table=11
atgcagctctgcatcgcgcttgaccttcctagccaagaggagaatctaaagctcttggaatctcttgtggggcttcctgtgtggatcaaggtgggtttgaggagttatattcgcgatggaaaggagtttttagggagaatcaggcagattgatcctcgctttgaactctttcttgacttgaagctccatgatattcctaacaccatgggggatgcagctgaagaaatcgcctctttgggggtgggcatgttcacactccatgctagcagcggaggcgaggcgatgagagaggtggcggctcgtttggcgcgattccctaggcgtcccttggcttttgcggtgacggcgctcacgagttttggcgaggaagggtttagggagatttataacgcctctttggagagcaaagcgttggatatggcgatgttggcggctcaaaatggaatggatggtgtggtctgttcagtttttgaaagtcagagaatcaaatcctatgtcgcccaggattttctaaccctcactccgggaatccgcccctttggagagccaagtggcgatcagaagcgtgtggcggatctccatgaggctaaaagcgcctccagcgattttattgtcgtgggacgacccgtctacaagcatcctcgccctagagaggcggtagagaagattctagagggaatcgcctag

SEQ ID NO: 17061 - protein, 228 aa, Wolinella succinogenes
MQLCIALDLPSQEENLKLLESLVGLPVWIKVGLRSYIRDGKEFLGRIRQIDPRFELFLDLKLHDIPNTMGDAAEEIASLGVGMFTLHASSGGEAMREVAARLARFPRRPLAFAVTALTSFGEEGFREIYNASLESKALDMAMLAAQNGMDGVVCSVFESQRIKSYVAQDFLTLTPGIRPFGEPSGDQKRVADLHEAKSASSDFIVVGRPVYKHPRPREAVEKILEGIA

SEQ ID NO: 17062 - DNA, 732 bp, Xanthomonas axonopodis pv
  CDS (1)..(732): transl_table=11
atgagccgcgcgccattgccgctggccgcacatgagcggctgatcttcgcgctggatgtgcccagccacgaccaagcaatcgcctgggtggaccggctcggcgattcggtgtcgttctacaagatcggcatggagctgctggcatcgggcgagtacttccacgtgctcgatgcgctggccaagcgcgacaagcgcgtgttcgtggacctcaagttcttcgacattcctgccaccgtggccggcacgattcgccgcctggcgcagtggccggtgagctattgcaccgtgcacggctggcacgccggcatgctgcaggctgccgccgaagccaaccacggcgacatgcgcctgctggcggtcacggtgctgacgtcgatgggccgcccggacctggtggcaatgggcatcgaccgcgaaccggtggacgtggtggtggagcgcgcgctggccgcacgggccgccgggatcgatggcgtgatcgcttccgggcaggaagccggcccgatccgccgtgccaccggtccggacttttcgatcgtctgccccggcatccgccccggcggcccggtcggcgacgaccagcaacgcacggtcggcgtggctcaggcatttatcgacggcgccgacgcgatcgtcgttggccgcccgatccgcctggcgagcgatcctgcagcggcggctgacgccatccaggcggagatccgcgcggcactgatgcagaacggagactaa

SEQ ID NO: 17063 - protein, 243 aa, Xanthomonas axonopodis pv
MSRAPLPLAAHERLIFALDVPSHDQAIAWVDRLGDSVSFYKIGMELLASGEYFHVLDALAKRDKRVFVDLKFFDIPATVAGTIRRLAQWPVSYCTVHGWHAGMLQAAAEANHGDMRLLAVTVLTSMGRPDLVAMGIDREPVDVVVERALAARAAGIDGVIASGQEAGPIRRATGPDFSIVCPGIRPGGPVGDDQQRTVGVAQAFIDGADAIVVGRPIRLASDPAAAADAIQAEIRAALMQNGD

SEQ ID NO: 17064 - DNA, 732 bp, Xanthomonas campestris pv
  CDS (1)..(732): transl_table=11
atgaaccgtcccccgttaccgctggccgcgcacgatcggctgatctttgcgctggatgtgcccggccatgacgaggccatcgcctgggtggaccgtttgggcgagtcggtggcgttctacaagatcggcatggaattgctggcgtcgggcgagtacttccacgtgctcgatgcgctggccaagcgcaacaagcgcgtgttcgtcgacctgaagttcttcgacattcccgccaccgtcgccggcaccattcgccgcctgtcgcaatggccggtgagctattgcaccgtgcacggctggcacgccggcatgctggaagccgccgctgcggccaaccagggcgacatgcgcctgctcgcagtgaccgtgctgacctcaatgggccggccggacttggccgcgatgggcatcgaccgcgagccggtggacgtggtggtggagcgcgcgctggccgcccaagccgctggcatcgacggggtgatcgcctcgggccaggaagcgggcatgatccgccgcgccaccggcccggccttttcgatcgtctgccccggtatccgccccggcggcccggtcggcgatgaccagcagcgcaccgtgggcgtggcgcaggccttcgccgatggcgcagatgccattgtggtcggccgcccgatccgcctggccaacgaccccgccgccgccgccgccgccatccaggccgaaatccgcgcggccgtggtgcagcaccgggattga

SEQ ID NO: 17065 - protein, 243 aa, Xanthomonas campestris pv
MNRPPLPLAAHDRLIFALDVPGHDEAIAWVDRLGESVAFYKIGMELLASGEYFHVLDALAKRNKRVFVDLKFFDIPATVAGTIRRLSQWPVSYCTVHGWHAGMLEAAAAANQGDMRLLAVTVLTSMGRPDLAAMGIDREPVDVVVERALAAQAAGIDGVIASGQEAGMIRRATGPAFSIVCPGIRPGGPVGDDQQRTVGVAQAFADGADAIVVGRPIRLANDPAAAAAAIQAEIRAAVVQHRD

SEQ ID NO: 17066 - DNA, 735 bp, Xylella fastidiosa
  CDS (1)..(735): transl_table=11
atgatgaatcacacgccgttattactggggatccgcgagcggttgatcttcgcactagacgtacccagtcggacgcaagcattggaatggatcgaccgattgggtgatgccatctccttctataagatcggcatggaattgttggcttccggcgaatatttccaggtactcgacgacttggcttcgtgtggcaaacgcgtcttcgtcgacctgaaattcttcgacatccccgctacagtcgcaggagtcatccgtcgtctttcgcagtggcccatcagctattgcacaatccatggctggcacgcgcccatgatgcaagcggcgaccgaagccaataccagcaacatgcatttactggcagtcaccgtgctgacatccatgacacgtgcagatttagcgaagatgggtatcgaccgcgaacccgttgatgtcgtgattgaacgtgcattagccgcccacatggcggggatgagtggtgtgattgcttctggacaggaagcagcagcaatccgccgcgccgtcggctctggattctcaatcgtttgtccaggcattcgcacaaaccatgtgcctcacaatgaccaacaacgcacgatgagcatcacggctgcttttgccaacggtgcagatgcgattgtggtgggacgcccaatccgaatggcagaggatccgcaagcggcagcagaggctatgcaaacagaaatcatgacggcactcactgagccatcaacataa

SEQ ID NO: 17067 - protein, 244 aa, Xylella fastidiosa
MMNHTPLLLGIRERLIFALDVPSRTQALEWIDRLGDAISFYKIGMELLASGEYFQVLDDLASCGKRVFVDLKFFDIPATVAGVIRRLSQWPISYCTIHGWHAPMMQAATEANTSNMHLLAVTVLTSMTRADLAKMGIDREPVDVVIERALAAHMAGMSGVIASGQEAAAIRRAVGSGFSIVCPGIRTNHVPHNDQQRTMSITAAFANGADAIVVGRPIRMAEDPQAAAEAMQTEIMTALTEPST

SEQ ID NO: 17068 - DNA, 735 bp, Xylella fastidiosa
  CDS (1)..(735): transl_table=11
atgatgaatcacacgccgttattactggggatccgcgagcggttgatcttcgcactagacgtacccagtcgaacgcaagcattggaatggatcgaccaattgggtgatgccatctccttctataagatcggcatggaattgttggcttccggcgaatatttccaggtactcgacgacttggcttcgcgtggcaaacgtgtcttcgtcgacctaaaattcttcgacatccccgctacagtcgcaggagtcatccgtcgtctttcgcagtggcccatcagctattgcacaatccatggctggcacgcgcccatgatgcaagcggcgaccgaagccaatacgagcaacatgcatttactggcagttaccgtgctgacatcgatgacacgtgaagatttagcgaagatgggtatcaaccgcgaacccgttgatgtcgtggttgaacgtgcattagccgcccacatggcggggatgagcggtgtgattgcttctggacaggaagcagcagcaatccgccacgccatcggctctggtttctcaatcgtttgcccaggcattcgcacaaaccatgtgcctcacaatgaccaacaacgcacgataggcatcaaggctgcttttgccaacggtgcagatgcgattgtggtgggacgcccaatccgaatggcgcaggatccgcaagcggcagcagaggctatgcaaacagaaatcatgacggcactcactgagccatcaacataa

SEQ ID NO: 17069 - protein, 244 aa, Xylella fastidiosa
MMNHTPLLLGIRERLIFALDVPSRTQALEWIDQLGDAISFYKIGMELLASGEYFQVLDDLASRGKRVFVDLKFFDIPATVAGVIRRLSQWPISYCTIHGWHAPMMQAATEANTSNMHLLAVTVLTSMTREDLAKMGINREPVDVVVERALAAHMAGMSGVIASGQEAAAIRHAIGSGFSIVCPGIRTNHVPHNDQQRTIGIKAAFANGADAIVVGRPIRMAQDPQAAAEAMQTEIMTALTEPST

SEQ ID NO: 17070 - DNA, 738 bp, Yersinia pestis
  CDS (1)..(738): transl_table=11
atgacgtccgcaactaaaactaataacagtggctcaatatcctccccaattgttgttgcgttggattatgccaataaagacgctgcgttagcctttgctgatcaggttagtccacaggattgccggttaaaagtgggcaaagagatgtttacgttgtacggccccgagcttatccgtgacttacatcagcgcggctttgacgtatttcttgatttgaaattccatgacatccctaatactaccgcgcgtgccgtggctgcggcagcagagttgggggtctggatggtcaatgttcatgccagtggcggtgcccgcatgatgtcggcggcgaaagaagccttgttgccttatggtgcacaagcccccttactgattgccgttactgtactgaccagcatggatggcgaagatctgcgggatatcggtattactatcagtccggctgagcaggccgagcggttagcgaaactgacctgggattgcggtttggatggcgtggtgtgctcggctcatgaagcggtgcgtttgaagcaagtttgtggcgaagacttctcgctcgttaccccaggtattcgcccacaaggcagtgaagccggtgaccagcggcggatcatgacacctgaacaggcggtagctgtaggtgttgattacatggtaatcggtcgcccaattacacaatctcctgatccggaaaaaacgctgcgcgaaatattggcatcactgacgaaggtggcataa

SEQ ID NO: 17071 - protein, 245 aa, Yersinia pestis
MTSATKTNNSGSISSPIVVALDYANKDAALAFADQVSPQDCRLKVGKEMFTLYGPELIRDLHQRGFDVFLDLKFHDIPNTTARAVAAAAELGVWMVNVHASGGARMMSAAKEALLPYGAQAPLLIAVTVLTSMDGEDLRDIGITISPAEQAERLAKLTWDCGLDGVVCSAHEAVRLKQVCGEDFSLVTPGIRPQGSEAGDQRRIMTPEQAVAVGVDYMVIGRPITQSPDPEKTLREILASLTKVA

SEQ ID NO: 17072 - DNA, 23 bp, Artificial sequence
  (1)..(23): primer
atgacgttaactgcttcatcttc

SEQ ID NO: 17073 - DNA, 24 bp, Artificial sequence
  (1)..(24): primer
ttatgcactccgctgtaaagaggc

SEQ ID NO: 17074 - protein, 292 aa, Artificial sequence
  Variant (2)..(2): xaa in position 2 is any amino acid
  Variant (7)..(26): xaa in position 7 to 26 is any amino acid
  Variant (27)..(36): xaa in position 27 to 36 is any or no amino acid
  Variant (40)..(41): xaa in position 40 to 41 is any amino acid
  Variant (43)..(46): xaa in position 43 to 46 is any amino acid
  Variant (48)..(50): xaa in position 48 to 50 is any amino acid
  Variant (52)..(53): xaa in position 52 to 53 is any amino acid
  Variant (55)..(58): xaa in position 55 to 58 is any amino acid
  Variant (59)..(97): xaa in position 59 to 97 is any or no amino acid
  Variant (100)..(100): xaa in position 100 is any amino acid
  Variant (104)..(105): xaa in position 104 to 105 is any amino acid
  Variant (108)..(108): xaa in position 108 is any amino acid
  Variant (111)..(125): xaa in position 111 to 125 is any amino acid
  Variant (126)..(130): xaa in position 126 to 130 is any or no amino acid
  Variant (133)..(135): xaa in position 133 to 135 is any amino acid
  Variant (137)..(137): xaa in position 137 is any amino acid
  Variant (138)..(139): xaa in position 138 to 139 is any or no amino acid
  Variant (141)..(148): xaa in position 141 to 148 is any amino acid
  Variant (149)..(164): xaa in position 149 to 164 is any or no amino acid
  Variant (169)..(170): xaa in position 169 to 170 is any amino acid
  Variant (174)..(184): xaa in position 174 to 184 is any amino acid
  Variant (185)..(196): xaa in position 185 to 196 is any or no amino acid
  Variant (198)..(203): xaa in position 198 to 203 is any amino acid
  Variant (206)..(206): xaa in position 206 is any amino acid
  Variant (210)..(213): xaa in position 210 to 213 is any amino acid
  Variant (215)..(217): xaa in position 215 to 217 is any amino acid
  Variant (220)..(222): xaa in position 220 to 222 is any amino acid
  Variant (223)..(232): xaa in position 223 to 232 is any or no amino acid
  Variant (239)..(244): xaa in position 239 to 244 is any amino acid
  Variant (245)..(250): xaa in position 245 to 250 is any or no amino acid
  Variant (253)..(260): xaa in position 253 to 260 is any or no amino acid
  Variant (262)..(264): xaa in position 262 to 264 is any amino acid
  Variant (267)..(268): xaa in position 267 to 268 is any amino acid
  Variant (274)..(274): xaa in position 274 is any amino acid
  Variant (276)..(277): xaa in position 276 to 277 is any amino acid
  Variant (279)..(279): xaa in position 279 is any amino acid
  Variant (280)..(284): xaa in position 280 to 284 is any or no amino acid
  Variant (286)..(291): xaa in position 286 to 291 is any amino acid
LXVALDXXXXXXXXXXXXXXXXXXXXXXXXXXXXXXKVGXXLXXXXGXXXVXXLXXXXXXXXXXXXXXXXXXXXXXXXXXXXXXXXXXXXXXXXXXXVFXDLKXXDIXNTXXXXXXXXXXXXXXXXXXXXVHXXXGXXXMXXXXXXXXXXXXXXXXXXXXXXXXLIAVXXLTSXXXXXXXXXXXXXXXXXXXXXXXAXXXXXXGLXGVVXXXXEXXXIRXXXXXXXXXXXXXVTPGIRXXXXXXXXXXXXDQXXXXXXXXAXXXGSXXIVVGRXIXXAXXXXXXPXXXXXXI

SEQ ID NO: 17075 - protein, 6 aa, Artificial sequence
  Variant (2)..(3): xaa in position 2 to 3 is any or no amino acid
  Variant (5)..(5): xaa in position 5 is any or no amino acid
AXXLXD

SEQ ID NO: 17076 - protein, 10 aa, Artificial sequence
  Variant (2)..(2): xaa in position 2 is Ile, Leu or Val
  Variant (4)..(9): xaa in position 4 to 9 is any or no amino acid
KXGXXXXXXL

SEQ ID NO: 17077 - protein, 30 aa, Artificial sequence
  Variant (2)..(2): xaa in position 2 is any amino acid
  Variant (4)..(4): xaa in position 4 is any amino acid
  Variant (6)..(6): xaa in position 6 is Phe or Leu
  Variant (7)..(7): xaa in position 7 is any amino acid
  Variant (10)..(10): xaa in position 10 is Asp, Gly, Pro or Ser
  Variant (11)..(11): xaa in position 11 is any amino acid
  Variant (12)..(12): xaa in position 12 is Thr or Val
  Variant (13)..(29): xaa in position 13 to 29 is any amino acid
  Variant (30)..(30): xaa in position 30 is Phe, Ile, Leu, Met or Val
FXDXKXXDIXXXXXXXXXXXXXXXXXXXXX

SEQ ID NO: 17078 - protein, 8 aa, Artificial sequence
  Variant (2)..(2): xaa in position 2 is any or no amino acid
  Variant (4)..(5): xaa in position 4 to 5 is any or no amino acid
  Variant (7)..(7): xaa in position 7 is any amino acid
  Variant (8)..(8): xaa in position 8 is Ala, Asp, Glu, Gly, Asn, Ser or Thr
LXTXXSXX

SEQ ID NO: 17079 - protein, 4 aa, Artificial sequence
  Variant (3)..(3): xaa in position 3 is Ile or Val
  Variant (4)..(4): xaa in position 4 is Gln or Arg
PGXX

SEQ ID NO: 17080 - protein, 18 aa, Artificial sequence
  Variant (2)..(2): xaa in position 2 is any amino acid
  Variant (3)..(4): xaa in position 3 to 4 is any or no amino acid
  Variant (6)..(6): xaa in position 6 is Ala, Ser or Val
  Variant (7)..(7): xaa in position 7 is Asp, Asn, Ser or Thr
  Variant (8)..(8): xaa in position 8 is any amino acid
  Variant (9)..(9): xaa in position 9 is Ile, Leu, Met or Val
  Variant (10)..(10): xaa in position 10 is Ile or Val
  Variant (11)..(11): xaa in position 11 is any amino acid
  Variant (12)..(12): xaa in position 12 is Ala or Gly
  Variant (14)..(14): xaa in position 14 is any amino acid
  Variant (15)..(15): xaa in position 15 is Ile, Leu or Val
  Variant (16)..(17): xaa in position 16 to 17 is any amino acid
  Variant (18)..(18): xaa in position 18 is Ala, Asp, Asn, Pro, Ser or Thr
AXXXGXXXXXXXRXXXXX

SEQ ID NO: 17081 - DNA, 216 bp, Escherichia coli
  CDS (1)..(216)
atgactgttcaggactacttattaaaatttcgcaaaatcagttcactcgaaagtctggaaaaactctacgaccatcttaattacaccctgacggacgatcaggaactgatcaatatgtatcgtgctgccgatcaccgtcgcgcagagctggtttctggcgggcgtttgtttgacctcggccaggtaccgaagtccgtctggcactatgtccaataa

SEQ ID NO: 17082 - protein, 71 aa, Escherichia coli
MTVQDYLLKFRKISSLESLEKLYDHLNYTLTDDQELINMYRAADHRRAELVSGGRLFDLGQVPKSVWHYVQ

SEQ ID NO: 17083 - DNA, 228 bp, Escherichia coli
  CDS (1)..(228): transl_table=11
atgttcttcaggaattgtacaatgaaaacaaaacaagactggctctttcagttaagacgttgctcaacactcgacacacttgaaaagattattgaaaaaaaccaaaactgcctccccccttctgagcttgagtcgtttaatgccgcagccgatcacaggcttgcggaactcacaatgaataaactctacgataaagtccctccatccgtctggaaatatgtatattag

SEQ ID NO: 17084 - protein, 75 aa, Escherichia coli
MFFRNCTMKTKQDWLFQLRRCSTLDTLEKIIEKNQNCLPPSELESFNAAADHRLAELTMNKLYDKVPPSVWKYVY

SEQ ID NO: 17085 - DNA, 210 bp, Shigella flexneri
  CDS (1)..(210): transl_table=11
atggcaaaaacaaaacaggaatggctgtatcagttacggcgatgttcatcagtcaatacgctggaaaaaattattcataaaaacagagacagtttatcaaacagtgaacgtgaatcatttaattcagcagcagaccaccggctagcggaattaatcaccggaaagttatatgacaggataccaaaagagatatggaaatatgtaaggtaa

SEQ ID NO: 17086 - protein, 69 aa, Shigella flexneri
MAKTKQEWLYQLRRCSSVNTLEKIIHKNRDSLSNSERESFNSAADHRLAELITGKLYDRIPKEIWKYVR

SEQ ID NO: 17087 - DNA, 219 bp, Salmonella typhimurium LT2
  CDS (1)..(219): transl_table=11
atgtctgataaaccattaactaaaactgattatttgatgcgtttacggcgctgtcagacaattgacactctggagcgcgtcattgagaaaaataaatatgaattgtccgacaatgagctggctgtattttactcagctgcggatcaccgtcttgcagaattgacgatgaacaaactctacgacaagatcccctcttcagtatggaaattcattcgttaa

SEQ ID NO: 17088 - protein, 72 aa, Salmonella typhimurium LT2
MSDKPLTKTDYLMRLRRCQTIDTLERVIEKNKYELSDNELAVFYSAADHRLAELTMNKLYDKIPSSVWKFIR

SEQ ID NO: 17089 - DNA, 231 bp, Salmonella typhimurium LT2
  CDS (1)..(231): transl_table=11
atggatcaactttatatgactgttcaggattatctattaaaattccgcaaaattagttcgctcgaaagtctggaaaaactgttcgaccaccttaactatacccttactgatgacatggacattgttaatatgtatcgcgctgcagatcaccgccgtgccgaactggtttccggaggacgcctgtttgatgtaggtcaggttccgcaatccgtctggcgctatgtgcaataa

SEQ ID NO: 17090 - protein, 76 aa, Salmonella typhimurium LT2
MDQLYMTVQDYLLKFRKISSLESLEKLFDHLNYTLTDDMDIVNMYRAADHRRAELVSGGRLFDVGQVPQSVWRYVQ

SEQ ID NO: 17091 - DNA, 213 bp, Salmonella enterica subsp. enterica serovar Typhi str. CT18
  CDS (1)..(213): transl_table=11
atgtccgaaactaagcaggcgtatttaatgaaatttcgtaagtgctcttctttcgacacactggaaaaagtattcgaacgactctgtgaaaaaaatgcaggtatagcatcactggaaatttccggggcatatgaccatcgaaaagctgaactgacaatgaagaaactctacgataaagtacccgcaagcgtatggacactggtccgtcagtaa

SEQ ID NO: 17092 - protein, 70 aa, Salmonella enterica subsp. enterica serovar Typhi str. CT18
MSETKQAYLMKFRKCSSFDTLEKVFERLCEKNAGIASLEISGAYDHRKAELTMKKLYDKVPASVWTLVRQ

SEQ ID NO: 17093 - DNA, 231 bp, Escherichia coli CFT073
  CDS (1)..(231): transl_table=11
atgggtagaagtatgtccgaaaaacctttaacgaaaaccgattatttaatgcgtttacgtcgttgccagacaattgacacgctggagcgtgttatcgagaaaaataaatacgaattatcagataatgaactggcggtattttactcagccgcagatcaccgcctcgccgaattgaccatgaataaactgtacgacaagatcccttcctcagtatggaaatttattcgctaa

SEQ ID NO: 17094 - protein, 76 aa, Escherichia coli CFT073
MGRSMSEKPLTKTDYLMRLRRCQTIDTLERVIEKNKYELSDNELAVFYSAADHRLAELTMNKLYDKIPSSVWKFIR

SEQ ID NO: 17095 - DNA, 231 bp, Citrobacter freundii
  CDS (1)..(231): transl_table=11
atggcggaaacagtttatcaggcgcggaggcgtttttaccttctccgttttcggcgcagccgtaacccggacacactggaaaaaatgtacgaatccatgcgggatcgtggacaggtgccgccggaggactccgaggcttttgaggctgccgccgaccatcgccgcgcagagctggcatcgggacgcatctgggataagatcccgccgcatgtctggcagtatgtaaaataa

SEQ ID NO: 17096 - protein, 76 aa, Citrobacter freundii
MAETVYQARRRFYLLRFRRSRNPDTLEKMYESMRDRGQVPPEDSEAFEAAADHRRAELASGRIWDKIPPHVWQYVK

SEQ ID NO: 17097 - DNA, 210 bp, Escherichia coli
  CDS (1)..(210): transl_table=11
atggcaaaaacaaaacaggaatggctgtatcagttacggcgatgttcatcagtcaatacgctggaaaaaattattcataaaaacagagacagtttatcgaccagtgaacgtgaatcatttaattcagcagcagaccaccggttagcagaattaatcaccggaaagttatatgacaggataccaaaagaaatatggaaatatgtaaggtaa

SEQ ID NO: 17098 - protein, 69 aa, Escherichia coli
MAKTKQEWLYQLRRCSSVNTLEKIIHKNRDSLSTSERESFNSAADHRLAELITGKLYDRIPKEIWKYVR

SEQ ID NO: 17099 - DNA, 204 bp, Wigglesworthia glossinidia endosymbiont of Glossina brevipalpis
  CDS (1)..(204): transl_table=11
atgaaaaaaatagattaccttatgcgtttaagaaaatgtagaacattagcaactttagaaagagttatagaaaaaaataaatataaattgtcaaatgatgaattagaaatttttaattcagctgctgatcatagattagcagaaataactatgaataaattgtatgataagattccaaatgttgtatggaaatatgtaagataa

SEQ ID NO: 17100 - protein, 67 aa, Wigglesworthia glossinidia endosymbiont of Glossina brevipalpis
MKKIDYLMRLRKCRTLATLERVIEKNKYKLSNDELEIFNSAADHRLAEITMNKLYDKIPNVVWKYVR

SEQ ID NO: 17101 - DNA, 204 bp, Photorhabdus luminescens subsp. laumondii TTO1
  CDS (1)..(204): transl_table=11
atgactaaaactgattatctgatgcgtttaagaaaatgcaccacgattgatacactggaacgtgtgattgaaaagaacaaatatgaactttcaggagatgaacttgaactattctactctgctgcggatcatcgcctagctgagctgaccatgaataaactgtatgatagaattccaccttcagtatggaaatatgttcgctaa

SEQ ID NO: 17102 - protein, 67 aa, Photorhabdus luminescens subsp. laumondii TTO1
MTKTDYLMRLRKCTTIDTLERVIEKNKYELSGDELELFYSAADHRLAELTMNKLYDRIPPSVWKYVR

SEQ ID NO: 17103 - DNA, 213 bp, Serratia marcescens
  CDS (1)..(213): transl_table=11
atgtctgacacaaagcagtcttatttaatgaaattccgtaagtgtagttcgttcgaaacgctcgaaaaagtatttgaaaggttatgtgaaaaaaactcgggtgtcgcctctcttgaaatttctggtgcttatgatcatcgtaaagctgaactgacaatgaaaaagttatatgacaaagttcctgcgagtgtgtggacctttgttcgcgagtaa

SEQ ID NO: 17104 - protein, 70 aa, Serratia marcescens
MSDTKQSYLMKFRKCSSFETLEKVFERLCEKNSGVASLEISGAYDHRKAELTMKKLYDKVPASVWTFVRE

SEQ ID NO: 17105 - DNA, 231 bp, Erwinia amylovora
  CDS (1)..(231): transl_table=11
atggcggaaacagtttatcaggcgcggaggcgtttttaccttctccgttttcggcgcagtcgtaacccggacacactggaaaaaatgtacgaatccatgcgggatcgtggacaggtgccgccggaggacaccgaggcttttgaggctgcggccgaccatcgccgcgcagagctggcatcgggacgcatctgggataagatcccgccgcatgtctggcagtatgtaaaataa

SEQ ID NO: 17106 - protein, 76 aa, Erwinia amylovora
MAETVYQARRRFYLLRFRRSRNPDTLEKMYESMRDRGQVPPEDTEAFEAAADHRRAELASGRIWDKIPPHVWQYVK

SEQ ID NO: 17107 - DNA, 204 bp, Klebsiella pneumoniae
  CDS (1)..(204): transl_table=11
atgacgaaacaggaatggattttacgactacggcgctgtacatcgaaggaaaccctggaaagggttatagaaaaaaataaatattctctgtcagatgatgagcttgagcatttcaatgccgcggttgatcaccggctggcggagatgacgatgggaaagttgtatgaccgggtaccgccaggtgtctggaaatttgtgaaatag

SEQ ID NO: 17108 - protein, 67 aa, Klebsiella pneumoniae
MTKQEWILRLRRCTSKETLERVIEKNKYSLSDDELEHFNAAVDHRLAEMTMGKLYDRVPPGVWKFVK

SEQ ID NO: 17109 - DNA, 210 bp, Escherichia coli O157:H7
  CDS (1)..(210): transl_table=11
atggaaaaaacaaaacaggaatggctgtatcaattacggcgatgttcatcagtcaatacgctggaaaaaattattcataaaaacagagacagtttatcgaccagtgaacgtgaatcatttaattcagcagcagaccaccggttagcagaattaatcaccggaaagttatatgacaggataccaaaagaaatatggaaatatgtaaggtaa

SEQ ID NO: 17110 - protein, 69 aa, Escherichia coli O157:H7
MEKTKQEWLYQLRRCSSVNTLEKIIHKNRDSLSTSERESFNSAADHRLAELITGKLYDRIPKEIWKYVR

SEQ ID NO: 17111 - DNA, 204 bp, Erwinia carotovora subsp. atroseptica SCRI1043
  CDS (1)..(204)
atgaaaaaaatcgactatttgatgcgtttgcgtaaatgcacaaccattgacacactcgaacgtgttattgaaaaaaacaagtatgagctctccaatgatgaactggagatgttcttttcagcagccgatcatcgcctggctgaactgacaatgaacaaactctacgacaaaatccctaccgcagtatggcgctacgtacgttaa

SEQ ID NO: 17112 - protein, 67 aa, Erwinia carotovora subsp. atroseptica SCRI1043
MKKIDYLMRLRKCTTIDTLERVIEKNKYELSNDELEMFFSAADHRLAELTMNKLYDKIPTAVWRYVR

SEQ ID NO: 17113 - DNA, 210 bp, Escherichia coli
  CDS (1)..(210): transl_table=11
atggcgaaaacaaaacaggaatggctgtatcagttacggcgatgttcatcagtcaatacgctggaaaaaattattcataaaaacagagacagtttattaaacagtgaacgtgaatcatttaattcagcagcagaccaccggttagcggaattaatcaccggaaagttatatgacaggataccaaaagagatatggaaatatgtaaggtaa

SEQ ID NO: 17114 - protein, 69 aa, Escherichia coli
MAKTKQEWLYQLRRCSSVNTLEKIIHKNRDSLLNSERESFNSAADHRLAELITGKLYDRIPKEIWKYVR

SEQ ID NO: 17115 - DNA, 285 bp, Salmonella enterica subsp. enterica serovar Choleraesuis str
  CDS (1)..(285): transl_table=11
gtgcggttttgtttattttttatcagtgactactccgttggcattatatttaatatggatcaactttatatgactgttcaggattatctattaaaattccgcaaaattagttcgctcgaaagtctggaaaaactgttcgaccaccttaactatacccttactgatgacatggacattgttaatatgtatcgcgctgcagatcaccgccgtgccgaactggtttccggaggacgcctgtttgatgtaggtcaggttccgcaatccgtctggcgctatgtgcaataa

SEQ ID NO: 17116 - protein, 94 aa, Salmonella enterica subsp. enterica serovar Choleraesuis str
MRFCLFFISDYSVGIIFNMDQLYMTVQDYLLKFRKISSLESLEKLFDHLNYTLTDDMDIVNMYRAADHRRAELVSGGRLFDVGQVPQSVWRYVQ

SEQ ID NO: 17117 - DNA, 210 bp, Escherichia coli
  CDS (1)..(210): transl_table=11
atggcgaaaacaaaacaggaatggctgtatcagttacggcgatgttcatcagccaatacgctggaaaaaattattcgtaaaaacagagacagtttattaaacagtgaacgtgaatcatttaattcagcagcagaccaccggttagcggaattaatcaccggaaagttatatgacaggataccaaaagagatatggaaatatgtaaggtaa

SEQ ID NO: 17118 - protein, 69 aa, Escherichia coli
MAKTKQEWLYQLRRCSSANTLEKIIRKNRDSLLNSERESFNSAADHRLAELITGKLYDRIPKEIWKYVR

SEQ ID NO: 17119 - DNA, 387 bp, Escherichia coli
  CDS (1)..(387): transl_table=11
atgtgtaacgctacgttaattgcaatatctggttatggctttataccttcagtattaaaaatattttttaccggagaaacagggaagtggaaagacttccgggatgacgtcagaatacgttattctgatggtattatgttaacgttaatcacagcacaaaataacgagaggataatggaagttaagaccaaagaagactggctgtatcagtttcgccgttgttcatcccgggagacactagaaaaagtgatttcccacacgcgttataagcttactccagcggagatggaagccttcaactctgcggtcgatcaccggctggcagaactgaccatgaacaaactgtacgatcgtgttcccgcttcagtctggaaatatgttacctga

SEQ ID NO: 17120 - protein, 128 aa, Escherichia coli
MCNATLIAISGYGFIPSVLKIFFTGETGKWKDFRDDVRIRYSDGIMLTLITAQNNERIMEVKTKEDWLYQFRRCSSRETLEKVISHTRYKLTPAEMEAFNSAVDHRLAELTMNKLYDRVPASVWKYVT

SEQ ID NO: 17121 - DNA, 210 bp, Escherichia coli
  CDS (1)..(210): transl_table=11
atggcaaaaacaaaacaggaatggctgtatcagttacggcgatgttcatcagtcaatacgctggaaaaaattattcataaaaacagagacagtttatcgaacagtgaacgtgaatcatttaattcagcagcagatcaccggttagcagaattaatcaccggaaagttatatgacagtataccaaaagaaatatggaaatatgtaaggtaa

SEQ ID NO: 17122 - protein, 69 aa, Escherichia coli
MAKTKQEWLYQLRRCSSVNTLEKIIHKNRDSLSNSERESFNSAADHRLAELITGKLYDSIPKEIWKYVR

SEQ ID NO: 17123 - DNA, 219 bp, Escherichia coli
  CDS (1)..(219): transl_table=11
atgtccgaaaaacctttaacaaaaaccgattatttaatgcgtttacgtcgttgccagacaattgacacgctggagcgtgttatcgagaaaaataaatacgaattatcagataatgaactggcggtattttactcagccgcagatcaccgcctcgccgaattgaccatgaataaactgtacgacaagatcccttcctcagtatggaaatttattcgctaa

SEQ ID NO: 17124 - protein, 72 aa, Escherichia coli
MSEKPLTKTDYLMRLRRCQTIDTLERVIEKNKYELSDNELAVFYSAADHRLAELTMNKLYDKIPSSVWKFIR

SEQ ID NO: 17125 - DNA, 216 bp, Salmonella paratyphi
  CDS (1)..(216): transl_table=11
atgactgttcaggattatctattaaaattccgcaaaattagttcgctcgaaagtctggaaaaactgttcgaccaccttaactatacccttactgatgacatggacatcgttaatatgtatcgcgctgcagatcaccgccgtgccgagctggtttccggaggacgcctgtttgatgtaggtcaggttccgcaatccgtctggcgctatgtgcaataa

SEQ ID NO: 17126 - protein, 71 aa, Salmonella paratyphi
MTVQDYLLKFRKISSLESLEKLFDHLNYTLTDDMDIVNMYRAADHRRAELVSGGRLFDVGQVPQSVWRYVQ

SEQ ID NO: 17127 - DNA, 204 bp, Yersinia enterocolitica
  CDS (1)..(204): transl_table=11
atgacaaaaactgactacctgatgcgtttaagaaaatgtacgactattgatacattggaacgtgtaattgaaaaaaataagtacgaactttctgacgatgagctggaattgttttactcagcagcagaccaccgcttagctgaactcacaatgaataaactttatgataaaattccacctactgtatggcaacatgtgaaatag

SEQ ID NO: 17128 - protein, 67 aa, Yersinia enterocolitica
MTKTDYLMRLRKCTTIDTLERVIEKNKYELSDDELELFYSAADHRLAELTMNKLYDKIPPTVWQHVK

SEQ ID NO: 17129 - DNA, 26 bp, Artificial sequence
  (1)..(26): primer
atgactgttcaggactacttattaaa

SEQ ID NO: 17130 - DNA, 23 bp, Artificial sequence
  (1)..(23): primer
ttattggacatagtgccagacgg

SEQ ID NO: 17131 - protein, 72 aa, Artificial sequence
  Variant (4)..(4): xaa in position 4 is any amino acid
  Variant (29)..(29): xaa in position 29 is any amino acid
  Variant (34)..(35): xaa in position 34 to 35 is any or no amino acid
  Variant (39)..(39): xaa in position 39 is any amino acid
  Variant (54)..(54): xaa in position 54 is any amino acid
  Variant (55)..(57): xaa in position 55 to 57 is any or no amino acid
  Variant (65)..(65): xaa in position 65 is any amino acid
MTKXDYLMRLRKCSSIDTLEKVIEKNKYXLSDDXXELEXFYSAADHRLAELTMXXXXKLYDKIPXSVWKYVR

SEQ ID NO: 17132 - protein, 10 aa, Artificial sequence
  Variant (2)..(2): xaa in position 2 is Lys or Arg
  Variant (3)..(3): xaa in position 3 is any amino acid
  Variant (4)..(4): xaa in position 4 is Gln, Ser or Thr
  Variant (5)..(5): xaa in position 5 is Ser or Thr
  Variant (6)..(6): xaa in position 6 is any amino acid
  Variant (7)..(7): xaa in position 7 is Asp, Glu or Asn
  Variant (8)..(8): xaa in position 8 is Ser or Thr
RXXXXXXXLE

SEQ ID NO: 17133 - protein, 8 aa, Artificial sequence
  Variant (2)..(2): xaa in position 2 is Ala or Val
  Variant (6)..(6): xaa in position 6 is any amino acid
AXDHRXAE

SEQ ID NO: 17134 - protein, 5 aa, Artificial sequence
  Variant (2)..(2): xaa in position 2 is any amino acid
  Variant (3)..(3): xaa in position 3 is Ala, Gly, Ser, Thr or Val
PXXVW

SEQ ID NO: 17135 - DNA, 1470 bp, Escherichia coli K12
  CDS (1)..(1470): transl_table=11
atggtttccgaaactaaaaccacagaagcgccgggcttacgccgtgaattaaaggcgcgtcacctgacgatgattgccattggcggttccatcggtacaggtctttttgttgcctctggcgcaacgatttctcaggcaggtccgggcggggcattgctctcgtatatgctgattggcctgatggtttacttcctgatgaccagtctcggtgaactggctgcatatatgccggtttccggttcgtttgccacttacggtcagaactatgttgaagaaggctttggcttcgcgctgggctggaactactggtacaactgggcggtgactatcgccgttgacctggttgcagctcagctggtcatgagctggtggttcccggatacaccgggctggatctggagtgcgttgttcctcggcgttatcttcctgctgaactacatctcagttcgtggctttggtgaagcggaatactggttctcactgatcaaagtcacgacagttattgtctttatcatcgttggcgtgctgatgattatcggtatcttcaaaggcgcgcagcctgcgggctggagcaactggacaatcggcgaagcgccgtttgctggtggttttgcggcgatgatcggcgtagctatgattgtcggcttctctttccagggaaccgagctgatcggtattgctgcaggcgagtccgaagatccggcgaaaaacattccacgcgcggtacgtcaggtgttctggcgaatcctgttgttctatgtgttcgcgatcctgattatcagcctgattattccgtacaccgatccgagcctgctgcgtaacgatgttaaagacatcagcgttagtccgttcaccctggtgttccagcacgcgggtctgctctctgcggcggcggtgatgaacgcagttattctgacggcggtgctgtcagcgggtaactccggtatgtatgcgtctactcgtatgctgtacaccctggcgtgtgacggtaaagcgccgcgcattttcgctaaactgtcgcgtggtggcgtgccgcgtaatgcgctgtatgcgacgacggtgattgccggtctgtgcttcctgacctccatgtttggcaaccagacggtatacctgtggctgctgaacacctccgggatgacgggttttatcgcctggctggggattgccattagccactatcgcttccgtcgcggttacgtattgcagggacacgacattaacgatctgccgtaccgttcaggtttcttcccactggggccgatcttcgcattcattctgtgtctgattatcactttgggccagaactacgaagcgttcctgaaagatactattgactggggcggcgtagcggcaacgtatattggtatcccgctgttcctgattatttggttcggctacaagctgattaaaggaactcacttcgtacgctacagcgaaatgaagttcccgcagaacgataagaaataa

SEQ ID NO: 17136 - protein, 489 aa, Escherichia coli K12
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 17137 - DNA, 1464 bp, Pseudomonas aeruginosa PAO1
  CDS (1)..(1464): transl_table=11
atgactgacctgaacaccagccagggccagcaattgcggcgggtgctcaagccgcgccacctgaacatgatcgccatcggcggctccatcggcaccgggctgttcgtcgcctccggggccacagtggccaccgccgggcccggcggtgcgctgctttcctacgcactgatcgggctgatggtgtacttcctcatgaccagtctcggcgagatggccgcctacatgcccgtttccggctcattctgtacctatggcagccggttcgtcgaagatggcttcggtttcgccctcggctggaactactggtacaactgggcggtgaccatcgccgcggagctggtggcggcgcaactggtgatgagtttctggttccccgaggtgccgggcatctactggagcgcgatcttcctgggcatcatgttcggcctcaacgtgatttccgcgcgcggcttcggcgagagcgaattctggttcgccctgatcaaggtagtcacggtggtgatcttcatcggcgtcggcctggcgaccatcttcggcatcatgcatggcgtggagtcgcccggcttcagcaacttcaccatgggcgacgcgcccttcgtcggcggcttccaggcgatggtcggggtggcgatgatcgccggcttctcgttccagggcaccgaactgatcggcatcgccgccggtgaatcggaaaatccgcggaagaacatcccgatcgccattcgccaggtgttctggcgcatcctgatgttctacatcctggcgatcttcgtgatcggcatgctgattccctacaccgacccgaacctgctgaagaacgatgccagcgacatcagcgtgtcgcccttcaccctgctcttcgagcgcgccggcttcgccgcggcggccggggtgatgaacgcagtgatcctctcggcgatcctctccgccggcaactccggcatgtacgcctcgacccggatgctctacaacctcgccctcgagggcaaggcaccgcgcctgttctcccgcgtctcgcgcagcggcgtgccacgcaacgcgctgtacgccactaccctggtcggcgccctgtgcttcctcacttcggccttcggcgacagcaccgtctacacatggctgctgaacacctcgggcatgtgcggcttcatcgcctggctgggcatcgccatctcccactatcgcttccgcaagggttacctggcccagggcggccgcctggaagacctgccctaccgggccaagctgttccccttcgggccgctgttcgccttcgccctgtgcatggtcatcaccctcgggcagaactaccaggcgctggtgggcgaacgcatcgactggatcggcctcctcgccacctatatcagcctgccgctgttcctggcgatctggctgggataccgctggaagaagcgcgcacgcttcgttcgctaccacgaaatggacgtcagcccgaccaatacctga

SEQ ID NO: 17138 - protein, 487 aa, Pseudomonas aeruginosa PAO1
MTDLNTSQGQQLRRVLKPRHLNMIAIGGSIGTGLFVASGATVATAGPGGALLSYALIGLMVYFLMTSLGEMAAYMPVSGSFCTYGSRFVEDGFGFALGWNYWYNWAVTIAAELVAAQLVMSFWFPEVPGIYWSAIFLGIMFGLNVISARGFGESEFWFALIKVVTVVIFIGVGLATIFGIMHGVESPGFSNFTMGDAPFVGGFQAMVGVAMIAGFSFQGTELIGIAAGESENPRKNIPIAIRQVFWRILMFYILAIFVIGMLIPYTDPNLLKNDASDISVSPFTLLFERAGFAAAAGVMNAVILSAILSAGNSGMYASTRMLYNLALEGKAPRLFSRVSRSGVPRNALYATTLVGALCFLTSAFGDSTVYTWLLNTSGMCGFIAWLGIAISHYRFRKGYLAQGGRLEDLPYRAKLFPFGPLFAFALCMVITLGQNYQALVGERIDWIGLLATYISLPLFLAIWLGYRWKKRARFVRYHEMDVSPTNT

SEQ ID NO: 17139 - DNA, 1413 bp, Pseudomonas aeruginosa PAO1
  CDS (1)..(1413): transl_table=11
atggctgacggcaaggaaaggctgcaactcacccgggccctggcgagccgccacatcttcatgctgtccctcggcggggtgatcggcaccgggctgttcatgggctccggcgtgaccatcaaccagggcggcccggccggcgcggtgctggcctacctggtggccggggtgctgatgtacctggtgatggtctgcctcggcgagctgtcggtgcagatgccggtctccggttcgttccaggcccacgcgacgcgtttcatcggcccggcgactggcttcatgatcggctgggtctactggatgagctgggcctccacggtaggcctggaattcaccgcggccgggatgctcatgacccgctggttcccggaggtgcccgtgtggctatggtcgggtttcttcgtggtcgtgctgttctccctcaatgccctggcgacccgcgctttcggcgaggccgagtactggttcgccgggatcaaggtggcggcgatcctggtgttcatcgtggtcggggggctggtgatcttcggcggtatcgaactgaagagcggtgcgccggcgccgatgttctccaacctggtcggcgagcggctgttccccaacggcctgtcggcggtgttcgcggtgatgatgacggtggtctatgccttccagggttgcgagatcatgggcgtcgccgccggcgagaccgagcgaccggagaagagcatcccgcgggcggtgcgcaacgtggtgttccgcgtactgatcttctacgtgctggccatcgtcgtgctttccgccatcattccctggcaacaggccgggctgatggaaagcccgttcgtgcaggtgttcgacatggtcgggattccctacgcggcggacctgatgaacttcgtcatcctcaccgccatcctctcggtaggcaactcgggcctgtacgcctcgacgcggatcctctgggcgatgtccaggtccggcatggccccgcgcggcctgtcgaagctcagcgcgcgcggcgtgccgctctacgcgttgctgatcaccctgtgcttcgccctgctctcgttgctgaccagcgtggtcgccgccgacaccctgttcatggtgctgatggcggtgagcgggatgtccggcaccgtcacctggatcgtcatcgcctacgcccaataccgcttccgccgcgagcacatggccagcggcggcacggtcgccgagctgaaatatgccgcgccgctgttcccgctggtgccgctggcctgcatcgccgtgtgctgctcgctgttcgtcttcctcgccctcgatcccacccagcggccgtccttgtactggggcttcggcttcatcgccgcctgctacctggcctattacgtggttcgtcgccggcagccgcagggactgggcgaccccgccctgggacgggccggctga

SEQ ID NO: 17140 - protein, 470 aa, Pseudomonas aeruginosa PAO1
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLMESPFVQVFDMVGIPYAADLMNFVILTAILSVGNSGLYASTRILWAMSRSGMAPRGLSKLSARGVPLYALLITLCFALLSLLTSVVAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 17141 - DNA, 1434 bp, Lactococcus lactis subsp. lactis Il1403
  CDS (1)..(1434): transl_table=11
atggaaaatcaaaatcaggtcaagcgcaaccttaaacagcgccacatcaccatgattgcattgggtggtacaattggaacaggtttatttttaacttcaggagcaacaattagtcaagcaggtccctggggcgcagttcttgcttattgttttattggtattatggtttacttcgtaatgacttccttaggtgagatggcgacatatttgcctacctcaggttcattctccgattatggcggtcgttatgttgatcctgcttttggctttgcattagggtggaactattggctcaatggagcgattaccattgccgtggatttaacgacagcaggattgattacgcagttttggttcccgcaccttccgtcttggatattttcaggaattgcgacggtcttaatttttattattaatgttatggcggttggagcattcggggaaacagaatattggttatcaacgattaaagtgattacgattgtcctctttttagctattggtttacttaccatttttggagttttgggacaaggaaatgttgatgtcgttgccaatttaagtgctggcaatcatggctttgttggtggaatttcaggatttgttggagttttacttattgccggattctcttttcaaggaactgagcttttagggattaccgcaggtgaatctgaagacccaggtaagtcaattcctaaagcaatgaactctattttctggcgtatcttacttttttacatcttttcaatcattgtgattgctgcaattatcaattttaaagaccctcgcttgttaaatccaaattcgacagctgtcatgagtccatttactattgtctttaaaaatattggctttgcagttgcagcttcagttatgaatgcggtcattcttacttcggtaatttcatcagcaaattcagtaatgtatgcttcaacacgtattctttattcattgggacaagaaaaaggcgcaccaaaattctttggacgaacagcaaaaaatggaattcctttttatgccctattagccacaacaattatttgttttattgctttcttaactggaatatttggaacgcaaatttatcttttcttggttgatttatcatcactaacaggctttcttgcttggcttggaatttctatcagtcatatccgttttagaagagcctatattgctcaagggaaaaaattggaagatcttccttacaaagctaaatggttcccatttggtccaattgttgcgctcttgatgactgcggcgattgccattaatcttgacccagccatgctctttagtgagcactggggtgaaggcttagctttatacgctgcaattcctattttcattattctttattttggttataaatggaagtataatacaaaaattattccacttgaagaagtagatttgagtcgggaaaaataa

SEQ ID NO: 17142 - protein, 477 aa, Lactococcus lactis subsp. lactis Il1403
MENQNQVKRNLKQRHITMIALGGTIGTGLFLTSGATISQAGPWGAVLAYCFIGIMVYFVMTSLGEMATYLPTSGSFSDYGGRYVDPAFGFALGWNYWLNGAITIAVDLTTAGLITQFWFPHLPSWIFSGIATVLIFIINVMAVGAFGETEYWLSTIKVITIVLFLAIGLLTIFGVLGQGNVDVVANLSAGNHGFVGGISGFVGVLLIAGFSFQGTELLGITAGESEDPGKSIPKAMNSIFWRILLFYIFSIIVIAAIINFKDPRLLNPNSTAVMSPFTIVFKNIGFAVAASVMNAVILTSVISSANSVMYASTRILYSLGQEKGAPKFFGRTAKNGIPFYALLATTIICFIAFLTGIFGTQIYLFLVDLSSLTGFLAWLGISISHIRFRRAYIAQGKKLEDLPYKAKWFPFGPIVALLMTAAIAINLDPAMLFSEHWGEGLALYAAIPIFIILYFGYKWKYNTKIIPLEEVDLSREK

SEQ ID NO: 17143 - DNA, 1521 bp, Lactococcus lactis subsp. lactis Il1403
  CDS (1)..(1521): transl_table=11
ttgagtctgagtcaaacaagtcggtgtagaataaattttattagggagagaattttggaaaattcttcaaactcaactactgagacgcaagtaaaacgcggcttaaaatcacgtcatgtttccatgattgcccttggcggaacaatcggaactggattgtttctgacttcaggcgatgtcattcacacggcaggaccatttggtgcactgactgcctatgttcttatcggagcaatggtttacttcctcatgacatcacttggtgaaatggccacttatttacccacttctggttctttttcagactatggaacacgttatgttgacccagcttttggttttgctctaggttggaattactggttaaactgggcaattaccgtagcggttgatttaacagccgttgccctttgtatcaaattctggttaccagatgttccaagttggattttttcactgattgccttaattattgtctttgcaatcaatgccttatcagttaaaacttttggcgaaactgaatattggttgtcagccattaaaattactgttgttgttttattcttgattattggtttcttatctatttttggaattatgggcggtcatattgacgtcgctaaaaatctttcagttggtaatcatggttttgtcggaggacttggtagtttcactaccggcggagggattctcggcgtactcttagtcgctggtttctctttccaaggaacagaattgctcggaattacagctggcgaagctgaaaatcctgaaaaatcaattcctaaagctatgaactctatcttctggcgtattcttgtcttttatatcttatctatcttcgtgatggcggctatcattccatttaccgacccacacttagttggaggaaattcagctgctcaaagccctttcacaattgtatttgaacgtgttggtctctctattgcagcttctatcatgaacgccgttgttttaacttctgtcgtttcagcagcaaattctggaatgtatgcctctactcggatgctttattcactagctaaagatggtggcgcaccaaagattttctcaaaaacttcaaaaaacgggatccctttcattgctttattagctacaactgctattgctttactcacattcttgacatcaatttacggagttagcttctttacattcctcgtctcagcctctggtttaacaggatttattgcttggattgggattgcaattagccacttccgcttccgccgcgcctatgttgctcaaggaaaagatgttaaaaaattaccttatcatgcaaaactattcccatttggtccaatcttagccttaattatgaccgttttagtcacactcggccaagacccaatgcttctttttggtaaaacttgggtgcaaggtgtcatcatgtatgccgcaattccactcttcttcatcctttacttgggttataaatttaaaaacaaaacgaaacttatcccccttaaagaggttgatttaagtcgtcataaagattaa

SEQ ID NO: 17144 - protein, 506 aa, Lactococcus lactis subsp. lactis Il1403
MSLSQTSRCRINFIRERILENSSNSTTETQVKRGLKSRHVSMIALGGTIGTGLFLTSGDVIHTAGPFGALTAYVLIGAMVYFLMTSLGEMATYLPTSGSFSDYGTRYVDPAFGFALGWNYWLNWAITVAVDLTAVALCIKFWLPDVPSWIFSLIALIIVFAINALSVKTFGETEYWLSAIKITVVVLFLIIGFLSIFGIMGGHIDVAKNLSVGNHGFVGGLGSFTTGGGILGVLLVAGFSFQGTELLGITAGEAENPEKSIPKAMNSIFWRILVFYILSIFVMAAIIPFTDPHLVGGNSAAQSPFTIVFERVGLSIAASIMNAVVLTSVVSAANSGMYASTRMLYSLAKDGGAPKIFSKTSKNGIPFIALLATTAIALLTFLTSIYGVSFFTFLVSASGLTGFIAWIGIAISHFRFRRAYVAQGKDVKKLPYHAKLFPFGPILALIMTVLVTLGQDPMLLFGKTWVQGVIMYAAIPLFFILYLGYKFKNKTKLIPLKEVDLSRHKD

SEQ ID NO: 17145 - DNA, 1470 bp, Clostridium acetobutylicum ATCC 824
  CDS (1)..(1470): transl_table=11
gtgtctgcagagttagagaaagataaaaatggtgaattaaagagaagtttaaaaacacgacatatgaatatgattgccattggaggatcaattggtacaggtttgttttttactagtggtaatacaataagtacggcgggtccaggaggtgctattgcagcctatgctattatgggggtgcttgtgtattttttaatgacatcgctgggagaaatggctacaatgataccaaacgctggttcatttgaaacctatgcctcaaagtttgtagatccagcattaggttttgcattaggttggaactactggtttaactgggcgataactgttgcagcagaattagttgcaggcggacttgttgttaagttttggttgccaaatacagggacaactatttggagtataggatttttagttattttatttggtctgaatttgctatctgcaaaagcatatggtgaaggagaatactggttttcaagtataaaagtcgtaacaattatagtatttcttattatgggagtgcttattatatttggaataatgggcggacatggagtaggttttagcaattgggtgcttaaggatggaaaagggaattcagcaccatttgtaggtggaggaatggctatattaatgagctttttaactgccggattttcttttgctggcacagaggtagtaggtttagctgctggtgaagctgaaaatccggaaaaggatgtaccaaaagcaataaattcagttttttggagaatacttattttttatattggtgcaattatagttattggttttatcattccttttaatgattctaatttgcttaaaaatggtgtatcagatatagcgtatagtccatttactatagtgtttaaaagatctggaattgctcttgcagcgtcaataatgaatgcagttatactaacttctgtgctttcctgtggtaattcaggtctttatgcaggttcacgtatgatgtatgctatggctaaagaaggaaaagcaccaaagatatttggtaaattaaataaaagtggtgtaccactaaatgctcttatttttacttctgttattgcatcaacagcgttttttgcatcgcttattggtgacggtaagatatattcaattctttacaatttatcgggtataacaacatttataacatggcttggaatagcaatttgtcattatagatttagaaaagcttatattgctcaaggaaataaaattgaagatttaaagtataaggctttattgtatccatttggtcctatatttgcaatgatactttgtacagtagttttatttggtgctaatatatgggtgtttcaagcaaaaaccttcagttggttcgattttacaactaactatggaagcattcctttatttttatgtttttattttatatataaaaaagtgcataaaacaaggatagtttctttaatggagtgtgatcttaataagtag

SEQ ID NO: 17146 - protein, 489 aa, Clostridium acetobutylicum ATCC 824
MSAELEKDKNGELKRSLKTRHMNMIAIGGSIGTGLFFTSGNTISTAGPGGAIAAYAIMGVLVYFLMTSLGEMATMIPNAGSFETYASKFVDPALGFALGWNYWFNWAITVAAELVAGGLVVKFWLPNTGTTIWSIGFLVILFGLNLLSAKAYGEGEYWFSSIKVVTIIVFLIMGVLIIFGIMGGHGVGFSNWVLKDGKGNSAPFVGGGMAILMSFLTAGFSFAGTEVVGLAAGEAENPEKDVPKAINSVFWRILIFYIGAIIVIGFIIPFNDSNLLKNGVSDIAYSPFTIVFKRSGIALAASIMNAVILTSVLSCGNSGLYAGSRMMYAMAKEGKAPKIFGKLNKSGVPLNALIFTSVIASTAFFASLIGDGKIYSILYNLSGITTFITWLGIAICHYRFRKAYIAQGNKIEDLKYKALLYPFGPIFAMILCTVVLFGANIWVFQAKTFSWFDFTTNYGSIPLFLCFYFIYKKVHKTRIVSLMECDLNK

SEQ ID NO: 17147 - DNA, 1476 bp, Clostridium acetobutylicum ATCC 824
  CDS (1)..(1476): transl_table=11
atgacgtctaaaaaagaacaaaagaatgagcttaagagaacactgacggcaaggcatatgaatatgatcgcaataggaggctctgttggaactggacttttttttgcaagtggaagtgcaataagcacagcaggaccaggaggagcgcttcttgcatatataatcacgggaattctagtttatgtactaatgatgtcactaggagaaatgtcaacactattacctatttcgggttcttttgaaacctatgctactagatttgtagatccagcacttggatttactcttggctggaactactggttttcttggtccatatgtgtggcatcggaattagttgcaggatcacttatagtgaagttttggtttcctcatactaatacaaccatttggagcataggatttttacttgtaatttttatactaaatattctttctgctaaagcttatggagaaagcgaatattggttttcaagtattaaggtagttactataatcatatttatcatagttggagtacttatgatatttggaattatgggaaatgattcacctggttttaaaaattgggttatatcgggaaatggttcgagagcaccgtttgtaggtggaatagcagcaattataaatgtttttttagttgcaggcttttcgttttcaggtacagaaatagttggacttgcagctggagaaacagaaaatcctgaggaaaacgtcccaaaggcaattaaatctgttttttggcgtatactactattttatatttgtgcaattataataataggctttctagttccttttaatgacaagaatctattaaaaagtggagttaataatatagcatatagtccatttacaatggtatttgcaaagtgtggaatagcttttgcggcaagtgctatgaatgctgtaattttaacctcagtactttcttgcggaaactcaggactttatgtatcatcacgtatgctatattctcttgcaaaagaaggaaaagcacctaagtttttagcaaaggtaaacaagcaaggtgtacctatgaatgcgttatatgcaacaactttagttgcatcctctgcatttttgtcatcacttattggtgaaggaaagatatactatgttttatacaatgcatctggaataacagcattgtttgcatggcttggtataggaatctgtcattacaggtttagaaaagcttatgtagcgcaaggaagagatttaaaggacttgaagtttaaggctaagttttatccttatggtcctattatggcaatagtgttatgcgtagtaataatatttggagctaacatatggatatttcaggctccaaagttcagttggtttgattttataagtaattacatttgtattcctatatttatagcactatatatagcatataaatacattaagaaaactaagctagttccgcttgaggaatgcgattttgaatataacggaaaagataaataa

SEQ ID NO: 17148 - protein, 491 aa, Clostridium acetobutylicum ATCC 824
MTSKKEQKNELKRTLTARHMNMIAIGGSVGTGLFFASGSAISTAGPGGALLAYIITGILVYVLMMSLGEMSTLLPISGSFETYATRFVDPALGFTLGWNYWFSWSICVASELVAGSLIVKFWFPHTNTTIWSIGFLLVIFILNILSAKAYGESEYWFSSIKVVTIIIFIIVGVLMIFGIMGNDSPGFKNWVISGNGSRAPFVGGIAAIINVFLVAGFSFSGTEIVGLAAGETENPEENVPKAIKSVFWRILLFYICAIIIIGFLVPFNDKNLLKSGVNNIAYSPFTMVFAKCGIAFAASAMNAVILTSVLSCGNSGLYVSSRMLYSLAKEGKAPKFLAKVNKQGVPMNALYATTLVASSAFLSSLIGEGKIYYVLYNASGITALFAWLGIGICHYRFRKAYVAQGRDLKDLKFKAKFYPYGPIMAIVLCVVIIFGANIWIFQAPKFSWFDFISNYICIPIFIALYIAYKYIKKTKLVPLEECDFEYNGKDK

SEQ ID NO: 17149 - DNA, 1455 bp, Staphylococcus aureus subsp. aureus Mu50
  CDS (1)..(1455): transl_table=11
atggaagataataaaatgaaccgtagtcttaactcaagacacatttccatgattgctataggtggtgcaattgggactggtctatttgtagctactggtaatatcatttctcaagctggtcctggaggcgctatactcgcttatcttgttattggtgtcatgctatatttcttaatgtcatcaattggagagttggcaacattttatccagtatcaggttcattcagctcttattcaacacgctttattgactcatctcttggctttaccatgggatggttgtattgggcattgtggtcattagttacaagtgttgatgtcatagtagcgtcaaatgtgctttatttctgggacacatttaaatttttccaccccattacttggagcttaatctttattacaattttactattattaaacattttttctgtaaaatcatttggagaaactgagttttggttatcattgattaaagtgttaacaattatcgtattcgttatttttggctttttaatgattttcggtatcttaggtggtcatacatatggatttgaaaactatacaaaaggccaagcaccgtttgttggtggtatctctggtttcttaggcgtattattagtcgccggattttcggttggtggtacagaagtagtagcagtaactgctggtgaatcagatgaccctaaaaagtctatgcctaaggcaattaaacaagtattttggcgtattcttttattctatgtcttatcaattgcagtaattggtgcaattattccgtacacagatccatcattattaagagcaagtagttcaataagtcaaagcccatttacaattgtattcgatagagtaggcatagcctttgcagcatcagtaatcaacgcggttattttaacttcattattatccgctgcaaattcaggtgtttatacaacaggcagaatgttgtattccttaagttcagacaaaaaagcaccccaatttttaagtaaattaaacaagacaactaagttacctttaagagcattattaactacttatgcagtcgttgttattgttattatttatgcaaactttaattcaaatgccgtttttaatttacttgaaattattggttcaatgattatagttgtttggggatcaagcatttggtcacaaatacgattgcgacaagctattaaaaaacaaggtcaagaccctaataaggtcctaccatataaagcacctttttatccattaggaccaatcattgtcatcactacactattattcttgctatttggtggctcagttgaatatattttaaaagatcaatggttaaatgcttttaaaaactttttacctttaatcattctagcgttgatttactttattcataaaatcattcacaaaacaaaatttgtaaagctagaaacaattaatttaaaaccacacgattatgacaatcaaaactaa

SEQ ID NO: 17150 - protein, 484 aa, Staphylococcus aureus subsp. aureus Mu50
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQN

SEQ ID NO: 17151 - DNA, 1494 bp, Staphylococcus aureus subsp. aureus Mu50
  CDS (1)..(1494): transl_table=11
atgtcaaaagttcaaaatgaaagtaacaatgttgtcaaaaggggacttaaagatcgtcatatttctatgattgcgattgggggttgtattggtacaggtttatttgtaacttctggtggagcaattcatgatgcaggtgctttgggtgcattaataggatacgcaattatcggaataatggtatttttcttaatgacgtcacttggtgaaatggctacgtatttaccagtatcaggttcatttagtacatatgctacaagatttgttgatccatctttagggtttgcgcttggttggaactattggtttaactgggtagtaactgtagcagcagatattacgattgcagcacaagtcattcaatattggacaccattgcaaggcatacccgcttgggcatggagtgcgttgtttttagttataatttttagtctgaattcgttatcagttcgcgtctatggtgaaagtgaatactggttggcattgataaaagtgattacagttattgttttcattgcaattggtttattaacgattgtaggaatcatgggtggtcatgttgtaggatttgaaatatttaataaaggtgaaggtcctattcttggtggcaacttaggaggaagtttgttatcaattctaggtgtattcttaatcgctggtttctcattccaaggtactgagttaattggtattacggctggtgaatcagaaaatcctgaacgtgctgtgccgaaagcaattaaacaagtattctggagaattttattattttacattttagccatttttgttatcggtatgttaattccttatgatagtagtgcattaatgggtggtagtgataatgtagcaacgtctccattcacattagtgtttaaaaatgctggatttgcgtttgcagcatcatttatgaatgcagtcattttaacgtctgtgttatcagcaggtaactcaggtatgtatgcttcaacccgaatgctatattcaatgagtaaagataaattagcgtttgaagcatttggtaaaacaaataaaaacggtgtgccatatatgtcgttactcgttacagcaatcattgtagtgattattttcgtattacaaagccttacaaaaggtgcatacgaatatatcgttgcagcaagtggtttaactggttttattgcttgggtaggtatagcagtaagtcattatcgatttagaagagcatttgataaacaaaattatgacaaatctaaattaaaatatactgctaaattattcccattcggaccattatttgctggctttttatgtattgtagtaattattggtcaagatgttgactttattaaaacaggagattttaattttagtcgcttcttaattacgtatatgggaattccagtatttttagcattctttatttatcataagcttcgatataaaacgaaaaaaattccattagaacaagtagatttacgtcaagacgtgtcaatggatgaaataaaaggttaa

SEQ ID NO: 17152 - protein, 497 aa, Staphylococcus aureus subsp. aureus Mu50
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 17153 - DNA, 1413 bp, Bacillus subtilis subsp. subtilis str. 168
  CDS (1)..(1413): transl_table=11
atgaactctgcccacaacaagaatgagacaacctttcagagaagtatgaaaagccggcacctctttatgctttccttgggaggtgtcatcggaaccgggctgtttttaagctcaggttataccattcagcaagcaggcccggccggaacgatactcgcctacttagtcggggccggcatcgtctatctggtcatgctatgcctcggtgagctgtcagtcgccatgcctgtgaccggcgcctttcacacctatgcagccaaatacatagggccgggcaccggatttacggtcgcttggctgtattggctgacatggaccgtggcattgggatcagaattcacagcagccggcctgttaatgcagcgctggttcccccatacatcggtttggatgtggagtgccgtctttgcgctgttcatcttcttgcttaacgcattttcggtcaagtttttcgctgaatcagaattttggttttccagcatcaaagtattagccattgtattatttattcttttaggcggctctgccatgttcggcatcatcccgatcaaaggcggagaagccgctccgatgctgtccaacttcacggcggaaggcgggctttttcccaatggatttgtcccgattttgatgacgatgctgtccgtcaattttgccttttcgggaacggaactaatcggaatcgcagccggtgaaagcgttgatcctgacaagacgataccaaaagcgataaaaacaacggtctggcgtctctcgctcttctttgtcggaacaatttttgtgctgtcagggctgattccgattcaagatgcaggtgtcatcaaaagcccgtttgtcgctgtctttgacagagtcggtgtaccatacgcagccgatatcatgaactttgttatcctgacagcgatcctgtcagcggctaattccggactctacgcttcttcccggatgctgtggtctttatcaaaagaaaaaacgcttcatccgacatttgcaaagctgacgtcaaaaggaaccccttttaacgcgctggtgttcagcatgatcggcggcattctgtcgttgctgtccagcgtatttgcgccagacactgtatacgttgtgctcgtgtcgatttccggttttgccgtcgttgtcgtgtggatgggaatcgctgcttctcaattcatgttcagaaaacgttatatcgaagcgggaaacaaggttactgatttgaaatacagaacccctttgtatccgttcgtgccgattgctgcgttcctgttatgcctggcttccgtcgttggcattgcctttgatccgaatcaaagaatcgcactctattgcggcgttccatttatggccatttgctatgcaatatattatgtaaaaaaccgcaaaagccagccggctgctgatatgactcattcaaaataa

SEQ ID NO: 17154 - protein, 470 aa, Bacillus subtilis subsp. subtilis str. 168
MNSAHNKNETTFQRSMKSRHLFMLSLGGVIGTGLFLSSGYTIQQAGPAGTILAYLVGAGIVYLVMLCLGELSVAMPVTGAFHTYAAKYIGPGTGFTVAWLYWLTWTVALGSEFTAAGLLMQRWFPHTSVWMWSAVFALFIFLLNAFSVKFFAESEFWFSSIKVLAIVLFILLGGSAMFGIIPIKGGEAAPMLSNFTAEGGLFPNGFVPILMTMLSVNFAFSGTELIGIAAGESVDPDKTIPKAIKTTVWRLSLFFVGTIFVLSGLIPIQDAGVIKSPFVAVFDRVGVPYAADIMNFVILTAILSAANSGLYASSRMLWSLSKEKTLHPTFAKLTSKGTPFNALVFSMIGGILSLLSSVFAPDTVYVVLVSISGFAVVVVWMGIAASQFMFRKRYIEAGNKVTDLKYRTPLYPFVPIAAFLLCLASVVGIAFDPNQRIALYCGVPFMAICYAIYYVKNRKSQPAADMTHSK

SEQ ID NO: 17155 - DNA, 1428 bp, Escherichia coli K12
  CDS (1)..(1428): transl_table=11
atgtccatacgtttagaaggttatatgcaaacaacacaacaaaatgcgccactgaagcgcacaatgaaaacgcgtcacctgattatgctttccttgggcggcgtgattggcacaggattattcttcaataccgggtacatcatttccaccactggagcggcgggaacgctgctggcctatctgattggtgcgctggtggtctggctggttatgcagtgtctgggcgagctgtcggtcgcgatgccggagaccggagcgtttcacgtttatgccgcgcgctatcttggtccggctaccgggtataccgtggcctggctttactggctgacctggaccgtggcgctgggttcgagctttaccgccgctggattctgtatgcagtactggtttccacaggtgccggtatgggtctggtgcgtggtgttctgcgcgattatttttggtctgaatgttatctccacgcgcttttttgccgaaggggagttctggttctcgctggtcaaagtggtcactatcatcgcctttatcatcctcggtggggcggcgattttcggctttattccgatgcaggatggctcgcccgcgccggggctgagtaatatcacggcagaaggctggttcccgcacggtggcttaccgattttgatgactatggtggcagtgaactttgctttttcgggtaccgagcttatcggcattgccgccggtgaaacggaaaacccgcgcaaagttatcccggtagcgattcgtactaccatcgcgcgactgattattttctttatcggcaccgtgtttgtgctggcagcgctgatcccgatgcagcaggtgggcgtggagaaaagcccgtttgtgctggtatttgagaaagtagggatcccgtacgccgctgatatttttaacttcgtgatcctgacggctattctttctgcagcgaactccgggttatatgcctccgggcgcatgctgtggtcgttgtcgaatgaacgtacgctaccggcctgttttgcgcgagtaacgaaaaacggcgtgccactgacggcgctgtcggtcagtatgctcggtggtgtgctggcgctgttttccagcgtggtggccccggacacggtatttgttgcgctgtcggcaatctccgggtttgcggtggtagcggtgtggctgagtatctgcgcctcgcattttgtttttcgtcgccgtcatctgcaacaaggtaaggcattgagtgaattacattatcgcgcgccgtggtatccgctggtgccagtattaggttttgtgctgtgcctggtggcctgtgttgggctggcattcgatccagcgcagagaattgcgttgtggtgcgggttaccgtttgttgcgttgtgctatggtgcttatttccttactcaaccccgaaacgcaaaacaggagccagaacatgtcgcagaataa

SEQ ID NO: 17156 - protein, 475 aa, Escherichia coli K12
MSIRLEGYMQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 17157 - DNA, 1461 bp, Listeria monocytogenes EGD-e
  CDS (1)..(1461): transl_table=11
gtgaaaaaagaaacacatggcgagattcgtcgtgacttaaaaacaaggcatttgtccatgattgccattggtggttcgatcgggacgggattatttttagcaagtggtaatgcgattcatactgccggacctggtggcgcgttggttgcttatgttgcaatcgggattatggtgtactttttaatgacaagtttaggcgaaatggctacttacatgcctgtatctggttcatttagtacgtatgctagtcgatttgttgacccagctttcgggtttgcacttggttggaattattggtttaactgggcaattacgctagcagtcgatatttccaccgcggcgattattgttcaattttggctaccgaatactcctgcttggctatggagcgcgattttcttaattttgatttttggcttaaatgcgctttcggtaaaagcttacggagaatcagaatattggttttcgattattaaagtggccacggttattattttccttatcgtcggcgtgctaactattgttggaattcttggcggcgaagttattggcttttctaactttacagctggcgatgctccgtttaaaggtggtttttttgccatcttaggtaccttcttaattgctggattttctttccaagggactgaaatggttggtattgcggcaggtgaaagtgctactccagaaaccagtgtgccaaaagcgattaaacaagtgttctggcggattttgttattttatatttttgcgattttcattattgggatgattattccttatactaacccgaacttacttagtgccgaggcaactgatgtggcaattagcccatttacactcgtatttgaaaaagctggtcttgcatttgcggcttcagtgatgaatgcggttatcctgacttctgttctatctgctggtaattcaggtctttacgcttccaccagaatgctttgggcgatggctcgcgataaaaaagcacctaaattcttgggaaaagtaaaccgtcgtggtattccgatggcagcattaatcgttacgacgattgttggtgccatgacattcattacaacgctaacagaaaatggcacagtaatttatacgtggttactttctgcctctggtttaactggatttatcgcttgggtcggcatcgctatcagtcattaccgtttccgaaaagcatttatcaaacaagggcatgacttaagtgaactaaaatataaagcgaaatttttcccattcggacctattttagcacttgttttatgtattttagtcattgtcggtcaagattacgcggcatttttaaaaccagaatttacgaatccggcttggtggcaaaaaatcggcatttcgtatatcggtcttcccattttcctagttttttggctatcttttaaatttacaaataaaactaaagttattccactggaagactgcaaatttgatcaaaaataa

SEQ ID NO: 17158 - protein, 486 aa, Listeria monocytogenes EGD-e
MKKETHGEIRRDLKTRHLSMIAIGGSIGTGLFLASGNAIHTAGPGGALVAYVAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALVLCILVIVGQDYAAFLKPEFTNPAWWQKIGISYIGLPIFLVFWLSFKFTNKTKVIPLEDCKFDQK

SEQ ID NO: 17159 - DNA, 1461 bp, Listeria innocua Clip11262
  CDS (1)..(1461): transl_table=11
gtgaaaaaagaaacacatggcgagattcgtcgtgacttaaagacaaggcatctatccatgatagcaattggtggttcaatcggaacaggattatttttagcaagtggaaatgcgattcatactgctgggcctggtggagcgctagttgcttatattgcgattggcattatggtgtactttttaatgacaagcttaggtgagatggctacctatatgcctgtttccggctcatttagtacgtatgctagtcgatttgttgatccagcttttggttttgcactcggttggaactattggtttaactgggcgatcacgcttgcggtcgatatttcaacagcggcgattattgttcaattttggttgccgaatacgcctgcttggctctggagtgcgattttcttactcttgattttcgggttaaatgccctatcggtaaaagcttacggggagtcagagtactggttctcaattattaaagtagcgactgttattatttttcttatcgtcggtgtgctgacaattgttggtattcttggcggcgaagtgattggcttttctaactttacagcaggagatgcaccatttaaaggtggatttttcgcgatattaggcacgttcttgattgctggattttctttccaaggtactgaaatggttgggattgcagctggtgaaagcgctactccagaaaaaagtgttcctaaagcgattaagcaagttttctggcggattttgttattttatatttttgcgattttcattatcgggatgattattccttatactaatccgaatttactgagcgctgaggcaacagatgtggcgattagtccatttacgctcgtatttgaaaaggctgggctagcttttgcggcttcggtaatgaacgcggttatcttgacttccgttctatccgctggtaattcaggcctttacgcttccacaagaatgctttgggcaatggctcgtgataaaaaagctcctaaattcttaggcaaagtaaaccgtcgtggtatcccgatggctgcacttattgtgacaaccattgttggtgcgatgacattcattactacgcttaccgaaaatgggacagtgatttatacatggctcctttctgcctctggtttaaccggatttatcgcttgggtcggcatcgctattagccattaccgattccgtaaagctttcattaagcaaggccatgatttgaacgaactaaaatataaagccaaatttttcccttttggtccgattttagctttaatcttatgtattttagttattgtcggtcaagattacgcggcatttttaaaacctgaatttacgaatcctgcttggtggcaaaaaatcggtatttcttatatcggcctccctattttccttatcttctggttatcatttaaatttacaaataaaacaaaagtcattccactggaagactgcaaatttgatcaaaaataa

SEQ ID NO: 17160 - protein, 486 aa, Listeria innocua Clip11262
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLLLIFGLNALSVKAYGESEYWFSIIKVATVIIFLIVGVLTIVGILGGEVIGFSNFTAGDAPFKGGFFAILGTFLIAGFSFQGTEMVGIAAGESATPEKSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLNELKYKAKFFPFGPILALILCILVIVGQDYAAFLKPEFTNPAWWQKIGISYIGLPIFLIFWLSFKFTNKTKVIPLEDCKFDQK

SEQ ID NO: 17161 - DNA, 1530 bp, Ralstonia solanacearum GMI1000
  CDS (1)..(1530): transl_table=11
atgcatacaccgatcacccccaccggcctcgagggccagtccgaactgcgccggcgcctgcgcgcgcgccacctgacgatgatcgccctcggcggcgccatcggcaccgggctgttcgtcgcctccggcgcctccatcgcgcaggccggcccgggcggcgccctgttcacctacacgctgatcggcgtgatggtctactgcctgatgacgagcctcggcgagctggcggtgcacctgccggtgtcgggctccttcgtcacgtacagccggctgtacgtggaggaagggttcggctttgcgctggggtggaattactggtttgcgctggcggtgtccgtggcggtggagctggcggcggcgcagctggtgatgaagtactggttccccggcgtctcgggcatggtctggagcgccgccttcctgctgctgatgttcgtgctcaacgcgttctcggtgcgcggcttcggtgaggcggaatactggttctcgatgatcaaggtggtgaccatcgtcgtgttcctgctgatcgggctggcgatgatcttcggcatcatgaaaggcgggccgcagtcgggctggcacaacttcacggtgggcgacgcgccgttcgtgggcggactgcctgcgatgatcggcgtggcgatgatcgccgggttctcgttccagggcgtcgagaccatcggcgtggccgccggcgaggcggagaaccccgcccgcaccattccgcgcggcatccgccagaccttctggcgcatcctgctgttctacgtgctggcgatcctgatcatcgccgtgctgctgccgtacaccgatccgaacctgctgcgcaacgaggccaccgacatcggcgtaagcccgttcgcgctggtgttccagcatgccggcctcgccttcgccgccggcatgatgaacgcggtggtgctgaccgcgctgctgtcgtccggcacctcgagcctgtatgtctcgacgcgcatcctctacgacctcgcgcttgaaggccaggcgccgcggtggttcgccagggtctcgggcaacggcgtgccgcaccgggcgctgctggccacctcggcggtgggcgcgctgtgcttcttcagctcgctcttcggcgaccaggtcgtgtacctgtggctgctcaatacctcggcggtgacgtgcttcatcgcctggttcggcatcgcgctggcgcactaccgcttccgcaagggctttctgcatcagggccacacggtcgatcagctcgaataccgctcgcccttcttcccgttcgggccgatcctggtggccgccctgtgcgtgatcatcatcctcgggcagaacaccaaggcgctgttcgcgccgatcgacaacttcggcgccttcgtcgccacgtattgcggggtgtttctgttcgtggcgatctggctggggtaccggtggcgctacaagacgcggtttgtgcggtacgagcagatgcagttcagcccgcggcacatccgggcggcgcaggccggggatggcggggccgcgctgccgggcgtggccgcggattag

SEQ ID NO: 17162 - protein, 509 aa, Ralstonia solanacearum GMI1000
MHTPITPTGLEGQSELRRRLRARHLTMIALGGAIGTGLFVASGASIAQAGPGGALFTYTLIGVMVYCLMTSLGELAVHLPVSGSFVTYSRLYVEEGFGFALGWNYWFALAVSVAVELAAAQLVMKYWFPGVSGMVWSAAFLLLMFVLNAFSVRGFGEAEYWFSMIKVVTIVVFLLIGLAMIFGIMKGGPQSGWHNFTVGDAPFVGGLPAMIGVAMIAGFSFQGVETIGVAAGEAENPARTIPRGIRQTFWRILLFYVLAILIIAVLLPYTDPNLLRNEATDIGVSPFALVFQHAGLAFAAGMMNAVVLTALLSSGTSSLYVSTRILYDLALEGQAPRWFARVSGNGVPHRALLATSAVGALCFFSSLFGDQVVYLWLLNTSAVTCFIAWFGIALAHYRFRKGFLHQGHTVDQLEYRSPFFPFGPILVAALCVIIILGQNTKALFAPIDNFGAFVATYCGVFLFVAIWLGYRWRYKTRFVRYEQMQFSPRHIRAAQAGDGGAALPGVAAD

SEQ ID NO: 17163 - DNA, 1539 bp, Ralstonia solanacearum GMI1000
  CDS (1)..(1539): transl_table=11
atgtcagaacacaccaccgcgtccgccgggacgccgggcttgcgccggactttgcgtgcgcgccacctcaccatgatcgccatcggcgggtcgatcggcaccgggctgttcgtcgcctcgggcgcgtcggtgtcgcaggccggccccggcggcgcgctggccgcctacgtgctgatcgggacgatggtctactttctgatgaccagcctcggcgagctcgccgcctacatgccggtgccgggctcgttcgccacctacggcgcgcgctacgtggacgaaggcttcggcttcgcgctgggctggaactactggtacaactgggcggtgacgatcgcggtggagctggccgccgcgcagctggtcatgcactactggtttcccgaggtgccgggcgtgctgtggagcgcgggcttcctggcggtgatgttcctgctcaacgcgatctccgtgcgcggcttcggcgaggcggaatactggttcgcgctcatcaaggtcgtcaccgtgctgtgcttcatcgcgatcggcctggcgatgatcttcggcatcatcaagggcgcgccggcatcgggcctgcacaacctgaccctcggcgaggcgccgttcgtgggcgggctgccggcgatgatcggcgtggcgatgatcgccgggttctcgttccagggcaccgagctgatcggcgtggcggcgggcgaatcggccgacccggcgcgcaccattccgcgcgcggtccggcaggtgttctggcgcatcctgctgttctatgtgctggcgatcttcatcatcggcgcgctggtgccgtacaccgatccgaacctgctgtcgacggaggtcgccaacatcggcgtgagcccgttcacgctggtcttccgccatgccggcctggcctttgccgccgggctgatgaacgcggtgatcctgacggcggtgctgtcggcgggcaattcgggcatgtatgcgtccacgcgcatgctctacaacctcgccaccgaaggccgcgcgccgcgcctgttcgcgcggctatcgaagaacggcgtgccgcgcaatgcgctgctggccaccaccgccgtgggcgcgctgtgcttcctgagctcgctgtacggcgacaagaccgtctacctgtggctgctcaacacctcgggcatgaccggcttcgtcgcgtggctgggcatcgcgatcagccattaccgcttccgcaagggcctggtgctgcagggccacgacccggcgctgctgccctaccgctcgccgttctttccgtacggcccgctgttcgcgttcgggttgtgcctggtcatcaccctgggccagaactaccaggccttcgccagcggccgggtcgactgggccgaggtgaccgccacctatatcggcatcccgatcttcttcgcggtctggctaggctaccggctggtgcgcggcggcggcatcatccgctaccaggacatgcgcttcccgcgcccgcccgtcacgcgcgacccgccgggcgaagcgcccgccgcccccgggctgccggccgccgcgacgagcccgcagcgttga

SEQ ID NO: 17164 - protein, 512 aa, Ralstonia solanacearum GMI1000
MSEHTTASAGTPGLRRTLRARHLTMIAIGGSIGTGLFVASGASVSQAGPGGALAAYVLIGTMVYFLMTSLGELAAYMPVPGSFATYGARYVDEGFGFALGWNYWYNWAVTIAVELAAAQLVMHYWFPEVPGVLWSAGFLAVMFLLNAISVRGFGEAEYWFALIKVVTVLCFIAIGLAMIFGIIKGAPASGLHNLTLGEAPFVGGLPAMIGVAMIAGFSFQGTELIGVAAGESADPARTIPRAVRQVFWRILLFYVLAIFIIGALVPYTDPNLLSTEVANIGVSPFTLVFRHAGLAFAAGLMNAVILTAVLSAGNSGMYASTRMLYNLATEGRAPRLFARLSKNGVPRNALLATTAVGALCFLSSLYGDKTVYLWLLNTSGMTGFVAWLGIAISHYRFRKGLVLQGHDPALLPYRSPFFPYGPLFAFGLCLVITLGQNYQAFASGRVDWAEVTATYIGIPIFFAVWLGYRLVRGGGIIRYQDMRFPRPPVTRDPPGEAPAAPGLPAAATSPQR

SEQ ID NO: 17165 - DNA, 1470 bp, Clostridium perfringens str. 13
  CDS (1)..(1470): transl_table=11
atgagtcaagaacaaaatactaatctaaaaagaggcttgaaatcaagacatcttagcatgattgccatgggtggtgccataggaactggtattttcttagccatgggagatacacttcatcaagccggtgtaggaggagcttttgtagcttacggaatcataggagtaatggtatatttcttgtgtacaagcttaggggagatggcaacatatatgccagaaacaggttcctttggagcttatgcaacaaaatttgttgatcctgctttaggatttgctctaggatggaattactggtataactgggctataacaatagcagcagaaatggttgcaggttctttattaatgaagttttggtttcctaatattccagcaatagtttggagcgcattattcttagtaattatattaactcttaatttattatctgccaaagcttatggagaatcagagttttggtttgcagctgtaaaagttgctactgttataatattcttaatcgtaggagttcttatgatttttggaatattaggtggagataatgtaggattcaaaaacttctatgaaaatggagggccatttattggaggagcaaaatcaattttcatgatctttttaatagctggtttctcatttcaaggaactgaattagtaggggttgctgctggagaaagtgaagatcctgaaaaaaatgtacctaaggctgttaatacaatattttggagaatcttattattttatttaggaacaattttagtaataggtgctttagtgccaaatgctcaagcaggagtagaaacaagtgcatttacaatagtatttgaaaaattaggattagctggagccgcttctattatgaatgctataatacttacatccgttttatcagctggtaactctggtatgtatgcatcgagtagaatgctttatgctatggctaaaaatggaatggcacctaagatttttgaaaaaactaattctagaggagtaccagttaatgctattataataacaacaataattgcaagtttatgtttcttaacaggtatttatgccgaaaatacagtttatgtatggcttgtagcagcctcaggattatcaggatttatagcttggcttggaatcgcaatatgtcattatagatttagaaaagcttatgtagctcaaggtaaagatatgagtagattagtttataaagctaaattattcccactagggcctataatagctttaatattatgtggaataatagttttaggtcaaggatatgcatacttagatgttagaaatggagtagactggggtggattaatttcatcttatattggattacctctattctttggattatttgcatattataaaattaaatataaaactaaaataatagacttaaaagatgttgacttaagtgtagagcatatagatactgatgagagtatagaagatgaagtattttcttactaa

SEQ ID NO: 17166 - protein, 489 aa, Clostridium perfringens str. 13
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNIPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKNGMAPKIFEKTNSRGVPVNAIIITTIIASLCFLTGIYAENTVYVWLVAASGLSGFIAWLGIAICHYRFRKAYVAQGKDMSRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 17167 - DNA, 1398 bp, Xanthomonas axonopodis pv. citri str. 306
  CDS (1)..(1398): transl_table=11
atgcccgagccgtcgtccgccaccgcaccgcagttccagcgcagcatgcaggtgcgccatctggtgatgctgtcgctgggcggggtgatcggcaccggcctgttcttcaacactgggtacatcattgccagcaccggcgcgctgggcacggtactggcgtatctgatcggcgcactggtggtgtacctggtgatgcaatgcctgggcgagctggcggtggcgatgccgcaaaccggtgcgtttcatgtgtatgccgcgcgctacctcggcccggcgaccggctatgtggtggcgtggttgtattggttgacctggacggtggcattgggttcgagcctgacggccgcagcgttctgcatgcagtactggtttccgcacagcctggcgtggccgtggtgtctgctgttctgcgcgctgatcttcggcctgaatacagtttcggcgcgctggtttgccgaaggcgagttctggttttcgttgatcaaggtgatcaccatcctggtgttcatcgtgcttggcggcgcggcggtgatcggtctgttgccactggccgacggttcgcccgcacccgggctgcgccatctgcgcgccaacggctggttcgcgcacggtacgctcccgatcttgatgacgatggtggcggtgaatttcgcattttccggcaccgagttgatcggcgtggcggccggcgaaaccgcacagcctgcacgcgcgattccgctggcaatccgcacaacgctggtgcggctggtggtgctgttcgtcggcacggtgctggtgctggcggcgctgctgcctgccagacgagcggccgtggaaaccagcccgttcgtgcgcgccttcgagctgttgggcattccatatgcagccgacatcttgaatgcggtgatcctcaccgcgatcctgtcggcggccaattccgggctgtatgcggccgcgcgcatgctgtggtcgttggccaatgaaggcacgttgccgagcggcctggcgcgcttgaccggccgcggcatcccgttgcgtgccgtgtcgctgagcatgctgggcggcttgctggcgctgctcaccggcgtgtatgcgcccgaaacggtgttcgttgcgatctcggcagtctcgggcttcgccgtcgtggtggtgtggctgagcatttgcgccgcgcattaccgcttccgtcgccaatggctgcgcgatggcgctgcgctggaaacgctggcgtatcgcgcgccgtggtacccgtggaccccgattctgggcttttcgctgtgtctgctcgcctgcatcgggttggcattcgatccgcagcagcgcattgcgttgtggtgcggtattccgttcgtcgcgctgtgctatggcgcctacgcacttacccaatggcttgcggcccggagactgtacgcatga

SEQ ID NO: 17168 - protein, 465 aa, Xanthomonas axonopodis pv. citri str. 306
MPEPSSATAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSLAWPWCLLFCALIFGLNTVSARWFAEGEFWFSLIKVITILVFIVLGGAAVIGLLPLADGSPAPGLRHLRANGWFAHGTLPILMTMVAVNFAFSGTELIGVAAGETAQPARAIPLAIRTTLVRLVVLFVGTVLVLAALLPARRAAVETSPFVRAFELLGIPYAADILNAVILTAILSAANSGLYAAARMLWSLANEGTLPSGLARLTGRGIPLRAVSLSMLGGLLALLTGVYAPETVFVAISAVSGFAVVVVWLSICAAHYRFRRQWLRDGAALETLAYRAPWYPWTPILGFSLCLLACIGLAFDPQQRIALWCGIPFVALCYGAYALTQWLAARRLYA

SEQ ID NO: 17169 - DNA, 1377 bp, Streptococcus agalactiae 2603V/R
  CDS (1)..(1377): transl_table=11
atggaaaatcatcgttatgaagatgaaggtaaattccagcgtaagatgaccagtcgtcatctctttatgttatcgctaggtggtgttatcgggactgggcttttcttgagttcaggttataccattgcacaggctggtccgcttggagctgtgctgtcttatttgattggtgccgttgtggtttatttggtcatgctatcacttggggaattggcggttgccatgccggtgacggggtcattccacacttatgccactaagtttatcagtcctggaacaggttttactgttgcttggctatattggatttgttggacggtcgccttggggactgaatttttaggtgctgccatgctgatgcagcgctggttcccaaatgtgccggcttgggcatttgcttccttttttgcccttgtgatttttggtttaaatgctcttagcgtacgcttttttgcagaagcagagtctttcttctcaagtattaaggttattgctatcattatctttattatcttgggcttaggtgctatgtttggtctagtttcctttgaaggtcagcacaaggctattctcttcactcatctgactgccaatggtgcctttccaaatggtatcgttgcagttgtctcagtcatgttggctgttaactatgccttctctggtactgagttaattggtattgcggctggtgaaacggataatcccaaagaagctgtaccaagggctattaaaacgacaatcggtcgcttggttgttttctttgtactgacaattgttgtcctagcttcgctattgccaatgaaagaggcaggcgtatccacagcaccattcgttgatgtctttgacaagatgggaatcccttttacggcggatatcatgaacttcgttatcttgacagccatcctgtctgctggtaactcaggtctctacgcatcaagccgtatgctctggtcccttgccaatgaaggtatgttgtcaaaatctgttgtgaaaatcaataaacacggtgtcccaatgcgtgctcttctcttgtcaatggcaggagcagtgctgtcgctcttttcaagtatttacgctgcagacacagtttatctagccttggtttcaatcgcgggctttgctgttgttgtcgtatggctagccattccagtcgcacaaatcaatttccgcaaggaattcttgaaagagaatcaactagaagatttgtcttacaaaacaccttttacaccagttctcccttatatcacaatcattttgctcttgatttcgattgtagggattgcttgggatagctcacaacgtgctgggctttacttcggtgttccatttattattttctgctatatttatcacaaactacgttacaagaaatggtga

SEQ ID NO: 17170 - protein, 458 aa, Streptococcus agalactiae 2603V/R
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPNVPAWAFASFFALVIFGLNALSVRFFAEAESFFSSIKVIAIIIFIILGLGAMFGLVSFEGQHKAILFTHLTANGAFPNGIVAVVSVMLAVNYAFSGTELIGIAAGETDNPKEAVPRAIKTTIGRLVVFFVLTIVVLASLLPMKEAGVSTAPFVDVFDKMGIPFTADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENQLEDLSYKTPFTPVLPYITIILLLISIVGIAWDSSQRAGLYFGVPFIIFCYIYHKLRYKKW

SEQ ID NO: 17171 - DNA, 1401 bp, Bifidobacterium longum NCC2705
  CDS (1)..(1401): transl_table=11
atggcggcagccggcacacccaaggacgataccggccttgaacggaagatggagtcgcgtcacctgacgatgatctccctgggcggcgtgatcggcaccggcctgttcgtcagctccggctacgcgattcatcaggcgggaccgttgggcgcgatcctcgcttacgcggccggctccctgctcgtctactgcgtgatggtgtcgttgggcgagctgtccgtggccatgccgtacgccggcagcttccacatgtatgcgaagcggttcatcggccccggcaccgcgttcaccatcgccatcctgtattggctgaactgggcggtggcgctcgcctccgaattcacggccgcagggctgttgatgcagcgatggttcccgcattcgccgtcctgggtgtggtcggccgtgttcattgtggtggtgttcgcgctcaacatcatgtccgtgcggctgtacggcgaggcggaattctggttcgcgtcaatcaaggtgttcgccatcatcgcgttcattgtgatcggcctgctggcgatcttcggcgccataccgattgccggtcatgattccgcgccgttgctgggcaacttcgtggccggcggctggttcccgagcggcatcgcgccgattttctcgactttgctgaccgtggtgttcgcgttctccggcaccgaagtggtgggcgtggcggccggcgaaaccaaggatccctcgcgtgcgattcccaaggccgtgcacaccacggtgctgcgcctggcgattttcttcatcggctcgattctggtgatggcggccttgatcccctggcatcaggccggcgtggatacgagcccgttcgtgctggtgttccagtcaatcggtatgccgttcgccggcgacatcatgaacttcgtggtgttgacggccgtgctttccgccgcgaactccggcctgtacgtgtgttcgcgcatggtgtggtcgctggccaaggagcggctgattcccgaacgttttgctaggacgaatttccgtggtgtgccggtgtgggccgtgctgttcagcatggcgggctcactgctggcgttgctgtcttccgtgatcgccgcctcgaccgtgtatctggtgttggtcgccgtgtcaggtttggcgacgctggtggtgtggttctccgtatgcgtgtgccatatccgtttccggcgcgaatgggcgcgggatgggcacagcgccgatgagctcggctatcgtgcgcccggtttcccggtgctgccgtggctggccatcgtgatgtgcatcggcgcgctggtgctcgtggtgctcgatgatacgcagcgttcgaccctgtattgcatgatcccgttcgtcgcctgctgctacgcggcttattacgcactcgaacggcagcgcaaacgcgaaaacaacgcctaa

SEQ ID NO: 17172 - protein, 466 aa, Bifidobacterium longum NCC2705
MAAAGTPKDDTGLERKMESRHLTMISLGGVIGTGLFVSSGYAIHQAGPLGAILAYAAGSLLVYCVMVSLGELSVAMPYAGSFHMYAKRFIGPGTAFTIAILYWLNWAVALASEFTAAGLLMQRWFPHSPSWVWSAVFIVVVFALNIMSVRLYGEAEFWFASIKVFAIIAFIVIGLLAIFGAIPIAGHDSAPLLGNFVAGGWFPSGIAPIFSTLLTVVFAFSGTEVVGVAAGETKDPSRAIPKAVHTTVLRLAIFFIGSILVMAALIPWHQAGVDTSPFVLVFQSIGMPFAGDIMNFVVLTAVLSAANSGLYVCSRMVWSLAKERLIPERFARTNFRGVPVWAVLFSMAGSLLALLSSVIAASTVYLVLVAVSGLATLVVWFSVCVCHIRFRREWARDGHSADELGYRAPGFPVLPWLAIVMCIGALVLVVLDDTQRSTLYCMIPFVACCYAAYYALERQRKRENNA

SEQ ID NO: 17173 - DNA, 1575 bp, Bifidobacterium longum NCC2705
  CDS (1)..(1575): transl_table=11
atgagtcagcccgacaccgacacggcggcacagtcgccgtcctcgcaacaggaaccgcagattcagacggatggccgtcgaagccattcggaacagatgaatcaaccagcgcaaaccagccagtccgagtcgtcacatgatggcaaagacgagcacgccctacataccaacctgaagcgcggcatggaatcccgccacctgcagatgatctcattaggcggcgtaatcggcaccggcctgttcctgagctccggatacaccatccagcaggcgggccccatcggcacgatcctggcatacagcatcggcgcgctgatcgtctatctggtcatgcttacgctcggcgaattgtccgtggccatgccggtgaccggctccttccacgtgtatgccgaaaagttcatcggccccggcaccggcttcgtgatcgcaatccagtattggctcacctggacggtggcgctcggctccgaattcaccgccgccggcctgctcatgcaacgctggttcccggacagccccacatgggtgtggagcgcggcgtgcatcattctcatcttcaccttaaacgccttgtcggtgcggctcttcgccgaagcggaattctggttcgcctcgatcaaggtgttcgctatctgcgcgttcatcgtcatcggcctgctcgccatattcggcgttattccgattgccggctaccagcatgctccgatgttcggcaacctcgttaaggacggcatcttccccaacgggttcatgccagtgttcgccacgattctgaccgtcaacttcgcgttctccggcaccgagctcatcggcgtgaccgccggcgagacgcgcgacccggaaaccaccgtgccgaaggccatccacaccacgctgtggcgcctggtgctgttcttcatcggctcgatcaccgtgatgtgcgcgctgatcccgtggcgccaggccggcgtgggcgaaagcccgttcgtgctcgtcttcaacagcatcggcatcccctatgcgggcgacatcatgaatttcgtggtgctgacggccgtgctttccgcctcgaattccggcctgtacgcctccacgcgcatggtgtggtcgatgggcaacgaaggcatgattccgcgctggttcgccaaaacgaaccgtcgcggcgtgccgatgctcgccttgtgcgccgcgatggccggtggcctgctggcgctcctgtcttccgtgatcgccgcctcgactgtgtacctggtgctggtggcgctttccggcctgtccgccgtggtggtgtggatcgccatcgcctactgccagatcgtgttccgtcgccgttggctggagtccggccattccaccagcgaactcaaataccgcacgcccggctatccgtacgtgtcttgggcggcgttcatcctgtgcaccgcatcgttcgtattggtgattttcgacgtggagcaacggttcgcgctcgtggccgagctcgtgttcatcgtggcctgctatggggcgtatttcctgcaacagtgggtacgcaagcgcaaaaaggcgaccgaggccgacgacctcgatacgctttgggtcgcgcgcgactga

SEQ ID NO: 17174 - protein, 524 aa, Bifidobacterium longum NCC2705
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGLLAIFGVIPIAGYQHAPMFGNLVKDGIFPNGFMPVFATILTVNFAFSGTELIGVTAGETRDPETTVPKAIHTTLWRLVLFFIGSITVMCALIPWRQAGVGESPFVLVFNSIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLESGHSTSELKYRTPGYPYVSWAAFILCTASFVLVIFDVEQRFALVAELVFIVACYGAYFLQQWVRKRKKATEADDLDTLWVARD

SEQ ID NO: 17175 - DNA, 1377 bp, Streptococcus mutans UA159
  CDS (1)..(1377): transl_table=11
atggaaaaccacaattttgaaaatgaaggtcagtttaagcgaaaaatgaccagtcgtcatctctttatgttgtccttaggcggtgttattggaacagggcttttcttaagttcaggttatacaattgctcaagctggtcccttaggagcggtaatttcttatttagttggtgctattgttgtttaccttgtgatgctttctttgggtgaattagcagtagctatgcctgttacaggttcttttcatacctatgctaccaaattcatcagtcctggaactggttttaccattgcttggctttattggatttgttggacggttgctttagggacagagtttcttggtgcaggtatgttgatgggacggtgggttccttatgttcccacttgggtctttgcagcactttttgccttgcttatttttggtctcaatgctctcagtgttcgttcttttgctgaagcagaatccttcttttctagtataaaggttttagctattcttgtttttattattcttggttttggagccatgcttggtttggtttcttttaatggtaagcacgaagtatttctttttagtcatttgacagctcatggagctctgccaaagggacttccagcattaatgtcagtcatgctggcagttaattatgccttttctggaacagagctcatcgggattgcagcgggagaaacgaacaatcctaaagaagctgttcccaaggctattaaaacaacaattggtcgtttagtgattttctttgtattgacaattgttgtcttagcatcgtttttaccaatgaaagaagcaggtgtatccagtgctccttttgttgatgtttttgataagatgggcattccttttgctgctgatatcatgaatttcgttattttgacagctattttgtctgctggtaattcaggactttatgcttccagccgcatgctttggtctttggccaacgaaggtatgattagtccgagggttgttaaaatcaatgaacacggtgttcctatgagagctttgctcctatcgatggcaggtgctgttttatccttgttttcaagtatctatgcggcagataccgtttatttggctctgatgtcaatcgctggctttgctgttgttgtagtctggttgtccattcctatggcacaaattaattttcgtaaggaatggctgaaaagtcatgcccaagaagacttgttttataaaacgccttttactccaattctgccttacattacgattatgctattgttgatttcgattattggtattgcttgggatgcatcacaaagagcgggtctttatttcggtataccttttattctactttgttatctttattattattggcggcataagacattgtaa

SEQ ID NO: 17176 - protein, 458 aa, Streptococcus mutans UA159
MENHNFENEGQFKRKMTSRHLFMLSLGGVIGTGLFLSSGYTIAQAGPLGAVISYLVGAIVVYLVMLSLGELAVAMPVTGSFHTYATKFISPGTGFTIAWLYWICWTVALGTEFLGAGMLMGRWVPYVPTWVFAALFALLIFGLNALSVRSFAEAESFFSSIKVLAILVFIILGFGAMLGLVSFNGKHEVFLFSHLTAHGALPKGLPALMSVMLAVNYAFSGTELIGIAAGETNNPKEAVPKAIKTTIGRLVIFFVLTIVVLASFLPMKEAGVSSAPFVDVFDKMGIPFAADIMNFVILTAILSAGNSGLYASSRMLWSLANEGMISPRVVKINEHGVPMRALLLSMAGAVLSLFSSIYAADTVYLALMSIAGFAVVVVWLSIPMAQINFRKEWLKSHAQEDLFYKTPFTPILPYITIMLLLISIIGIAWDASQRAGLYFGIPFILLCYLYYYWRHKTL

SEQ ID NO: 17177 - DNA, 1377 bp, Streptococcus agalactiae NEM316
  CDS (1)..(1377): transl_table=11
atggaaaatcatcgttatgaagatgaaggtaaattccagcgtaagatgaccagtcgtcatctctttatgttatctctaggtggtgttatcgggactgggcttttcttgagttcaggttataccattgcacaggctggtccgcttggagctgtgctgtcttatttgattggtgccgttgtggtttatttggtcatgctatcacttggtgaattggcagttgccatgccggtgacggggtcattccacacttatgccactaagtttatcagtcctggcacaggttttactgttgcctggctatattggatttgttggacggtcgccttgggaactgaatttttaggtgctgccatgctcatgcagcgctggttcccagatgtgccggcttgggcatttgcttctttctttgcccttgtgatttttggcttaaatgctctcagtgtgcgcttttttgcagaagcagagtctttcttctcaagtattaaggttattgctatcattatctttattatcttgggcttaggtgctatgtttggtctagtttcctttgaaggtcagcacaaagctattcttttcactcatctgactgccaatggtgactttccaaatggtatcgttgcagttgtctcagtcatgttggctgttaactatgccttctctggtactgagttgattggtattgcggcaggtgaaacggataatccaaaagaagctgtgccaagggctattaaaacgacaatcggtcgcttggttgttttctttgtactgacaattgttgtcctagcttcgctattgccaatgaaagaggcaggcgtatccacagcaccattcgttgatgtctttgacaagatgggagtcccttttgcggcggatatcatgaactttgttatcttgacagccatcctgtctgctggtaactcaggtctctacgcatcaagccgtatgctctggtcccttgccaatgaaggtatgttgtcaaaatctgtcgtgaaaatcaataaatacggtgtcccaatgcgtgctcttctcttgtcaatggcaggagcagtgctgtcgctcttttcaagtatttacgctgcagacacagtttatctagccttggtttcaatcccgggctttgctgttgttgtcgtatggctagccattccggtcgcacaaatcaatttccgcaaggaattcttgaaagagaatcgactagaagatttgtcttacaaaacaccctttacaccagttctcccttatatcacaatcgttttgcttttgatttcgattgtggggattgcttgggatagctcacaacgtgctgggctttacttcggtgttccatttattattttatgttatatttatcacaaactacgttacaagacatggtga

SEQ ID NO: 17178 - protein, 458 aa, Streptococcus agalactiae NEM316
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPDVPAWAFASFFALVIFGLNALSVRFFAEAESFFSSIKVIAIIIFIILGLGAMFGLVSFEGQHKAILFTHLTANGDFPNGIVAVVSVMLAVNYAFSGTELIGIAAGETDNPKEAVPRAIKTTIGRLVVFFVLTIVVLASLLPMKEAGVSTAPFVDVFDKMGVPFAADIMNFVILTAILSAGNSGLYASSRMLWSLANEGMLSKSVVKINKYGVPMRALLLSMAGAVLSLFSSIYAADTVYLALVSIPGFAVVVVWLAIPVAQINFRKEFLKENRLEDLSYKTPFTPVLPYITIVLLLISIVGIAWDSSQRAGLYFGVPFIILCYIYHKLRYKTW

SEQ ID NO: 17179 - DNA, 1440 bp, Pseudomonas putida KT2440
  CDS (1)..(1440): transl_table=11
atgtccgtgcagacaaccacaactagaaatgcctcggcgcataccttcaagcaggatatgcaaacccgccacatcgtcatgctggcgctgggcggagtgataggcaccggcctgtttctcacgtcgggctacaccgttaaccaggccggcccgttgggcgcggtcatcgcttacatactcggcgcaatcatggtgtacctggtcatgatgtgcctgggcgagctggcggtacacatgccggaagtcggctcgttcagcagttacgccacgcgttacctcggcccgggcaccggctacatggtggcctggatgtactggctgacctggacggtggcaatcggctccgaattcaccgccgcgggcatcctgatggtgcgctggttccccgacacgccggtatggatgtggagtgcgctgttcggcgctgcggtgttcatcagcaatatcatttcggtgcgatcgttcgccgaaaccgaattctggttgtcactggtcaaggtgttggccgtcatcgcctttctggtggtgggcggcggggccattctgggtggcttcgagatccagcaggcgcacagtgcagggctgggcaatttcacccgtgaagggttgttccccaccggtttctggtccattgcaatgaccctgctggcagtggccttcgcgttctcgggtaccgagctgatcggcatcgctgccggcgaaaccaaagacccggaaaagaacgtgcccaaggccattcgcaccacggtcctgcgcctggcgctgttcttcatcggcaccatctttgtactggccaccttgctgccgcgtgaacaggccggggttattgaaagcccgttcgtgatggtctttgcgatgattggtatcccgtatgcggccgatatcatgaacttcgtcatcatcaccgcgctgctgtctgccgccaactccggcctctacgccgcttcgcgcatgctctggaccctcagcgaccaaggcaacatgccccgccgttacgccacgctgtcgcgccgcggcacccccttcaatgcgatcgtgctgagcatggctggcggcatggcttcgctgttgagcagtgtgtttgcccccgacaccatctacctggcgctggtgtcgatttcagggttggccgtggtagtggtgtggatcagcatcgcggccagccagatcgcattccgccgtcattacatcgccagcggcggcaagctcgaggacctcaagttccgggtgcgtggctacccgttcgtaccactgggggccattttctgctgcgtactggcctgcgtcggcattgccttcgacccagctcagcgggttgccctgtacttcggcttgcccttcattgcctggtgctacctggcctattggctgacgtgcaagtaccgcagccgccgtacggccccgctggaaatcgtcgccccaggttccgaggccgcctga

SEQ ID NO: 17180 - protein, 479 aa, Pseudomonas putida KT2440
MSVQTTTTRNASAHTFKQDMQTRHIVMLALGGVIGTGLFLTSGYTVNQAGPLGAVIAYILGAIMVYLVMMCLGELAVHMPEVGSFSSYATRYLGPGTGYMVAWMYWLTWTVAIGSEFTAAGILMVRWFPDTPVWMWSALFGAAVFISNIISVRSFAETEFWLSLVKVLAVIAFLVVGGGAILGGFEIQQAHSAGLGNFTREGLFPTGFWSIAMTLLAVAFAFSGTELIGIAAGETKDPEKNVPKAIRTTVLRLALFFIGTIFVLATLLPREQAGVIESPFVMVFAMIGIPYAADIMNFVIITALLSAANSGLYAASRMLWTLSDQGNMPRRYATLSRRGTPFNAIVLSMAGGMASLLSSVFAPDTIYLALVSISGLAVVVVWISIAASQIAFRRHYIASGGKLEDLKFRVRGYPFVPLGAIFCCVLACVGIAFDPAQRVALYFGLPFIAWCYLAYWLTCKYRSRRTAPLEIVAPGSEAA

SEQ ID NO: 17181 - DNA, 1407 bp, Pseudomonas putida KT2440
  CDS (1)..(1407): transl_table=11
atgactgacagcgttgaaaaaatccagctcacccgcgccctgaaaagccggcacatcttcatgctgtcgctgggtggggttattggaaccggcctgttcatgggctcgggcgtaaccatcaatcagggcgggccggtgggcgcgatcctggcttacctggtcgcaggcttgctgatgtacctggtgatggtctgcctgggcgagctgtcggtgcagatgccggtgtccggttcgtttcaggcccacgccaccaaatacattggcccggccaccgggttcatgatcggctgggtgtactggatgagctgggccaccaccgtaggcctggagttcaccgctgccggcatgttgatgacccgctggttcccggaggtgccgatctggtactggtcggcgctgttcgtggtggtgctgttcgggctcaacgccctggccacgcgtgcctttggcgaggccgagtactggttctcgggcatcaaggtggcaaccatcctcggcttcatcgtcattggcctgctggtgatcttcggtgccatccccctgagcagcggggcacccgcaccgatgctgaacaacctggtgggcgagtcgctgttcccccatggcctgtcggcagtgttcgcggtgatgatgaccgtggtgtatgccttccagggctgcgaaatcatgggggtggctgccggtgagaccgagcacccggaaaagagcatcccgcgggcggtgcgcaatgtggtgttccgcgtgctgatcttctatgtgctggcgattgccgtgctgtcggccattgtgccgcacgagcaggccgggctgatggaaagcccgttcgtgcaggtgttcgacatggtcggcatcccttacgccgccgacttgatgaacttcgtcatcctcacggccatcctctcggtgggcaactccgggttgtatgcctccacgcgtatcctctgggccatgtccaagactggcatggcaccgaaaagcctgtcgccgctgagcaagcgtggcgtgccgctgcgggcgctgagcatcaccctgtgctttgcgctgatctcgctgatgaccagcttcgtcgcggctgacacgctgttcatggtgctgatggcggtgagcggcatgtccggcaccgtgacctggatcgtcatcgccctggcgcagtaccgtttccgcaaggcctggctgcgtgacggcgggcaactgcaggacctgaagtacaaggcgccgctgtacccactggtgccgctgctgtgcatcaccctgtgcagttcgctgttcgtgttcctggcgctggatgaaacccaacggccgtcgctgtactggggctttggcttcattgccctgtgctatgcggcgtacttcttcgtcaaccgccgtcggcagggggccttcgcacccagcacaccaggggtttga

SEQ ID NO: 17182 - protein, 468 aa, Pseudomonas putida KT2440
MTDSVEKIQLTRALKSRHIFMLSLGGVIGTGLFMGSGVTINQGGPVGAILAYLVAGLLMYLVMVCLGELSVQMPVSGSFQAHATKYIGPATGFMIGWVYWMSWATTVGLEFTAAGMLMTRWFPEVPIWYWSALFVVVLFGLNALATRAFGEAEYWFSGIKVATILGFIVIGLLVIFGAIPLSSGAPAPMLNNLVGESLFPHGLSAVFAVMMTVVYAFQGCEIMGVAAGETEHPEKSIPRAVRNVVFRVLIFYVLAIAVLSAIVPHEQAGLMESPFVQVFDMVGIPYAADLMNFVILTAILSVGNSGLYASTRILWAMSKTGMAPKSLSPLSKRGVPLRALSITLCFALISLMTSFVAADTLFMVLMAVSGMSGTVTWIVIALAQYRFRKAWLRDGGQLQDLKYKAPLYPLVPLLCITLCSSLFVFLALDETQRPSLYWGFGFIALCYAAYFFVNRRRQGAFAPSTPGV

SEQ ID NO: 17183 - DNA, 1449 bp, Staphylococcus epidermidis ATCC 12228
  CDS (1)..(1449): transl_table=11
atggaagataataatatgaaacgtggtctcaattcgagacatatatctatgatagctataggtggcgctataggtactggactttttgtggcaactggaagtgtcatttctcaagctggcccaggaggagctatattagcttatatactaattggtattatgctttattttttaatgtcatcaataggagaattagcaactttctatccggtttctggttcttttagttcatactctaccagatttgttgattcgtcacttggttttacaatgggttggttgtattggggtatgtggtcacttgtaacaagtgtagatatcattgttgcttccaatgtattacaatattgggatgtatttaaagttttaaatccacttacatggagcttaattttcttaactctgttgtttttaattaatattttttctgttaaagcttttggagaaactgagttttggttatcactgatcaaagtcattactataattgtatttattatttttggaattatgatgattttcggtattcttggtggtcatacatatggctttgagaattatactaaaggtcaagcaccttttgtcggtggaatatcaggcatattaagcgttcttttagttgcaggtttttcagttggtggtactgaagtagtcgcagtaacagctggtgaatcaaataatcccgaaaaatcaatgcctaaagctataaaacaggtattttggagaatattactcttttacgtattgtctatagctgtgatagctgccatcattccatatacggatccacttttacttaatgaaaatgagtctgtatcacaaagtccgtttacaattgttttcgataaaatagggatcgcttttgctgcatccgtcatcaacgctgttatcttaacatcattattatcagcagctaactctggtatttatacaacaagtagaatgctattttctttaagtgctgataaacaagcacctaaattctttggaaaactcaatgataaaactaaattacctatgcgtgcattaattacaacatatattattattgtattagtcattgtttatgctaattttaatgctaatgctgtatttaacttattaaatatcataggatctatggttattgtagtttggggatctagtatttggtcacaaattagattaagacaagcaattaaaaaacagggtaaaaatccagataaactgttgccatataaagcacctttttacccagtcggacctattattgtccttttcacattattattcttattattaggtagttcctttggtagtatcgcatctggtgatattttaggtgtcattcgaaactttacaccattatttattctagctatcatctatattgctcataaattaatcaaacggacacattttgtcaaactggaagaaatagatttaactccgcataattacaagaattaa

SEQ ID NO: 17184 - protein, 482 aa, Staphylococcus epidermidis ATCC 12228
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDKIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 17185 - DNA, 1452 bp, Lactobacillus plantarum WCFS1
  CDS (1)..(1452): transl_table=11
atggcagaaaaacaacatcaggaagtgcatcgttccttacagacgcggcatttatccatgattgcattaggtggtagtatcgggaccgggctgtttgtcgcgtccggttcggcaatttcaacggctgggccagggggagcattactggcctacgttggtattggagtgatggtttactttttaatgactagtctgggcgaaatggcaacttatttgcccgtttcaggttcgttttccacgtatgccacgaagtttgttgacccggcacttgggtttgcgatgggctggaattactggttcaactgggcaatcacgttagcggtcgatattagtacggcggcgattgtcatgcagttctggttgccatccgtgccggggtgggtttttagtctgattgcgctcgttttgatttttacgatcaacgcgctgtcagtccggtcgtttggagaaactgagtactggctttcgctaattaaagtggtgaccgtgctcgtattcttggttatcggtgtcttgacgatcgtgggaatcatgggcggtcatgccactggcctcagtaactttacctataaaaaggcaccatttgtcggtggaattccaacgattttgagtgtcttcgtggtcgctggtttttcgtttcaaggaaccgaattaattgggatcacggccggggagtcagcaacaccggagaaaagtattccggcggctattaaacaagttttctggcgtattttgttattttacattttagccattttcgtgattgcggcgattattccttatacgtcgaaagatcttctagggtcatcagcgagcgatattgccatcagtccgttcacgttagtctttaaacgggctgggttggcggctgcggccagtgtgatgaacgcagtgatcttgacgtccgtattgtcagctgctaattcggggatgtacgcctcgacacggatgttatattctttgtcattacagggttatgcccccaagacatttggtcgggtcaatcgtcgtgggattccaatcatggcattattaggaacgacggtgattggattactcacgttcttgtcgagtctattcggtgaacggatttatattttcctcgtttcggccagtgggttaacgggttttatcgcttggctaggaatcgctatttcgcatctgcgtttccgtcgcgcgtttgttaagcaggggcatcaattgagtgaattgcggtaccatgccaagtggttcccatttggcccgtggttcgcctttatcttgtgtgtcgtggtcattattggtcaagacttacattcatttgcaacgcttgattggcaggctattggggtgacctatatgagcatcccgttattcatcatcttgtatgtctattataagattcgctatcatactaagatgattccgctagacaaggttgatttgacacgcaaacgacaccatcaagattaa

SEQ ID NO: 17186 - protein, 483 aa, Lactobacillus plantarum WCFS1
MAEKQHQEVHRSLQTRHLSMIALGGSIGTGLFVASGSAISTAGPGGALLAYVGIGVMVYFLMTSLGEMATYLPVSGSFSTYATKFVDPALGFAMGWNYWFNWAITLAVDISTAAIVMQFWLPSVPGWVFSLIALVLIFTINALSVRSFGETEYWLSLIKVVTVLVFLVIGVLTIVGIMGGHATGLSNFTYKKAPFVGGIPTILSVFVVAGFSFQGTELIGITAGESATPEKSIPAAIKQVFWRILLFYILAIFVIAAIIPYTSKDLLGSSASDIAISPFTLVFKRAGLAAAASVMNAVILTSVLSAANSGMYASTRMLYSLSLQGYAPKTFGRVNRRGIPIMALLGTTVIGLLTFLSSLFGERIYIFLVSASGLTGFIAWLGIAISHLRFRRAFVKQGHQLSELRYHAKWFPFGPWFAFILCVVVIIGQDLHSFATLDWQAIGVTYMSIPLFIILYVYYKIRYHTKMIPLDKVDLTRKRHHQD

SEQ ID NO: 17187 - DNA, 1383 bp, Lactobacillus plantarum WCFS1
  CDS (1)..(1383): transl_table=11
atgtcaaaacaaacccacctcagtcgccagatggaatcacggcacgtactgatgatttcgctcggtggcgtgattgggaccggattatttttaagttccggttacacgattcatcaagcggggccaattgggaccctgctcgcctataccattggagccatcctcgtctatctcgtcatgctctgtctaggtgagctgtcagttgcaatgccctacaccggggcgtttcacgtctatgcgaaaaaatatattggtcccggcacaggctttacggttgccatcctatattggttgacttggacgattgccctcggttcagaatttacagcagcggggctcatcatgcaaacgtggtttccgcacattgcgacctggatctggagcctcgtctttatggtggtcatcttcaccgttaacgccctctccgtacgctggtttgcggaaacggaattctggtttgccagtatcaaagtcatcgcgatcattgcttttattgtgttaggcggactggcaatggtcggtatcctgccacttcacggtcataccagtgccccgtttctgagcaactatacgcgtaacggttggttccccaatggttttggtggcgtctttacaactatgctaacggtcaactttgccttttctggaactgagctaattggaattacagctggtgagactaaggatccggcccacaccattccgaccgcaatcaaaacgaccctctggcgcctgattattttcttcatcggtagcatgttcgtcatggccgcactgattccttacaaacaagcaggtgtgacgcaaagtccattcgtgctcgtcttcaaagcgattgggattccctacgccgctgatttaatgaatttcgtcgtattgaccgccattatgtcggccgctaattctggcctctacgcgtctacccgcatgctgtggtcacttgcgaacgagggaaccattccaaaggttttcaaacgaaccacgaagcgtgatgtgccgttagtcgccctaattactagcatgctgggtggcattctggccctattgtcgagtgtctatgccgccggttcggtgtacctggtcttagtatccatttcaggacttgccgtcgtcattgtttggatggcaattgccctttcggagatcaacttccgcaaagcctacctgaaaagtgggcagtcgcttgatcaattgacttttaaaacgcccggctacccggtcgtcccgtggctggcctttatcttaagtgggctctcttgtatcttgatttggtttgaccctaaccagcggattgccttgtattacaccattcccttcgtggcgatttgctatctaggctactatctcaatcaacgttatcgacggacccacgccgcaaagtaa

SEQ ID NO: 17188 - protein, 460 aa, Lactobacillus plantarum WCFS1
MSKQTHLSRQMESRHVLMISLGGVIGTGLFLSSGYTIHQAGPIGTLLAYTIGAILVYLVMLCLGELSVAMPYTGAFHVYAKKYIGPGTGFTVAILYWLTWTIALGSEFTAAGLIMQTWFPHIATWIWSLVFMVVIFTVNALSVRWFAETEFWFASIKVIAIIAFIVLGGLAMVGILPLHGHTSAPFLSNYTRNGWFPNGFGGVFTTMLTVNFAFSGTELIGITAGETKDPAHTIPTAIKTTLWRLIIFFIGSMFVMAALIPYKQAGVTQSPFVLVFKAIGIPYAADLMNFVVLTAIMSAANSGLYASTRMLWSLANEGTIPKVFKRTTKRDVPLVALITSMLGGILALLSSVYAAGSVYLVLVSISGLAVVIVWMAIALSEINFRKAYLKSGQSLDQLTFKTPGYPVVPWLAFILSGLSCILIWFDPNQRIALYYTIPFVAICYLGYYLNQRYRRTHAAK

SEQ ID NO: 17189 - DNA, 1470 bp, Salmonella enterica subsp. enterica serovar Typhi Ty2
  CDS (1)..(1470): transl_table=11
atgggttccaaaactaaaaccacagaagcgcccgcgctacgtcgcgaattaaaggcgcgtcacctgacgatgattgccattggcggctccatcgggacaggtcttttcgttgcatctggtgcgacaatttctctggcggggccaggcggcgcgctgttttcttatattctgattggtttgatggtctacttcctgatgaccagtcttggcgagctggcggcctatatgccggtatctggctcgtttgcgacatatggtcagaactatgtggaagaaggctttggtttcgcgctgggctggaactactggtacaactgggcggtgactatcgctgttgacctggttgccgcacaattggtgatgggctggtggttcccggacacgccgggctggatctggagcgcgctattcctctgcgtcattttcttgctgaactacatttctgtacgcggttttggcgaggcggagtactggttctcgttaattaaagtcgcgaccgttattatcttcatcatcgttggcgtagcgatgattatcggcatctttaaaggtgtcgagccggtcggctggagcaactggacgacgggcgatgcgcctttcgctggcggttttgcggcaatgattggcgtcgcgatgatcgtgggcttctctttccagggaactgagctgattggtattgccgccggggaatctgaaaacccggagaagaatattccgcgcgcggtgcgtcaggtgttctggcgtattctgctgttttatgttttcgcgattttgattatcagcctgatcattccttataccgatccaaacctgctgcgtaacgacgtcaaagacattagcgtcagtccgtttaccttagtgttccagcatgcgggcttgttgtctgcggcggcgataatgaatgcggttatcctgacggcggtactgtctgcgggtaactccgggatgtatgcctcgacccgtatgctctacaccctggcctgtgacggtaaggccccgcgtatttttgcgaaattgtcccgcggcggcgtaccgcgcaatgcgctttatgccaccaccgtgattgccggtctttgctttttgacctcaatgttcggcaaccagacggtctatctgtggctgttgaacacctccggtatgacgggcttcatcgcctggctggggattgccattagccattatcgcttccgtcgcggttacgtgttacaagggtatgatgtgaatgatttgccgtaccgttccgggttcttcccgctggggccgattttcgcctttgtactgtgcctgattattacgttggggcagaactatgaagcgttcctgaaagataccatcgactggggcggcgtcgcggcgacctatatcggtattccgctgttcctgcttatctggttcggctacaagctgataaaaggcacgcatttcgtgcgctatagcgaaatgcacttcccggaacgcgttaaaaagtaa

SEQ ID NO: 17190 - protein, 489 aa, Salmonella enterica subsp. enterica serovar Typhi Ty2
MGSKTKTTEAPALRRELKARHLTMIAIGGSIGTGLFVASGATISLAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGYDVNDLPYRSGFFPLGPIFAFVLCLIITLGQNYEAFLKDTIDWGGVAATYIGIPLFLLIWFGYKLIKGTHFVRYSEMHFPERVKK

SEQ ID NO: 17191 - DNA, 1428 bp, Bacillus cereus ATCC 14579
  CDS (1)..(1428): transl_table=11
atgcagcaaccaacgaatgagaaattacatcgtacgatgaagagtagacatttatttatgatcgcacttggtggtgtaatcggaactggtttcttcttaggttcaggttacaccattaatcaggctggaccagggggagccatcctttcatatttagtaggcggatttattatgtatttaacaatgctttgtcttggagagttaacggtagcgatgccggtttcaggatctttccaaaagtatgcgacgaagtttattggaccaggaacgggctttatgattggctggttatactggctcggctgggcagtaacagtgggtctagaattaacgtcaatcggtttaatgatgaaaagatggtttccaaatgttgatgtttgggtatggtgccttgtattcggcgttattttatatgcttcaaacgcaatttcggcgaaaagttatgctgaattagaattttggttctctagtattaaagtaattacaattcttgcatttgttgtgcttggtggtagtgcattattaggatttatatcatatgacggaaaagaagcagcacctcttttctctaactttgtaagcaatggtggacttttcccgaatggactagctgccgtattacttacaatgattacagttaacttctcgttccaaggaacagagttaatcggaattgcagcgggagaaagtgaaaatccagaaaaaacaattccacgtgcgattcgtaatacagtatggcgcattatgttattcttcattttaacaatgacgattttagtaggattaatttcttggaaagaagcaggcgtaattgaaagtccattcgtagtcgtatttgataaaattggtattccatacgcagctgatattatgaacttcgttattattactgcgttattatctgtagcgaactctggattatatgcagcgacgcgtatactatggtcacttgcaaatgagggaatggcaccaacttccttccagaaagtaaataagcgtggtattccaattacagcgctagtcgtaacgattgcggtagctggattatctctattcacaagtttccttgcagaagatacagtatacatgtatttattatcgatagctggtttatcggctgtttcaagttggatcattattgctctatcgcaacttcgctttagaagtcagtatataaaaggcggaggaaagttagaggacttaaagtatagaacaccactatacccaattgtcccgattttagccttaattacaaatagcattgttgttattagtttagcgtttattcctgaacaaagaatggcgttatactgtggtattccatttatcattttctgctatatatattattatattagtaagaaacggcagaaaccgatgaaagtggagatggaaaaaacaaatgaaactaacaatcaaacacgatga

SEQ ID NO: 17192 - protein, 475 aa, Bacillus cereus ATCC 14579
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSNGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYISKKRQKPMKVEMEKTNETNNQTR

SEQ ID NO: 17193 - DNA, 1416 bp, Bacillus cereus ATCC 14579
  CDS (1)..(1416): transl_table=11
atgaatcaacaaattgaacaaacagatttaaaacgaacaatgaaaagtagacacctatttatgattgcactcggcggtgttatcggaaccgggttatttatgggatctggtcaaattgtccataatgccggacctggtggtgctattcttgcatttttagtcggtggatttgttatgtatttaacgatgttatgtcttggtgaattatccgtcgctatgccagaagcaggttcattccaaagttatgcaagcaaattcatttcacctggttttggatttgttgtcggttggatgtattggttaaattgggctgttacagttggcgtagagttaacaactgtaagtattttaatgaaacgctggtttccagacgtttcttcctggatttggtgcgttacatttgcagcagcactcttcctcgtaaacgctttatcagcaaaagcatatgcagaagcagagttttggttcgcaagtgtaaaagtcgcaacaattgttattttcatcgtacttggcggcgctgttatgttcggtctactagactttaatggaaagccagctccaatgcttcataatttcactgaaaatggcgggctatttccaaatggtgcattagctgttcttcttacgatgattacagtaaattactccttccaaggaacagaattaatcggaatcgcttcaggcgaaagtgaaaatcctgaaaaaacaattccaaaagcaattaaaaacacaatttggcgaactctcttcttcttcgtcttagcgatatcagttgttgtaggtttactcccatggcaagaggctaatctagtcgaaagtccctttgtacttgtatttgatgtagccggtgtcccatatgcagcagacattatgaactttgttattattacagctgtattatccgttgctaactctggtctctacgcaaattctcgtatgctgtgggcgatggcaaaacaaggaatggcaagtccagcatttacgaaattaactaaaaaaggtgtaccgctaaatgcattaattttcagcctaattttcgctagcctgtccttactaacaagtgtatttgcggcagatactgtctttctagttttaacatctattgcagcaatggctgccgttgtcgtttggatgtcaatcgccgcttcacagtttttcttccgtagaaatttcgtgaaaaacggtggcaacataaatgatttaaaatatcgtacaccgctctatccactagttccaatcgtagcgttttcgctgaatttcattacatttgttagtttggctttcattccagatcaaagaattgctctttattgtggcattccatttatgattatttgttacattttatatcaagttaaatataaaaaaattgtcacacttgaacagccacgaactgtcatacgagaaataaactaa

SEQ ID NO: 17194 - protein, 471 aa, Bacillus cereus ATCC 14579
MNQQIEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGNINDLKYRTPLYPLVPIVAFSLNFITFVSLAFIPDQRIALYCGIPFMIICYILYQVKYKKIVTLEQPRTVIREIN

SEQ ID NO: 17195 - DNA, 1425 bp, Bacillus cereus ATCC 14579
  CDS (1)..(1425): transl_table=11
atggcgcaagtaagcaatacaaacaatgaattaaaacgtacgatgaaaagtagacacttattcatgattgcactcggtggtgtgattggaaccgggttatttaacggatctggctttattataagtcaggctggacctggtggatccgtacttgcctttattgctggtggattattaatgtatttcgttatgctatgtcttggtgaacttgctgtagccatgcctgtttcaggttcctttcaggaatatgctactaaatttatcaatcctgcaactggctttacaatcggatggttgtattggttaagctgggcgaatacgaccggtcttgaatttacaactgccggtattacaatgcagcgctggtttcctgatattcctgtttgggtttggtgtttaatatttggcgttaccatcttcactattaacgcattatctgctcgtagttatgcagaaacagaattttggttttcaagtataaaagtatctgccattatagcttttatacttcttggtggcgccgctatgttcggttttattgatttaaaaggcgatgaaccagctccacttctttcaaatttcgtaaatcatggtggtttatttccgaatggacttgcagctattctattaacaatggttacagtcaattattccttccaaggtacagagcttgtcggaatcgcagcaggtgaaagtgaagatccagcaaaaactttacctcgttctattagaaatattatatggcgcacaatgtttttcttcgtcttagcaatctttgttcttgttgctttaattccttgggaagaagctggattaacaaagagtccattcgttgctgtttttgataatatcggtattccatatgcagctgatattatgaactttgttattcttactgctgttctttctgtcgcaaactcaggactatacgctgctactcgaatgctttggtctttatcaaaaaacgaaatggctccagcatttttaaagaaattatcatcacgtgggattcctctcaacgctttaatcatgacaatagctatttctgctttttctcttttgacaagtgtagtagctgctgaaactgtttacttgtggctcatttcaatttccggagtcattaccattattgtttggatgtcaatttgtgtttctcaattctttttccgcaaacattatttagcagacggcggaaaattagaagacttaaaatttaaaacgccactttatccactcgtaccaattcttggttttggattgtatggcattatattaatcagtcttatttttatcccagaacaacgacttggaatctattgcactgtcccatttatcatcttttgctacacttactatcactttaaagttaagaaaagaaattctactaacactcatagtgaaactaaaattagcgagacttcgtaa

SEQ ID NO: 17196 - protein, 474 aa, Bacillus cereus ATCC 14579
MAQVSNTNNELKRTMKSRHLFMIALGGVIGTGLFNGSGFIISQAGPGGSVLAFIAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFILLGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHFKVKKRNSTNTHSETKISETS

SEQ ID NO: 17197 - DNA, 1476 bp, Bacillus cereus ATCC 14579
  CDS (1)..(1476): transl_table=11
gtgttgaacatgaatagcgcaacaaatcaagctacctctaaaacagaaactacacaaggaaaaggtgaattaagacgcggtctaaaatcaaggcaccttacgatgatttctctcggtggtacaattggtaccggactatttcttgccagcggtggtgtcatccattcagctggacctggtggtgcattaattgcatacgccgcaattggaattatggtttacttcttaatgacaagcttagctgaactcgcagcttacatgcctgttactggatcttttagcacgtacgcaacaaaatttgttgatccatcacttggctttgcacttggatggaactattggtataactgggcaattacgattgctgctgaactagctgctgtaacattaattatgaaattttggttcccagataccccttctcttatttggagcggattatgtttagctattattttccttttaaactatttatctgttaaagggtttggtgaatctgaatattggttcgcacttattaaagtagttacgattattatctttttaattgttggtttcatgatgatttttggaattatgggcggcgaaacggttggcttcaaaaacttcactgttgcagatgcaccatttaacggcggtatcatggcaattatcggtgtgtttatggcagctggtttctcattccaaggtactgaactattaggagtagctgctggtgaaacatctgatccagaacgtaatatcccaaaagcaattcgttcaatcttttggcgtattcttttattctatatccttgcgattctcgttatcggtttattaattccttatacaactgaaagtcttgctgcaagtgatgtaacagtaagtccatttacacttattttcgaaaaagcgggcgttgcctttgctgcttctgttatgaacgctgttattttaacggcagtactatctgctggtaactctggtatgtatgcatcaactcgtatgctttgggatttagctcgccaagggaaggcaccaaagtttcttggtaaattagatagccgcggtgtacctgttaacgcattaatcgtaacatcgattgtcggtagtattgctttcattgcttctttattcggtgacggtgttgtatacatttggttattaaatgcatcaggaatgtctggctttatcgcttgggtcggcattgcaattagtcattaccgtttccgtaaagcgtatatcgcacaaggaaaagatttaaatgacttaccatatagagcaaaatggttccccttcggtccaatctttgcatttacactttgtatcatcgtaattttaggacaaaactacggggcatttatgggtgagtcaatcgactggaacggtgtactcgtttcttacatcggtttaccactcttcttagtactatggttaggttataaatttacgaaaaaaacaaaagtgattccacttgataaatgtgaactaaaataa

SEQ ID NO: 17198 - protein, 491 aa, Bacillus cereus ATCC 14579
MLNMNSATNQATSKTETTQGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFTLCIIVILGQNYGAFMGESIDWNGVLVSYIGLPLFLVLWLGYKFTKKTKVIPLDKCELK

SEQ ID NO: 17199 - DNA, 1575 bp, Bordetella parapertussis 12822
  CDS (1)..(1575): transl_table=11
atggctccaccgggccacgtcgtccccagcccggcgaacggccaccgccatgacgcccggcccgccacgcgcctgcccgaaccgacgagcctgcgccgcaccctgtcggcgcgccacctgaccatgatcgcggtcggcggctcgatcggcaccggcctgttcgtcgcctcgggcgccaccatcgcccaggccggcccgggcggcgccctgctggcctacttgctggtcggcatcatggtgtacttcctgatgaccagcctggacgaactggcggccagcatgccggtggcgggctcgttctccacctacggcgccaagtatgtcgacgaaggcttcggcttcgcgctgggctggaactattggtacaactgggccgtgaccgtcgcggtggacctggttgccgcgcagctggtcatggcctattggtttcccgaaatgcccggcgtgctctggagcgccgccttcctggcgctgatcgtcgggctgaacgccctgtcggcgcgcggcttcggcgaggccgagttctggttcgcgctgatcaaggtgatcgcggtgctggcgttcattgccatgggcgtgctgatgctgctgggcatcatccgcggcggcgagcacggcggcctggcctactggaccctggacgacgcgccattcgccggcggattcgccgcgctgatcggcgtggccatggtagtgggcttttcgttccagggcaccgagctgatcggcatcgccgccggcgaatccaaggacccggcccgcaacctgccgcgcgccgtgcgccaggtgttctggcgcatcctgctcttctacgtgctggccatcgccgtcatcggcctgctgattccctataccgatccgcaattgctgcgcaacgaggtgtccgacgtcagcgtcagcccgtttgcgctgatcttcgagcgcgccggcctgctggcggccgcctccatcatgaatgcggtggtgctgacgtcggtgctgtcggcaggcaattccggcatgtacgccgccacccgcatgctgtacagcctggcccgcgacggcaaggcgccggcgcgcttcggccgcctgtcgcgcagcggcgtgcccctgtgggcgctgctggccaccaccgcggtcgccgcgctgtgttttctgtcgttcctgttcagccccaaggcggtgtacatctggctgctgaacacctcgggcatgaccggattcatcgcctggctgggcatcgccatcagccactaccggtttcgccgcggctatgtcgcccagggcaacaacctggccgacctgccgtatgtctcgcccttcttcccgttcggcccgctgttcgcgttcgtcctgtgcctggtcatcacgctgggccagaactaccacgccttcctgcaggaccgcatcgactggaccggcgcggccgccacctatgtcggcattccgctgttcctggcgatctgggcgggctatcgcctggtgcgcggctcgcgcttcgtgcgctaccgcgacatgcagttccccgacctgcgcatgcgcaaccgcgagttgaacgccatgctcagcggcgactgcgccgagccccgccgctag

SEQ ID NO: 17200 - protein, 524 aa, Bordetella parapertussis 12822
MAPPGHVVPSPANGHRHDARPATRLPEPTSLRRTLSARHLTMIAVGGSIGTGLFVASGATIAQAGPGGALLAYLLVGIMVYFLMTSLDELAASMPVAGSFSTYGAKYVDEGFGFALGWNYWYNWAVTVAVDLVAAQLVMAYWFPEMPGVLWSAAFLALIVGLNALSARGFGEAEFWFALIKVIAVLAFIAMGVLMLLGIIRGGEHGGLAYWTLDDAPFAGGFAALIGVAMVVGFSFQGTELIGIAAGESKDPARNLPRAVRQVFWRILLFYVLAIAVIGLLIPYTDPQLLRNEVSDVSVSPFALIFERAGLLAAASIMNAVVLTSVLSAGNSGMYAATRMLYSLARDGKAPARFGRLSRSGVPLWALLATTAVAALCFLSFLFSPKAVYIWLLNTSGMTGFIAWLGIAISHYRFRRGYVAQGNNLADLPYVSPFFPFGPLFAFVLCLVITLGQNYHAFLQDRIDWTGAAATYVGIPLFLAIWAGYRLVRGSRFVRYRDMQFPDLRMRNRELNAMLSGDCAEPRR

SEQ ID NO: 17201 - DNA, 1575 bp, Bordetella bronchiseptica RB50
  CDS (1)..(1575): transl_table=11
atggctccaccggaccacgtcgtccccagcccggcgaacggccaccgccatgacgcccggcccgccacgcgcctgcccgaaccgacgagcctgcgccgcaccctgtcggcgcgccacctgaccatgatcgcggtcggcggctcgatcggcaccggcctgttcgtcgcctcgggcgccaccatcgcccaggccggcccgggcggcgccctgctggcctacttgctggtcggcatcatggtgtacttcctgatgaccagcctgggcgaactggcggccagcatgccggtggcgggctcgttctccacctacggcgccaagtatgtcgacgaaggcttcggcttcgcgctgggctggaactattggtacaactgggccgtgaccgtcgcggtggacctggttgccgcgcagctggtcatggcctattggtttcccgaaatgcccggcgtgctctggagcgccgccttcctggcgctgatcgtcgggctgaacgccctgtcggcgcgcggcttcggcgaggccgagttctggttcgcgctgatcaaggtgatcgcggtgctggcgttcattgccatgggcgtgctgatgctgctgggcatcatccgcggcggcgagcacggcggcctggcctactggaccctggacgacgcgccattcgccggcggattcgccgcgctgatcggcgtggccatggtagtgggcttttcgttccagggcaccgagctgatcggcatcgccgccggcgaatccaaggacccggcccgcaacctgccgcgcgccgtgcgccaggtgttctggcgcatcctgctcttctacgtgctggccatcgccgtcatcggcctgctgattccctataccgatccgcaattgctgcgcaacgaggtgtccgacgtcagcgtcagcccgtttgcgctgatcttcgagcgcgccggcctgctggcggccgcctccatcatgaatgcggtggtgctgacgtcggtgctgtcggcaggcaattccggcatgtacgccgccacccgcatgctgtacagcctggcccgcgacggcaaggcgccggcgcgcttcggccgcctgtcgcgcagcggcgtgcccctgtgggcgctgctggccaccaccgcggtcgccgcgctgtgttttctgtcgttcctgttcagccccaaggcggtgtacatctggctgctgaacacctcgggcatgaccggattcatcgcctggctgggcatcgccatcagccactaccggtttcgccgcggctatgtcgcccagggcaacaacctggccgacctgccgtatgtctcgcccttcttcccgttcggcccgctgttcgcgttcgtcctgtgcctggtcatcacgctgggccagaactaccacgccttcctgcaggaccgcatcgactggaccggcgcggccgccacctatgtcggcattccgctgttcctggcgatctgggcgggctatcgcctggtgcgcggctcgcgcttcgtgcgctaccgcgacatgcagttccccgacctgcgcatgcgcaaccgcgagttgaacgccatgctcagcggcgactgcgccgagccccgccgctag

SEQ ID NO: 17202 - protein, 524 aa, Bordetella bronchiseptica RB50
MAPPDHVVPSPANGHRHDARPATRLPEPTSLRRTLSARHLTMIAVGGSIGTGLFVASGATIAQAGPGGALLAYLLVGIMVYFLMTSLGELAASMPVAGSFSTYGAKYVDEGFGFALGWNYWYNWAVTVAVDLVAAQLVMAYWFPEMPGVLWSAAFLALIVGLNALSARGFGEAEFWFALIKVIAVLAFIAMGVLMLLGIIRGGEHGGLAYWTLDDAPFAGGFAALIGVAMVVGFSFQGTELIGIAAGESKDPARNLPRAVRQVFWRILLFYVLAIAVIGLLIPYTDPQLLRNEVSDVSVSPFALIFERAGLLAAASIMNAVVLTSVLSAGNSGMYAATRMLYSLARDGKAPARFGRLSRSGVPLWALLATTAVAALCFLSFLFSPKAVYIWLLNTSGMTGFIAWLGIAISHYRFRRGYVAQGNNLADLPYVSPFFPFGPLFAFVLCLVITLGQNYHAFLQDRIDWTGAAATYVGIPLFLAIWAGYRLVRGSRFVRYRDMQFPDLRMRNRELNAMLSGDCAEPRR

SEQ ID NO: 17203 - DNA, 1527 bp, Chromobacterium violaceum ATCC 12472
  CDS (1)..(1527): transl_table=11
atgagcaagaaacaagacgcgccggagctgcggcgctcgctgcaggctcgacacctgtcgatgatcgccatcggcggctcgatcggcaccggcctgttcctggcgtccggcgccaccatctcgggcgcgggcgccggcggcgcgctgctggcctacgcgctggtcggcctgatggtgtacttcctgatgaccagcctgggcgaaatggccgccttcatgccggtgtccggctccttccaggcctacggctcgcgtttcgtcgatccggccttcggcttcgcgcagggctggaactactggtacaactgggcgatcaccgtcgcggtggaactggccgcggccgccatcatcatgaactactggtatcccgggataccgggcgtggtgtggagcgggggcttcctggccatcatcttcgcgctcaactatttctcggtgaagggcttcggcgaggccgagttctggtgctcgatgctgaaggtggccaccatcatcgccttcatcgtcatcggcttcctgatgattctgggcatcatgaccgagccgaacccgagccgcatcgcgccgggtctgcaagtgatgatgcagggcgaggggcccttcgtcggcggcctggcggccttcgtcggcgtggccatggtggtgggcttctccttccagggcaccgagctgatcggcgtcgccgcgggcgagtcggccaaccccggccgcaccattccgcgcgccgtgcgccagatcttctggcgcatcctgatgttctacatgctgtccatcctgatcatcggtctgatcctgccgcacaacgatccgtcgctgctgaagaacgacatgaaggatgtcggcgccagcccgttcacgctggtgttcaaccgcgccggcctcgctttcgccgccagtctgatgaacgcggtgatcctgtccgccatcctgtcggccggcaactccggcatgtacgcgtccacccgcatgctgtacgcgatggccaagaacggcatggcgcccaaggttttcggcaagctgaccgacaacggcgtgccgcgcaacgcgctgtacgccaccacgctggtggcctgcctgtgcttcctgacgtcgttgttccagagcaacgctgtctacatgtggctgttgaactcgtccggcatgaccggcttcatcgcctggctgggcgtggcgatcagccattaccgcttccgccgcgcctacgtgaagcagggctacagcctggacgacctgccgtacaaggccaaatggttcccgctgggcccgctgttcgccttcgcgctgtgcctgctgatcatgctgggccagaactacaccgccttcaccgccgccaaggtggattggaacggcgtcatcgccacctatctgggcattccgctgttcctggcgctgtggtggggctaccgcgtcaagcacaatacccgcatggtgcccttggaaaaggtggaactggcggaggcgcatcgcaacgccttgatgcagcgagaggaaaatcgcggcggcaagcccgccgccgcccaggcctga

SEQ ID NO: 17204 - protein, 508 aa, Chromobacterium violaceum ATCC 12472
MSKKQDAPELRRSLQARHLSMIAIGGSIGTGLFLASGATISGAGAGGALLAYALVGLMVYFLMTSLGEMAAFMPVSGSFQAYGSRFVDPAFGFAQGWNYWYNWAITVAVELAAAAIIMNYWYPGIPGVVWSGGFLAIIFALNYFSVKGFGEAEFWCSMLKVATIIAFIVIGFLMILGIMTEPNPSRIAPGLQVMMQGEGPFVGGLAAFVGVAMVVGFSFQGTELIGVAAGESANPGRTIPRAVRQIFWRILMFYMLSILIIGLILPHNDPSLLKNDMKDVGASPFTLVFNRAGLAFAASLMNAVILSAILSAGNSGMYASTRMLYAMAKNGMAPKVFGKLTDNGVPRNALYATTLVACLCFLTSLFQSNAVYMWLLNSSGMTGFIAWLGVAISHYRFRRAYVKQGYSLDDLPYKAKWFPLGPLFAFALCLLIMLGQNYTAFTAAKVDWNGVIATYLGIPLFLALWWGYRVKHNTRMVPLEKVELAEAHRNALMQREENRGGKPAAAQA

SEQ ID NO: 17205 - DNA, 1482 bp, Photorhabdus luminescens subsp. laumondii TTO1
  CDS (1)..(1482): transl_table=11
atgtctcaacaacaaaaaagtgtttcccggaaacccgcaacgcaacatttgcgacgtgaattgaaagctcggcatctagcgatgattgccattggcggatcaataggcaccgggttattcgtggcttcaggtgcgacagtttcacaagcagggcctggcggagcattactttcctatgcattaattggcttgatggtttatttcctgatgaccagtttgggtgaactggccgcttatatgccggtttccggttctttctcaacttatggttccaaatatgttgaagaagggtttggttttgccttgggttggaactattggtacaactgggcggtgactatcgcggtggatttggttgcagcccaattggttatgggttattggctgccggatatgccgggttggatctggagtgcgttattcctcgcgttgattttcctactgaattttatttcagtgaaaggatttggtgaagctgaatactggttctccttgattaaagtcagcacggttattgtttttattgtggtcggattactgatgatagccggcatcatgaaaggggcagaaggtgctggatggcataactggactgttggtgatgcaccttttgccggtggtttctctgccatgattggcgtggcaatgatagttgggttttcttttcagggaactgagctaattggcattgcggcgggtgagtcaaaagatccggcaaaaaatgttcccagtgctgtacgtaaggtattctggcgtattctgctattctatatttttgcgatcctgattatcagcctgattattccttatactgatccaagcctactgcgtaatgaggtcggtgatatcagtgttagtccgtttacgttggtatttgaaaacgctggtttgttatccgccgcagctatgatgaatgcggttattttgacggctgtgttgtctgcgggtaattcaggtatgtatgcatcgactcgtatgttgttcacattggcaaaagagggtaaagcaccgaggatttttggcaaattatccaaaggtggtgtaccgcgtaatgccttgtatgcaacaacggtggttgctgcgttgtgtttcctcagttcaatgtacggtaaccagaccgtctatctgtggttgttgaatacttctgggatgaccggttttattgcctggttggggattgctattagtcattatcgtttccgccgtggttatgtcgctcaggggttggatttaagtaaattaccttatcgttcaggatttttccccgttggcccaatttttgcgtttgttttgtgtctaaccatcacattaggacagaattatcaggcatttctacaagataaaattgactggtatggtgtcactgcaacttatgttggtattccactcttcctgttgatttggtttggttacaaattagctaggaaaactcactttatcaaatatagcgagatgaaatttcctgatatcgagaatcagtga

SEQ ID NO: 17206 - protein, 493 aa, Photorhabdus luminescens subsp. laumondii TTO1
MSQQQKSVSRKPATQHLRRELKARHLAMIAIGGSIGTGLFVASGATVSQAGPGGALLSYALIGLMVYFLMTSLGELAAYMPVSGSFSTYGSKYVEEGFGFALGWNYWYNWAVTIAVDLVAAQLVMGYWLPDMPGWIWSALFLALIFLLNFISVKGFGEAEYWFSLIKVSTVIVFIVVGLLMIAGIMKGAEGAGWHNWTVGDAPFAGGFSAMIGVAMIVGFSFQGTELIGIAAGESKDPAKNVPSAVRKVFWRILLFYIFAILIISLIIPYTDPSLLRNEVGDISVSPFTLVFENAGLLSAAAMMNAVILTAVLSAGNSGMYASTRMLFTLAKEGKAPRIFGKLSKGGVPRNALYATTVVAALCFLSSMYGNQTVYLWLLNTSGMTGFIAWLGIAISHYRFRRGYVAQGLDLSKLPYRSGFFPVGPIFAFVLCLTITLGQNYQAFLQDKIDWYGVTATYVGIPLFLLIWFGYKLARKTHFIKYSEMKFPDIENQ

SEQ ID NO: 17207 - DNA, 1422 bp, Bacillus cereus ATCC 10987
  CDS (1)..(1422): transl_table=11
atgatggatcaaaaccaaggattaaaaagggaattgaaaagcagacacatatttatgattgcacttggaggagttattggtaccggactttttttaggatcggggtatacaattcatgaagctgggcctggaggagcgattgtagcttatcttgttggaggatttgttatgtatttaacgatgctctgtctcggagaattagctgttgcgatgcctgacgcaggatcttatcaaacgtatgctacgaagcatatttcccctgcagcgggttatgtagtcggatggatgtcgtggctaaactggtcggctacaataggtattgaactcattgcagttagtattttaatgaaacgatggtttcctgatgtaccgtcttggatttggtgcgtagtgtttgcggtactactttttgctattaacgcgttatcttcaagaagttttgcagaagttgaattttggtttgcaagtattaaagtcattacaatcattgcatttattattttgggcggggcagcaatgtttggttttctagatatgaaaggaaatgaaccagcaccaatgttttctagctttactgattatggtgggttatttccaaatggattatccgctattttaattacgatgattgctgttaatttttccttccaaggaacagagctagttggtattgcagctggagagagtgaaaatccagaaaagacaatcccgaaggcaattaataatacagtttggcgtatacttgtgttctttgtattatctattttcattcttgcaggattattcccatggcaacaagcaggagtgatagaaagtccattcgtagttgtatttgataaaattggtattccttatgcagctgatattatcaatttcgttatcattacagcagtattatccgttgcgaattcagggctatatgcaacttctcgtatgctatggtctatgtctaatcaaggaatgattagtccgatttttagtaagttatctaaaagcggcgttccaatttatgcattgattgtaagtacaattgtaggttgtctctcattactatcaggtatttatgcggaagatacagtttatttatggttgctttctattgctggatttggagcaatactagtttgggcatctattgctctatctaacttattagctagaagggcgtatataaagcagggcggggatgtgaaagacttgaaatttaaaacaccgctatatccattcgtaccacttcttgcattagtattaaatgtaacagtaattgttgctatggcctttattccagaacaaagaatggcattgtattgtggtattccctttatgattgtttgtttactgttttaccgtgcgacaagaaataaggggagtaacttagagcatattgaaaagacaaagacaacagaaatagagagtttataa

SEQ ID NO: 17208 - protein, 473 aa, Bacillus cereus ATCC 10987
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFSKLSKSGVPIYALIVSTIVGCLSLLSGIYAEDTVYLWLLSIAGFGAILVWASIALSNLLARRAYIKQGGDVKDLKFKTPLYPFVPLLALVLNVTVIVAMAFIPEQRMALYCGIPFMIVCLLFYRATRNKGSNLEHIEKTKTTEIESL

SEQ ID NO: 17209 - DNA, 1422 bp, Bacillus cereus ATCC 10987
  CDS (1)..(1422): transl_table=11
atgcagcaacaaacgaatgagaaattacatcgtacgatgaagagtagacatttatttatgatcgcactaggtggtgtaatcggaactggttttttcttaggttcaggttacaccattaatcaggctggaccagggggagccatcctttcatatttagtaggcggatttattatgtatttaacaatgctatgccttggagagttaacggtagcaatgccagtttcaggttctttccaaaagtatgcgacgaagtttattggaccaggaacgggctttatgatcggttggctatattggcttggctgggcagtaacagtaggactagaattaacgtcaatcggtttaatgatgaaaagatggtttccgaatgctgatgtttgggtatggtgccttgtattcggtgttattttatatgcttcaaacgcaatttcggcgaaaagttatgctgaattagaattttggttttctagtattaaagtaattacaattcttgcatttgttgttcttggtggtagtgcattattagggtttatatcatatgacggaaaagaagcagcacctcttttctctaactttgtaagtgaaggcgggttattcccgaatggactagctgccgtattacttacaatgattacagtgaacttctcgttccaaggaacagagttaatcgggattgcagcgggagaaagcgaagagcctgaaaaaacaattccacgtgcaattcgtaatacagtatggcgcattatgttattcttcattttaacaatgacgattttagtaggattaatttcttggaaagaagctggcgtaattgaaagtccgttcgtagttgtatttgataaaatcggtattccatatgcagctgatattatgaacttcgttattattactgcgttattatctgtagcgaactctggattatatgcagcgacgcgtatactatggtcacttgcaaatgaaggaatggcaccaaagtctttccagaaagtaaataagcgtggtattccaattacagcactagttgtaacaattgctgtagctgctttatctttattaacaagcttccttgcagaagatacagtatacatgtacttattatctatagctggtttatcagctgtatcaagttggattattattgccctgtcgcaacttcgctttagaagtcagtatataaaaggcggaggaaagttagaggacttaaaatataaaacaccgttatatccaatcgttcctattttagctttaattacaaatagtatcgttgttattagtttagcgtttattccagaacaaagaatggcgttatattgtggtattccatttatcattttctgctacatatattattatataaataagaaacggcagaaaccgatgaaggtggagacaacaaatgaaactaaccatcaaacaagatga

SEQ ID NO: 17210 - protein, 473 aa, Bacillus cereus ATCC 10987
MQQQTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNADVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESEEPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYKTPLYPIVPILALITNSIVVISLAFIPEQRMALYCGIPFIIFCYIYYYINKKRQKPMKVETTNETNHQTR

SEQ ID NO: 17211 - DNA, 1416 bp, Bacillus cereus ATCC 10987
  CDS (1)..(1416): transl_table=11
atgaatcaacaagtagaacaaacagatttaaaacgtacaatgaaaagtagacacctatttatgattgcacttggtggtgttatcggaactggcctatttatgggatctggtcaaatcgtccataacgccggccctggtggtgctattcttgcatttttagtcggtggatttgttatgtatttaacgatgttatgtcttggtgaattatctgttgctatgccagaagcaggttcattccaaagctatgcaagcaaatttatttcacctggttttggttttgttgtcggttggatgtattggttaaattgggctgttacagttggagtagagttaacaactgtaagtattttaatgaaacgctggtttccagatgtttcttcgtggatttggtgtgttacatttgcagcagcactctttcttgtaaacgccctatcagcaaaagcatatgcagaagcagaattttggttcgctagtgtaaaagtcgcaaccatcgttattttcatcgtactcggtggtgcagttatgttcggtctactagactttaacggaaaaccagctccaatgcttcacaatttcactgaaaatggcggattatttccgaatggtgcattggctgttcttcttacgatgattacagtgaattattctttccaaggaacagaattaatcggaatcgcttcaggagaaagtgagaatcctgaaaaaacaattccaaaagcaatcaaaaataccatttggcgaacgctattcttcttcgtcctagccatatcagttgttgtaggtttactcccgtggcaagaggctaatctagtcgaaagtccatttgtacttgtatttgatgtagctggtattccatatgcagcagacattatgaactttgttattattacagctgtattatccgtagccaattctggtctatacgcaaattcacgtatgctttgggcaatggcaaaacaaggaatggcaagtccagcatttacgaagctaacgaaaaaaggtgtaccattaaacgcattgattttcagtctaatctttgcaagtttatccctattaacaagtatatttgcagcagatactgtctttttagttttaacatctatcgcagcaatggctgccgttgtcgtttggatgtcaattgcggcttcacagtttttcttccgtagaaacttcgtgaaaaacggtggtgacatcaatgatttaaaatatcgcacaccactttatccgctcgttccaatcgtagcattctcactcaatttcattacatttgtaagtttagctttcattccagatcagagaatcgctctttattgcggtattccatttatggttatttgttacattttatatcaagtgaaatataaaaaaattgtcacatttgaacaacaaataagtctaaaaaaagaagtaaactaa

SEQ ID NO: 17212 - protein, 471 aa, Bacillus cereus ATCC 10987
MNQQVEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGIPYAADIMNFVIITAVLSVANSGLYANSRMLWAMAKQGMASPAFTKLTKKGVPLNALIFSLIFASLSLLTSIFAADTVFLVLTSIAAMAAVVVWMSIAASQFFFRRNFVKNGGDINDLKYRTPLYPLVPIVAFSLNFITFVSLAFIPDQRIALYCGIPFMVICYILYQVKYKKIVTFEQQISLKKEVN

SEQ ID NO: 17213 - DNA, 1542 bp, Bacillus cereus ATCC 10987
  CDS (1)..(1542): transl_table=11
ttgacttttctttttaattatctgaaaattataacaagatttcacatcacggaatatattccacaatacggaaaaacatcaaactttattctatcaactacgaaagtgaggaaaacaatggcgcaagtaaataatacaaacaatgaattaaaacgtacgatgaaaagtagacacttattcatgattgcactcggtggtgtgattggaacggggttatttaacggatctggctttattataagtcaagctggacctggtggatccgtacttgcctttatggccggtggattattaatgtatttcgttatgctatgtcttggtgagctcgctgtagccatgcctgtttcaggctctttccaggaatatgccactaagtttattaatcctgcaactggctttacaatcggatggttgtattggttaagctgggcaaatacaaccggccttgaatttacaactgccggcattacaatgcagcgctggtttcctgatattcctgtttgggtttggtgtttaatatttggcgttacaatcttcacaattaacgcattatctgctcgtagttatgcagaaacagaattttggttttcaagtataaaagtatctgccattatcgcttttattattcttggcggcgccgctatgttcggttttatcgatttaaaaggcgacgaaccagcaccgctattatcaaatttcgtgaatcatggtggtttatttccaaatggacttgcagctatcctattaacaatggttacagtcaattattccttccaaggtacagaacttgtcggaatcgcagcaggtgaaagtgaagatccagcaaaaactttacctcgttctattagaaatattatatggcgcacgatgtttttcttcgtcttagcaatctttgttctcgttgctttaattccttgggaagaagcaggattaacaaaaagtccgttcgttgctgtatttgataatatcggtattccatatgccgctgatattatgaactttgttattcttactgctgttctttcggtcgccaattcaggattgtacgcagcaactcgcatgctttggtcattatccaaaaatgaaatggctccagcctttttaaagaaattatcatcacgaggaatacctttgaatgctttaattatgacaattgctatttctgctttttctcttttaacaagcgttgtagctgctgaaacggtttacttatggctcatttccatttctggcgtcataacaatcattgtttggatgtcaatttgtgtctctcaattctttttccgtaaacattatttagcagacggcggaaaattagaggacttaaagttcaaaactccactttatccacttgtaccaatacttggttttggattgtacggcattatattaatcagtctaatctttatcccagaacaacgacttggaatctattgcactgtaccatttattatcttttgctacacttattatcacttaaaagttaagaaaagaatttctactaacactaatagtgagactaaaattagcgagacgatgtaa

SEQ ID NO: 17214 - protein, 513 aa, Bacillus cereus ATCC 10987
MTFLFNYLKIITRFHITEYIPQYGKTSNFILSTTKVRKTMAQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHLKVKKRISTNTNSETKISETM

SEQ ID NO: 17215 - DNA, 1467 bp, Bacillus cereus ATCC 10987
  CDS (1)..(1467): transl_table=11
atgaatagcgcaacgaatcaagctacctctaaaacagaaactacaaaaggaaaaggtgaattaagacgcggtctaaaatctcggcaccttacgatgatttctctcggcggtacaattggtaccggactatttcttgccagcggtggtgtcatccattcagctggacctggtggcgcattaattgcatacgccgcaatcggaattatggtttactttttaatgacaagcctagctgaactcgcagcttacatgcctgttactggatcttttagcacgtacgcaacaaaatttgttgatccatcacttggctttgcacttggatggaactattggtataactgggcaattactatcgctgctgaactagcggctgtaacattaattatgaaattttggttcccaaataccccttctcttatttggagcggattatgtttagctattattttccttttaaactacttatctgttaaagggtttggtgaatctgaatattggttcgcacttattaaagtcgttactattattatctttttaattgtcggctttatgatgattttcggaattatgggcggtgaaactgttggatttaaaaacttcactgttgcagacgcaccatttaacggtggtattatggcaattattggtgtatttatggcagctggtttctcattccaaggaacagaattacttggggtagctgctggtgaaacttctgatccagagcgcaatattccgaaagcaattcgttcaattttctggcgtattctcttattctatatccttgcgattctcgttatcggtttattaattccttatacaactgaaagccttgctgcaagtgatgtaacagtaagtccatttacacttatttttgaaaaagcgggcgttgccttcgctgcttctgttatgaacgctgttattttaacggcagtactgtctgctggtaactctggtatgtatgcttcaactcgtatgctttgggatttagctcgccaaggaaaagcaccaaaattcttaggaaaattagatagccgcggtgtacctgttaacgcattaatcgtaacatcaattgtcggtagtatcgctttcattgcttctttattcggtgatggtgttgtatacatttggttattaaacgcatctggaatgtctggctttatcgcatgggtcggcattgcaattagtcattaccgtttccgtaaagcatatatcgcacaaggaaaagatttaaaagacttaccttataaagcaaaatggttcccattcggtccactcttcgcttttacgctttgtattatcgtaattttaggacaaaactacggcgcatttatgggcgaatcaatcgactggaacggtgtactcgtttcttacatcggtttaccactcttcttagtactatggttaggatataaatttacgaaaaaaacgaaagtgattccacttgataaatgtgaactgaaataa

SEQ ID NO: 17216 - protein, 488 aa, Bacillus cereus ATCC 10987
MNSATNQATSKTETTKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPNTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLKDLPYKAKWFPFGPLFAFTLCIIVILGQNYGAFMGESIDWNGVLVSYIGLPLFLVLWLGYKFTKKTKVIPLDKCELK

SEQ ID NO: 17217 - DNA, 1692 bp, Eremothecium gossypii
  CDS (1)..(1692)
atggcgccaaaggatacggcggtgtcggagacctctacgcggtctcgctatatcaaaaagggcaagactttagagaatgacattgagctacagtcggtgacgccagccaccggggagttccccgaggaccacacggaagagggcgactaccaggagacggaggtcaagagggcgctgaaggcgcggcacatctcgatgatcgcgctgggcgggacgataggcacaggcctgttcattgtgattgcatccccgctgcggacagcggggccagtggggtcgctgttggcgtacatcttcatcggtacggtggtgtactcgatcacgcagtcgctgggggagatggcgacgttcattcctgtgacgtcgtcggtgacggtattttcaaagcggtttctgtcgcctgcgtttggcgtggcaaacgggtatatgtactggttcaactgggcgatcacgtttgctgtcgagctttctgtggttggccagatcatacagtactggacggaccgcgtgccaatcgcggcgtggattgtgattttctgggtcctggtgacgctagttaacttcttcccggtgcgcttctacggtgagatagagttctggattgcgtcggtcaaggtgctgaccattgtgggctatcttatttacgcgttcattattgtctgtggcggctccaagcagggcccaatcgggcttcccgccactggcgggatccccgcccgtggggcaagggcgtcatctcgcacaaccagaaagaggcacggcttcctcggctgggtctcgtcgctgatcaaggctgcgtttacgtaccaggggacagagcttgtcggtatcactgcaggtgagtccacgaacccaagaaagaacgtccccaaggccatcaacaaggtcttcttccggattctattcttctacattggctcactgctattcgttggcctgctggtgccctacgatgaccctcggttaaacagcgagtctagcacggacgtcaatgcctcaccatttgtgatctccattaagaatgcaggtacaaagattttgcccgacatctttaacgctgtcgtgctgatcaccgtcatttccgcagcgaactccaacgtttacattggctctcgtgttgcatactctctggcgctcgctggcaacgctcccaagcagcttgccttcgtcaccaagcagggtgtgccctacttcggcgttctgatcacgtcgctaatgggcctgatgtccttcctcgtgctcaaccacaacgccagcaccgcattcgactggctggttaacatttccacccttgcaggcttgtgcgcctggcttttcatctcgctcgcccacatccgcttcatgcagtgcctcaagcatcgcggcatttcgcgcgacgacctgccgttcaaggccaagttcatgccctgggccgcatactacgcaaccttctttgtcacggtcatcatcttcatccagggctacactgccttcactccgaagttcgacgttaccaccttcttcacctcctacatctctctatttttgatgctgctggtgttcatcggctgccagatctactacaagtgtcgctttctgtgggcggttgaggacatcgacatcgacagcgaccgccgcgagatcgacgccatcgtctgggaagaggatgaacccaagaacatttgggacaagttttggtctgctgtggcctag

SEQ ID NO: 17218 - protein, 563 aa, Eremothecium gossypii
MAPKDTAVSETSTRSRYIKKGKTLENDIELQSVTPATGEFPEDHTEEGDYQETEVKRALKARHISMIALGGTIGTGLFIVIASPLRTAGPVGSLLAYIFIGTVVYSITQSLGEMATFIPVTSSVTVFSKRFLSPAFGVANGYMYWFNWAITFAVELSVVGQIIQYWTDRVPIAAWIVIFWVLVTLVNFFPVRFYGEIEFWIASVKVLTIVGYLIYAFIIVCGGSKQGPIGLPATGGIPARGARASSRTTRKRHGFLGWVSSLIKAAFTYQGTELVGITAGESTNPRKNVPKAINKVFFRILFFYIGSLLFVGLLVPYDDPRLNSESSTDVNASPFVISIKNAGTKILPDIFNAVVLITVISAANSNVYIGSRVAYSLALAGNAPKQLAFVTKQGVPYFGVLITSLMGLMSFLVLNHNASTAFDWLVNISTLAGLCAWLFISLAHIRFMQCLKHRGISRDDLPFKAKFMPWAAYYATFFVTVIIFIQGYTAFTPKFDVTTFFTSYISLFLMLLVFIGCQIYYKCRFLWAVEDIDIDSDRREIDAIVWEEDEPKNIWDKFWSAVA

SEQ ID NO: 17219 - DNA, 1713 bp, Neurospora crassa
  CDS (1)..(1713)
atggcggtgcgagaaagtacgccgccggcgccagcgagtcccggctcctccgctgccggatcgccacccggaagcgcaaccaaaaaggactttgtcaaggaacagtcggccgctgatgacgatgcggcctccttcgccgagcacaacgccggccccgagctgaagcgcaggctcaagtctcgccatttgcaaatgattgccattggtatcataggtggtactattggtactggtctcttcatcggttccggcagcgccctcgccaagtcgggccctgctggcgtcctcatcggctactgctttatcgcctccattgtttacagcatcatgatgtccctcggtgaaatggccacctacgtccccgtcaccggcggtttcaccacgtacgcggctcgctttgtcgacagctctctcggtttctccatgtcgtggatctactggttttcgtgggccattacctttgcgctcgagctggtcgctactggtctgatcattcagtattgggacgactctctgtccatcggtattttcatcgccatcttctgggtcgtcattttcgtcatcaacctgttccccgtgtcctggtacggcgaggcggaattctggatgtcctctgtcaaggtcatcaccgtcctcggcttcctcatcttcggcatctgcatcaacgccggcgccggtcagcagggctacattggcttcaagtactggcacgagccgggtgcttttgctccctacattgttgaccctagccgccctgtcgccaagtgggttggcttctggtccgtcatgatccaggccggcttctccttccagggcaccgagcttgtcggtatcgctgctggcgagaccgaagacccgcgccgcaacgtcccccgtgcgatccgcatgaccttttaccgtatcttcctcttcttcatcatgaccgtcttcttcatcggcatcctcatcccctacgacaacaaggacctgaacaatggcggctacaccgcggctgcctctccctttgtcattgcggcccagctcgccggcgtcaaggtcctacccgacatcatcaacgctgtcttgcttactgtcgtcctctctgccgccaactccaacgtctactcgggctctcgtgtcctcgtctccctcgccaacgacggcatggcccccaagtggttcaagatgaccaccaagtccggcgtcccctatattgccgtcatgtttacctcggcgttcggtttcctcggcttcctcaacctctctcccaacggcagccaggccttcgactggcttctcaacatttcgggcgtcgcgggtttcattgcctggtccggcatcctcatcgcccacctccgcttcatgaagggtcttgaggcgcacggcatcccccgctccaagctgccctatcgcgccacctgggccccttactacgtctactacgccctgttcttctgcatcttgatcaccctgacccaaggcttcaccgcgttcatgccctggagcgtcgaagaattctttgtggcgtacgtttcgctcatcatttttgctgtcatgtacctgggccacaagctctataccctcattgtctacggcgccgcggcgtgtaagccggtctctgccaaggacatggatgttactactgggtctttggatctggatgccgagatccccgacgaggtcgaggagcctacgagtatctggaagaagattggaacgggtatcatgggttaa

SEQ ID NO: 17220 - protein, 570 aa, Neurospora crassa
MAVRESTPPAPASPGSSAAGSPPGSATKKDFVKEQSAADDDAASFAEHNAGPELKRRLKSRHLQMIAIGIIGGTIGTGLFIGSGSALAKSGPAGVLIGYCFIASIVYSIMMSLGEMATYVPVTGGFTTYAARFVDSSLGFSMSWIYWFSWAITFALELVATGLIIQYWDDSLSIGIFIAIFWVVIFVINLFPVSWYGEAEFWMSSVKVITVLGFLIFGICINAGAGQQGYIGFKYWHEPGAFAPYIVDPSRPVAKWVGFWSVMIQAGFSFQGTELVGIAAGETEDPRRNVPRAIRMTFYRIFLFFIMTVFFIGILIPYDNKDLNNGGYTAAASPFVIAAQLAGVKVLPDIINAVLLTVVLSAANSNVYSGSRVLVSLANDGMAPKWFKMTTKSGVPYIAVMFTSAFGFLGFLNLSPNGSQAFDWLLNISGVAGFIAWSGILIAHLRFMKGLEAHGIPRSKLPYRATWAPYYVYYALFFCILITLTQGFTAFMPWSVEEFFVAYVSLIIFAVMYLGHKLYTLIVYGAAACKPVSAKDMDVTTGSLDLDAEIPDEVEEPTSIWKKIGTGIMG

SEQ ID NO: 17221 - DNA, 1593 bp, Gibberella zeae PH-1
  CDS (1)..(1593)
atggcttattattctgaaaaagacaagtcgccaggcggcggcgacgtcgagaataccccagacagcgatggcttgtccagacgaggtcccacgcagtcagacctgctaagccgttcgctctcggcgcgacaggtccagatgattgccattggaggtacaatcggtacaggtttattcctgggtactggaaagtcactcgctacaggtggcccagcgtcgatattgattgcttacgctattgtgggtggcattgtttttactaccatgttagctcttggtgagatggcggcgtttattcccgtggcaggtagtttctgtacttttgcaggtcgcttcgtggatgatgcttttggtttcgctctgacttggaattactggttcaacgatgctgtatctacagcctcggatctcgtcgcactgcagctcattctccaatactggaccgacaacttccccggctgggctctgagtcttattttctgggttgttctcatcgctctcaacatcatttccgtcaaggcctacggtgaagtcgagtactggctcagtctgctcaaggtcatcaccattgttgtctttatcgtcatgggtattgtcgtcaactgtggcggcaacgaaactggagagtatattggtggcaaatactggcatttgcctgatgcgccttttgttggtggtattggaggttttgcctctgtttttgttactgcttcttttgcttatggtggaacagagagtatcgccatcactgctggtgagaccaaggatcctaccaaaaacatccccaaagttgtcaagaacgtcttttggcgtatcctcctattctatatcctttcaattctcatcatcggcctcaatgtcccctacaactaccccgatctcaactccaaggaaacccgcacttcgccatttaccattgtctttgagatgacaggcgccaaagctgctggaagtgttatcaacgctgttattctaaccagtgttctttcggccggaaaccacgctctttttgctggtgtgagactgatgtacactctcgctcttgagggacatgcgcctaaagtactcggaaaactcaacaggaacagagtcccttgggttgctgttttggtcaccggttttgtagctggtctttgcttcggctcaagtttcattggcgctggacaactgtggtcctggctacaaaacatcgtcggtgtatccaaccaactaagctggatctccatcggaatcacatcaatccgcttccgccaagccctcgagctccaaggcaaaacgcatcttctgccattcaagaattggacgtacccctatggcccatggatctgcgtcttcctcaacagcttcctggtgctagtgcagggctggagctgtttcagtcccaagtttgacgttgtcagctttatcagcttttacatcgagctacccgtcatgctcatcatgtatatcgggtggaagcttctcaaaaagacaaaggttgttaagttgagcgagatggatcttgagacggatgtacatactattgaggagaaggttactgaggaggcggggtggaagaataagctgaagaatgcggttacttggttgttttaa

SEQ ID NO: 17222 - protein, 530 aa, Gibberella zeae PH-1
MAYYSEKDKSPGGGDVENTPDSDGLSRRGPTQSDLLSRSLSARQVQMIAIGGTIGTGLFLGTGKSLATGGPASILIAYAIVGGIVFTTMLALGEMAAFIPVAGSFCTFAGRFVDDAFGFALTWNYWFNDAVSTASDLVALQLILQYWTDNFPGWALSLIFWVVLIALNIISVKAYGEVEYWLSLLKVITIVVFIVMGIVVNCGGNETGEYIGGKYWHLPDAPFVGGIGGFASVFVTASFAYGGTESIAITAGETKDPTKNIPKVVKNVFWRILLFYILSILIIGLNVPYNYPDLNSKETRTSPFTIVFEMTGAKAAGSVINAVILTSVLSAGNHALFAGVRLMYTLALEGHAPKVLGKLNRNRVPWVAVLVTGFVAGLCFGSSFIGAGQLWSWLQNIVGVSNQLSWISIGITSIRFRQALELQGKTHLLPFKNWTYPYGPWICVFLNSFLVLVQGWSCFSPKFDVVSFISFYIELPVMLIMYIGWKLLKKTKVVKLSEMDLETDVHTIEEKVTEEAGWKNKLKNAVTWLF

SEQ ID NO: 17223 - DNA, 1671 bp, Yarrowia lipolytica CLIB99
  CDS (1)..(1671)
atgtctcgtctttcaacagacggtaacatcactgtggaagcagtgccagtcaaacacgacattggtgtcgacctggaaaaataccctaaggccttcaatgagttctccgatgatgccaactcacaaacagcagaccataccgtcttccccgtcgaccaggatcgtctctcaagatctctgtctggaagacaggtgcagatgattgctatcgccggcgtgattggtacaggtctgtttctgggcactggaaagtcgctggcgaacggaggaccagcttcaatgctcatttgctacaccattatgggctttctcgtgtatttgacaatgctgtcgcttggtgaaatggccacttacatgcctgtggcaggttctttctgctcctacgcttcgcggttcgtgtctgagtctgtgggcttttccctcacctggaactattggtttaatgacgtcacctccacagcctccgatctggtcgccctccagctcgtgttcaagtactggtccgaattccctggctgggccatctctctcattttctgggtctttctgatcgtgctcaacgtgatccatgtcaaggcatatggagagctcgagtactggctggccctgctgaaggtggtcaccatcatcgtgttcatcattctcggcattgtcgtcaactgtggaggaaaccatgaccacgagtaccttggattctcgtactggcacctcgagggagctccgtttgtgaacggcttcaagggctttgcgtctgtgtttgtcactgctgcctttgcctacggaggaactgagtccattggaatcactgccggagaacaaaagaaccccacaaagtccatgccccgtgtcatcaagacagtcttctggcgtatcatcatcttctacgtcctgtcgattttactgatcggcatcaacgtgccctacaactaccccaatctgtcttccaaggaaaccaccacctccccattcacccttgtgttccaaaaggccggctccaaggttgcaggatctttcatcaacgccgtcatcatgacctctgttctctcagctggtaaccacgctctgtttgcaggaactcgactattgtacactttggccatccagggatacgcccccaagtttttcggtaaactgaccaaggccaaggtcccttacgttgctttgctcttcacttcgctactctcgggtctctgtttcggctcttctttcattggagcaggtacactctggtcctggctccagaaccttgtcggagtgtctaaccagctgtcttggatgctcattggagtcacctccatcagatttagaaaggcgctcgacatccagggcaaggtccaccagctcaagtacgtcaactggacctacccttggggaccctgggtggtggttattctctcagcagttatcattctgatccagggatggagttcgttcgcaccctggaatgtctcagatttcttttcctattacattgaactgcttgtcttccctttgctttggctgggatggcaactgtggtcccgaactactctgcttattaagccggaagatgtcgatgtcgagactgaccgctaccacgatactccagaggacctggccgagatggaatacgaggcccagttcaagggatggcgtaaggccgtccacctagcaaagtctttctttgtctag

SEQ ID NO: 17224 - protein, 556 aa, Yarrowia lipolytica CLIB99
MSRLSTDGNITVEAVPVKHDIGVDLEKYPKAFNEFSDDANSQTADHTVFPVDQDRLSRSLSGRQVQMIAIAGVIGTGLFLGTGKSLANGGPASMLICYTIMGFLVYLTMLSLGEMATYMPVAGSFCSYASRFVSESVGFSLTWNYWFNDVTSTASDLVALQLVFKYWSEFPGWAISLIFWVFLIVLNVIHVKAYGELEYWLALLKVVTIIVFIILGIVVNCGGNHDHEYLGFSYWHLEGAPFVNGFKGFASVFVTAAFAYGGTESIGITAGEQKNPTKSMPRVIKTVFWRIIIFYVLSILLIGINVPYNYPNLSSKETTTSPFTLVFQKAGSKVAGSFINAVIMTSVLSAGNHALFAGTRLLYTLAIQGYAPKFFGKLTKAKVPYVALLFTSLLSGLCFGSSFIGAGTLWSWLQNLVGVSNQLSWMLIGVTSIRFRKALDIQGKVHQLKYVNWTYPWGPWVVVILSAVIILIQGWSSFAPWNVSDFFSYYIELLVFPLLWLGWQLWSRTTLLIKPEDVDVETDRYHDTPEDLAEMEYEAQFKGWRKAVHLAKSFFV

SEQ ID NO: 17225 - DNA, 1728 bp, Cryptococcus neoformans var. neoformans JEC21
  CDS (1)..(1728)
atgtcaagcgcaattgaaaaagaaggaagtattagggggagaacatcccaagaggtcgtcagcgcgggatacgacccaaagaaaggtggcgatggtgtagacacagtggtcacccctgcacatgcggaaaaaggcagttatgaaggcgaaggcatccatgttggcgaaggaactgttcatcgtcagttgaagcagcgtcatatggccatgatcgctcttggtggagcgattggtactggtctcttcgttggttctgggtctgctttggccagcggtggtcctgtgggcgtgtggcttggttatatcttcatggcgtctatggtatacgcgatgatggtggcgcttggagaaatggcagctttatacccggtttctggtgccttcactcattacgcgtcacgtttcgtcgatccttctcttggtttcgcgcttggtttcaactactggtattcttacgctatcaccattccgactgaggttgttgctgccagtattgtgatctcatattgggatacaacaacgaatgtcgccgtttacattaccgtatgccttgtgctgatttggttcattaacttctggggagccagagcgtatggtgaagcagaattttggttctcttccatcaaggttatcaccatcgtgggcctcattatcttaggaatcgttttgatgtgtggtggcggtcccaaccatgacgctattggtttccgatactggcgtaacccaggaccatttgcgcaaatcacaattaataatggtgacggtgttatccccggacgatggggtcagttcctcgccttctggaatgtctttgtacaggctgctttctctttcatcggtactgaaatcattgctaccactttgggtgaggccgagaaccccaggaagacggtccctcgagcgatcaagcgtgttttcttccgtttgctcttcttctacgtctttggcatttttatcatctcggtccttgttccgtacaccgagcccaatctcctcaatggaactggcaccgctgccgcttctcctttcgtcattgctattgagaacgcgggtattaaagctcttccttccattgtcaacgctgtgctccttatttctgcttggtcggctggtaactcagatctctatgcttcttctcgaaccctatatgctctcgcgctcgagcgccagatgcctcgtttctttcgacgatgcaccaaaaggggtcttcccatctggtgtgttgtaatcacaggtctttttggttttctttcatacatgaacactggcggtgagacggctgagaaggcatttgactggttgtacaacttgtctgccattacaggtatcatcacgtggtgggctattctgctttcgtatcttcgattctactatggtttgaagaagcagggtctcagtcgagacgatttcccataccgcgctcctttccagccttggctttcttggtatggctttatcttcttcactctcatcattcttttcaacggtttcactgtcttcttgaagggcaactgggatgcctcttcctttgttgctgcctatattacgctgcccatcttcgctgtctgctggattggatggaaacttgttaagaagaccagggtagttcctttggccgagatcgacttccacagtggacgaagggaattggatgagcttgaagcattggatgcggaaaggtttaaggcggagaccaagtaccaaaaaattatcagtatcttgttttaa

SEQ ID NO: 17226 - protein, 575 aa, Cryptococcus neoformans var. neoformans JEC21
MSSAIEKEGSIRGRTSQEVVSAGYDPKKGGDGVDTVVTPAHAEKGSYEGEGIHVGEGTVHRQLKQRHMAMIALGGAIGTGLFVGSGSALASGGPVGVWLGYIFMASMVYAMMVALGEMAALYPVSGAFTHYASRFVDPSLGFALGFNYWYSYAITIPTEVVAASIVISYWDTTTNVAVYITVCLVLIWFINFWGARAYGEAEFWFSSIKVITIVGLIILGIVLMCGGGPNHDAIGFRYWRNPGPFAQITINNGDGVIPGRWGQFLAFWNVFVQAAFSFIGTEIIATTLGEAENPRKTVPRAIKRVFFRLLFFYVFGIFIISVLVPYTEPNLLNGTGTAAASPFVIAIENAGIKALPSIVNAVLLISAWSAGNSDLYASSRTLYALALERQMPRFFRRCTKRGLPIWCVVITGLFGFLSYMNTGGETAEKAFDWLYNLSAITGIITWWAILLSYLRFYYGLKKQGLSRDDFPYRAPFQPWLSWYGFIFFTLIILFNGFTVFLKGNWDASSFVAAYITLPIFAVCWIGWKLVKKTRVVPLAEIDFHSGRRELDELEALDAERFKAETKYQKIISILF

SEQ ID NO: 17227 - DNA, 1767 bp, Candida albicans SC5314
  CDS (1)..(1767): transl_table=12
atgccagaaaaggaattagattacattaggtccacagatgctgctggatccaccgaaaaagacggtggaatttatattgatgcctttgacaaacaagataacgccccaccaaagaaagggtttgccaaattcattgatggtttcagacgtgctgatgctgaagaattaggtattgatcctaacttgtcagaagcagaaaaaattgccattatgactgcaaactccccattgactcgttcattgaaaaatagacatttacaaatgattgctattggtggtagtattggtactggtcttttcgttggttcgggttcttctttacatactgggggtccagctgggcttttgattgcttatatacttattggaactatgatttattgtacagttatgtcccttggggaattggctgttactttccctgtatctggtgcttttgttacttataatagtcgttttattgatccaagttgggggtttgccatggcttggaattatgctatgcaatggctagtggtgttgcccttggaattggttgctgcagcaatgacggtgaaatattgggatgccaaaacaaacctggcggcgttcgtggttattttctatgttttgattgttgctattaacttttttggtgtccgtggttacggtgaagctgaatttatatttagtgccgttaaagttttggctgttttgggtttcattattttgggtattgtattgtgtgctggtggtggtccacaaggtggttatattggaggtaaaaactggtatattgaaggtgctccattccctaatggtgctaaaggtgtcataacggtgtttgtgaatgctgcctttgctttcgctggtactgaattgtgtggattggctgctgctgaaaccgaaaacccaagaaaatcattaccaaaagcttgtaagcaagttttctggagaatcactttattctatgtcatctgtttgactttagttgggttattggttccatggaatgatgaaagattattgggtagttcttctgctgatgcttctgcttctccattcgtcatttcaattagaaatgctggtattaaaggtttaccatcagttatgaatgttgttattatgattgctgtcttatctgttggtaactcctctgtctatggttcctcaagaactttggctgctttggctgcttccaaccaagctccaaaaatatttggttacattgataaacaaggtagaccgttagttggtattattgcccaattgcttgttggtttattatgtttccttgctgcatccgataaacaaggtgaagttttcaattggttgttggccttgtctggtttgtcttctattttcacttggggatcaattaatgtttgtttgattagattcagaagagcattggctgctcaaggtagagacactggtgaattggttttcacttctcaagttggtgttattggtgctatttggggtgcttttttgaacactgttgttctttgtttacaattctggattgctgtgtggccattgcattcttccccaagtgctgaagctttcttcagtgcttacttgactgttcctgttgttattgttttctacgttggtcataaactctggaccaagaattggcaagtctacatttgtgccaaggatattgatatcgatactggtagaagagaattggacttggacttggtcaaacaagaagttgccgaagaaaaggcttacattgcttctttgccattctacagaagagtctacaatgcttggtgttga

SEQ ID NO: 17228 - protein, 588 aa, Candida albicans SC5314
MPEKELDYIRSTDAAGSTEKDGGIYIDAFDKQDNAPPKKGFAKFIDGFRRADAEELGIDPNLSEAEKIAIMTANSPLTRSLKNRHLQMIAIGGSIGTGLFVGSGSSLHTGGPAGLLIAYILIGTMIYCTVMSLGELAVTFPVSGAFVTYNSRFIDPSWGFAMAWNYAMQWLVVLPLELVAAAMTVKYWDAKTNSAAFVVIFYVLIVAINFFGVRGYGEAEFIFSAVKVLAVLGFIILGIVLCAGGGPQGGYIGGKNWYIEGAPFPNGAKGVITVFVNAAFAFAGTELCGLAAAETENPRKSLPKACKQVFWRITLFYVICLTLVGLLVPWNDERLLGSSSADASASPFVISIRNAGIKGLPSVMNVVIMIAVLSVGNSSVYGSSRTLAALAASNQAPKIFGYIDKQGRPLVGIIAQLLVGLLCFLAASDKQGEVFNWLLALSGLSSIFTWGSINVCLIRFRRALAAQGRDTGELVFTSQVGVIGAIWGAFLNTVVLCLQFWIAVWPLHSSPSAEAFFSAYLTVPVVIVFYVGHKLWTKNWQVYICAKDIDIDTGRRELDLDLVKQEVAEEKAYIASLPFYRRVYNAWC

SEQ ID NO: 17229 - DNA, 1677 bp, Aspergillus fumigatus Af293
  CDS (1)..(1677)
atgacagttcatgatattgaaaaatatccccctcatgctccccaagagcctctgagcggaaaggccgcaggcgctgagccctttgaattcaatcaacatgtcaacgccgacaggctcgctcgtaagctctccgcccgccaggtgcagatgatcgccatcggcggcacaattgggacgggactcttcctgggaacaggcaaagctctcgcgacaggtgggcctgcgtcgatgcttatttcgtatgccatatgtggtgggattgtgttcgtcacgatgttaagcctgggggagatggcggcgtttattcccattgcgggttcgttctgtactttcgcagggcgcttcgttgacgatgctcttggtttcgctctgacttggaattactggtttaatgacgctgtctcaacggcggcggatgtcattgcactgcaactattgctgcagtattggacggataacttcccaggctgggcgatcagcttaatctttctgatttttgttattttacttaatgtgatgtctgtgagaatctacggagagattgaatattggctcagcttactcaaggtcatcacgattataatcttcatcattctcgggattgttgtcaactgcgggggcaataaggaccacaaatacatcggtgacaagtacttctatgtcggcgatgcccccttcgtaggtggaatcggtggattcgcctccgtctttgtcacggcatcgtttgcttatggcggcacggaatccattgccatcacagcgggagaaaccaaagacccagctaaaaacctgccgcgagtcgtccgcaatgtcttctggcgcatcgtcctcttctacatcatctccatcattctcatcggtctcaatgttccctacaactaccccaacctgtcaaagaaaaccaccgccaccagcccgttcaccatcgtcttcatggaagctggcagcgccgtggcaggcagcttcatcaacgccgtgctaatgaccagcgtcatctccgccgccaaccatgccctcttcgcagggtcccggcttctctacacgctcgcggtagacggccacgcccctcatttctttggccacctcaaccgcttccagatcccctgggtcgccgtgctagccacatccctcgtcagcggtctctgcttcggagccagctacatcggagccggccagctctggacctggttgcaaaacatcgtcggcgtctccaaccaaatctcgtgggtctgcatcggcatcgcctccctgcgcttccgcgccgccatccgccggcagaacctcgagcatctcctccccttcaagaactggacgtaccccgtcggccccatcatcgccgtcgggctgaatatcgtcctgatcctcgtgcagggctggtcctgcttcagcccgtccttccaggccgtcgactttgtgtcgttctacatcgagatccctatcatgattgtcatgtttttggcctggaagctggttaagcagacgaggttcgtgcatctggatgagatggacttggttactgatcggtatgatctgaatgcggagcatgctgaaagcgatggcaatgccgatggtgatagcccgtcgcgggtcgggaggattctgcatatcaaacagttgcagagtgaaaagggcgtgctcgggaagctgaagcgagttgggatgtggctgttcctatag

SEQ ID NO: 17230 - protein, 558 aa, Aspergillus fumigatus Af293
MTVHDIEKYPPHAPQEPLSGKAAGAEPFEFNQHVNADRLARKLSARQVQMIAIGGTIGTGLFLGTGKALATGGPASMLISYAICGGIVFVTMLSLGEMAAFIPIAGSFCTFAGRFVDDALGFALTWNYWFNDAVSTAADVIALQLLLQYWTDNFPGWAISLIFLIFVILLNVMSVRIYGEIEYWLSLLKVITIIIFIILGIVVNCGGNKDHKYIGDKYFYVGDAPFVGGIGGFASVFVTASFAYGGTESIAITAGETKDPAKNLPRVVRNVFWRIVLFYIISIILIGLNVPYNYPNLSKKTTATSPFTIVFMEAGSAVAGSFINAVLMTSVISAANHALFAGSRLLYTLAVDGHAPHFFGHLNRFQIPWVAVLATSLVSGLCFGASYIGAGQLWTWLQNIVGVSNQISWVCIGIASLRFRAAIRRQNLEHLLPFKNWTYPVGPIIAVGLNIVLILVQGWSCFSPSFQAVDFVSFYIEIPIMIVMFLAWKLVKQTRFVHLDEMDLVTDRYDLNAEHAESDGNADGDSPSRVGRILHIKQLQSEKGVLGKLKRVGMWLFL

SEQ ID NO: 17231 - DNA, 1836 bp, Ustilago maydis 521
  CDS (1)..(1836)
atggtcgacaatcccagcagcgatcttgtcgtcgagcagcctgctgacgctcgctcacccatgaccgtcaacaactcgaaagcctctagcaatatggatcaagatattgctcccaccttgtccaaggttggctctcagaccagtaccatcggctttgggtccacacacccacccatcaccgatgctgctcttcaacaggttcgcttgcgccgtgctttgggcgagcgtactatccagatgattgccctcgcaggcaccattggcacaggtctcttcctcggttctggcaaagcactcgccacttctggtcctctctcgatcctgatctcgtactcgctcgtcggtgtcattgtctaccttaccatgatagccatgggcgaaatggctgcgcttgtccccacctctggtgcttttggcgtcttcaccactcgctttgtgagcgttcatgcagggttttctgtcaatctgaattactggctgaatgacgcgatcagcgtagcttcagacctaacggcgatgcagatcctgaaaaactactgggtctccgacgacgtctttcctggctgggccctatctctcatttccctcgcgttcctgatttccgtcaatgttatctctgtgcgcggatatgcagagctcgagtatcttctttcgcttctcaagattgccaccatcattgcctttatcattgtcggtatcgtcgtcaatgccggtgtcaatgatacccattcttaccttggtttcaggtattggaccatcggcgatgcacccttcgtcggtggtttcggtggttgggtctcctctttcgtcaccgcttcctttgcattcggcggaaccgagtcccttaccatcaccgccggagaaacgcgcaacccatccaagacaatcccgaagaccatacgcaacgtcttttggcggatcattctcttctacatcctcgccctcttcatcattggcatcaacatcccttacaacaccccagggcttaagtccaagaacaccgctgtctccccttttactctcgtattcaagcaggctggctcccacggcgcggctagtttcatgaacgccgttgttctcacatcagctctgtcggctggtaatcacgcgctttatgccgggacccggattcttcattcaatggcaacaaacggtcaggcccccaagatttttgcgactgtctccaaaagcactcgtgtaccttgggttgctctggcctgtacagcgagcatctccggtctgtgcttcggctcgagttatatcggcgccggcgacctttggaactggctacagaatcttgtgggtgtcagcaatcagctttcctgggccgcgattggggtctcgtccatccgctttcacaaagccgtcgttaagcaagggaaacagtcgtcacttatctacaagaattggacgcaaccgtggggtccttacgttgccgtcataggctctgttctcatgatcctcgttcaaggatggaccgccttcaagccttttaacgtctcggactttttctcttactatatcgagctcgtcttcttcgcattagcattcttaggatggaagctgtggaaaaagactaagctgatcccaatcgaagaggtcgatctctacacggacactgttcagtacgaaaaagatcttcgaagaaggagaagggatctcatcagggacggtgccggtgacaagttacccgtcttgctcgaagacgaggaaatgccggaggatgacgatgaccgagaggcacagaaggagcaggagaaggaccagaagcatcgagataagaagcaaaggttcaaagcgatggcaagtagggcttctcagtatctgtgcttttag

SEQ ID NO: 17232 - protein, 611 aa, Ustilago maydis 521
MVDNPSSDLVVEQPADARSPMTVNNSKASSNMDQDIAPTLSKVGSQTSTIGFGSTHPPITDAALQQVRLRRALGERTIQMIALAGTIGTGLFLGSGKALATSGPLSILISYSLVGVIVYLTMIAMGEMAALVPTSGAFGVFTTRFVSVHAGFSVNLNYWLNDAISVASDLTAMQILKNYWVSDDVFPGWALSLISLAFLISVNVISVRGYAELEYLLSLLKIATIIAFIIVGIVVNAGVNDTHSYLGFRYWTIGDAPFVGGFGGWVSSFVTASFAFGGTESLTITAGETRNPSKTIPKTIRNVFWRIILFYILALFIIGINIPYNTPGLKSKNTAVSPFTLVFKQAGSHGAASFMNAVVLTSALSAGNHALYAGTRILHSMATNGQAPKIFATVSKSTRVPWVALACTASISGLCFGSSYIGAGDLWNWLQNLVGVSNQLSWAAIGVSSIRFHKAVVKQGKQSSLIYKNWTQPWGPYVAVIGSVLMILVQGWTAFKPFNVSDFFSYYIELVFFALAFLGWKLWKKTKLIPIEEVDLYTDTVQYEKDLRRRRRDLIRDGAGDKLPVLLEDEEMPEDDDDREAQKEQEKDQKHRDKKQRFKAMASRASQYLCF

SEQ ID NO: 17233 - DNA, 1461 bp, Listeria monocytogenes str. 4b F2365
  CDS (1)..(1461): transl_table=11
gtgaagaaagaaacacatggcgagattcgtcgtgacttaaaaacaaggcatttgtccatgattgccattggtggttcaatcgggacgggattatttttagcaagtggtaatgcgattcatacagcaggacctggtggcgctttagttgcttatatagcaatcgggattatggtgtactttttaatgacaagtttaggcgaaatggctacttacatgcctgtatctggttcatttagtacctatgctagtcgatttgttgacccagctttcggttttgcgcttggttggaattattggtttaactgggccattacacttgcggttgatatttccactgctgcaattatcgttcaattttggctaccgaacacccccgcttggctatggagcgcgattttcttaattttgattttcggcttaaacgcgctttcggtaaaagcatacggagaatcagagtattggttttcaattattaaagtggccacggttattattttccttatcgtcggcgtgcttactattgtcggaattcttggcggcgaagttattggcttttctaactttactgctggcgatgctccgtttaaaggtggattttttgccatcttaggtaccttcttaattgctggattttctttccaagggactgaaatggttggtattgcagctggtgaaagtgctactccagaaaccagcgtgccaaaagcgattaaacaagtattctggcggattttgctattttatatttttgcgattttcattattgggatgattattccttatactaacccgaatttacttagtgccgaggcaacagatgtggcaattagcccatttacactcgtatttgaaaaagctggtcttgcatttgcggcttccgtaatgaatgcggttatcctgacttctgttttatctgctggtaattcaggtctttacgcttccacaagaatgctttgggcaatggctcgtgataaaaaagcgcctaaattcttgggtaaagtaaaccgtcgtggcattccgatggctgctttaattgttacgacgattgttggtgcaatgacattcattacaacgctaacagaaaacggcacagtgatttatacgtggttactttccgcctctggtttaaccggatttattgcttgggtcggcatcgctatcagtcattaccgtttccgaaaagcatttatcaaacaaggacatgacttaagtgaactaaaatataaagcaaaatttttcccattcggacctattttagcactaattttatgtattttagttattgtcggtcaagattacgcggcatttttgaaaccagaatttacgaatcctgcttggtggcaaaaaatcggtatttcttatatcggcctccctattttccttgttttctggctatcttttaaatttacaaataaaacaaaagttattccactggaagactgcaaatttgatcaaaaataa

SEQ ID NO: 17234 - protein, 486 aa, Listeria monocytogenes str. 4b F2365
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALILCILVIVGQDYAAFLKPEFTNPAWWQKIGISYIGLPIFLVFWLSFKFTNKTKVIPLEDCKFDQK

SEQ ID NO: 17235 - DNA, 1425 bp, Bacillus anthracis str. 'Ames Ancestor'
  CDS (1)..(1425): transl_table=11
atgtcgcaagtaaacaatacaaacaatgaattaaaacgtacgatgaaaagtagacacttattcatgattgcactcggtggtgtgattggaacggagttatttaacggatctggctttattataagtcaagctggacctggtggatccgtacttgcctttatggctggtggattattaatgtatttcgttatgctttgtcttggtgaactcgctgtagctatgcctgtttcaggttcttttcaggaatatgcaactaagttcatcaatcctgcaactggatttacaatcggctggttatattggttaagctgggcaaatacgaccggtcttgaatttacaactgctggcattacaatgcagcgctggttccctgatattcctgtttgggtttggtgtttaatatttggtgttacaatcttcatgattaatgcattatctgctcgtagttatgcagaaacagaattttggttttcaagtataaaagtatctgccattatagcttttattattcttggcggcgccgctatgttcggtttaattgatttaaaaggcgacgaaccagccccattattatcaaatttcgtaaatcatggcggtttattcccaaatggacttgcagctattctattaacgatggttacagttaattattccttccaaggtacagaacttgtcggaatcgcagcaggtgaaagtgaagatccagcaaaaactttacctcgttctattagaaatattatatggcgtacgatgtttttcttcgtcttagcaatctttgttcttgttgctttaattccttgggaagaagcaggattaacaaaaagcccgttcgttgctgtttttgataatatcagtattccatatgcagctgatattatgaactttgttattcttacagctgttctttctgtcgcaaactcaggactttacgcggcaactcgtatgctttggtcattatcaaaaaatgaaatggctccagcctttttaaagaaattatcatcacgaggaatacctttaaacgctttaattttgacaatttctatttctgctttttctcttttaacaagcgtcgtagctgctgaaacagtttacttatggttaatttccatttctggcgtcattacaattattgtttggatgtcaatttgtgtttctcaattctttttccgtaaacattatgtagcagacggtggaagattagaagacttaaaatttaaaacgccactttatccacttgtaccaattcttggttttggattgtatggcattatattagtaagtcttatctttatcccagatcaaagactaggcatttattgtactgtaccatttatcatcttttgctacacttactatcactttaaagtgaagaaaagaatttctactaacacttctagtgaaaataaaattagcgagactatataa

SEQ ID NO: 17236 - protein, 474 aa, Bacillus anthracis str. 'Ames Ancestor'
MSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 17237 - DNA, 1467 bp, Bacillus anthracis str. 'Ames Ancestor'
  CDS (1)..(1467): transl_table=11
atgaatagcgcaacgaatcaaactacctctcaaacagaaactacaaaaggaaaaggtgaattaagacgcggtctaaaatcaaagcaccttacgatgatttctctcggcggtacaattggtaccggactatttcttgccagcggtggtgtcattcattcagctggacctggcggcgcattaattgcatacgccgcaattggaattatggtttactttttaatgacaagcttagccgaactcgcagcttacatgcctgttactggatcttttagcacgtacgcaacaaaatttgttgatccatcacttggctttgcacttggatggaactattggtataactgggcaattactatcgctgctgaactagcggctgtaacattaattatgaaattttggtttccagatactccttccctcatttggagcggattatgtttagctattattttccttttaaactacttatctgttaaaggatttggtgaatctgaatattggttcgcacttattaaagtagctacgattattatctttttaattgtcgggtttatgatgattttcggaattatgggcggcgaaactgttggatttaaaaacttcactgttgcagatgcaccatttaacggcggcatcatggcaattatcggtgtatttatggcagctggtttctcattccaaggtactgaattattaggtgtagctgctggtgaaacatctgatccagagcgtaatattccaaaagcaattcgttcgatcttttggcgtatccttttattctatatccttgcgattctcgttatcggtttattaattccttatacaactgaaagtcttgccgcaagtgatgtaacagtaagtccatttacacttatttttgaaaaagcgggcgttgccttcgctgcttctgttatgaacgctgttattttaacggcagtactatctgctggtaactctggtatgtatgcatcaactcgtatgctttgggacttagctcgccaagggaaagcaccaaagtttcttggtaaattagatagccgcggcgtacctgttaacgcattaatcgtaacatcgattgtcggtagtatcgctttcattgcttctttattcggtgacggtgttgtatacatttggttactaaatgcatcaggaatgtctggctttatcgcatgggttggaatcgcaattagtcattaccgtttccgcaaagcatatatcgcacaaggaaaagatttaaatgacttaccttatagagcaaaatggttcccattcggaccaatcttcgcttttgcgctttgcgtcatcgtaattttaggtcaaaactacggcgcatttatgggcgaatcaatcgattggaacggcgtactcgtttcttacatcggtttaccactcttcttagtactttggttaggatacaaatttacgaaaaaaacaaaagtcattccacttgataaatgtgaactaaaataa

SEQ ID NO: 17238 - protein, 488 aa, Bacillus anthracis str. 'Ames Ancestor'
MNSATNQTTSQTETTKGKGELRRGLKSKHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 17239 - DNA, 1422 bp, Bacillus anthracis str. Sterne
  CDS (1)..(1422): transl_table=11
atgatgaatcaaaaccaaggattaaaaagagaattgaagagcaggcacatatttatgattgcacttggaggagttattggtactggcctttttttaggatctgggtatacaattcatgaagctgggcctggaggagcgattgtagcgtatcttgtcggaggatttgttatgtatttaacgatgctctgtcttggagagttagctgttgcaatgcctgacgcagggtcttatcaaacgtatgcaactaagcacatttcccctgcagcgggttatgtagtcggatggatgtcgtggttgaactggtcagctacgataggtattgaactaattgcagttagtattttaatgaaacgatggtttccagatgtaccgtcatggatttggtgcgtagtgtttgcggtactgctttttgctattaatgcgttatcttcaagaagttttgcagaagttgaattttggtttgcaagtattaaagtcattacaatcattgcatttattattttgggcggggcagcaatgtttggttttctagatatgaaaggaaatgaaccagcaccaatgttctctagttttactgattatggtggattgtttccaaatggattatccgctattttaattacgatgattgctgttaacttttccttccaaggaacagaactagtcggtattgcagcaggtgagagtgaaaatccagagaaaacaatcccgaaggcaattaataatacagtttggcgtatactcgtgttctttgtattatctattttcattcttgcaggattattcccttggcaacaggcgggagtaatagaaagtccattcgtagttgtatttgataaaattggtattccttatgcagccgatattatcaatttcgttattattacagcggttctatccgttgcgaattcaggattatacgcaacttctcgtatgctatggtctatgtctaatcaaggaatgattagtccgatttttggtaagttatctaaaaatggtgttcctatttatgcattgattgtaagtacaattgtaggttgcctttcattactatcaggtatttatgcggaagatacagtttatttatggctactttctattgccgggttcggagcgatattagtttgggcatctattgctctatctaacttattagctagaaggtcatatataaagcagggcggagatgtgaaagacttgaaatttaaaacaccactgtatccattcgtaccgctgcttgcattagtattaaatgtaacagtaattgttggtatggcctttattccagaacaaagaatggcgttatattgtggaattccatttatgattgtttgcttactgttttaccgtgcgacaagaaataaggcacataaagtagaacatattgaaaagacagatacaacagaagtagacagtttataa

SEQ ID NO: 17240 - protein, 473 aa, Bacillus anthracis str. Sterne
MMNQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTDTTEVDSL

SEQ ID NO: 17241 - DNA, 1437 bp, Bacillus anthracis str. Sterne
  CDS (1)..(1437): transl_table=11
gtgaggaaaacaatgtcgcaagtaaacaatacaaacaatgaattaaaacgtacgatgaaaagtagacacttattcatgattgcactcggtggtgtgattggaacggagttatttaacggatctggctttattataagtcaagctggacctggtggatccgtacttgcctttatggctggtggattattaatgtatttcgttatgctttgtcttggtgaactcgctgtagctatgcctgtttcaggttcttttcaggaatatgcaactaagttcatcaatcctgcaactggatttacaatcggctggttatattggttaagctgggcaaatacgaccggtcttgaatttacaactgctggcattacaatgcagcgctggttccctgatattcctgtttgggtttggtgtttaatatttggtgttacaatcttcatgattaatgcattatctgctcgtagttatgcagaaacagaattttggttttcaagtataaaagtatctgccattatagcttttattattcttggcggcgccgctatgttcggtttaattgatttaaaaggcgacgaaccagccccattattatcaaatttcgtaaatcatggcggtttattcccaaatggacttgcagctattctattaacgatggttacagttaattattccttccaaggtacagaacttgtcggaatcgcagcaggtgaaagtgaagatccagcaaaaactttacctcgttctattagaaatattatatggcgtacgatgtttttcttcgtcttagcaatctttgttcttgttgctttaattccttgggaagaagcaggattaacaaaaagcccgttcgttgctgtttttgataatatcagtattccatatgcagctgatattatgaactttgttattcttacagctgttctttctgtcgcaaactcaggactttacgcggcaactcgtatgctttggtcattatcaaaaaatgaaatggctccagcctttttaaagaaattatcatcacgaggaatacctttaaacgctttaattttgacaatttctatttctgctttttctcttttaacaagcgtcgtagctgctgaaacagtttacttatggttaatttccatttctggcgtcattacaattattgtttggatgtcaatttgtgtttctcaattctttttccgtaaacattatgtagcagacggtggaagattagaagacttaaaatttaaaacgccactttatccacttgtaccaattcttggttttggattgtatggcattatattagtaagtcttatctttatcccagatcaaagactaggcatttattgtactgtaccatttatcatcttttgctacacttactatcactttaaagtgaagaaaagaatttctactaacacttctagtgaaaataaaattagcgagactatataa

SEQ ID NO: 17242 - protein, 478 aa, Bacillus anthracis str. Sterne
MRKTMSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 17243 - DNA, 1467 bp, Bacillus anthracis str. Sterne
  CDS (1)..(1467): transl_table=11
atgaatagcgcaacgaatcaaactacctctcaaacagaaactacaaaaggaaaaggtgaattaagacgcggtctaaaatcaaagcaccttacgatgatttctctcggcggtacaattggtaccggactatttcttgccagcggtggtgtcattcattcagctggacctggcggcgcattaattgcatacgccgcaattggaattatggtttactttttaatgacaagcttagccgaactcacagcttacatgcctgttactggatcttttagcacgtacgcaacaaaatttgttgatccatcacttggctttgcacttggatggaactattggtataactgggcaattactatcgctgctgaactagcggctgtaacattaattatgaaattttggtttccagatactccttccctcatttggagcggattatgtttagctattattttccttttaaactacttatctgttaaaggatttggtgaatctgaatattggttcgcacttattaaagtagctacgattattatctttttaattgtcgggtttatgatgattttcggaattatgggcggcgaaactgttggatttaaaaacttcactgttgcagatgcaccatttaacggcggcatcatggcaattatcggtgtatttatggcagctggtttctcattccaaggtactgaattattaggtgtagctgctggtgaaacatctgatccagagcgtaatattccaaaagcaattcgttcgatcttttggcgtatccttttattctatatccttgcgattctcgttatcggtttattaattccttatacaactgaaagtcttgccgcaagtgatgtaacagtaagtccatttacacttatttttgaaaaagcgggcgttgccttcgctgcttctgttatgaacgctgttattttaacggcagtactatctgctggtaactctggtatgtatgcatcaactcgtatgctttgggacttagctcgccaagggaaagcaccaaagtttcttggtaaattagatagccgcggcgtacctgttaacgcattaatcgtaacatcgattgtcggtagtatcgctttcattgcttctttattcggtgacggtgttgtatacatttggttactaaatgcatcaggaatgtctggctttatcgcatgggttggaatcgcaattagtcattaccgtttccgcaaagcatatatcgcacaaggaaaagatttaaatgacttaccttatagagcaaaatggttcccattcggaccaatcttcgcttttgcgctttgcgtcatcgtaattttaggtcaaaactacggcgcatttatgggcgaatcaatcgattggaacggcgtactcgtttcttacatcggtttaccactcttcttagtactttggttaggatacaaatttacgaaaaaaacaaaagtcattccacttgataaatgtgaactaaaataa

SEQ ID NO: 17244 - protein, 488 aa, Bacillus anthracis str. Sterne
MNSATNQTTSQTETTKGKGELRRGLKSKHLTMISLGGTIGTGLFLASGGVIHSAGPGGALIAYAAIGIMVYFLMTSLAELTAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 17245 - DNA, 1422 bp, Bacillus thuringiensis serovar konkukian str. 97-27
  CDS (1)..(1422): transl_table=11
atgatggatcaaaataaaggattaaaacgggaattgaaaagcaggcacatatttatgattgcacttggaggagttattggtaccggtctttttttaggatctgggtatacaattcatgaagctgggcctggaggagcgattgtagcgtatcttgtcggaggatttgttatgtatttaacgatgctctgtcttggagagttagctgttgcaatgcctgacgcaggatcttatcaaacgtatgctacgaagcatatttcccctgcagcgggttatgtagtcggatggatgtcgtggttaaactggtcggctacaataggtattgaactaattgcagttagtattttaatgaaacgatggtttcctgatgtaccgtcttggatttggtgcgtagtgtttgcggtactactttttgctattaacgcgttatcttcaagaagttttgcagaagttgaattttggtttgcaagtattaaagtcattacaatcattgcatttattattttgggcggggcagcaatgtttggttttttagatatgaaaggaaatgaaccagcaccaatgttttctagctttattgattatggtgggttgtttccaaatggattatccgctattttaattacgatgattgcagttaatttttccttccaaggaacggaactagtcggtattgcagcaggtgagagtgaaaatccagagaaaacgatcccgaaggcaattaataatacagtttggcgtatactcgtgttctttgtattatctattttcattcttgcaggattattcccttggcaacaggcgggagtaatagaaagtccattcgtagttgtatttgataaaattggtattccttatgcagccgatattatcaatttcgttattattacagcggttctatccgttgcgaattcaggattatatgcaacttctcgtatgctatggtctatgtctaatcaaggaatgattagtccgatttttggtaagttatctaaaaatggtgttcctatttatgcattgattgtaagtacaattgtaggttgcctttcattactatcaggtatttatgcggaagatacagtttatttatggctactttctattgccgggttcggagcgatattagtttgggcatctattgctctatctaacttattagctagaaggtcatatataaagcagggcggagatgtgaaagacttgaaatttaaaacaccactgtatccattcgtaccgctgcttgcattagtattaaatgtaacagtaattgttggtatggcctttattccagaacaaagaatggcgttatattgtggaattccatttatgattgtttgcttactgttttaccgtgcgacaagaaataaggcacataaagtagaacatattgaaaagacaaatacaacagaagtagaaagtttataa

SEQ ID NO: 17246 - protein, 473 aa, Bacillus thuringiensis serovar konkukian str. 97-27
MMDQNKGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFIDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTNTTEVESL

SEQ ID NO: 17247 - DNA, 1437 bp, Bacillus thuringiensis serovar konkukian str. 97-27
  CDS (1)..(1437): transl_table=11
gtgaggaaaacaatgtcgcaagtaaataatacaaacaatgaattaaaacgtacgatgaaaagtagacacttattcatgattgcactcggtggtgtgattggaacggggttatttaacggatctggctttattataagtcaagctggacctggtggatccgtacttgcctttatggctggtggattattaatgtatttcgttatgctttgtcttggtgaactcgctgtagccatgcctgtttcggggtctttccaggaatatgcaactaagttcatcaatcctgcaactggctttacaatcggatggttgtattggttaagctgggcaaatacgaccggtcttgaatttacaactgctggcattacaatgcagcgctggttccctgatattcctgtttgggtttggtgtttaatatttggcgttacaatcttcacgattaatgcattatctgctcgtagttatgcagaaacagaattttggttttcaagtataaaagtatctgccattatcgcttttattatccttggcggcgccgctatgttcggtttaattgatttaaaaggcgacgaaccagccccattattatcaaatttcgtaaatcatggcggtttattcccaaatggacttgcagctattctattaacgatggttacagttaattattccttccaaggtacagaacttgtcggaatcgcagcaggtgaaagtgaagatccagcaaaaactttacctcgttctattagaaatattatatggcgtacgatgtttttcttcgtcttagcaatctttgttcttgttgctttaattccttgggaagaagcaggattaacaaaaagcccgttcgttgctgtttttgataatatcggtattccatatgcagctgatattatgaactttgttattcttacagctgttctttctgtcgcaaactctggactatatgccgcaactcgcatgctttggtcattatcaaaaaacgaaatggctccggcctttctaaagaaattatcttcacgaggaatacctttaaacgctttaattttgacaatttctatttctgctttttctcttttaacaagcgtcgtagctgctgaaacagtttacttatggttaatttcaatttctggcgtcattacaatcattgtttggatgtcaatttgtgtttctcaattctttttccgtaaacattatgtagcagacggtggaagattagaagacttaaaatttaaaacgccactttatccacttgtacccattcttggttttggattgtatggcattatattagtaagtcttatctttatcccagatcaaagactaggcatttattgtactgtaccatttatcatcttttgctacacttactatcactttaaagtgaagaaaagaatttctactaacacttctagtgaaaataaaattagcgagactatataa

SEQ ID NO: 17248 - protein, 478 aa, Bacillus thuringiensis serovar konkukian str. 97-27
MRKTMSQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 17249 - DNA, 1467 bp, Bacillus thuringiensis serovar konkukian str. 97-27
  CDS (1)..(1467): transl_table=11
atgaatagcgcaacgaatcaagctacctctaaaacagaagctacaaaaggaaaaggtgaattaagacgcggtctaaaatcaaggcaccttacgatgatttctctcggcggtacaattggtaccggactatttcttgccagcggtggtgtcatccattcagctggacctggcggtgcattaattgcatacgccgcaattggaattatggtttactttttaatgacaagcttagccgaactcgcagcttacatgcctgttactggatcttttagcacgtacgcaacaaaatttgttgatccatcacttggctttgcacttggatggaactattggtataactgggccattacgattgctgctgaactagcggctgtaacattaattatgaaattttggtttccagatactccttccctcatttggagcggattatgtttagctattattttccttttaaactacttatctgttaaaggatttggtgaatctgaatattggttcgcacttattaaagtagctacgattattatctttttaattgtcgggtttatgatgattttcggaattatgggcggcgaaactgttggatttaaaaacttcactgttgcagatgcaccatttaacggcggcatcatggcaattatcggtgtatttatggcagctggcttctcattccaaggtactgaattattaggtgtagctgctggtgaaacatctgatccagagcgtaatattccaaaagcaattcgttcgatcttttggcgtatccttttattctatatccttgcgattctcgttatcggtttattaattccttatacaactgaaagtcttgccgcaagtgatgtaacagtaagtccatttacacttatttttgaaaaagcgggcgttgccttcgctgcttctgttatgaacgctgttattttaacggcagtactatctgctggtaactctggtatgtatgcatcaactcgtatgctttgggatttagctcgccaagggaaagcaccaaagtttcttggtaaattagatagccgcggcgtacctgttaacgcattaatcgtaacatcgattgtcggtagtatcgcttttattgcttctttattcggtgacggtgttgtatacatttggttattaaatgcatcaggaatgtctggctttatcgcatgggttggaatcgcaattagtcattaccgttttcgtaaagcatatatcgcacaaggaaaagatttaaatgacttaccttatagagcaaaatggttcccattcggaccaatcttcgcatttgcactttgcgtcatcgtaattttaggtcaaaactacggcgcatttatgggcgaatcaatcgattggaacggcgtactcgtttcttacatcggtttaccactcttcttagtactttggttaggatacaaatttacgaaaaaaacaaaagtcattccacttgataaatgtgaactgaaataa

SEQ ID NO: 17250 - protein, 488 aa, Bacillus thuringiensis serovar konkukian str. 97-27
MNSATNQATSKTEATKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 17251 - DNA, 1455 bp, Staphylococcus aureus subsp. aureus MRSA252
  CDS (1)..(1455): transl_table=11
atggaagataataaaatgaaccgtagtcttaactcaagacacatttccatgattgctataggtggtgcaattgggactggtctatttgtagctactggtaatatcatttctcaagctggtcctggaggcgctatactcgcttatcttgttattggtgtcatgctatatttcttaatggcatcaattggagagttggcaacattttatccagtatcaggttcattcagctcttattcaacacgctttattgactcatctctaggctttaccatgggatggttgtattgggcattgtggtcattagttacaagtgttgatgtcatagtagcgtcaaatgtgctttatttctgggacacatttaaatttttccaccccattacttggagcttaatctttattacaattttactattattaaacattttttctgtaaaatcatttggagaaactgagttttggttatcattaattaaagtgttaacaatcatcgtattcgttatttttggctttttaatgattttcggtatcttaggtggtcatgcatatggatttgaaaactatacaaaaggccaagcaccgtttgttggtggtatctctggtttcctaggcgtattattagtcgctggattctcagttggtggtactgaagtagtagcagtaactgctggcgaatcagatgatcctaaaaagtctatgcctaaagcaattaaacaagtgttttggcgtattcttttattctatgtattatcaattgcagtcattggtgcaattattccgtacacagatccatcattattaagagcaagtagttcaataagtcaaagcccatttacaattgtattcgatagagtaggcatagcctttgcagcatcagtaatcaatgcggttattttaacttcactattatccgctgcaaattcaggtgtttatacaacaggcagaatgttgtattccttaagttcagacaaaaaagcacctaaatttttaagtaaattaaacaagacaacaaaattaccattaagagcattattaactacatatgcagtcgttgttattgttattatttatgcaaactttaattcaaatgccgtttttaatttacttgaaattattggttcaatgattatagttgtttggggatcaagcatttggtcacaaatacgattgcgacaagctattaaaaaacaaggtcaagatcctaataaggtcctaccatataaagcacctttttatccattaggaccaatcattgtcatcgctacgctattattcttgctatttggtggttcagttgaatatattttaaaagatcaatggttaaatgcttttaaaaactttttacctttaatcattctagcgttgatttactttattcataaaatcattcacaaaacaaaatttgtaaagctagaaacaattaatttaaaaccacacgattatgacaatcaaaaataa

SEQ ID NO: 17252 - protein, 484 aa, Staphylococcus aureus subsp. aureus MRSA252
MEDNKMNRSLNSRHISMIAIGGAIGTGLFVATGNIISQAGPGGAILAYLVIGVMLYFLMASIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHAYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPKFLSKLNKTTKLPLRALLTTYAVVVIVIIYANFNSNAVFNLLEIIGSMIIVVWGSSIWSQIRLRQAIKKQGQDPNKVLPYKAPFYPLGPIIVIATLLFLLFGGSVEYILKDQWLNAFKNFLPLIILALIYFIHKIIHKTKFVKLETINLKPHDYDNQK

SEQ ID NO: 17253 - DNA, 1494 bp, Staphylococcus aureus subsp. aureus MRSA252
  CDS (1)..(1494): transl_table=11
atgtcaaaagttcaaaatgaaagtaacaatgttgtcaaaaggggacttaaagatcgtcatatttctatgattgcgattgggggttgtattggtacaggtttatttgtaacttctggtggagcaattcatgatgcaggtgctttgggtgcattaataggatacgcaattatcggaataatggtatttttcttaatgacgtcacttggcgaaatggctacttatttgccagtatcaggctcatttagtacatatgctacaagatttgttgatccatctttagggtttgcgcttggttggaactattggtttaactgggtagtaactgtagcagcagatattacgattgcagcacaagtcattcaatattggacaccattacaaggcataccagcttgggcatggagtgcgttgttcttagttataatttttagtctgaattcgttatcggttcgcgtctatggtgaaagtgaatactggttggcattgataaaagtggttacagttattgttttcattgcaattggtttattaacgattgtcggaatcatgggtggtcatgttgtaggattcgaaatatttaataaaggtgaaggtcctattcttggtggaaatctaggcggaagtttattatctattttaggtgtattcttaattgctggtttttcattccaaggtacagagttaataggtattacagctggggaatcagaaaatcctgaacgtgctgtgccgaaagcgattaaacaagtattctggagaattttattattttacattttagccatttttgttatcggtatgttaattccttatgatagtagtgcattaatgggaggcggtaatgacgttgcaacctctccgttcacgctagtttttaaaaatgcaggatttgcttttgcagcctcatttatgaatgctgttatcttaacatcagttttatcagcaggtaactctggaatgtatgcctcaacgcgtatgctttattcaatgagtaaagataaattggcgtttgaaacatttgggaaaacaaataaaaatggtgtgccatatatgtctttattagtaactgcaattattgtagtcatcatatttgtggtacaaagtgttacagaaggtgcttatcaatacatcgttgctgcaagtgggttaactggctttattgcctgggtaggtatcgcagtgagtcattaccgatttagaagggcatttgataaacaaaattatgataaatctaaattgaaatatacagctaaatggtttccgttcggacctatttttgcagctattttatgtattgttgtaatcatcggtcaagatgttgactttattaaaacaggagattttaattttagtcgcttcttaattacgtatatgggaatcccagtatttttagcattctttatttatcataagcttcgatataaaacgaagaaaattccattagaacaagtagatttacgtcaagacgtgtcaatggatgaaataaaaggttaa

SEQ ID NO: 17254 - protein, 497 aa, Staphylococcus aureus subsp. aureus MRSA252
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGGNDVATSPFTLVFKNAGFAFAASFMNAVILTSVLSAGNSGMYASTRMLYSMSKDKLAFETFGKTNKNGVPYMSLLVTAIIVVIIFVVQSVTEGAYQYIVAASGLTGFIAWVGIAVSHYRFRRAFDKQNYDKSKLKYTAKWFPFGPIFAAILCIVVIIGQDVDFIKTGDFNFSRFLITYMGIPVFLAFFIYHKLRYKTKKIPLEQVDLRQDVSMDEIKG

SEQ ID NO: 17255 - DNA, 1455 bp, Staphylococcus aureus subsp. aureus MSSA476
  CDS (1)..(1455): transl_table=11
atggaagataataaaatgaaccgtagtcttaactcaagacacatttccatgattgctataggtggtgcaattgggactggtctatttgtagctactggtaatatcatttctcaagctggtcctggaggcgctatactcgcttatcttgttattggtgtcatgctatatttcttaatgtcatcaattggagagttggcaacattttatccagtatcaggttcattcagctcttattcaacacgctttattgactcatctcttggctttaccatgggatggttgtattgggcattgtggtcattagttacaagtgttgatgtcatagtagcgtcaaatgtgctttatttctgggacacatttaaatttttccaccccattacttggagcttaatctttattacaattttactattattaaacattttttctgtaaaatcatttggagaaactgagttttggttatcattgattaaagtgttaacaattatcgtattcgttatttttggctttttaatgattttcggtatcttaggtggtcatacatatggatttgaaaactatacaaaaggccaagcaccgtttgttggtggtatctctggtttcttaggcgtattattagtcgccggattttcggttggtggtacagaagtagtagcagtaactgctggtgaatcagatgaccctaaaaagtctatgcctaaggcaattaaacaagtattttggcgtattcttttattctatgtcttatcaattgcagtaattggtgcaattattccgtacacagatccatcattattaagagcaagtagttcaataagtcaaagcccatttacaattgtattcgatagagtaggcatagcctttgcagcatcagtaatcaacgcggttattttaacttcattattatccgctgcaaattcaggtgtttatacaacaggcagaatgttgtattccttaagttcagacaaaaaagcaccccaatttttaagtaaattaaacaagacaactaagttacctttaagagcattattaactacttatgcagtcgttgttattgttattatttatgcaaactttaattcaaatgccgtttttaatttacttgaaattattggttcaatgattatagttgtttggggatcaagcatttggtcacaaatacgattgcgacaagctattaaaaaacaaggtcaagaccctaataaggtcctaccatataaagcacctttttatccattaggaccaatcattgtcatcactacactattattcttgctatttggtggctcagttgaatatattttaaaagatcaatggttaaatgcttttaaaaactttttacctttaatcattctagcgttgatttactttattcataaaatcattcacaaaacaaaatttgtaaagctagaaacaattaatttaaaaccacacgattatgacaatcaaaaataa

SEQ ID NO: 17256 - protein, 484 aa, Staphylococcus aureus subsp. aureus MSSA476
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQK

SEQ ID NO: 17257 - DNA, 1494 bp, Staphylococcus aureus subsp. aureus MSSA476
  CDS (1)..(1494): transl_table=11
atgtcaaaagttcaaaatgaaagtaacaatgttgtcaaaaggggacttaaagatcgtcatatttctatgattgcgattgggggttgtattggtacaggtttatttgtaacttctggtggagcaattcatgatgcaggtgctttgggtgcattaataggatacgcaattatcggaataatggtatttttcttaatgacgtcacttggcgaaatggctacgtatttgccagtatcaggttcatttagtacatatgctacaagatttgttgatccatctttagggtttgcgcttggttggaactattggtttaactgggtagtaactgtagcagcagatattacgattgcagcacaagtcattcaatattggacaccattgcaaggcatacccgcttgggcatggagtgcgttgttcttagttataatttttagtctgaattcgttatcagttcgcgtctatggtgaaagtgaatactggttggcattgataaaagtggttacagttattgttttcattgcaattggtttattaacgattgtcggaatcatgggtggtcatgttgtaggattcgaaatatttaataaaggtgaaggtcctattcttggtggcaacttaggaggaagtttattatcaattctaggtgtattcttaatcgctggtttctcattccaaggtactgagttaattggtattacggctggtgaatcagaaaatcctgaacgtgctgtgccgaaagcaattaaacaagtattctggagaattttattattttacattttagccatttttgttatcggtatgttaattccttatgatagtagtgcattaatgggtggtagtgataatgtagcaacgtctccattcacattagtgtttaaaaatgctggatttgcgtttgcagcatcatttatgaatgcagtcattttaacgtctgtgttatcagcaggtaactcaggtatgtatgcttcaactcgaatgctatattcaatgagtaaagataaattagcgtttgaagcatttggtaaaacaaataaaaacggtgtgccatatatgtcgttactcgttacagcaatcattgtagtgataattttcgtattacaaagccttacaaaaggtgcatacgaatatatcgttgcagcaagtggtttaactggttttattgcttgggtaggtatagcagtaagtcattatcgatttagaagagcatttgataaacaaaattatgacaaatctaaattaaaatatactgctaaattattcccattcggaccattatttgctggctttttatgtattgtagtaattattggtcaagatgttgactttattaaaacaggagattttaattttagtcgcttcttaattacgtatatgggaatcccagtatttttagcattctttatttatcataagcttcgatataaaacgaaaaaaattccattagaacaagtagatttacgtcaagacgtgtcaatggatgaaataaaaggttaa

SEQ ID NO: 17258 - protein, 497 aa, Staphylococcus aureus subsp. aureus MSSA476
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 17259 - DNA, 1464 bp, Acinetobacter sp. ADP1
  CDS (1)..(1464): transl_table=11
atgagcgaaaccactcaacctgatcagctccagcgcaagctcggtgctcgtcatcttaatatgattgccattggcggctccattggcacaggtttattccttgcatctggctcaaccatcgcaaatgcgggaccaggcggcgccctgctggcatacgtactcatcggcatcatgatttattttctcatgaccagtctcggtgaactagcgactcataatcccacttcaggggcattttttacgtatggcaatcgttatgtagaagagggattcgggttcgcattaggatggaactactggtataactgggccattactgtggcatttgagctagtggcagtccagtttattatgaaattctggtttccagatattccaggtttttactggagtgctattttcttggtggtgatttttgccatcaatgccatgaccgttaaaggttttggtgaaagtgaattctggttttcaatggtcaaggtcgttgccatcattgcctttattattattggtatggccatgattattaaaatcatgatgaccccaaatatggcaacctttggtaactggacctataaagatgcaccgtttgtaggggggttacaagctatgattggtgtggccatgattgcaggattctcatttcagggaacggaaatggtcggtgttgcggcaggtgagtctaaagatccaaaacgtacaattccgcttgcgattaaacagattttctggcgaattctgctattttatgtggtgtgtattttcatcattgggaccttggtcagctacgatgacccgcgtctacttcaagctgcacatagctcagatattgccttgtcaccttttaccctgctgtatgaaaaagcgggctttgcctttgctgcaagcctgatgaatgcggtgattttaacggcgattttatcggctggaaactcaggcatgtactcttctacccgtatgctttgggatatggcaaaagaaggacgtgcacctaaatggtttgcaaagcttgaccgtcgtggcgtgcccatgaacgccctatatgcaacaactgcaattgcagcactctgctttttaactacatttattggtgaacaggaagtctttaactggctactgaatatgtctgggatgtgtggttttattgtttggctagggattgcgatttcacattatcgcttccgcaaaggttatatcgcccaaggttataaacttgaagatctcgcctatcgagccaaattttttccttttgcaccctggtttgcctttattttatgttcgattattattctgggacaaaattatcaggcgatattaggcggtaaaatagactggactggattgttatccacctatatcagtattccactctttttaatcatttggcttggttataaatggaaatataaaaccaagctcattccttatcaagaaatgaatgtgaaagcaggtaaagaagattga

SEQ ID NO: 17260 - protein, 487 aa, Acinetobacter sp. ADP1
MSETTQPDQLQRKLGARHLNMIAIGGSIGTGLFLASGSTIANAGPGGALLAYVLIGIMIYFLMTSLGELATHNPTSGAFFTYGNRYVEEGFGFALGWNYWYNWAITVAFELVAVQFIMKFWFPDIPGFYWSAIFLVVIFAINAMTVKGFGESEFWFSMVKVVAIIAFIIIGMAMIIKIMMTPNMATFGNWTYKDAPFVGGLQAMIGVAMIAGFSFQGTEMVGVAAGESKDPKRTIPLAIKQIFWRILLFYVVCIFIIGTLVSYDDPRLLQAAHSSDIALSPFTLLYEKAGFAFAASLMNAVILTAILSAGNSGMYSSTRMLWDMAKEGRAPKWFAKLDRRGVPMNALYATTAIAALCFLTTFIGEQEVFNWLLNMSGMCGFIVWLGIAISHYRFRKGYIAQGYKLEDLAYRAKFFPFAPWFAFILCSIIILGQNYQAILGGKIDWTGLLSTYISIPLFLIIWLGYKWKYKTKLIPYQEMNVKAGKED

SEQ ID NO: 17261 - DNA, 1392 bp, Acinetobacter sp. ADP1
  CDS (1)..(1392): transl_table=11
gtgctcgatagtgctgcacccttaaaacgagccatgagtacccgtcatttggttatgctgtcattaggcggtgcgattggtacagggttgtttcttggttcaggggaagtcattacccagacagggccgattggagcagtgattgcctatatgcttggcggtttgattgcatatatggtgatgttatgtctgggtgaactggccgtacacatgcctgtatcaggatctttcggcgcttatgccaaaaaatacatcgggccaggcacaggctacatgatttcatgggtttactggctcacatggacagcaacgctgggtaccgaatttacagccgctgcattactcatgcaggaatggtttcctcatacatcgatgtggatctggactattatttttgccttgactatttttgggctaaatttaagttccacacatatttttgccgaatcagaattctggttatcattggttaaagtcctcactgtcattagctttattattcttggactattggctattttcgggattattcattttgagggacatgcctccgcaccactgtttagcaatctgaccagtcacggctggtttccacagggtttgatgccaatttttgcaacaatgctgattgtaaattttgcattttctggaactgaactaattggtgtggcagcaggcgaaaccaaagatccttctatcaatgtaccaaaagccatcaatgctgccatctggcgtctgctgatctttttcgttggaaccattgttgttataagtgctttattgccctatgatcagactggcctcggcggtcataacgtcagtaatagcccgtttgtaactgtgtttcaatatattggtattccctatgcagatcatattattcgctttgtgattattaccgcactcctgtcagcagcaaactctggtttgtatgccgcatcacgcatgatgtggtctttatcaaatcaacgccagcttccttctgtcttttcaaagctaacggccagtggcacccccattattgccttagtggttaccatgtttggcgcaattcctggcttactctcggagcaatttgcacctgaaacgatttttaagaatcttttgggcgtggctgcatttaccatggtgattgtatggatgagcatctgcttaagtcagtttaatttcagacggcactggtataaacaaggctatcacgccaaagacttaaaattcgcagctcccctgtttccaattttacccattttaggcttcttgttttgtttgattactggactaagtatggcgaaagatccagaaatgttgcctggttttattggatgcttaatttttgtagcgtgttgctatttgagccactacatattttatcgggaaaaaagcaagctgtga

SEQ ID NO: 17262 - protein, 463 aa, Acinetobacter sp. ADP1
MLDSAAPLKRAMSTRHLVMLSLGGAIGTGLFLGSGEVITQTGPIGAVIAYMLGGLIAYMVMLCLGELAVHMPVSGSFGAYAKKYIGPGTGYMISWVYWLTWTATLGTEFTAAALLMQEWFPHTSMWIWTIIFALTIFGLNLSSTHIFAESEFWLSLVKVLTVISFIILGLLAIFGIIHFEGHASAPLFSNLTSHGWFPQGLMPIFATMLIVNFAFSGTELIGVAAGETKDPSINVPKAINAAIWRLLIFFVGTIVVISALLPYDQTGLGGHNVSNSPFVTVFQYIGIPYADHIIRFVIITALLSAANSGLYAASRMMWSLSNQRQLPSVFSKLTASGTPIIALVVTMFGAIPGLLSEQFAPETIFKNLLGVAAFTMVIVWMSICLSQFNFRRHWYKQGYHAKDLKFAAPLFPILPILGFLFCLITGLSMAKDPEMLPGFIGCLIFVACCYLSHYIFYREKSKL

SEQ ID NO: 17263 - DNA, 1476 bp, Erwinia carotovora subsp. atroseptica SCRI1043
  CDS (1)..(1476): transl_table=11
atggctcagcacgatattcaacaaactacacagggcgcaccgaccctgcgccgtgaactgaaagcgcggcatttaacgatgatcgccattggcggatcgattggtactggattatttgtcgcttctggtgcgacggtttcacaagcgggtcctggtggtgcactcctgtcttatgccctgattgggctgatggtttacttcctgatgacgagcctaggcgaactggcggcattcatgccagtttctggttcattttctacctacggatctcgctatgttgaggaaggtttcggcttcgcattgggctggaactattggtacaactgggcggtgaccattgcggtcgatctggtcgctgcgcaactggtgatgggatattggttccctgaagtctccggttggatctggagcgctttgtttctggcgctgatgttcctgcttaattacatttctgtgaaagggtttggcgaagccgagtattggttctcactgattaaagtgacgacggtcattattttcattgctgtgggtgtgatgatgattacgggcatcatgagcggtgcggaaaatgctggattccacaactgggagattggcgatgcaccgtttgctggtggcttctccgccatgatcggcgtggcgatgatcgtgggtttttctttccagggaacggaattgatcggtgtggctgctggggagtcccaggaaccgagcaaaaacattccgcgtgccatccgtcaggttttctggcgtatcctgctgttttacatcttcgcgattctgattattagcttaatcattccgtataccgatccgaacctgctgcgtaatgatgtgaaagacattacggtgagtccgttcacgctggtgtttgagaatgcgggtctgttgtctgccgctgcggtcatgaatgcggtcatcttgacggcggtgttgtcggcgggtaactccgggatgtacgcctctacacgtatgctgtttacgctggcatcggaaggtaaagcgccgcgtattttcgctaagctgtcaaaaggtggtgtgccacgtaatgcgctgtatgcaacaaccgtggtggctgcgctgtgtttcctgtcttctctgtatggtaaccaaacggtttatctgtggttgttgaatacctcgggtatgaccggctttattgcctggctagggatcgcgatcagccattaccgtttccgtcgcggctatgttatgcaaggccacgatctgaaccgtctgccttatcagtcgcgtttcttcccgttagggccaatcttcgcgtttgtgctctgcctgatcatcacactggggcagaattatcaggcgtttctgcaagacaacatcgactggtatgccgtcacggcaacgtacatcggcattcctttgttcctgctgatttggttcggctataagctgtatcgtggaacgggcttcatcaagtatcaggatatgacgttcccggatcataaagactaa

SEQ ID NO: 17264 - protein, 491 aa, Erwinia carotovora subsp. atroseptica SCRI1043
MAQHDIQQTTQGAPTLRRELKARHLTMIAIGGSIGTGLFVASGATVSQAGPGGALLSYALIGLMVYFLMTSLGELAAFMPVSGSFSTYGSRYVEEGFGFALGWNYWYNWAVTIAVDLVAAQLVMGYWFPEVSGWIWSALFLALMFLLNYISVKGFGEAEYWFSLIKVTTVIIFIAVGVMMITGIMSGAENAGFHNWEIGDAPFAGGFSAMIGVAMIVGFSFQGTELIGVAAGESQEPSKNIPRAIRQVFWRILLFYIFAILIISLIIPYTDPNLLRNDVKDITVSPFTLVFENAGLLSAAAVMNAVILTAVLSAGNSGMYASTRMLFTLASEGKAPRIFAKLSKGGVPRNALYATTVVAALCFLSSLYGNQTVYLWLLNTSGMTGFIAWLGIAISHYRFRRGYVMQGHDLNRLPYQSRFFPLGPIFAFVLCLIITLGQNYQAFLQDNIDWYAVTATYIGIPLFLLIWFGYKLYRGTGFIKYQDMTFPDHKD

SEQ ID NO: 17265 - DNA, 1413 bp, Erwinia carotovora subsp. atroseptica SCRI1043
  CDS (1)..(1413): transl_table=11
atggaacaacacgcatctggctcggaagggcagtttaagcgcaccatgaaagctcgccatttggtgatgctttcgctcggcggcgtcatcggtaccggcctgtttttcaatacgggctacattatttccacgacgggtgctgccgggacgctgttggcgtatctgatcggtgcgttggtggtgtacttggtgatgcttagcctgggtgagctgtctgtcgcgatgccggaaactggggcgttccatgtgtacgcatcccgttatcttagcccggcaacgggctataccgtggcgtggttgtattggctgacgtggacggtcgcgctcggttccagcctcactgccgctggtttttgcatgcagtactggttcccgcaggtgccagtctggacctggtgcctgctgttttgtgcgctgatctatctgctgaatgtcgtctcgtcccgcttctttgccgaaggagaattctggttctcgattgttaaagtggttacgattcttgcctttattgtgctcggtgcgggcgcgatgtttggttttattccgatgcaggacggttctcccgcgccgttcttccagaacattaccgcttctggctggctcccacacggcggcctgccgatattgatgacgatggtggcggtgaatttcgctttctctggtacagagctgatcggcatcgcggcaggagaaaccgagaatccgcagaaggttgtaccgatggcgattcgcacgaccgtcgcgcggttggtgatcttcttccttggtacggtgctggtgctagccgccatcatcccgatggaagaggccggtatcgccaaaagtccgtttgtgctggtgtttgaaaaaattggtattccttacgccgcagacatttttaacttcgtgatcttgacggcgattctgtcggccgcgaactcagggctgtatgcttcgggacgtatgctgtggtcgctgtctaacgaaggcacgttgccgcgtcgtttttctcgcctgacgcgccgtggtattccgctctttgctatttccgtcagtatgcttggcgggctgttggcgctgttttccagcgtggtcgcgcccgataccgtctacgtagcgttgtccgcgatttccggctttgccgtggtggcggtgtggttgagtatctgcgcctcgcactatatgttccgccgtcatcatattcgctctggaaaatcactttccgagctgcaatatcgtgcgccctggttcccgataacgccgattcttggcttcctgttgtgcctgcttgcctgcgtcgggctggtgtttgatccaagccagcggattgcactgtggtgtggcattccgtttgtcgcattgtgttacggtgcttattatttcacgcaatcggtgaagaaacgtggattaacgggagtagaagacattgcgtaa

SEQ ID NO: 17266 - protein, 470 aa, Erwinia carotovora subsp. atroseptica SCRI1043
MEQHASGSEGQFKRTMKARHLVMLSLGGVIGTGLFFNTGYIISTTGAAGTLLAYLIGALVVYLVMLSLGELSVAMPETGAFHVYASRYLSPATGYTVAWLYWLTWTVALGSSLTAAGFCMQYWFPQVPVWTWCLLFCALIYLLNVVSSRFFAEGEFWFSIVKVVTILAFIVLGAGAMFGFIPMQDGSPAPFFQNITASGWLPHGGLPILMTMVAVNFAFSGTELIGIAAGETENPQKVVPMAIRTTVARLVIFFLGTVLVLAAIIPMEEAGIAKSPFVLVFEKIGIPYAADIFNFVILTAILSAANSGLYASGRMLWSLSNEGTLPRRFSRLTRRGIPLFAISVSMLGGLLALFSSVVAPDTVYVALSAISGFAVVAVWLSICASHYMFRRHHIRSGKSLSELQYRAPWFPITPILGFLLCLLACVGLVFDPSQRIALWCGIPFVALCYGAYYFTQSVKKRGLTGVEDIA

SEQ ID NO: 17267 - DNA, 1425 bp, Propionibacterium acnes KPA171202
  CDS (1)..(1425): transl_table=11
atggacggcgaattgaagcgcgggctctcctcgcggcacatgaacatgatcgcaatcggcggggccattggtactggcctgttcgtggcatctggtgccaccatctcccaagctgggccgggtggagctctggttgcctacttcgctatggggcttatggtcttcttgcttatgcagtctctcggcgagatgagctcctatctcccggtgccaggcgcattcgaaacctatgccaccagattcgtctcgccttcctttggcttcgcattggggtggaattactggttcaactgggccatcacggtcgctgctgaattagctgctgcctccatcgttatggcctactggtggcccggtgtaccggcctggatgtggtcggtcggattcctggcgttgctcttcctcctgaacgtcttgtctgcccgcgcgtatggtgagagcgagttctggttcgccatcatcaaggtgacggcagttatcgtcttcctggtgcttgggatcctcatgatcgccggcgtgatggggacatctcctggtctatctcattggcgtcgcggtgacgcgcccttcgttcacgggttcggtggcatcctgactgtctttcttattgctggattctccttccagggcaccgagctcatcggcattgctgcaggagaatcgaaagacccccgaatgacgatccccaaggccactcgtcagattttctggcggatcatgatcttctacatcggtgccatcgccgttatcggtttgttgctgccttatactgacccgcacctgcttgcgggcgaggtcaccgatgttgctgtcagcccgtttacgttggtcctaaagcgggccggtgttgctgctgcggcggctgtcatgaatgcggtcatccttacctcggtgctttcggctggtaactctggtctttatgcgtccacccgaatgctttacgccctagcgcgtgagggcaaagctcctcgcatccttggccgtactagtcgacgaggtgtcccggtgccggctcttatcgtcactactcttgtcggcgcggcctgttttgctacatctctggtggggtcaggccaggcatacacctggttggtcaatatctctggtctgtgtggattcatcgcatggatcggtattgcgatatgccatatccagttccggcgcgcctttcaggctcaggggcacgacctgtccgagttgccgtatcgggcgcgctggtatcctgccggtcctatcgtcgccggggtgttgtgcgtcatcgttactctcggccagggacgtgacgcagttctcagcggtgatgtcaccgacatgatcgtcgcttacatcagcattccggtattcctggcgttgtgggtcggtcacaagattgtcaccaaggcgcctcatgccgacctttcaacggccgatcttcatcacgactga

SEQ ID NO: 17268 - protein, 474 aa, Propionibacterium acnes KPA171202
MDGELKRGLSSRHMNMIAIGGAIGTGLFVASGATISQAGPGGALVAYFAMGLMVFLLMQSLGEMSSYLPVPGAFETYATRFVSPSFGFALGWNYWFNWAITVAAELAAASIVMAYWWPGVPAWMWSVGFLALLFLLNVLSARAYGESEFWFAIIKVTAVIVFLVLGILMIAGVMGTSPGLSHWRRGDAPFVHGFGGILTVFLIAGFSFQGTELIGIAAGESKDPRMTIPKATRQIFWRIMIFYIGAIAVIGLLLPYTDPHLLAGEVTDVAVSPFTLVLKRAGVAAAAAVMNAVILTSVLSAGNSGLYASTRMLYALAREGKAPRILGRTSRRGVPVPALIVTTLVGAACFATSLVGSGQAYTWLVNISGLCGFIAWIGIAICHIQFRRAFQAQGHDLSELPYRARWYPAGPIVAGVLCVIVTLGQGRDAVLSGDVTDMIVAYISIPVFLALWVGHKIVTKAPHADLSTADLHHD

SEQ ID NO: 17269 - DNA, 1512 bp, Yersinia pseudotuberculosis IP 32953
  CDS (1)..(1512): transl_table=11
atgactcagcaaaatactaaaatcccagcgcagcagggtgcacagcgcttacgccgggagcttaaatcgcggcatttagccatgattgctatcggtggttctattggtaccggtttatttgttgcctctggtgcaacggtatcgcaagccggtccagggggggcattgctctcctacgcattgattggcttgatggtttacttcctgatgaccagcttgggagaattggctgcgttcatgccagtttcaggctcattctctacttatggttctaaatatgtcgaggaaggctttggctttgccctaggttggaactactggtacaactgggcggtaaccatcgcagttgacttggtagccgcacagttagtgatgaactactggttcccggacgcgcccggttggatctggagtgctttattcctgggcctgatgttcttactgaactacatctcagtgaaaggtttcggtgaagcggaatattggttctcgctgattaaagtgacaaccgtggttatcttcatcatcgttggtgtcatgatgatcaccggtatcatgaaagggggcgaaacggcgggttggcataactggactatcggtgatgcaccatttgctggtggtttctctgccatgattggggtggccatgatcgtcggcttctctttccaggggactgaattgattggtattgcggctggggaatccaaagatccaggcaaaaatattccaaaggcaattcgcaaagtgttctggcgtattctgttgttctatatcttcgctattctgattattagcctgattattccttataccgatcccagtttgttacgcaacgatgtgaaagatatcagcgtcagcccgttcacactggtattccagaatgcgggtctgttatcagcagcggcagtgatgaatgcggttattttgaccgctgttttatcggcgggtaactcggggatgtatgcctcgacccgtatgctgtttaccttagcctctgaaggcaaagcaccgcgtattttcgccaagttatctaagggcggtgtccctcgtaatgcgctgtatgccacgacagtcgttgcaggtttgtgcttcctgagctccatgtttggtaaccaaactgtgtatttgtggttactgaatacctcggggatgactgggtttatcgcctggttgggtattgccatcagccactaccgcttccgtcggggctatatgatgcagggccgtgacttgaacgacttaccgtatcagtctggtttcttccctctggggccaatttttgccttcgtcctgtgtctaatcatcacgttaggccagaattatcaggcattcctgcaagaccgtattgattggtatggcgtgacggcaacctatattggtattccattgttcctggtgatttggtttggctataagctcagccgtggtacccgggtagtgaaataccaagagatggaattcccaaaatggcgtgatgagagtgaagagcatcagaaaccgacaagtcggtga

SEQ ID NO: 17270 - protein, 503 aa, Yersinia pseudotuberculosis IP 32953
MTQQNTKIPAQQGAQRLRRELKSRHLAMIAIGGSIGTGLFVASGATVSQAGPGGALLSYALIGLMVYFLMTSLGELAAFMPVSGSFSTYGSKYVEEGFGFALGWNYWYNWAVTIAVDLVAAQLVMNYWFPDAPGWIWSALFLGLMFLLNYISVKGFGEAEYWFSLIKVTTVVIFIIVGVMMITGIMKGGETAGWHNWTIGDAPFAGGFSAMIGVAMIVGFSFQGTELIGIAAGESKDPGKNIPKAIRKVFWRILLFYIFAILIISLIIPYTDPSLLRNDVKDISVSPFTLVFQNAGLLSAAAVMNAVILTAVLSAGNSGMYASTRMLFTLASEGKAPRIFAKLSKGGVPRNALYATTVVAGLCFLSSMFGNQTVYLWLLNTSGMTGFIAWLGIAISHYRFRRGYMMQGRDLNDLPYQSGFFPLGPIFAFVLCLIITLGQNYQAFLQDRIDWYGVTATYIGIPLFLVIWFGYKLSRGTRVVKYQEMEFPKWRDESEEHQKPTSR

SEQ ID NO: 17271 - DNA, 1455 bp, Bacillus licheniformis ATCC 14580
  CDS (1)..(1455): transl_table=11
atggaacagtcaaacaccaatcgccagaactttcaaagaaaaatgcaaacgagacaccttatcatgctttccttaggaggcgttatcggcacgggccttttcttaagttccggttatacgatctcacaggctggtcctgccggaacgattctagcctacttggccggggctctgatcgtctaccttgtcatgctctgcctcggcgaattatcggtcgccatgcctgtcaccggatcgtttcatatgtacgcctccagattcatcgggccgggcaccggattcaccgtcgcctggctatactggctgacctgggctgtcgcgctcggttcggaatttaccgctgccgggttattaatgcagcgctggttccccgatacttcagtctggatgtggagcgcggtattcgctgcactgattttcgcgctcaatgctgtctcagtgagatttttcgccgaatccgaattttggttttcaagcattaaagtgcttgccattatattgtttattatattaggaggagcggcgatattcggcatcatcccgatacaaaatgcagacgctgcaccgcttctttcaaactttgcaggagaaggcggtctctttccaaacggcttccttccaatttttatggcgatgctctccgtgaattttgcgttttcgggtacggagctgatcggaattgccgccggagaaagcgccgaaccggaaaagaacattccaaaagcgatcaagacaacactctggagactggtgcttttcttcatcggaacgattttcgtgctttcgtgcctcattccggttaaagaagccggtgtgatcaaaagcccatttgtcgacgtctttgaccgcatcggtgttccatatgcggccgacatcatgaactttgtaattctgacggctctgctttccgcggccaactcaggcttgtatgcatgctcccggatgctctggtcactgtcaaaagaaaaaactttgcaccccgtatttcaaaagctgacttcacggggaatcccgttgaacgcgctgatcttcagcatgctcggcggcattctgtcgctgctctccagcgtgtttgcgcctgattccgtctacatcgttcttgtgtcgatttcagggtttgccgttgttgctgtctggatgagcattgcggcttcgcagttcatgttccgcagacgctttttggctgagggaaacaccgcagacgacttaaaataccggacaccgctttatccggccgtaccgattgccgcttttctgctatgcctggcatcctgcattggcattgcctttgatccgaaccaaaggatcgcccttttttgcggtgtgccgtttatggcgttatgctataccatctattatgcaacaaaccgaaaaaatagctggaatccgtctgagcccgttaagaatgcaagtttgcatgtttcattttctgaatacgaggaaaagaaaaactaa

SEQ ID NO: 17272 - protein, 484 aa, Bacillus licheniformis ATCC 14580
MEQSNTNRQNFQRKMQTRHLIMLSLGGVIGTGLFLSSGYTISQAGPAGTILAYLAGALIVYLVMLCLGELSVAMPVTGSFHMYASRFIGPGTGFTVAWLYWLTWAVALGSEFTAAGLLMQRWFPDTSVWMWSAVFAALIFALNAVSVRFFAESEFWFSSIKVLAIILFIILGGAAIFGIIPIQNADAAPLLSNFAGEGGLFPNGFLPIFMAMLSVNFAFSGTELIGIAAGESAEPEKNIPKAIKTTLWRLVLFFIGTIFVLSCLIPVKEAGVIKSPFVDVFDRIGVPYAADIMNFVILTALLSAANSGLYACSRMLWSLSKEKTLHPVFQKLTSRGIPLNALIFSMLGGILSLLSSVFAPDSVYIVLVSISGFAVVAVWMSIAASQFMFRRRFLAEGNTADDLKYRTPLYPAVPIAAFLLCLASCIGIAFDPNQRIALFCGVPFMALCYTIYYATNRKNSWNPSEPVKNASLHVSFSEYEEKKN

SEQ ID NO: 17273 - DNA, 1446 bp, Bacillus licheniformis ATCC 14580
  CDS (1)..(1446): transl_table=11
ttgaatcatgaaaaccgtgaacaatatacactgaaacgaacgatgaaatcccgccatttgtttatgatctcgcttggcggcgtcatcggaaccggcttttttctcggaacaggttatacgattaatgaagccggaccgatcggcgcgattctttcctatttagcgggcggaatgatcatgtattttacgatgctctgccttggggagctcgctgtggcaatgccggtttcaggctcttttcagacgtacgcgacaaaatttatcgggcctgctacagggtttgccgtcggctggatctattggctcggctggtcggttactgttgctttggaatttttgtcagcggggcagctgatgaaaagatggtttcccgatgtcggcgtctggatatggtgcttgattttcgggctgctgcttttttcactcaatgctttatcggcaaaggctttcggggaatcggaattttggctgtccggcatcaaaattatcgtcattcttctgtttattattctcggcggaggcgcgatgttcggactcatcgacttgaaagacggacaggctgcaccgttcttttccaatctgattggagacggaatttttccaaacggattcggcgcgatctttatcacgatgatcaccgtcaactttgcctttcaggggacggagctgatcgggatcgcggcgggggaaagcgaaaatccggaaaaaacggtgccccgctccatcaaacagacggtctggcggacactggtgtttttcggcctgtccgtatttgtactggcgggattgattccatgggaaaaagcgggggttgttgaaagtccgttcgttgtggtatttgaacaaatcggcattccgtatgccgccgatctgatgaactttgttattttaattgctttgttatcggtggcgaattcgggcttgtacgcatcgacgaggatgctttattccctggcgaaagagggaatggccgctcaggctttaagccgggtcaataaaagaggtattccgatgaatgcgctttggatcacgctcggttttgcgggtttgtccctcatctcaagcgtagtcgcagcagaaacgctctacatttggcttttgtctctagccggtttaagcgcgcaagtcggctggatcacgattacggtatcacagctgctatttcgcagacgatatgtcaaagaaggcggaaaggttgaagacttaaaatttaaaacgcctctttatccttatttgccgctgacgggatttattttaaacagcgccgtccttgtgagcctcgcttttgattcagagcagaggatggcattgtactgcgggattttattcatgtcggcctgctactttgtttatcacgtgtttgtgaaaaaacgccaggctcttgatcgacaagaagcaatgatctatcaaaacaaaacaaacgatgaggtggttattgatgaataa

SEQ ID NO: 17274 - protein, 481 aa, Bacillus licheniformis ATCC 14580
MNHENREQYTLKRTMKSRHLFMISLGGVIGTGFFLGTGYTINEAGPIGAILSYLAGGMIMYFTMLCLGELAVAMPVSGSFQTYATKFIGPATGFAVGWIYWLGWSVTVALEFLSAGQLMKRWFPDVGVWIWCLIFGLLLFSLNALSAKAFGESEFWLSGIKIIVILLFIILGGGAMFGLIDLKDGQAAPFFSNLIGDGIFPNGFGAIFITMITVNFAFQGTELIGIAAGESENPEKTVPRSIKQTVWRTLVFFGLSVFVLAGLIPWEKAGVVESPFVVVFEQIGIPYAADLMNFVILIALLSVANSGLYASTRMLYSLAKEGMAAQALSRVNKRGIPMNALWITLGFAGLSLISSVVAAETLYIWLLSLAGLSAQVGWITITVSQLLFRRRYVKEGGKVEDLKFKTPLYPYLPLTGFILNSAVLVSLAFDSEQRMALYCGILFMSACYFVYHVFVKKRQALDRQEAMIYQNKTNDEVVIDE

SEQ ID NO: 17275 - DNA, 1422 bp, Bacillus cereus E33L
  CDS (1)..(1422): transl_table=11
atgatggatcaaaataaaggattaaaacgggaattgaaaagcaggcacatatttatgattgcacttggaggagttattggtaccggtctttttttaggatctgggtatacaattcatgaagctgggcctggaggagcgattgtagcgtatcttgtcggaggatttgttatgtatttaacgatgctctgtcttggagagttagctgttgcaatgcctgacgcaggatcttatcaaacatatgctacgaagcatatttcccctgcagcgggttatgtagtcggatggatgtcgtggttaaactggtcggctacaataggtattgaactaattgcagttagtattttaatgaaacgatggtttcctgatgtaccgtcttggatttggtgcgtagtgtttgcggtactactttttgctattaacgcgttatcttcaagaagttttgcagaagttgaattttggtttgcaagtattaaagtcattacaatcattgcatttattattttgggcggggcagcaatgtttggttttctagatatgaaaggaaatgaaccagcaccaatgttttctagctttactgattatggtgggttgtttccaaatggattatccgctattttaattacgatgattgcagttaatttttccttccaaggaacggaactagtcggtattgcagcaggtgagagtgaaaatccagagaaaacgatcccgaaggcaattaataatacagtttggcgtatactcgtgttctttgtattatctattttcattcttgcaggattattcccttggcaacaggcgggagtaatagaaagtccattcgtagttgtatttgataaaattggtattccttatgcagccgatattatcaatttcgttattattacagcggttctatccgttgcgaattcaggattatatgcaacttctcgtatgctatggtctatgtctaatcaaggaatgattagtccgatttttggtaagttatctaaaaatggtgttcctatttatgcattgattgtaagtacaattgtaggttgcctttcattactatcaggtatttatgcggaagatacagtttatttatggctactttctattgccgggttcggagcgatattagtttgggcatctattgctctatctaacttattagctagaaggtcatacataaagcggggcggggatgtgaaagacttgaaatttaaaacaccactgtatccattcgtaccgctgcttgcgttagtattaaatgtaaccgtaattgttggtatggcctttattccagaacaaagaatggcattgtattgtggaattccatttatgattgtttgcttactgttttaccgtgcgacaagaaataaggcacataaagtagaacatattgaaaagacagatacaacagaagtagaaagtttataa

SEQ ID NO: 17276 - protein, 473 aa, Bacillus cereus E33L
MMDQNKGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKRGGDVKDLKFKTPLYPFVPLLALVLNVTVIVGMAFIPEQRMALYCGIPFMIVCLLFYRATRNKAHKVEHIEKTDTTEVESL

SEQ ID NO: 17277 - DNA, 1422 bp, Bacillus cereus E33L
  CDS (1)..(1422): transl_table=11
atgcagcaaccaacgaatgagaaattacatcgtacgatgaagagtagacatttatttatgatcgcactaggtggtgtaatcgggacaggctttttcttaggttctggttacaccattaatcaggctggaccagggggagccatcctttcctatttagtgggcggatttattatgtatttaacaatgctatgccttggagagctaacggtagcgatgccagtttcaggttctttccaaaagtatgcgacgaagtttattggaccaggaacgggctttatgatcggctggctatattggcttggctgggcagtaacagtaggactagaattaacgtcaatcggtttaatgatgaaaagatggtttccgaatgttgatgtttgggtatggtgcctcgtcttcggcgttattttatatgcgtcaaacgcaatttcggcgaaaagttatgctgaattagaattttggttctctagtattaaagtagttaccattcttgcctttgttgttcttggtggtagtgcattattagggtttatatcatatgacggaaaagaagcagcacctcttttctctaactttgtaagcgatggtggattattcccgaatggactagctgccgtattacttacgatgattacagttaacttctcgttccaaggaacagagttaattgggattgcagcgggagaaagtgaaaatccagaaaaaacaattccacgcgcgatccgtaatacagtatggcgcattatgttattcttcattttaacaatgacgattttagtagggttaatttcttggaaagaagctggcgtaattgaaagtccattcgtagtcgtgtttgataaaatcggtattccgtatgcagctgatattatgaacttcgttattattacagcgttactatctgtagcgaattcaggattatatgcggcaactcgtatactatggtcacttgcaaatgaaggaatggcaccaaagtctttccaaaaagtaaataaacgtggtattccaattacagcgttagttgtaacaattgctgtagctgctttatctttattaacaagcttccttgcagaagatacagtatacatgtacttattatctatagctggtttatcagctgtttcaagttggatcattattgctttatcacaacttcgctttagaagtcagtatataaaaggcggaggaaagttagaggacttaaagtatagaacaccactatacccaatcgtcccaattttagctttaattacaaatagtatcgttgttattagtttagcgtttattccagaacaaagaatggcgttatattgtggtattccatttatcattttctgttatatatattattatataaataagaaacggcagaaaccgatgaaggtggagacaactaatgaaactaacaatcaaacacgatga

SEQ ID NO: 17278 - protein, 473 aa, Bacillus cereus E33L
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVVTILAFVVLGGSALLGFISYDGKEAAPLFSNFVSDGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVETTNETNNQTR

SEQ ID NO: 17279 - DNA, 1425 bp, Bacillus cereus E33L
  CDS (1)..(1425): transl_table=11
atggcgcaagtaaataatacaaacaatgaattaaaacgtacgatgaaaagtagacacttattcatgattgcacttggtggtgtgattggaacggggttatttaacggatctggttttattataagtcaggctggacctggtggatccgtacttgcctttatggccggtggattattaatgtatttcgttatgctatgtcttggtgaactcgctgtagccatgcccgtttcggggtctttccaggaatatgccactaagtttatcaatcctgcaactggctttacaatcggatggttgtattggttaagctgggcgaatacgaccggccttgaatttacaactgccggcattacaatgcagcgctggtttcctgatattcctgtttgggtttggtgtttaatatttggcgttacaatcttcacaattaacgcactatctgctcgtagttatgcagaaacagaattttggttttcaagtataaaagtatctgccattatcgcttttattattcttggcggcgccgctatgttcggtttaattgatttaaaaggcgacgaaccagctccgctattttcaaatttcgtaaatcatggtggtttattcccaaatggacttgcagctattctattaacaatggttacagtcaattattccttccaaggtacagaacttgtcggaatcgcagcaggtgaaagtgaagatccagcaaaaactttacctcgttctattagaaatattatatggcgcacgatgtttttcttcgtcttagcaatctttgttcttgttgctttaattccttgggaagaagcaggattaacaaaaagcccgttcgttgctgtttttgataatatcggtattccatatgcagctgatattatgaactttgttattcttacagctgttctttctgtcgcaaactcaggactttacgcggcaactcgtatgctttggtcattatcaaaaaatgaaatggctccagcctttttaaagaaattatcatcacgaggaatacctctaaacgctttaattatgacaattgctatttctgctttttctcttttaacaagcgttgtagcagctgaaactgtttacttatggttaatttctatttcgggcgtcataacaatcattgtttggatgtcaatttgtgtttctcaattctttttccgtaaacattatgtagcagacggtggaaagttagaagacttaaaatttaaaacgccactttatccacttgtacccatgcttggttttggattgtatggcattattttaatcagtcttatttttatcccagaacaacgacttggaatctattgcactgtaccatttattatcttttgctacacttactatcactttaaagtgaagaaaagaatttctactaacacttctagtgaaaataaaattagcgagactatataa

SEQ ID NO: 17280 - protein, 474 aa, Bacillus cereus E33L
MAQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGLIDLKGDEPAPLFSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYVADGGKLEDLKFKTPLYPLVPMLGFGLYGIILISLIFIPEQRLGIYCTVPFIIFCYTYYHFKVKKRISTNTSSENKISETI

SEQ ID NO: 17281 - DNA, 1563 bp, Burkholderia mallei ATCC 23344
  CDS (1)..(1563): transl_table=11
atgtcaccacacccgaattccgacaactcaaccgcacaatcgaatcctcctcagctgcgccgcagcctgaaagcccgtcacctgacgatgatcgcgatcggcggctcgatcggcacgggcctgttcgtcgcgtccggcgcgtccatctcgcaggcgggccccggcggcgcgatgctcgcctatctgttgatcggcctgatggtctattgcctgatgatgagcttgggcgagatggccgcgttcatgccggtgtcgggctcgttcgcgacgtacggcgcgaaatacgtcgaggaaggcttcggcttcgcgctcggctggaactactggtacaactgggcggtgacgatcgccgtcgagctcgtcgccgcgcagctcgtcatgcattactggtttccggacgtgccgggcgtctggtggagcgcggcgttcctcggcgtgatgttcctgctcaacgtgctgaccgtgcgcggcttcggcgaggccgaatactggttcgcgctcatcaaggtcgtcaccgtgatcgcgttcatcggcgtcggcctgctgatgatcttcggcatcctgaagggcggcccgagcaacggctggagcaacttcacgatcggcgacgcgccgttcgcgggcggcctgcccgcgatgatgggcgtcgcgatgatcgccggcttctcgttccagggcaccgagctgatcggcgtcgcggccggcgaatcggaaaacccgcgcacgacgatcccgcgcgcggtgcgccaggtgttctggcgcatcctgctgttctacgtgctcgcgatcttcgtgatcggcgtgctgattccgtacaccgatccgaatctgctgaagagcgacgtgaccgacgtcggcgtgagcccgtttacgctcgtgttccgtcacgcgggcctcgcgttcgccgcgggcgtgatgaacgcggtgatcctgaccgccgtgctctcggcgggcaactcggggatgtacgcgtcgacgcggatgctccacaacctcgcgaccgaaggccgcgcgccgaagctgttcgcgaagctgtcggcgggcggcgtgccgcgcaacgcgctgtatgcgacgaccgcggtcggcgcgctgtgcttcctgtcgtcgctgtacggcgacaagaccgtgtatctgtggctgctgaacacgtcgggaatgacgggcttcatcgcgtggctcggcatcgcgctcagccactatcgcttccgcaagggctacgtgcgccagggcttctcggtcgaccaactgccgtatcagtcgagcctgtatccgtacggcccgatcttcgcgttcgcgctgtgcatcgtgatcgcgctcggccaggattatcaggcgttcctcgcgaaccggatcgactggatcggcgtgctcgccacctacgtcggcattccgctcttcctcgtcgtgtggctcggctatcggctcgtccacaagacgcgcgtcgtccgctatgaggacatggacatcgcatcgtgggtggccgagcacgagcgcgcggcggcgcacgaggcgcgcgaggcggcggccgtgcgcgtgccgtcgagtcccgaggcggcttcgtaa

SEQ ID NO: 17282 - protein, 520 aa, Burkholderia mallei ATCC 23344
MSPHPNSDNSTAQSNPPQLRRSLKARHLTMIAIGGSIGTGLFVASGASISQAGPGGAMLAYLLIGLMVYCLMMSLGEMAAFMPVSGSFATYGAKYVEEGFGFALGWNYWYNWAVTIAVELVAAQLVMHYWFPDVPGVWWSAAFLGVMFLLNVLTVRGFGEAEYWFALIKVVTVIAFIGVGLLMIFGILKGGPSNGWSNFTIGDAPFAGGLPAMMGVAMIAGFSFQGTELIGVAAGESENPRTTIPRAVRQVFWRILLFYVLAIFVIGVLIPYTDPNLLKSDVTDVGVSPFTLVFRHAGLAFAAGVMNAVILTAVLSAGNSGMYASTRMLHNLATEGRAPKLFAKLSAGGVPRNALYATTAVGALCFLSSLYGDKTVYLWLLNTSGMTGFIAWLGIALSHYRFRKGYVRQGFSVDQLPYQSSLYPYGPIFAFALCIVIALGQDYQAFLANRIDWIGVLATYVGIPLFLVVWLGYRLVHKTRVVRYEDMDIASWVAEHERAAAHEAREAAAVRVPSSPEAAS

SEQ ID NO: 17283 - DNA, 1452 bp, Streptococcus thermophilus LMG 18311
  CDS (1)..(1452): transl_table=11
ttgatagtttcaacctattatccaaagatcttttattgtgataagcttgttttattacatctattggaggaatctatggaaaaccataattatgaaaatgaaggtcagtttcaacggaagatgacctcacgccacctctttatgctctcgctgggtggtgttatcggcactggtcttttcttgagctcgggctatacgattgcacaagcaggtccccttggtgttatcctctcttatcttgtgggagctgttgtcgtttacttggttatgctttcgttgggggagttagcggtagctatgccagtaacgggatcctttcacacctatgccactaagtttatcagtcctggaacaggttttactgtagcctggctttattggatttgttggacggttgccttggggacagaattcctaggtgcggccatgctgatgcaacgctggtttccgtcagttccggcttggatttttgcagccttctttgccttagtaattttggggattaatgctttgagtgtgagatcttttgcggaagcagaatccgtcttctcgtcaatcaaagtcatcgccatctttgttttcatcatactaggtctaggagctatgtttggtttggtgagttttgaaggtcaccatgaagctattatgtttaagcatttgacggccaatggtctctttcccaatggaggtcttgccattgtgtcagttatgttggcggttaattatgccttttcgggaacagaattaatcggtattgcagctggtgaaacagataatcccaaagaggctgttccacgtgctattaaaacaaccattggacgtttggttatcttcttcgtcttgactattgtggtattggcttcgcttcttccaatgaaagaagcaggggtatcctcagcccctttcgttgatgtctttgacaagatggggattccatttgcggcagacattatgaattttgttatcctgacagctattctttcggctgggaattcggggctctatgcttcaagccgtatgctttggtctttggccaatgagggaatgctcaataaaaaactagtgacaatcaataagcatggcgttccaatgacagcccttttgatttccatggctggggcagttttatcgctcttctcaagtatctatgcagcggatacggtttatctagctctagtatcaattgctggttttgcagttgttgttgtttggctttctattcctatggcacagattaatttccgaaaacagtggaagctagaacattccgaagacgaactagactataagacaccgtttaatccaatcctcccttatatcacaattgttctgttggctatttctgtgcttgggattgcttgggatagttcacaacgtgcgggactctatttcggtattcctttcatgattttctgttacctttatcactacctttgctttaacaaatggtaa

SEQ ID NO: 17284 - protein, 483 aa, Streptococcus thermophilus LMG 18311
MIVSTYYPKIFYCDKLVLLHLLEESMENHNYENEGQFQRKMTSRHLFMLSLGGVIGTGLFLSSGYTIAQAGPLGVILSYLVGAVVVYLVMLSLGELAVAMPVTGSFHTYATKFISPGTGFTVAWLYWICWTVALGTEFLGAAMLMQRWFPSVPAWIFAAFFALVILGINALSVRSFAEAESVFSSIKVIAIFVFIILGLGAMFGLVSFEGHHEAIMFKHLTANGLFPNGGLAIVSVMLAVNYAFSGTELIGIAAGETDNPKEAVPRAIKTTIGRLVIFFVLTIVVLASLLPMKEAGVSSAPFVDVFDKMGIPFAADIMNFVILTAILSAGNSGLYASSRMLWSLANEGMLNKKLVTINKHGVPMTALLISMAGAVLSLFSSIYAADTVYLALVSIAGFAVVVVWLSIPMAQINFRKQWKLEHSEDELDYKTPFNPILPYITIVLLAISVLGIAWDSSQRAGLYFGIPFMIFCYLYHYLCFNKW

SEQ ID NO: 17285 - DNA, 1452 bp, Streptococcus thermophilus CNRZ1066
  CDS (1)..(1452): transl_table=11
ttgatagtttcaacctattatccaaagatcttttattgtgataagcttattttattacatctattggaggaatctatgaaaaaccataattatgaaaatgaaggtcagtttcaacggaagatgacctcacgccacctctttatgctctcgctgggtggtgttatcggcactggtcttttcttgagctcgggctatacgattgcacaagcaggtccccttggtgctatcctctcttatcttgtgggagctgttgtcgtttacttggttatgctttcgttgggggagttagcggtagctatgccagtaacgggatcctttcacacctatgccactaagtttatcagtcctggaacaggttttactgtagcctggctttattggatttgttggacggttgccttggggacagaattcctaggtgcggccatgctgatgcaacgctggtttccgtcagttccggcttggatttttgcagccttctttgccttagtaattttggggattaatgctttgagtgtgagatcttttgcggaagcagaatccgtcttctcgtcaatcaaagtcatcgccatcttggttttcatcatactaggtctaggagctatgtttggtttggtgcgttttgaaggtcaccatgaagctattatgtttaagcatttgacggccaatggtctctttcccaatggaggtcttgccattgtgtcagttatgttggcggttaattatgccttttcgggaacagaattaatcggtattgcagctggtgaaacagataatcccaaagaggctgttccacgtgctattaaaacaaccattggacgtttggttatcttcttcgtcttgactattgtggtattggcttcgcttcttccaatgaaagaagcaggggtatcctcagcccctttcgttgatgtctttgacaagatggggattccatttgcggcagacattatgaattttgttatcctgacagctattctttcggctgggaattcggggctctatgcttcaagccgtatgctttggtctttggccaatgagggaatgctcaataaaaaactagtgacaatcaataagcatggcgttccaatgacagcccttttgatttccatggctggggcagttttatcgctcttctcaagtatctatgcagcggatacggtttatctagctctagtatcaattgctggttttgcagttgttgttgtttggctttctattcctatggcacagattaatttccgaaaacagtggaagctagaacattccgaagacgaactggactataagacaccgtttaatccaatcctcccttatatcacaattgttctgttggctatttctgtgcttgggattgcttgggatagttcacaacgtgcgggactctatttcggtattcctttcatgattttctgttacctttatcactacctttgctttaacaaatggtaa

SEQ ID NO: 17286 - protein, 483 aa, Streptococcus thermophilus CNRZ1066
MIVSTYYPKIFYCDKLILLHLLEESMKNHNYENEGQFQRKMTSRHLFMLSLGGVIGTGLFLSSGYTIAQAGPLGAILSYLVGAVVVYLVMLSLGELAVAMPVTGSFHTYATKFISPGTGFTVAWLYWICWTVALGTEFLGAAMLMQRWFPSVPAWIFAAFFALVILGINALSVRSFAEAESVFSSIKVIAILVFIILGLGAMFGLVRFEGHHEAIMFKHLTANGLFPNGGLAIVSVMLAVNYAFSGTELIGIAAGETDNPKEAVPRAIKTTIGRLVIFFVLTIVVLASLLPMKEAGVSSAPFVDVFDKMGIPFAADIMNFVILTAILSAGNSGLYASSRMLWSLANEGMLNKKLVTINKHGVPMTALLISMAGAVLSLFSSIYAADTVYLALVSIAGFAVVVVWLSIPMAQINFRKQWKLEHSEDELDYKTPFNPILPYITIVLLAISVLGIAWDSSQRAGLYFGIPFMIFCYLYHYLCFNKW

SEQ ID NO: 17287 - DNA, 1413 bp, Geobacillus kaustophilus HTA426
  CDS (1)..(1413): transl_table=11
atgcaaccagtgcaagaactgaaacgagagctaaaaagcaggcatttatttatgatcgcgctaggcggagtgatcggcaccggtttgtttttaggatcgggttatacgattcatgaggcggggccaggaggggccgtcgttgcttatctttttggcggattggttatgtatttgaccatgctttcgttaggagaattggccgtgagaattcctgatgccgggtcgtatcagacgtatgcgacgaaattcatctcgccggcagtggggtattgcatcggttggctgtcatggctgaactggtcggtgacggtcggcatcgagctgctcacggtcagcattttgatgaagcgatggtttcctgatgtgccgacatgggtgttttgtgcggtcttcgctttgctcttgtttttgatcaacgccttgtctgtcaaaggatttggcgaggtggagttttggttttcgagcatcaaggtgctgacggtgatcgcctttattgttcttggtctggcggcgatgttcggagtcatccatatgaaaaatggacaacctgctccgtttttctcgaactttacagaccatgggggcttgtttccaaatgggttttgggcgatctttacgacgatgatcctcgtgaacttttcgttccaggggacggaattggtcggcgtggcggcaggggaaagccgcgagccggaaaaaacggtgccggttgcgttgcgcaacaccgtatggcgcattttgatcttctttattttggccatttttgtgctggctggtttgtttccgtgggagaaagccggcgttgtggaaagcccgtttgttgaggtgtttgacaacattggcattccgtatgcagccgatatcatgaactttgtcatcattaccgcggtgctgtcggtggccaactcgggcttatatgcgacatcgcgcgtcctctggtcgatgtcgcgccaaggcatggtcactccgtttttcagcaagctatcgaaacgcggcgtgcccatcaatgcgcttattgccagcattgccatcggctgcttgtctctgttgtgcagcgtgtatgcggaagatacggtgtacgtctggctgacggcgatcgccggatttggcgccgtcacggtgtgggcttccatcgcgctgtcaagctatttcggccggaaagcgtttttgcgcgaaggcggcgatgtgcgcgatctgaaatacaggacgccgttgtatccgttcgtgccgctggccgcgtttgcgttgaatatggcgacgatcatcggactggcctttatcccagatcaacggatcgcgctttactgcggcattccgtttttgctcgcttgctacgggtactaccaccttgtggcgaaaaaacgggttcagcccctagccgcagaagaaggggagctcaaggccgccaagtaa

SEQ ID NO: 17288 - protein, 470 aa, Geobacillus kaustophilus HTA426
MQPVQELKRELKSRHLFMIALGGVIGTGLFLGSGYTIHEAGPGGAVVAYLFGGLVMYLTMLSLGELAVRIPDAGSYQTYATKFISPAVGYCIGWLSWLNWSVTVGIELLTVSILMKRWFPDVPTWVFCAVFALLLFLINALSVKGFGEVEFWFSSIKVLTVIAFIVLGLAAMFGVIHMKNGQPAPFFSNFTDHGGLFPNGFWAIFTTMILVNFSFQGTELVGVAAGESREPEKTVPVALRNTVWRILIFFILAIFVLAGLFPWEKAGVVESPFVEVFDNIGIPYAADIMNFVIITAVLSVANSGLYATSRVLWSMSRQGMVTPFFSKLSKRGVPINALIASIAIGCLSLLCSVYAEDTVYVWLTAIAGFGAVTVWASIALSSYFGRKAFLREGGDVRDLKYRTPLYPFVPLAAFALNMATIIGLAFIPDQRIALYCGIPFLLACYGYYHLVAKKRVQPLAAEEGELKAAK

SEQ ID NO: 17289 - DNA, 1470 bp, Salmonella enterica subsp. enterica serovar Paratyphi A str. ATCC
  CDS (1)..(1470): transl_table=11
atgggttccaaaactaaaaccacagaagcgcccgcgctacgtcgcgaattaaaggcgcgtcacctgacgatgattgccattggcggctccatcgggacaggtcttttcgttgcatctggtgcgacaatttctcaggcggggccaggcggcgcgctgttttcttatattctgattggtttgatggtctacttcctgatgaccagtcttggcgagctggcggcctatatgccggtatctggctcgtttgcgacatatggtcagaactatgtggaagaaggctttggtttcgcgctgggctggaactactggtacaactgggcggtgactatcgctgttgacctggttgccgcacaattggtgatgggctggtggttcccggacacgccgggctggatctggagcgcgctattcctctgcgtcattttcttgctgaactacatttctgtacgtggttttggcgaggcggagtactggttctcgttaattaaagtcgcgaccgttattatcttcatcatcgttggcgtagcgatgattatcggtatctttaaaggtgtcgagccggtcggctggagcaactggacgaccggcgatgcgcctttcgctggcggttttgcggcaatgattggcgtcgcgatgatcgtgggcttctctttccagggaactgagctgattggtattgccgccggggaatctgaaaacccggagaagaatattccacgcgcggtgcgtcaggtgttctggcgtattctgctgttttatgttttcgcgattttgattatcagcctgatcattccttataccgatccaaatctgctgcgtaacgacgtcaaagacattagcgtcagtccgtttaccttagtgttccagcatgcgggcttgttgtctgcggcggcgataatgaatgcggttatcctgacggcggtactgtctgcgggtaactccgggatgtatgcctcgacccgtatgctctacaccctggcctgtgacggtaaggccccgcgtatttttgcgaaattgtcccgcggcggcgtaccgcgcaatgcgctttatgccaccaccgtgattgccggtctttgctttttgacctcaatgttcggcaaccagacggtctatctgtggctgttgaacacctccggtatgacgggcttcatcgcctggctggggattgccattagccattatcgcttccgtcgcggttacgtgttacaagggtatgatgtgaatgatttgccgtaccgttccgggttcttcccgctggggccgattttcgcctttgtactgtgcctgattattacgttggggcagaactatgaagcgttcctgaaagataccatcgactggggcggcgtcgcggcgacctatatcggtattccgctgttcctgcttatctggttcggctacaagctgataaaaggtacgcatttcgtgcgctatagcgaaatgcacttcccggaacgcgttaaaaagtaa

SEQ ID NO: 17290 - protein, 489 aa, Salmonella enterica subsp. enterica serovar Paratyphi A str. ATCC
MGSKTKTTEAPALRRELKARHLTMIAIGGSIGTGLFVASGATISQAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGYDVNDLPYRSGFFPLGPIFAFVLCLIITLGQNYEAFLKDTIDWGGVAATYIGIPLFLLIWFGYKLIKGTHFVRYSEMHFPERVKK

SEQ ID NO: 17291 - DNA, 1455 bp, Francisella tularensis subsp. tularensis SCHU S4
  CDS (1)..(1455): transl_table=11
atgtcgcagaaacttaaacgtggcttacatactcgtcatatgtcaatgatagctctaggtggctgtattggtactggtttatttgtagcacttggtggagcaatcgctgatgcgggtcctggaggaactgtcttggcgtatgttattatagctataatggtttatttcttgatggcgagtcttggcgaaatggctgcgcatagccctgttagtggcacattttgtgaatatgctacgcgctatgttgatccagcgttaggctttagtaccggttggagttattggtttaattgggctattacagttgctacagaggttattgccgcagcgttaattatgcagtattggtttccaggtagttcaattctgttgtggagtggatttttctttgtactagtttttgctttgaatatcttctcagtaaaaatatatggtgaagttgaatattggttatcttttataaaagtttctacagttattatatttataattgttggtttcttatcaatacttggtttagtaggtaatcaccaaagtgttggttttcagaactggcatatcggagatgctccttttcataatggttggtggggctttatatcagtattcatgattgctggattttctttccaaggtagtgagcttataggtgtaacagctggagaagcgaaagatccaaatacatctataccaaaagcaatcaaacaaacattttggcgtttatttatattttatatacttgctgtagtgattattagcttcttgattccatacaataatccatctttgataaaagctggagcaagtaatgatgtttcagttagtccatttacaatagtttttgaaaacgttggtttgaattcagcggcaactattatgaatgtaattatattaactgcgataatatctgcatgtaatgcaagtatgtatagtgcgacaagggtactatggcatttaggtaacattaagcaagccccgcagttttttgcaactactaattcaaaaggtacgccaatgattgctcttttggttacagcagttataggctcgtcattcttctttgtatcttttgttggtagtggatatatatttacatggttagtcaacgtttcaagtttagcgggatttattgcatggtttacaattgcacttagtcactatcgttttagaagggcatatataaagcagggtaaaagcttagaagatttaccatatgtagcaaagtttttcccatgggcgcctattattgctttaactatggtaagtatagtaatcgttggtcaaggtgttacaatgttgacaatggagggtagaacttggtttagtgtaataatagagtttttatcaacttatataggtttctttgcatttgtgatactatattttgtatataagtttattaaaaagacaaaattgataagactagaagattgtgatcttactagagaatcttag

SEQ ID NO: 17292 - protein, 484 aa, Francisella tularensis subsp. tularensis SCHU S4
MSQKLKRGLHTRHMSMIALGGCIGTGLFVALGGAIADAGPGGTVLAYVIIAIMVYFLMASLGEMAAHSPVSGTFCEYATRYVDPALGFSTGWSYWFNWAITVATEVIAAALIMQYWFPGSSILLWSGFFFVLVFALNIFSVKIYGEVEYWLSFIKVSTVIIFIIVGFLSILGLVGNHQSVGFQNWHIGDAPFHNGWWGFISVFMIAGFSFQGSELIGVTAGEAKDPNTSIPKAIKQTFWRLFIFYILAVVIISFLIPYNNPSLIKAGASNDVSVSPFTIVFENVGLNSAATIMNVIILTAIISACNASMYSATRVLWHLGNIKQAPQFFATTNSKGTPMIALLVTAVIGSSFFFVSFVGSGYIFTWLVNVSSLAGFIAWFTIALSHYRFRRAYIKQGKSLEDLPYVAKFFPWAPIIALTMVSIVIVGQGVTMLTMEGRTWFSVIIEFLSTYIGFFAFVILYFVYKFIKKTKLIRLEDCDLTRES

SEQ ID NO: 17293 - DNA, 1449 bp, Staphylococcus epidermidis RP62A
  CDS (1)..(1449): transl_table=11
atggaagataataatatgaaacgtggtctcaattcgagacatatatctatgatagctataggtggcgctataggtactggactttttgtggcaactggaagtgtcatttctcaagctggcccaggaggagctatattagcttatatactaattggtattatgctttattttttaatgtcatcaataggagaattagcaactttctatccggtttctggttcttttagttcatactctaccagatttgttgattcgtcacttggttttacaatgggttggttgtattggggtatgtggtcacttgtaacaagtgtagatatcattgttgcttccaatgtattacaatattgggatgtatttaaagttttaaatccacttacatggagcttaattttcttaactctgttgtttttaattaatattttttctgttaaagcttttggagaaactgagttttggttatcactgatcaaagtcattactataattgtatttattatttttggaattatgatgattttcggtattcttggtggtcatacatatggctttgagaattatactaaaggtcaagcaccttttgtcggtggaatatcaggcatattaagcgttcttttagttgcaggtttttcagttggtggtactgaagtagtcgcagtaacagctggtgaatcaaataatcccgaaaaatcaatgcctaaagctataaaacaggtattttggagaatattactcttttacgtattgtctatagctgtgatagctgccatcattccatatacggatccacttttacttaatgaaaatgagtctgtatcacaaagtccgtttacaattgttttcgatagaatagggatcgcttttgctgcatcagtcatcaacgctgttatcttaacatcattattatcagcagctaactctggtatttatacaacaagtagaatgctattttctttaagtgctgataaacaagcacctaaattctttggaaaactcaatgataaaactaaattacctatgcgtgcattaattacaacatatattattattgtattagtcattgtttatgctaattttaatgctaatgctgtatttaacttattaaatatcataggatctatggttattgtagtttggggatctagtatttggtcacaaattagattaagacaagcaattaaaaaacagggtaaaaatccagataaactgttgccatataaagcacctttttacccagtcggacctattattgtccttttcacattattattcttattattaggtagttcgtttggtagtatcgcatctggtgatattttaggtgtcattcgaaactttacaccattatttattctagctatcatctatattgctcataaattaatcaaacggacacattttgtcaaactggaagaaatagatttaactccgcataattacaagaattaa

SEQ ID NO: 17294 - protein, 482 aa, Staphylococcus epidermidis RP62A
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDRIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 17295 - DNA, 1503 bp, Staphylococcus epidermidis RP62A
  CDS (1)..(1503): transl_table=11
atgaaaaagaataataaacaaaatgacggtgttcaaagaggattaaaagatagacatatttcaatgattgccattgggggatgtataggaactggtctattcatgacttctggtggagctatacatgacgcaggtgcattgggtgctttgattgcctatgcagttattggagcgatggtgttctttctaatgacgtcgttaggggagatggcgacatatttgcctgtgtcaggttcatttagtacttatgctacacgctttgtcgatccttcactaggttttgctttaggatggaattattggttcaactgggtgataacagtagcagctgatgttactattgcagcgcaagttatacaatattggtcccctatgcaaggtataccagcttgggtctggagttgtattttccttattattattttcgcgcttaattctttatccgttagagtatatggagagagtgaatattggttcgcacttatcaaagtagttacagtcatcatatttataggaattggtatcttaactattttagggattatgggtggagaatttgtaggatttgatacgtttacaaaaggagatgggccaatactaggtgggaatttaggaggtagcttgctatcaattcttggtgtatttctagtcgcaggcttctcattccaaggaactgaacttattggtattacagcaggtgaatctgaaaatccagaaagagcagttccaaaagcgattaaacaagtattttggcgtatacttttattttacattctagctattttcattattggtatgttgattccatatgatagtaaggcattaatgggcggtggtgatagtatagctacttcaccttttacattagtatttaagaatgctggattagcttttgctgcttcatttatgaatgctgttatattaacaagtgtattatcagcaggtaactcaggaatgtatgcttcaacaagaatgttatattcgatgagtaaagataaattagcttataattcttttggaaaaacaaataaaagtggcgtaccttatgtatctctaattgcaactggagtactagtcattcttattttcgcattgcaacatttaagtggagatgcatatgaatacattgtagctgctagcggaatgactggttttattgcttgggttggtatagcaatcagtcactttagatttagacgcgcatttgataaacaaaattatgataaatcaaaattaaaatataaagcgaagttattcccatttggtccgatttttgcaggtattttatgtgtaatagttatcattggacaagatgtagattttattaaaacaggtaactttgatatgaatagattttttataacttacatgggaatacctgtattcttaattttcttcttttatcataaatttagatataaaactaaaaagattcctctaaacaaagttgacttaaggcaagatgtttcgatggaagaagtaagacaccataaaaataattaa

SEQ ID NO: 17296 - protein, 500 aa, Staphylococcus epidermidis RP62A
MKKNNKQNDGVQRGLKDRHISMIAIGGCIGTGLFMTSGGAIHDAGALGALIAYAVIGAMVFFLMTSLGEMATYLPVSGSFSTYATRFVDPSLGFALGWNYWFNWVITVAADVTIAAQVIQYWSPMQGIPAWVWSCIFLIIIFALNSLSVRVYGESEYWFALIKVVTVIIFIGIGILTILGIMGGEFVGFDTFTKGDGPILGGNLGGSLLSILGVFLVAGFSFQGTELIGITAGESENPERAVPKAIKQVFWRILLFYILAIFIIGMLIPYDSKALMGGGDSIATSPFTLVFKNAGLAFAASFMNAVILTSVLSAGNSGMYASTRMLYSMSKDKLAYNSFGKTNKSGVPYVSLIATGVLVILIFALQHLSGDAYEYIVAASGMTGFIAWVGIAISHFRFRRAFDKQNYDKSKLKYKAKLFPFGPIFAGILCVIVIIGQDVDFIKTGNFDMNRFFITYMGIPVFLIFFFYHKFRYKTKKIPLNKVDLRQDVSMEEVRHHKNN

SEQ ID NO: 17297 - DNA, 1425 bp, Xanthomonas oryzae pv. oryzae KACC10331
  CDS (1)..(1425): transl_table=11
atggagcgcccccgatcggacgcgcccatgccagaaccatcgtccaccaccgccccgcagttccggcgcagcatgcaggtgcgccatctggtgatgctgtcgctgggcggcgtgatcggtaccggcttgttcttcaataccgggtacatcattgccagcaccggcgcgctgggcacggtgctcgcatatctgatcggcgcgttggtggtgtacctggtgatgcaatgcctgggcgagttggcggtggcgatgccgcagaccggcgcattccacgtgtatgccgcgcgttatctggggccggcgaccggctacgtggttgcgtggttgtactggctgacctggacggtggcattgggctcgagcctaaccgcagcggcgttctgcatgcagtactggtttccgcatagcccggcgtggccgtggtgtctgctgttctgcgcgctgatcttcggtttgaacacggtctcggcgcgctggtttgcagaaggcgagttctggttttcgttgatcaaggtcatcaccatcctggtgttcatcgtgcttggcggtgcggcggtgatcggtctgctgccactggccgatggttcgcctgcacccgggctgcgtcatctacgtgccgatggctggtttgcgcatggaacgctgccgatcctgatgacgatggtggcagtgaattttgcattttccggcaccgagttgattggtgtggccgccggcgaaaccgagcagccagcgcgcgcgattccgctggcgatccgcacaacgctgatgcggctggtggtgttcttcgtcggcacggtgctggtgctggcagcgctgctgcctgccgaacaagcggcagtggagacgagcccgttcgtgcgcgccttcgagctgttgggcattccgtatgcggccgacctcttgaatgtggtgatcctcaccgcgatcctgtcggcggccaattccggcctgtatgcggccgcgcgcatgctgtggtcgttggccaacgaaggcacgttgccttcgggcctgacgcggttgaccggccgcggcattccgttgcgcgccgtgtcgttgagcatgttgggtggcttgctggcgctgctcacgggcgtgtatgcggccgacaccgtgttcgttgcgatctcggcggtttcggggtttgcggtggtagtggtgtggctgagcatctgcgcgtcgcactatgtgtttcgtcgccagctgctgcgcgatggcgttgcgccagagacgctggcgtaccgcgcccggtggtatccatggacaccgatcctcggcttttcgctgtgtctgctggcctgtatcgggctggcattcgatccgcagcagcgcatcgcgttgtggtgcggcgttccgttcgttgcgctgtgctacggcgcttacgcacttacccaacggcttgcggcccggagactgcacgcatga

SEQ ID NO: 17298 - protein, 474 aa, Xanthomonas oryzae pv. oryzae KACC10331
MERPRSDAPMPEPSSTTAPQFRRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCALIFGLNTVSARWFAEGEFWFSLIKVITILVFIVLGGAAVIGLLPLADGSPAPGLRHLRADGWFAHGTLPILMTMVAVNFAFSGTELIGVAAGETEQPARAIPLAIRTTLMRLVVFFVGTVLVLAALLPAEQAAVETSPFVRAFELLGIPYAADLLNVVILTAILSAANSGLYAAARMLWSLANEGTLPSGLTRLTGRGIPLRAVSLSMLGGLLALLTGVYAADTVFVAISAVSGFAVVVVWLSICASHYVFRRQLLRDGVAPETLAYRARWYPWTPILGFSLCLLACIGLAFDPQQRIALWCGVPFVALCYGAYALTQRLAARRLHA

SEQ ID NO: 17299 - DNA, 1437 bp, Xanthomonas campestris pv. campestris str. 8004
  CDS (1)..(1437): transl_table=11
gtgcgtggcaggatggggcgccaccgatcaggaccacgcatgtccgagccctcgtccaccgacgcaccgcagttccagcgcagcatgcaggtgcgccatctggtgatgctgtccctgggcggcgtgatcggcacgggattgttcttcaacaccggctacatcatcgccagcaccggtgcgctgggtacggtgctggcgtacctgatcggcgcgctggtggtgtatctggtgatgcaatgcctgggcgagctggcggtggcgatgccgcagaccggcgcgtttcatgtgtatgcggcgcgctatctggggcctgccaccggctacgtggtggcctggttgtactggctcacctggacggtggcgttggggtcgagcctcaccgctgccgcgttctgcatgcagtactggtttccgcacagcccggcgtggccgtggtgcctgctgttctgcgtgctgattttcagtttgaacatggtgtcggcacgctggtttgccgaaggcgaattctggttttcgctgatcaatgtagtgaccattgtggtgttcatcgtgctgggcggcgcggcggtggtcggctggctgccgctggccgacggcagcccggcgccgggagtgcgccatctgcgcgccgatggctggtttgcgcacggcaccgtgccgatcctgatgacaatggtggcggtgaatttcgctttctccgggaccgagctgatcggcatcgcagccggcgaaactgcacagcctgcacgcgcaatcccgctggcgatccgcaccacgttgatccgtctggtggtgctgttcgtcggcaccgtgctggtgctggccgcgttgctgccggcgcacgcggcggcggtggagaccagcccgttcgtgcgcgccttcgagctgctgggcattccgtatgccgcaggtctgctcaacgcggtgatccttaccgcgatcctgtcggcggccaactccgggttgtatgcggcggcccgcatgctgtggtcgttggccaacgagggcaccttgcctgcccgctttgcgcggctgacccggcgtggcatcccgctgcctgcgctggtgctgagcatgcttggcgggctgctggcgctgctgaccggtgtgtacgcggccgacaccgtgttcgtggcgatttctgcagtctccgggtttgcggtggtggtggtgtggctgagcatctgtgcctcgcactattgtttccgccgccagctgctgcgtgacggcatcgcactggacagcctggcctaccgcgcgccgtggtatccgtggacgccgctgattggtggcgcgctgtgcgtgctggcctgcgctgggctggcgtttgacccgcagcagcgcatcgcgctgtggtgcgggattccgttcgtggcgctgtgctacggcgcccatgcagtgacccaaaggcttgcagcccggagagtgcgtccatga

SEQ ID NO: 17300 - protein, 478 aa, Xanthomonas campestris pv. campestris str. 8004
MRGRMGRHRSGPRMSEPSSTDAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCVLIFSLNMVSARWFAEGEFWFSLINVVTIVVFIVLGGAAVVGWLPLADGSPAPGVRHLRADGWFAHGTVPILMTMVAVNFAFSGTELIGIAAGETAQPARAIPLAIRTTLIRLVVLFVGTVLVLAALLPAHAAAVETSPFVRAFELLGIPYAAGLLNAVILTAILSAANSGLYAAARMLWSLANEGTLPARFARLTRRGIPLPALVLSMLGGLLALLTGVYAADTVFVAISAVSGFAVVVVWLSICASHYCFRRQLLRDGIALDSLAYRAPWYPWTPLIGGALCVLACAGLAFDPQQRIALWCGIPFVALCYGAHAVTQRLAARRVRP

SEQ ID NO: 17301 - DNA, 1494 bp, Staphylococcus haemolyticus JCSC1435
  CDS (1)..(1494): transl_table=11
atgaaaaaagtcgaaaatcaagatgatggaatcaaaagaggactgaaggaccgccatatttctatgatagcaatgggtggttgtatcggtaccggattatttatgacctctgggggagcaatacacgatgcaggggcattaggtgctttaattgcatatgcgattattggagctatggtattcttcctcatgacatctttaggtgaaatggcaacgtatttaccagtgcctggttcatttagtacttacgcaacacgttttgtagatccatctttaggatttgcgctaggttggaactattggtttaactgggttattacagttgcagcagatgtaaccattgctgcacaagtcattcaatattggacacctatggctggtattccagcatgggtttggagttgtatattcttagttattatattcgcactaaactctttatctgttagagtttatggtgaaagtgaatattggttcgctttaatcaaagttgtaacagtcattatctttatcattattggtcttttaacgatactaggtattatgggtggagaatttgtaggtttcgagacatttacgaaaggtgacggaccaattctaggtggtaacttaggtggaagtttattatcaattctaggcgtcttcctagttgctggattctcattccaaggtacagagttaattggtattacagctggagaatctgaaaatccagaacgcgctgtacctaaagctattaaacaagtattctggagaatattattattctacatattagcaatatttgttataggtatgttaatcccttacgatagtaatgcattgatgggtggcgatgataatattgctacttctccatttacactcgtgtttaaaaatgctgggttagcttttgcggcatcatttatgaatgcagttattttaacatcagttttatcagcaggtaattcaggtatgtatgcatcaacacgaatgttatattctatgagtaaagataaattagctttccattcatttggtaaaacgaataaatatggtgtgccatacttatctttatttgcgacagcgattttagttgttattattttcttagtgcaaaaactaagtggtgacgcatatgaatatattgttgctgcaagtggtatgacaggctttatcgcatgggtaggtattgcaattagtcactacagatttagaagagctttcgaaaaacaacatcatagtaaaagggagttgaagtataaagctaaatggttcccattcggtcctatattcgcaggcttgctctgtgtgattgtcataatcgggcaagatgttgattttattaaaacaggtcatttcgatttaaatcgcttcattatcacatatatgggaatcccagttttcttagtattctttatttatcataaattgagatataaaacgaagataattccattagataaagtagatttaagacaagatgtttcaatggatgaagtaaaacatcactaa

SEQ ID NO: 17302 - protein, 497 aa, Staphylococcus haemolyticus JCSC1435
MKKVENQDDGIKRGLKDRHISMIAMGGCIGTGLFMTSGGAIHDAGALGALIAYAIIGAMVFFLMTSLGEMATYLPVPGSFSTYATRFVDPSLGFALGWNYWFNWVITVAADVTIAAQVIQYWTPMAGIPAWVWSCIFLVIIFALNSLSVRVYGESEYWFALIKVVTVIIFIIIGLLTILGIMGGEFVGFETFTKGDGPILGGNLGGSLLSILGVFLVAGFSFQGTELIGITAGESENPERAVPKAIKQVFWRILLFYILAIFVIGMLIPYDSNALMGGDDNIATSPFTLVFKNAGLAFAASFMNAVILTSVLSAGNSGMYASTRMLYSMSKDKLAFHSFGKTNKYGVPYLSLFATAILVVIIFLVQKLSGDAYEYIVAASGMTGFIAWVGIAISHYRFRRAFEKQHHSKRELKYKAKWFPFGPIFAGLLCVIVIIGQDVDFIKTGHFDLNRFIITYMGIPVFLVFFIYHKLRYKTKIIPLDKVDLRQDVSMDEVKHH

SEQ ID NO: 17303 - DNA, 1455 bp, Staphylococcus haemolyticus JCSC1435
  CDS (1)..(1455): transl_table=11
atggaagataacaatatgaaaagaggtcttaactcaagacacatatctatgattgctataggtggcgcaattggtacggggctctttgtagcaacaggtagtgttgttgctcaagccggtcctggtggcgctatattagcttatttattaattggcataatgctttactttttaatgtcgtcaattggtgaattggcaacattttatcctgtttcaggatcgttcagttcatacgcaacgcgattcgtagacccttctctaggttttactatgggatggttatactacatcatgtgggcattagtatccagtgtagatgttatggtagcttcaaacgttttatattattgggatatatttaaattctttagtccacttacttggagtttaatctttatcacaattgtatttttattaaacatcttcacggtaaaagcttttggggaaactgaattttggttatctttagttaaagtagtaactattattatatttattattgttggtttcttgatgatcttcggtatattaggtggccatacttacggttttgaaaactatactaaaggcgaggcaccattcgtaggtggtttatctggtttcttaggcgttttactagtagccggattctcagttggtggtactgaagttgtagcagtaactgctggcgaatctgataatccagaaaaaacaatgcctaaagctgttaaacaagttttttggagaattttattattctatgtattatcaattggtgttattgcagctatcattccttatacagatccattattattaaatgaaaatgaatcagtaacacaaagccctttcacaattgtatttgacagaattggtgttgcttttgccgcttcagttattaacgctgttatattgacatcattattatctgcgacaaattcaggtgtttacaccactagtagaatgttattctctttaagtgatgaaaaacaagcaccaaagttcttaagtaagcttaatgaaaaatccaaattacctttaagagcattagttacaacatatattctaatcgttgcaattatcattattgctaatttttattcaaatgctgtatttagtttattaaacattataggttcattggtaatcattgtttgggcagctagttcatgggcacaagtgagattgcgtaaagctattaaacgtcaaggacaagatatcaatcaacttttaccttataaatcaccattgtaccctcttggaccaattttagtatttgcaactttaattttcttatactttggtaattcaattggagatttattcgatggtaatataggtaaatttttcgttaacatcttacctattattattttaggactcattttcttagctcataaattaataagaaaaacgaagttcgttaaattaaatgatatggatatcacaccacatcattatcataaagaaaattaa

SEQ ID NO: 17304 - protein, 484 aa, Staphylococcus haemolyticus JCSC1435
MEDNNMKRGLNSRHISMIAIGGAIGTGLFVATGSVVAQAGPGGAILAYLLIGIMLYFLMSSIGELATFYPVSGSFSSYATRFVDPSLGFTMGWLYYIMWALVSSVDVMVASNVLYYWDIFKFFSPLTWSLIFITIVFLLNIFTVKAFGETEFWLSLVKVVTIIIFIIVGFLMIFGILGGHTYGFENYTKGEAPFVGGLSGFLGVLLVAGFSVGGTEVVAVTAGESDNPEKTMPKAVKQVFWRILLFYVLSIGVIAAIIPYTDPLLLNENESVTQSPFTIVFDRIGVAFAASVINAVILTSLLSATNSGVYTTSRMLFSLSDEKQAPKFLSKLNEKSKLPLRALVTTYILIVAIIIIANFYSNAVFSLLNIIGSLVIIVWAASSWAQVRLRKAIKRQGQDINQLLPYKSPLYPLGPILVFATLIFLYFGNSIGDLFDGNIGKFFVNILPIIILGLIFLAHKLIRKTKFVKLNDMDITPHHYHKEN

SEQ ID NO: 17305 - DNA, 1404 bp, Pseudomonas fluorescens Pf-5
  CDS (1)..(1404): transl_table=11
atgacaaccaccacagaacgtaaaggcatccacctgacccgctccttgaagagccggcacattttcatgctgtccctgggaggcgtgatcggcaccgggctgttcatgggctccggggtcaccatcaaccagggcggcccttggggggcgatcctctcttacctgggggccgggttcctgatgtacctggtgatggtctgcctcggcgagctgtcggtgcagatgccggtgtccggctcgttccaggcccacgccaccaaatacattggcccggccaccggcttcatgatcggctgggtctactggatgagctgggccaccaccgtgggcctggaattcaccgccgccggcatgctgatgcaacgctggttccctggcgtgccgatctggtactggtcggcgctgttcgtggccttgctgttcggcatcaacgccctggccacccgcgcctttggcgaggccgaatactggttcgccggggtcaaggtgctggcgatcctgagctttatcgtggtgggcgcgctggtgatcttcggcgtcatcgacctgcccagcggcgccccggcgccgatgttcgacaacctcaagggcgactccctgttccccaacggcctgccggcggtgttcgcggtgatgatgaccgtggtctacgccttccagggctgcgagatcatgggcgtggctgccggtgaaaccgaccagccggaaaaaagcatcccccgcgccgtacgcaacgtggtgtttcgcgtgctgatcttctacgtgctggcagtgatggtgctggcggcgatcattccctggcagcaggccgggctggtggaaagccccttcgtccaggtgttcgacatggtgggcattccctacgccgccgacctgatgaacttcgtgatcctcacggcgatcctctcggtgggcaactccgggctgtatgcctccacgcgcatcctctgggccatgtccaaatccgggatggcgcccaaggccctgtcgcccctgagcaaacaaggcgtccccctgcgcgccctgttcatcactctgtgttttgccctgatctcgctgatgaccagcttcatcgccgccgacaccctgttcatggtgctgatggcggtgagcggcatggccggcaccgtgacctggatcgtcattgccctggcccagtaccgcttccgtcgccagttcctgcgcgagggcgggcaactggagcagctcaagtaccgcgcgccctggttccccctggtgccgctgctgtgcatcgtcctgtgcagttcgctgttcgtgttcctggccctggatgaaacccagcgtccgtcgctgtactgggggtcgggctttatcgccctgtgctatggcgcttactacctgatgcaacgcaaacgccaattgcaacctgcagccgctgtgtag

SEQ ID NO: 17306 - protein, 467 aa, Pseudomonas fluorescens Pf-5
MTTTTERKGIHLTRSLKSRHIFMLSLGGVIGTGLFMGSGVTINQGGPWGAILSYLGAGFLMYLVMVCLGELSVQMPVSGSFQAHATKYIGPATGFMIGWVYWMSWATTVGLEFTAAGMLMQRWFPGVPIWYWSALFVALLFGINALATRAFGEAEYWFAGVKVLAILSFIVVGALVIFGVIDLPSGAPAPMFDNLKGDSLFPNGLPAVFAVMMTVVYAFQGCEIMGVAAGETDQPEKSIPRAVRNVVFRVLIFYVLAVMVLAAIIPWQQAGLVESPFVQVFDMVGIPYAADLMNFVILTAILSVGNSGLYASTRILWAMSKSGMAPKALSPLSKQGVPLRALFITLCFALISLMTSFIAADTLFMVLMAVSGMAGTVTWIVIALAQYRFRRQFLREGGQLEQLKYRAPWFPLVPLLCIVLCSSLFVFLALDETQRPSLYWGSGFIALCYGAYYLMQRKRQLQPAAAV

SEQ ID NO: 17307 - DNA, 1437 bp, Pseudomonas fluorescens Pf-5
  CDS (1)..(1437): transl_table=11
atgtccctacaagaacaacagaccgacttgcgcggcggcttcaagcaagaaatgcagacccggcacattgtcatgctcgccctgggcggggtgataggcaccgggctgttcctcacgtccggctacacggtgaaccaggccggcccgctgggcgcggtgatcgcctacatcatcggcgcgctgatggtgtacctggtgatgatgtgcctcggcgagctggcggtgcagatgcccgagaccggctccttcagcacctacgccacgcgctttctcggccccggtaccggctacaccgtggcctggctgtactggctgacctggaccgtggccatcggctcggaattcaccgccgccgggatcctcatggcccgctggttccccgagaccccggtgtggatctggagcgcgctgttcgccatggtggtgttcttgtccaacgtggtgtcggtgcggctgttcgccgagaccgagttctggctgtcgctggtcaaggtgatcaccgtgctggcattcctggtggtgggcggcggggcgattctcggtcttctgcacatcgaccaggcccacagcatcggcctgagcaacttcacccgtgaggggctattccccaccggcttcatgccgatcgccatgaccctactggcggtggccttcgctttctccggcaccgaactgatcggcatcgccgctggcgaaacccgtgacccgcaacgcaatgtgccacgggcgatccgcaccacggtgctgcgcctggcgatcttcttcgtcggcaccatcttcgtcctcgccaccctgttgccccgggagcaggccggcctggtggaaagcccgttcgtcacggtgttcacctacatcggcattccgtactcggccgacatcatgaacttcgtgatcatcagcgcgttgctgtccgccgccaactccgggctgtacgccgcctcgcggatgctctggaccctgagcgaccagggccacctgcccaagcagttctcggccctgacccgcatgggcacgccgctcaacgcgatcatcgtgagcatggccggtggcgccgcctcgctgctcagcagcgtgttcgccccggacaccatctacctggccctggtgtcgatttccgggctggcggtggtggtggtgtggatgagcatcgccgccagccagatcgcctttcgccggcacttcgtggccaacggcggtgacgtgcgcgacttgaaattccgtgttcgtggctacccctgggtgccgttgggggcgctgttgtgctgcgccctggcctgtgtcggcattggtttcgaccccgagcagcgcgtggccctgtacttcggcctgcccttcatcgcctggtgctacctggtgtattacattacccgcagtagccgccagcggcgcctgtccctggcagccctggctcggccctccgatgccctgcagggttga

SEQ ID NO: 17308 - protein, 478 aa, Pseudomonas fluorescens Pf-5
MSLQEQQTDLRGGFKQEMQTRHIVMLALGGVIGTGLFLTSGYTVNQAGPLGAVIAYIIGALMVYLVMMCLGELAVQMPETGSFSTYATRFLGPGTGYTVAWLYWLTWTVAIGSEFTAAGILMARWFPETPVWIWSALFAMVVFLSNVVSVRLFAETEFWLSLVKVITVLAFLVVGGGAILGLLHIDQAHSIGLSNFTREGLFPTGFMPIAMTLLAVAFAFSGTELIGIAAGETRDPQRNVPRAIRTTVLRLAIFFVGTIFVLATLLPREQAGLVESPFVTVFTYIGIPYSADIMNFVIISALLSAANSGLYAASRMLWTLSDQGHLPKQFSALTRMGTPLNAIIVSMAGGAASLLSSVFAPDTIYLALVSISGLAVVVVWMSIAASQIAFRRHFVANGGDVRDLKFRVRGYPWVPLGALLCCALACVGIGFDPEQRVALYFGLPFIAWCYLVYYITRSSRQRRLSLAALARPSDALQG

SEQ ID NO: 17309 - DNA, 1521 bp, Ralstonia eutropha JMP134
  CDS (1)..(1521): transl_table=11
atgtcttcccactcccatcctcatcctcaccagcatccggtcgtcgagcacgacgaccttcagcgcaagctcaaggcgcgccatctcaccatgatcgcaatcggcggcgcggttggcacggggttgttcgtcgcatccggcgcctccatcgcacaggctggtcccggcggcgcgcttctgatgtacgccctgcttggcttcatggtgtattgcctgatgaccagccttggcgaactggccgtccacatgcccgtggctggctcgttcgtcacctacagcgcgctctatgtcgaggaaggtttcggctttgcgctcggctggaattactggttcagcctggccgtgaccatcgcggtggaactcaccgccgcgcaactggtgatgcagttctggttccccggcatgcccggcatggtctggagcgcgggcttcctgctgctgatgttcgcgctcaacgcgttctcggtgcgcggcttcggcgaagccgagtactggttcgcgctgatcaaggtgatcacggtgatcgtgttcctgggcgtggggctgctgatgatcttcggcatcatgaagggcggcccgcaatccggctggcacaacttcacgaccggcgacgcgccgttcgtcggcggcatccctgccatgatcggcgtggcgatgatcgccgggttttcgttccaaggcaccgagaccgtgggcgtagctgccggcgaagcgcaggatccggccagaacgatcccgcgcgcgatccgccagaccttctggcgcatcctgctgttctacgtgatcgcgatcctgatcatcggcgtgctgattccctataccgatccgaacctgctgcgcaatgatgtgaccgacgtcggcgtgagcccgttcgccctggtgttccgccaggccgggctggcctttgccgccggcctgatgaacgccgtagtgctgaccgcgctgctgtcggcgggcacgtcgagcatgtacgtctccacgcgtattctctacggcctggctgtgagcggacgcgccccgcgctggctgggcaagctgaccgtgaacggcgtaccgttcaatgcgctgctggtcaccaccgccgtcggcgcgctgtgcttcttcagttcgctgttcggcgacaaggccgtgtacctgtggctgctgaacacatcggccatgacgggcttcttcgcatggttcggtatcgccctgagccactaccgcttccggcgcggactggtctatcaaggctatgacatcaacgcgctggcgtaccgctcgccgctctatccgttcggcccaatctttgcgggcgtgctgtgcctggtgatcgtggcgggacagaactaccaggcattcgcggacattccgaaccgctggccggaaatcattgcgacgtacatcggggtgccggtgttcctggcgctgtggctggggtaccgcatcgtcaggaagacgcggctgatcgactatgaggatatgccgttcgagttgccgaagacggcaaaagtcattgccgggcaagcggcacaagtgtga

SEQ ID NO: 17310 - protein, 506 aa, Ralstonia eutropha JMP134
MSSHSHPHPHQHPVVEHDDLQRKLKARHLTMIAIGGAVGTGLFVASGASIAQAGPGGALLMYALLGFMVYCLMTSLGELAVHMPVAGSFVTYSALYVEEGFGFALGWNYWFSLAVTIAVELTAAQLVMQFWFPGMPGMVWSAGFLLLMFALNAFSVRGFGEAEYWFALIKVITVIVFLGVGLLMIFGIMKGGPQSGWHNFTTGDAPFVGGIPAMIGVAMIAGFSFQGTETVGVAAGEAQDPARTIPRAIRQTFWRILLFYVIAILIIGVLIPYTDPNLLRNDVTDVGVSPFALVFRQAGLAFAAGLMNAVVLTALLSAGTSSMYVSTRILYGLAVSGRAPRWLGKLTVNGVPFNALLVTTAVGALCFFSSLFGDKAVYLWLLNTSAMTGFFAWFGIALSHYRFRRGLVYQGYDINALAYRSPLYPFGPIFAGVLCLVIVAGQNYQAFADIPNRWPEIIATYIGVPVFLALWLGYRIVRKTRLIDYEDMPFELPKTAKVIAGQAAQV

SEQ ID NO: 17311 - DNA, 1491 bp, Staphylococcus saprophyticus subsp. saprophyticus ATCC 15305
  CDS (1)..(1491): transl_table=11
atggcaaatcaagaaaatcaaaacactgggattaaaagagggttgaaagaccgtcatatttccatgattgctattgggggttgtattggaacaggactattcatgacttccggtggtgcgatccacgatgctggtgcacttggtgcgcttttagcatatgcaatcattggagcaatggtcttctttcttatgacttcattaggagagatggcgacgtatttacctgtatctggatcgtttagtacatatgctacacgctttgtagatccttcattaggatttgcattgggatggaactactggtttaactgggtaattactgttgctgccgatgttacaatagctgcgcaagttattcaatattggacgccgttatctggtattccggcttggagttggagttgtctctttttaattattatttttggacttaatgcattatctgtacgagtttatggcgaaagtgaatattggttcgcgttaattaaagtagttactgtaattattttcattgcaattggtctattaacgattctaggtattatgggaggcgaatttgtaggctttgatacatttactaaaggcggtggacctattttaggtgacggtcttggaggtagtttacttactattttaggtgtgttcttagtggcaggtttctcattccaaggtacagaattgattggtattactgctggtgaatctgaaaatccagaacgcgcagttccaaaagcaattaaacaagtattttggagaatattaatcttttatatacttgctatatttgtaatcggtatgctaataccttacgatagttcagcgttaatgggcggcggagatgatatttctacttcaccatttacattagtattccaaaatgcaggcttagcatttgctgcgtcattcatgaatgcagtcattttaacttcagtgctttctgcaggtaactcaggtatgtatgcttcaactagaatgctttattcaatgagtaaagataaactggcataccctatatttggtaaaacaaataaaagcggtgttccttatgtatctttaatcgttacagcaatcatagttataggcatatttatattgcaacacttgagtggtgatgcatatgaatatatcgtagctgcgagtggtatgactggtttcatcgcatgggtaggtatagctgtgagtcattatagatttagaaaagcatttgataaacaagattatgataagtctaaattgaaatataaagcgaaattattcccatttggacctatatttgctggtatcttgtgtgtattagttattattggacaagatgtagattttattaaaacaggtgactttgaccttaacaggtttgttatcacttatatgggaattccagtattcttggcgttcttcatttatcataaagtgagatataaaacgaaaatggttccattggaaaaagtgaacttacgacaagatgttgatatggaagaaattaataaataa

SEQ ID NO: 17312 - protein, 496 aa, Staphylococcus saprophyticus subsp. saprophyticus ATCC 15305
MANQENQNTGIKRGLKDRHISMIAIGGCIGTGLFMTSGGAIHDAGALGALLAYAIIGAMVFFLMTSLGEMATYLPVSGSFSTYATRFVDPSLGFALGWNYWFNWVITVAADVTIAAQVIQYWTPLSGIPAWSWSCLFLIIIFGLNALSVRVYGESEYWFALIKVVTVIIFIAIGLLTILGIMGGEFVGFDTFTKGGGPILGDGLGGSLLTILGVFLVAGFSFQGTELIGITAGESENPERAVPKAIKQVFWRILIFYILAIFVIGMLIPYDSSALMGGGDDISTSPFTLVFQNAGLAFAASFMNAVILTSVLSAGNSGMYASTRMLYSMSKDKLAYPIFGKTNKSGVPYVSLIVTAIIVIGIFILQHLSGDAYEYIVAASGMTGFIAWVGIAVSHYRFRKAFDKQDYDKSKLKYKAKLFPFGPIFAGILCVLVIIGQDVDFIKTGDFDLNRFVITYMGIPVFLAFFIYHKVRYKTKMVPLEKVNLRQDVDMEEINK

SEQ ID NO: 17313 - DNA, 1446 bp, Staphylococcus saprophyticus subsp. saprophyticus ATCC 15305
  CDS (1)..(1446): transl_table=11
atggcacaaaacaatatgaatcgcggtctaaattctcgtcatatttcaatgattgcaattggtggtgccattggtactggactttttgttgcaactgggaatgtcatttctcaagcaggacctggtggcgctatattagcttatttaattattggaattatgttgtatttcttaatgtcatcaatcggggagctagcaactttctatcctgtttctggatcgtttagttcttattctacaaggtttgtagataaatcattaggatttaccatggggtggctatattgggcaatatggctacttgtaacgagcgttgatattattatttcttcaagtgtactttattactgggatacttttcaatttttcagtcctgtcacatggagcattatattcttatgcttactgttcttattaaatatattttctgttaaagcattcggtgaaacagaattttggttatctctcatcaaagttgtaaccatcatcgtgtttattctcattggtgtattaacgattgtaggaatattaggtgggaaaacttatggattatcgaattacacaactggtgaggcaccatttgttggtggtatttcaggttttctaggcgtcctcttggtagcaggcttttcagttggaggtacggaagtcgttgctgttactgcaggcgaatcttctaaccctgatcgctcaatgccaaaagctatcagacaagttttctggagaattttactcttttatgtattatcaatcgcagttatatcagcaattatcccttatacagacccaatgttattgaataaaaacgaatcggtttctcaaagcccttttaccattgtgtttgatcgtgttggcattgcatttgcagcttcagtaataaatgcagttattttaacttctttattatcagcagctaattctgggatttatactacaagtagaatgttattctctatggcagaagatagacaagcacctaagttcttatctaaattaaacaagactacaaaattaccaatgactgcattaattgctacatttgtaattgtattgttcatcataatactagcgcaattcaaatcagatatagtgttctcgttattaaatattataggatcactcgttattgtgatttgggcgtctagtatcttatcacaaattaggttacgctctgctattaagaaacaaaataaagatccaaatgaagtgttgccttacaaagcaccgttttatccatttggaccaattattgtcattatagcgttattattcttatttgttggtaactcgttagatgctgctttatctggagattttgccgcactatttagaaatttagcacctatgattattttatttgtaatttatatcgttcacaaatttattaagaaaactaaaatcgtcaaactcagtgagatggatttgaagagacacgattataattaa

SEQ ID NO: 17314 - protein, 481 aa, Staphylococcus saprophyticus subsp. saprophyticus ATCC 15305
MAQNNMNRGLNSRHISMIAIGGAIGTGLFVATGNVISQAGPGGAILAYLIIGIMLYFLMSSIGELATFYPVSGSFSSYSTRFVDKSLGFTMGWLYWAIWLLVTSVDIIISSSVLYYWDTFQFFSPVTWSIIFLCLLFLLNIFSVKAFGETEFWLSLIKVVTIIVFILIGVLTIVGILGGKTYGLSNYTTGEAPFVGGISGFLGVLLVAGFSVGGTEVVAVTAGESSNPDRSMPKAIRQVFWRILLFYVLSIAVISAIIPYTDPMLLNKNESVSQSPFTIVFDRVGIAFAASVINAVILTSLLSAANSGIYTTSRMLFSMAEDRQAPKFLSKLNKTTKLPMTALIATFVIVLFIIILAQFKSDIVFSLLNIIGSLVIVIWASSILSQIRLRSAIKKQNKDPNEVLPYKAPFYPFGPIIVIIALLFLFVGNSLDAALSGDFAALFRNLAPMIILFVIYIVHKFIKKTKIVKLSEMDLKRHDYN

SEQ ID NO: 17315 - DNA, 1413 bp, Pseudomonas aeruginosa UCBPP-PA14
  CDS (1)..(1413)
atggctgacggcaaggaaaggctgcaactcacccgggccctggcgagccgccacatcttcatgctgtccctcggcggggtgatcggcaccgggctgttcatgggctccggcgtgaccatcaaccagggcggcccggccggcgcggtgctggcctacctggtggccggggtgctgatgtacctggtgatggtctgcctcggcgagctgtcggtgcagatgccggtctccggttcgttccaggcccacgcgacgcgtttcatcggcccggcgaccggcttcatgatcggctgggtctactggatgagctgggcctccacggtaggcctggaattcaccgcggccgggatgctcatgacccgctggttcccggaggtgcccgtgtggctatggtcgggtttcttcgtggtcgtgctgttctccctcaatgccctggcgacccgcgccttcggcgaggccgagtactggttcgccgggatcaaggtggcggcgatcctggtgttcatcgtggtcggggggctggtgatcttcggcggtatcgaactgaagagcggtgcgccggcgccgatgttctccaacctggtcggcgagcggctgttccccaacgggctgtcggcggtgttcgcggtgatgatgacggtggtctatgccttccagggttgcgagatcatgggcgtcgccgccggcgagaccgagcgaccggagaagagcatcccgcgggcggtgcgcaacgtggtgttccgcgtgctgatcttctacgtgctggccatcgttgtgctttccgccatcattccctggcaacaggccgggctggtggaaagcccgttcgtgcaggtgttcgacatggtcgggattccctacgcggcggacctgatgaacttcgtcatcctcaccgccatcctctcggtaggcaactcgggcctgtacgcctcgacgcggatcctctgggcgatgtccaggaccggcatggccccgcgcggcctgtcgaagctcagcgcgcgcggcgtgccgctctacgcgttgctgatcaccctgtgcttcgccctgctctcgttgctgaccagcgtgatcgccgccgacaccctgttcatggtgctgatggcggtgagcgggatgtccggcaccgtcacctggatcgtcatcgcctacgcccaataccgcttccgccgcgagcacatggccagcggcggcacggtcgccgagctgaaatatgccgcgccgctgttcccgctggtgccgctggcctgcatcgccgtgtgctgctcgctgttcgtcttcctcgccctcgatcccacccagcggccgtccttgtactggggcttcggcttcatcgccgcctgctacctggcctattacgtggttcgtcgccggcagccgcagggactgggcgaccccgccctgggacgggccggctga

SEQ ID NO: 17316 - protein, 470 aa, Pseudomonas aeruginosa UCBPP-PA14
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLVESPFVQVFDMVGIPYAADLMNFVILTAILSVGNSGLYASTRILWAMSRTGMAPRGLSKLSARGVPLYALLITLCFALLSLLTSVIAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 17317 - DNA, 1422 bp, Bacillus cereus G9241
  CDS (1)..(1422): transl_table=11
atgatggatcaaaaccaaggattaaaaagggaattgaaaagcagacacatatttatgattgcacttggaggagttattggtaccggactttttttaggatcggggtatacaattcatgaagctgggcctggaggagcgattgtagcgtatcttgttggaggatttgttatgtatttaacgatgctctgtctcggagaattagctgttgcgatgcctgacgcaggatcttatcaaacgtatgctacgaagcatatttcccctgcagcgggttatgtagtcggatggatgtcgtggctaaattggtcggctacaataggtattgaactaattgcagttagtattttaatgaaacgatggtttcctgatgtaccgtcttggatttggtgcgtagtgtttgcggcattactttttgctattaacgcgttatcttcaagaagttttgcagaagttgaattttggtttgcaagtattaaagtcattacaatcattgcatttattattttgggcggggcagcaatgtttggttttctagatatgaaaggaaatgaaccagcaccaatgttttctagctttactgattatggtgggttgtttccaaatggattatccgctattttaattacgatgattgctgttaatttttccttccaaggaacagagctggttggtattgcagctggggagagtgaaaatccagaaaaaacaatcccgaaggcaattaataatacagtttggcgtatacttgtgttctttgtattatctattttcattcttgcaggattattcccatggcaacaagcaggagtgatagaaagtccattcgtagttgtatttgataaaattggtattccttatgcagccgatattatcaatttcgttattattacagcagtactatccgttgcgaattcaggattatatgcaacttctcgtatgctatggtctatgtccaatcaaggaatgattagtccgatttttggtaagttatctaaaaatggtgttcctatttatgcgttgattgtaagtacaattgtaggttgtctttcattactatcaggtatttatgcggaagatacagtttatttatggctactttctattgccgggttcggagcgatattagtttgggcatctattgctctatctaacttattagctagaaggtcatatataaagcagggcggggatgtgaaagacttgaaatttaaaacaccgctgtatccgttcgtaccactgcttgcgttagtattaaatgtaacggtaattgttggtatggcctttattccagaacaaagaatggcattgtattgtggtattccctttatgattgtttgtttactgttttaccgtgcgacaagaaataaggggagtaacttagagcatattgaaaagacaaagacaacagaaatagagagtttataa

SEQ ID NO: 17318 - protein, 473 aa, Bacillus cereus G9241
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAALLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKGSNLEHIEKTKTTEIESL

SEQ ID NO: 17319 - DNA, 1362 bp, Bacillus cereus G9241
  CDS (1)..(1362): transl_table=11
atgattgcactcggtggtgtgattggaacggggttatttaacggatctggctttattataagtcaagctggacctggtggatccgtacttgcctttatggccggtggattattaatgtatttcgttatgctatgtcttggtgagctcgctgtagccatgcctgtttcaggctctttccaggaatatgccactaagtttattaatcctgcaactggctttacaatcggatggttgtattggttaagctgggcgaatacaaccggccttgaatttacaactgccggcattacaatgcagcgctggtttcctgatattcctgtttgggtttggtgtttaatatttggcgttacaatcttcacgattaacgcattatctgctcgtagttatgcagaaacagaattttggttttcaagtataaaagtatctgccattatcgcttttattattcttggcggcgccgctatgttcggttttattgatttaaaaggcgacgaaccagctccgctattatcaaatttcgtgaatcatggtggtttattcccaaatggacttgcagctatcctattaacaatggttacagtcaattattccttccagggtacagaacttgtcggaatcgctgcaggtgaaagtgaagatccagcaaaaactttacctcgttctattagaaatattatatggcgtacgatgtttttcttcgtcttagcaatctttgttcttgttgctttaattccttgggaagaagcaggattaacaaaaagcccgttcgttgccgtttttgataatatcggtattccatatgccgctgatattatgaactttgttattcttactgctgttctttctgtcgcaaactcaggtctatacgcggcaactcgcatgctttggtcattatccaaaaatgaaatggctccagcctttttaaagaaattatcatcacgaggaatacctttaaacgctttaattatgacgatagctatttctgctttttcccttttgacaagcgttgtagctgctgaaacagtttacttatggttaatttctatttctggcgtcataacaatcatcgtttggatgtcaatttgtgtctctcaattctttttccgtaaacattatttagcagatggtggaagattagaagacttaaaatttaaaactccactttatccacttgtaccaattcttggttttggattgtatgacattatactaatcagtcttatctttatccctgaacaacgacttggaatctattgcactgtaccatttatcatcttttgctacacttactatcactttaaagttaagaaaagaatttctactaacactcaaagtgaaactaaaattagcgagacgatgtaa

SEQ ID NO: 17320 - protein, 453 aa, Bacillus cereus G9241
MIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGRLEDLKFKTPLYPLVPILGFGLYDIILISLIFIPEQRLGIYCTVPFIIFCYTYYHFKVKKRISTNTQSETKISETM

SEQ ID NO: 17321 - DNA, 1416 bp, Bacillus cereus G9241
  CDS (1)..(1416): transl_table=11
atgaatcaacaagtagaacaaacagatttaaaacgtacaatgaaaagtagacacctatttatgattgcacttggtggtgttatcggaactggcctatttatgggatctggtcaaatcgtccataacgccggccctggtggtgctattcttgcatttttagtcggtggatttgttatgtatttaacgatgttatgtcttggtgaattatccgtagctatgccagaagcaggttcattccaaagctatgcaagcaaatttatttcacctggttttggttttgttgtcggttggatgtattggttaaattgggctgttacagttggagtagagttaacaactgtaagtattttaatgaaacgatggtttccagacgtttcttcgtggatttggtgtgttacatttgcggcagcactctttcttgtaaacgctttatcagcaaaagcatatgcagaagcagaattttggttcgcaagtgtaaaagtcgcaactattgttgttttcatcgtactcggtggtgcagttatgttcggtctactagactttaacggaaaaccagctccaatgcttcacaatttcactgaaaatggcggcctatttccaaatggtgcattagctgttcttcttacgatgattacagtaaattactccttccaaggaacagaattaatcggaattgcttcaggagaaagtgaaaatcctgaaaaaacaattcctaaagcaatcaaaaataccatttggcgcacactattcttcttcgtcctagcaatatcagttgttgtaggtttactcccgtggcaagaggctaatctagtcgaaagtccatttgtacttgtatttgatgtagctggtgttccatatgcagcagacattatgaactttgttattattacagctgtattatccgtagccaattctggtctatacgcaaattcgcgtatgctttgggcgatggcaaaacagggaatggcaagtccagcatttacgaaattaactaaaaaaggtgtaccactaaacgcattgattttcagtctaatctttgcaagtctatccctattaacaagtgtatttgcagcagatactgtctttttagttttaacatctatcgcagcaatggctgctgttgtcgtttggatgtcaattgcggcttcacagtttttcttccgtagaaacttcgtgaaaaacggtggtgacataaatgatttaaaatatcgcacaccactttatccgctcgttccaatcgtagcgttctcactcaatttcattacatttgttagtttagctttcattccagatcagagaattgctctttattgcggcattccatttatggtcatttgttacattttatatcaagtgaaatataaaaaaattgtcacatttgaacaacaacagactattccacaagaaataaactaa

SEQ ID NO: 17322 - protein, 471 aa, Bacillus cereus G9241
MNQQVEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVVFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGDINDLKYRTPLYPLVPIVAFSLNFITFVSLAFIPDQRIALYCGIPFMVICYILYQVKYKKIVTFEQQQTIPQEIN

SEQ ID NO: 17323 - DNA, 1458 bp, Arthrobacter sp. FB24
  CDS (1)..(1458): transl_table=11
atggaactttcctccacaacccgcttggatccgcaggcttctttaccgcctgaatcggaacccgctgcgccagagcgcggtccggcgccggggctccagcgatccatgggcccgcggcacctggtgatgatcgccatgggcggcgtcatcgggtcgggccttttcctcagttcgggctacacgatctcccaggccggcccgctgggcgcggttctggcgtatctcgtgggcgccttcgtcgtttacctcgtcatggcctgcctcggggaactggccatcgcctacccggtctcgggcgcgttccacatctacgcggccagatccatcggtcccgccaccggtttcaccacagcgtggctttactggctgtgctgggccgtggcgctgggatccgagttcaccgcggccggcctgctcatgcagcggtggttcccgggaattgaggtgtgggtctggtgcgtcgttttcgcgtccatcctgtttgccctgaacgccgtctcttcgcggttcttcggcgaatccgagttctggttctccatcatcaaggtgggcgccatcgtggtcctgattgcctttggcagcgccgcactggtcggcttccacccgctggccggcggctcccacccgttcctgctcgaaaacttcaacacgtcgggcggactattccccaacggcttttccggcgtcctggtgactgccctggcggtcttctacgcgttctccggttcggaactcatcggcgtcgcagcgggcgaaacggccaaccccgagacaagcattcccaaagcaatgcggaccacggtgttccgcctgctcatcttctttgtaggcgccatcgcagtcatcgccgccaccatcccctttgaccaggtaggcctggacgagagccccttcgtcaccgtcttttcctccatcggcatcccctatgccgcggacatcatgaacttcgtcatcatcaccgcgctgctctccgccggaaacagcggcttgttctcctgcgcaaggatgctcttttccctgtccgaggaagggcacgcgccgaaggcattccggaagctcaccaaacgcgggattcccctcatcgccctctgcgtcagcatggtcggcgggctggcttcgctcatcagcagcgtggtcgctccggaatcggtctatctcgcgctggtttctgtcgccgggttcgctgttgtgggggtatggatgtccatcacggcgtcgcacttcttccacaggcgggccttcgttcggaacggcggaaacgtcgacgacctcgcctacaaggcgccgctgttcccggtggttccgatccttgccttcgcgctgtgcctcatctcgctgatcggcatcgctttcgacccgaaccaggtcgcagccctgtacttcggcattccgtttgtgggtgcctgctacgccttcttctactacaagtacggacggcggcagcagctcgccaagtag

SEQ ID NO: 17324 - protein, 485 aa, Arthrobacter sp. FB24
MELSSTTRLDPQASLPPESEPAAPERGPAPGLQRSMGPRHLVMIAMGGVIGSGLFLSSGYTISQAGPLGAVLAYLVGAFVVYLVMACLGELAIAYPVSGAFHIYAARSIGPATGFTTAWLYWLCWAVALGSEFTAAGLLMQRWFPGIEVWVWCVVFASILFALNAVSSRFFGESEFWFSIIKVGAIVVLIAFGSAALVGFHPLAGGSHPFLLENFNTSGGLFPNGFSGVLVTALAVFYAFSGSELIGVAAGETANPETSIPKAMRTTVFRLLIFFVGAIAVIAATIPFDQVGLDESPFVTVFSSIGIPYAADIMNFVIITALLSAGNSGLFSCARMLFSLSEEGHAPKAFRKLTKRGIPLIALCVSMVGGLASLISSVVAPESVYLALVSVAGFAVVGVWMSITASHFFHRRAFVRNGGNVDDLAYKAPLFPVVPILAFALCLISLIGIAFDPNQVAALYFGIPFVGACYAFFYYKYGRRQQLAK

SEQ ID NO: 17325 - DNA, 1404 bp, Exiguobacterium sp. 255-15
  CDS (1)..(1404): transl_table=11
atgcagttaaaaagagaaatgacaagccggcatctcttcatgatttcactcggagggattatcggtacgggactgttcctcggttccggattaacgatttcgcaagcaggaccgctcggggcggtcctcagttacatcgtgggtgggaccattatgtatctgacaatgttatgtttaggagagatggctgtccatatgccggtttccggatcatttcaaacgtatacgacacgtttcatcggaccgggtatcggatttgccgtcggctggatttactggctcggatgggccgtgacggtggcacttgaaatcacggcagccggaagtctgatggatcggtggtttccgaacacccctatcgtcatctggtgtgccatcttcaccgtcattttattcggacttaacgccgtatctgccaaagcctttggggaggctgaattctggttctcgagcctgaaagtcctggccattctatttttcatcgcgctcgggggagcggcttggtttggctggattgatatgacggcagcacgcccggaaagtttattcgccaactttacttcaaacggattgttcccgaacggtgcgctcggagtcttgacgacgatgatcgccgtcaacttcgcattccaggggacggaactgatcggggttgcggccggagagtcgaacgatcccgaaaaatcgattccgaaagcgatccgcaatacggtttggcggacgttcatcttttttgttctttcgattacaatcgtcggcgccttgattccttatgaaacagccggcggtatcagcagtccgttcatcatggtctttgatgcgatcgggattccgtacgcggccgatttgatgaacatcgtcgttctgactgccttactgtcggtcgggaactcgggattatacgctgctacccggatgttatggtcgatgtctcaagaaggcatgatttcgaaaaaacttgcgatcgtcaactcgcgtggtgtaccgatgcgggcgttatgttttacgatgctgtttgcgatgttatcgcttctgaccgcctttttcgcggaagataccgtcttcatctggttgttgtcactagcaggactcggtgcacaagtcggatggatttcaatttccgcttcgcagattgcgttccgtcgtcaattcatcaaaaacgggcatactgtcagtgaattaaaattcaagacaccgttcttcccggtcttgccgatcatctcgttttctctgaatatgctcgtattgatcagcttggcgtttcaggcggatcaacggattgcgctgtatatcggtgttccgttcttcctcttgacatggggttgttaccatctgttcgtcaaaggaaaacatattgcagctcaaaccgagcgtcaggcagccagttccacgttagaatcttga

SEQ ID NO: 17326 - protein, 467 aa, Exiguobacterium sp. 255-15
MQLKREMTSRHLFMISLGGIIGTGLFLGSGLTISQAGPLGAVLSYIVGGTIMYLTMLCLGEMAVHMPVSGSFQTYTTRFIGPGIGFAVGWIYWLGWAVTVALEITAAGSLMDRWFPNTPIVIWCAIFTVILFGLNAVSAKAFGEAEFWFSSLKVLAILFFIALGGAAWFGWIDMTAARPESLFANFTSNGLFPNGALGVLTTMIAVNFAFQGTELIGVAAGESNDPEKSIPKAIRNTVWRTFIFFVLSITIVGALIPYETAGGISSPFIMVFDAIGIPYAADLMNIVVLTALLSVGNSGLYAATRMLWSMSQEGMISKKLAIVNSRGVPMRALCFTMLFAMLSLLTAFFAEDTVFIWLLSLAGLGAQVGWISISASQIAFRRQFIKNGHTVSELKFKTPFFPVLPIISFSLNMLVLISLAFQADQRIALYIGVPFFLLTWGCYHLFVKGKHIAAQTERQAASSTLES

SEQ ID NO: 17327 - DNA, 1686 bp, Uromyces fabae
  CDS (1)..(1686)
atgattcttattcaaaaaaaagatcaaaaaaatgattcatttcgcatagaggacgaattagaaaagcacgcaaaccaagcttactatgagtccacagaagtcaacgcatcttcttctcctactggagatggtgcggttggcgaaaatacagttcatcgagctctcgaacaaagacacataagcatgattgcaatcggtggtacaattggaaccggtctattcttgggaatgggagaagcacttaacaaaggtggacctttaggtttgatactaggttacatggtgatgggacttgttgtctacgccatgacgattgcgctgggcgagatggtcacaatgtttccagtctctggttcatttactcattatccatgtcgctttgttgatccagcccttggatttgctgtcggatggaattattggtattcattgaccatcgcagttccaagtgaggttattgccgccaccattgtcgtagaatattggaaggccccagtgaacaaggtcgtttggatcatcacgtttattgttcttagttgtggaatcaatttcttcggagtgagatggtacggagagactgaattcgcattcgctgcggtcaaagtcgtagccatcattgtacttattcttgtgggcatcgtaattgatatcggcggagggcccactcatgagagaattggatttcgccatttcattgaccctggaccattcaaccaattgcacggaatacctggagctcttgggagatttttggccttctggtctgtatttactcaggcaagtttttcgtacatgggtacagaaatggtagctattacggccggtgaagctgccaatcctcgcaaaactgtgcctaaggctatcgagagagttttctacagaatactagtattttacttgggtagcacactcgttgtcggccttctagttccttattcatccccacaacttttaggaagcaccggcgatgctagttcatcaccattcgtgattgcaatcaatcgagccggtatcaccgtactccctgacatgatcaatgtggtgatattactatctgctatttccacggcgagctccaaactttatggtggtagtcgagtgttgtatggactgtcgaaagatgggatggcgcctagatttttctcaaagtgtaacgcttctggattgcctatgtggtctctacttgctaccagtagcaccgcggctctctcttttatgtgtctaaatagtaaagcaggtgttgctttccaatggttccaaaacctttcagccatgactgggatactaacctggtggacagtcttagtgtcatatgtattgttctatcaaggtctcaaggttcagggtcttagccgcgacaaattgcattacaaagccccatttcaaccgtatgcttcttggattgcattggctatgcttactctgatcatgtttatgagtggatttgagacattcctgaaaggaggatggtcgatttcggattttctagccaattatttaacattaccgattttcctaggattttacttgtactggaaaatatctacacgatccaaatttgtgagctcgaaacatgtggactttgttactggaacacgtgaattgaatgaaatggacgcgcaggagagagaaaaggagatcattccaaccacgaaatggggaaaatttattgacaagttgctctga

SEQ ID NO: 17328 - protein, 561 aa, Uromyces fabae
MILIQKKDQKNDSFRIEDELEKHANQAYYESTEVNASSSPTGDGAVGENTVHRALEQRHISMIAIGGTIGTGLFLGMGEALNKGGPLGLILGYMVMGLVVYAMTIALGEMVTMFPVSGSFTHYPCRFVDPALGFAVGWNYWYSLTIAVPSEVIAATIVVEYWKAPVNKVVWIITFIVLSCGINFFGVRWYGETEFAFAAVKVVAIIVLILVGIVIDIGGGPTHERIGFRHFIDPGPFNQLHGIPGALGRFLAFWSVFTQASFSYMGTEMVAITAGEAANPRKTVPKAIERVFYRILVFYLGSTLVVGLLVPYSSPQLLGSTGDASSSPFVIAINRAGITVLPDMINVVILLSAISTASSKLYGGSRVLYGLSKDGMAPRFFSKCNASGLPMWSLLATSSTAALSFMCLNSKAGVAFQWFQNLSAMTGILTWWTVLVSYVLFYQGLKVQGLSRDKLHYKAPFQPYASWIALAMLTLIMFMSGFETFLKGGWSISDFLANYLTLPIFLGFYLYWKISTRSKFVSSKHVDFVTGTRELNEMDAQEREKEIIPTTKWGKFIDKLL

SEQ ID NO: 17329 - DNA, 1719 bp, Neurospora crassa
  CDS (1)..(1719)
atgtccgacatagaaaaagggtcagcgggctcccacgacaaggagacccgcgtcgacgcggccactcttcccgcctatgaggccggcagcgtcgccgaggcgcaacaggaggacttcatgacgcgcaacggtctcaacctcgcctccttcaagccccgccggttccacacgggcgacggcaccgagatcgagcgcaccatgaagtcccgccacctgcacatgatcgccattggcggctccatcggcgccggtttctttgtcgggtccggcaaggcgctgcacaacggcgggccggcgtcgctgctgattgatttcgccatcatcggcgtcatgatgttcaacgtcgtgtacgccctgggtgagctggctgtcatgtttcctgttaccggtggcttctacacctactcgactcgctttatcgatccgtcttggggtttcgccatgggttggaattatgttttccagtgggcgatggtcttgcctctggaacttaccgtttgcgggtttacggtcgggtactggaatcaggacataaccgtctggatcaccaccttcctcgtcgccatcatcatcatcaacgtcttcggcaccctcggctacgccgaagaggaattctgggcttcggcattcaagctcggcgcaaccattgtcttcctcatcatctgcctcgtcatggtcctcggcggcggtcccaaaggcagccgctacgaccactacaccggtgccgccctgtggtactcccccggcgccttcgccaacggctttagggggttctgctcctgcttcgtcactgcggcttttgccttttcgggcaccgaactcgtcggtctcgctgctgccgaggacaaaaaccccgtcaagtcccttcccggcgccatcaagcaagtcttttggcgcatcaccctcttttacatcctcggtctcttcttcgtcggcttgctcatcccctatgacgacgagaacctgttgggcgctaacccgttcatcaacgtcaacgcttccccctttgtgctggtgggcaagtacgcgaacctgacgggcttcgactcgttcatgaatgtggttattctggtgtcggtcctctcgctcggtgtctcgtgcgtctatggtggctcgcgcaccttgactgccctcgctcagcaggggtacgcgcccaagatctttacgtacgttgatcgttccaaccgcccgctgttctcggtcctgctcattattgcgtttggccccctggcgtatgtcaacttggcggctgctggtccgaccgtgttcgattggttgctttcgctttccgggctggcggcgctgttcacgtggggatcgatttgcttgagccatattcgctttcgcaaggcgtgggcgctcaagggacatagtgtggaggagatcccgttccgggctgcgggcggtgtgtggggatcgtggctggggttggtgttggttgttttggtgttgattgctcagttctacgtagccatctgcccacccggcggcggcttcaacacggtcgagggcttcttcgtgcagtacctcgccttgcccgtcgtcatcgtcttctggatcggtggattcatctggaagcgcacgagctggctccgcgttgatcagatcgatgttgacacgggccgtcgcgaacatgattgggagtcgattaatgcgtaccaagctgagttggctgctatgcctgcttggaagaggtggttccataagttgtttgtctga

SEQ ID NO: 17330 - protein, 572 aa, Neurospora crassa
MSDIEKGSAGSHDKETRVDAATLPAYEAGSVAEAQQEDFMTRNGLNLASFKPRRFHTGDGTEIERTMKSRHLHMIAIGGSIGAGFFVGSGKALHNGGPASLLIDFAIIGVMMFNVVYALGELAVMFPVTGGFYTYSTRFIDPSWGFAMGWNYVFQWAMVLPLELTVCGFTVGYWNQDITVWITTFLVAIIIINVFGTLGYAEEEFWASAFKLGATIVFLIICLVMVLGGGPKGSRYDHYTGAALWYSPGAFANGFRGFCSCFVTAAFAFSGTELVGLAAAEDKNPVKSLPGAIKQVFWRITLFYILGLFFVGLLIPYDDENLLGANPFINVNASPFVLVGKYANLTGFDSFMNVVILVSVLSLGVSCVYGGSRTLTALAQQGYAPKIFTYVDRSNRPLFSVLLIIAFGPLAYVNLAAAGPTVFDWLLSLSGLAALFTWGSICLSHIRFRKAWALKGHSVEEIPFRAAGGVWGSWLGLVLVVLVLIAQFYVAICPPGGGFNTVEGFFVQYLALPVVIVFWIGGFIWKRTSWLRVDQIDVDTGRREHDWESINAYQAELAAMPAWKRWFHKLFV

SEQ ID NO: 17331 - DNA, 1494 bp, Staphylococcus aureus
  CDS (1)..(1494): transl_table=11
atgtcaaaagttcaaaatgaaagtaacaatgttgtcaaaaggggacttaaagatcgtcatatttctatgattgcgattgggggttgtattggtacaggtttatttgtaacttctggtggagcaattcatgatgcaggtgctttgggtgcattaataggatacgcaattatcggaataatggtatttttcttaatgacgtcacttggtgaaatggctacgtatttaccagtatcaggttcatttagtacatatgctacaagatttgttgatccatctttagggtttgcgcttggttggaactattggtttaactgggtagtaactgtagcagcagatattacgattgcagcacaagtcattcaatattggacaccattgcaaggcatacccgcttgggcatggagtgcgttgtttttagttataatttttagtctgaattcgttatcagttcgcgtctatggtgaaagtgaatactggttggcattgataaaagtgattacagttattgttttcattgcaattggtttattaacgattgtaggaatcatgggtggtcatgttgtaggatttgaaatatttaataaaggtgaaggtcctattcttggtggcaacttaggaggaagtttgttatcaattctaggtgtattcttaatcgctggtttctcattccaaggtactgagttaattggtattacggctggtgaatcagaaaatcctgaacgtgctgtgccgaaagcaattaaacaagtattctggagaattttattattttacattttagccatttttgttatcggtatgttaattccttatgatagtagtgcattaatgggtggtagtgataatgtagcaacgtctccattcacattagtgtttaaaaatgcaggatttgcttttgcagcatcatttatgaatgctgtcatcttaacatcagttttatcagcaggtaactctggaatgtatgcctcaacgcgaatgctttattcaatgagtaaagataaattagcgtttgaagcatttgggaaaacaaataaaaatggcgtgccatatatgtctttattagttactgcaattattgtagtcattatattggtattacaaagtcttacaaaaggtgcttacgaatacatcgttgctgcaagtgggttaactggctttattgcctgggtaggtatcgcagtgagtcattaccgatttagaagagcatttgataaacaaaattatgataaatctaaattgaaatatacagctaaattattcccgttcggacctttatttgcaggctttttatgtattgtagtaatcatcgggcaagatgttgactttattaaaacaggagattttaattttagtcgcttcttaattacgtatatgggaatcccagtatttttagcattctttatttatcataagcttcgatataaaacgaagaaaattccattagaacaagtagatttacgtcaagacgtgtcaatggatgaaataaaaggttaa

SEQ ID NO: 17332 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIILVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 17333 - DNA, 1746 bp, Saccharomyces kluyveri
  CDS (1)..(1746)
atgtcctttatccaagacagttatcgtaaggatctggagaaaatcgtctccaactcaaacaccacatctaaggatgtcgaaaatttggacctttccaaccaagatgatatctcatctcaagaatcccatttaaatattgacggtaagcatgacggtatccgtttgaaaaaagaattggaagcccgtcacgtttctatgattgccatcggtggttctttgggtaccggtttgttgattggtactggtacctccctttcccttgctggtcctgtttctattttgatcgcttactcctttgtcggtttcttggtctacattgttatgacatgtcttggtgagatggccacctacattccattggatggtttcacaagttatgcatcccgttactgtgacccagctttgggttttgccgttggttattcctaccttttcaaatacctgatcattacaccaaatcaattgaccgctgccgctttggtcttgcagtactgggtgtccagagagaaggtcaacccaggtgtctggattaccattttcctggttattattgtcacgatcaacgttgtaggcgtcaaattctttggtgaatttgaattttggctatcgagtttcaaagttcttgtcatgctgtgtctgatcgttctgctatttgttataatgttgggtggtggcccatcccatgaccgtttgggtttcaggttttacaaggatccgggtgcgttcagaccttattcagaagccatcagtggttccaagggtaaatttgtctcttttgtcgcagtctttgtttacgctttgtttgcatacttgggtaccgaattgtgtggtattgtcgctgcagagtgtaagaacccaagaagaaacgttcctcgtgctatcaagttgacgctgtaccgtatcgttgttttctaccttgtcaccatcttcttgttgggtatgactgtcgcttacaacgatccattgttgctacaagccaagaagaagtctacttctgccgctgcttctcccttcgtcgttgccatcaagaatgcaggtatcccagttttgccacacatcttcaacgcatgtgttttgatgttcgttttcagtgcttgtaactcggacttgtacgttgcttctagaagtttgtacgggttggccattgacaacaaggcaccaaagattttcgccaagactaacaagtggggtgttccatacaactctttgatcttgtgtatcctgttctgtctattggcttatatgaacgtgtcttctggttccgctcaagtcttcaactatttcgttaacgttgtgtctatctttggtttgatgagttggatcgccattttgattacctacatctacttcgacagggctttaagagcacaaggtgtggataaatctacgctagcttatgccgcaccactagcatccaaaggtgcttatttcgctttgtttttctgctgtttgattgctttgattaagaatttcaccgtatttttgggtcacaaatttgactacaagaatttcatcaccggctatattggtatcccagttttcatcatctgtttctttggttacaaatacatccgtggtaccaaattcgttaaaccagaggaagctgacttgtacactttcaaagaacttatcgacttggaagaagaagaaggtaagctttgggacgctgcacaaaaggaaaagatggaaagctctccaaagaacttcaaatggttttacgaaaagtttttgggctggatcttttaa

SEQ ID NO: 17334 - protein, 581 aa, Saccharomyces kluyveri
MSFIQDSYRKDLEKIVSNSNTTSKDVENLDLSNQDDISSQESHLNIDGKHDGIRLKKELEARHVSMIAIGGSLGTGLLIGTGTSLSLAGPVSILIAYSFVGFLVYIVMTCLGEMATYIPLDGFTSYASRYCDPALGFAVGYSYLFKYLIITPNQLTAAALVLQYWVSREKVNPGVWITIFLVIIVTINVVGVKFFGEFEFWLSSFKVLVMLCLIVLLFVIMLGGGPSHDRLGFRFYKDPGAFRPYSEAISGSKGKFVSFVAVFVYALFAYLGTELCGIVAAECKNPRRNVPRAIKLTLYRIVVFYLVTIFLLGMTVAYNDPLLLQAKKKSTSAAASPFVVAIKNAGIPVLPHIFNACVLMFVFSACNSDLYVASRSLYGLAIDNKAPKIFAKTNKWGVPYNSLILCILFCLLAYMNVSSGSAQVFNYFVNVVSIFGLMSWIAILITYIYFDRALRAQGVDKSTLAYAAPLASKGAYFALFFCCLIALIKNFTVFLGHKFDYKNFITGYIGIPVFIICFFGYKYIRGTKFVKPEEADLYTFKELIDLEEEEGKLWDAAQKEKMESSPKNFKWFYEKFLGWIF

SEQ ID NO: 17335 - DNA, 1662 bp, Saccharomyces castellii
  CDS (1)..(1662)
atgcatcaccgcactccctcacctcacatgaaattaaaccagccacaggtccattcattccaagtggactccaatgacacacccaccaccatttccactctggacgacgaccaggaaaagcaacaggatgtaaagagagaactaaagaaaagacacatctccatgattgccctaggtgggaccatcggcacgggactgtttttggggattgcacgtccactcattatcgcaggtccaataggtgcattgatcgcatatcttttcatgggaaccgtcgtattctctgtcactcaatcattgggtgaaatgtgcactttcatcccagtaacagcatcattcaccgtctttgcccaaagattcttatcccccgcattcggtgctgctaatgggtacatgtattggttctcctgggcaatgacctttgccctagaattatctgtggtgggccaaattattcaattctggaccatggcggtccccctagcagcctggatttccatcgtttgggtcctcttgacaatttctaacttattcccagtacgcatctacggtgaaattgaattctggatcgcttctgtcaaagtactggccatcctggggttcatcatttatggtatttgtatcatttgtggtgctggtgtcacaggacccgtcggtttcagatattggaagaatccaggaccttggggcatggggatcatttcttccaatgtcaatgaggcaagattctttggttgggtctcgtctttaatcaatgcagcattcacgttccagggaactgaattggtgggcatcactgccggtgaagccaagaatccaagaaagactgtccccaaggcaattaaaaaagtcgtctttagaattctggtcttctacattggttcactactagtcattggattgttggtcccatataatgatcccaaattacaaagtaatgacagctatgtctcctcgtcacctttcatcattaccatccaaaacgcaggaaccaagatcctaccacacattttcaacgctgtcattctcataaccatcatttcagcgggcaattcaaacgtttacattgggtccaggatattgtatggcttggctaaaaacaaggcagcacccaaattttttacaaacacatccaaagctggtgttccctatgtgactgtccttttcacttccatgtttggatccctagcatacatggaaaccaccacgggaggagacaaggctttcacatggttgttaaatatcgtaggagtagcagggtttttcgcctggttattgatttcttgttctcatatccgtttcatgaaggctttgaagcaaagaggaatttcaagaaatgatttgccctataaggccatgctcatgccatggctagcgtattatgccgtgttcttcatggttataataatcgtcatccagggattcacctcttttgccccgaaatttaaagtggcaaacttctttgcagcttatatttctgtctttttatttattatattttgggtcgcctttcaaatatggttcaaatgtcgattggtttggaagttgcaggatgtggatttggatacagatagaagggacattgaagaggaggtatggagtgatgatgtggaagacaagaacaagaattggtgggaccgtttttggaattacgtagcataa

SEQ ID NO: 17336 - protein, 553 aa, Saccharomyces castellii
MHHRTPSPHMKLNQPQVHSFQVDSNDTPTTISTLDDDQEKQQDVKRELKKRHISMIALGGTIGTGLFLGIARPLIIAGPIGALIAYLFMGTVVFSVTQSLGEMCTFIPVTASFTVFAQRFLSPAFGAANGYMYWFSWAMTFALELSVVGQIIQFWTMAVPLAAWISIVWVLLTISNLFPVRIYGEIEFWIASVKVLAILGFIIYGICIICGAGVTGPVGFRYWKNPGPWGMGIISSNVNEARFFGWVSSLINAAFTFQGTELVGITAGEAKNPRKTVPKAIKKVVFRILVFYIGSLLVIGLLVPYNDPKLQSNDSYVSSSPFIITIQNAGTKILPHIFNAVILITIISAGNSNVYIGSRILYGLAKNKAAPKFFTNTSKAGVPYVTVLFTSMFGSLAYMETTTGGDKAFTWLLNIVGVAGFFAWLLISCSHIRFMKALKQRGISRNDLPYKAMLMPWLAYYAVFFMVIIIVIQGFTSFAPKFKVANFFAAYISVFLFIIFWVAFQIWFKCRLVWKLQDVDLDTDRRDIEEEVWSDDVEDKNKNWWDRFWNYVA

SEQ ID NO: 17337 - DNA, 1773 bp, Saccharomyces bayanus
  CDS (1)..(1773)
atgacgacgcctaagcaagactctgaagtagaggaaaaacacatgtacactgagccggccggaacgttctttcatgacgtcgaagcctctcaaactcatcacaggcgtggatcattgtcgctgaaagatgagaagagcaaggaactgtatccattgcgctcctttcccaatggagtcaatggccaggacactttctcgatggaggaagatatacaggacgaagacgagggcgaagtgcagaatgcggaggtgaaaagagaacttaaacaaaggcacatcggtatgattgcccttggtggtaccatcggtaccggtctgttcatcggtctatctacacctctaacgaacgccggccccgtgggtgctctgatatcctatttattcatgggttcgttggcttactccgtcactcaatcactaggtgaaatggccacattcattccagtcacatcttcgttcacggtcttttcgcaaagatttctgtcgcctgcatttggtgcagccaacggttacatgtattggttttcttgggccgtcacctttgccctggagcttagtgtggttggacaagtcattcaattttggacgtacgccgtcccattggcagcatggattagtattttctgggtgatcatcaccgcaatgaacatgttccccgttaaatattacggtgaatttgaattctgggtcgcctctatcaaagtcatcgccattatcgggtttttgatctactgtttttgcatggtctgtggtgctggtgtcaccggcccagttgggttccgttactggagaaacccaggtgcatggggcccaggtattatctccaagaataagaacgaggcaaggttcctaggttgggtttcctctttgattaatgctgcgttcacattccaaggtactgaattggttggtatcactgctggtgaggccgccaacccaagaaaaactgttcccagagccatcaagaaggttgttttccgtatcttgaccttctacatcggatccctattgttcattggtcttttggtgccatacaacgatcctaaattaacctctgccacctcttatgtctccacttctccatttattattgccattgaaaactcaggtacaaaagtattgccccatatattcaatgctgttatcttaacaaccatcatttccgcagcaaattcaaatatttatgtgggctctcgtgtcttatttggtttatccaaaagcaagttggctccaaagtttttttcaaaaaccacaaaaggtggtgtcccatatattgcggttttcgccacttccatatttggtgctttagcttacatggaaacttccaccggtggtgggaaagtattcgcatggttattgaatatcactggtgtcgctgggttcttcgcttggttgtttatctcggtatctcatatcaggttcatgcaagctttgaaataccgtggcatttctcgtgatgaattgccattcaaagccaaactaatgcccggattggcttattatgctacttttttcatggtagttattatcctcatccaagggttcacctcttttacaccaacattcaacggtgttaatttccttgccgcctatatttctgttttccttttcttggcaatttggattctatttgaactgatatttagatgcagatttgtctggaaaatcgaagacgtggatatcgattctgacagaagagacatcgaagccattgtgtgggaagaacctgagccaaagaccctttgggacaagttttggaatgttgtaggttaa

SEQ ID NO: 17338 - protein, 590 aa, Saccharomyces bayanus
MTTPKQDSEVEEKHMYTEPAGTFFHDVEASQTHHRRGSLSLKDEKSKELYPLRSFPNGVNGQDTFSMEEDIQDEDEGEVQNAEVKRELKQRHIGMIALGGTIGTGLFIGLSTPLTNAGPVGALISYLFMGSLAYSVTQSLGEMATFIPVTSSFTVFSQRFLSPAFGAANGYMYWFSWAVTFALELSVVGQVIQFWTYAVPLAAWISIFWVIITAMNMFPVKYYGEFEFWVASIKVIAIIGFLIYCFCMVCGAGVTGPVGFRYWRNPGAWGPGIISKNKNEARFLGWVSSLINAAFTFQGTELVGITAGEAANPRKTVPRAIKKVVFRILTFYIGSLLFIGLLVPYNDPKLTSATSYVSTSPFIIAIENSGTKVLPHIFNAVILTTIISAANSNIYVGSRVLFGLSKSKLAPKFFSKTTKGGVPYIAVFATSIFGALAYMETSTGGGKVFAWLLNITGVAGFFAWLFISVSHIRFMQALKYRGISRDELPFKAKLMPGLAYYATFFMVVIILIQGFTSFTPTFNGVNFLAAYISVFLFLAIWILFELIFRCRFVWKIEDVDIDSDRRDIEAIVWEEPEPKTLWDKFWNVVG

SEQ ID NO: 17339 - DNA, 1836 bp, Saccharomyces bayanus
  CDS (1)..(1836)
atgggcaagtttagaaatataatatcgtccaaaaaatgggacgaggagcaggacaattccgaggaacagagcatacgggacgactcgacaaatcagatagaacatgagatggaggtgatagacacatccaacaagccggtcgcatactccattgacgagaaacaggacaatttgaagaagaagagcgggttgatgctagatggcaccattggtgacataaattcgatcacgaactcgttaacgaggtcccaaattgcctcgcacgagcaaggtggggacgacgaagaagaggaggctcactacgaagacaagcacgtcagaagagccttgaagcagagacacattggtatgatcgcgctcggtggtaccatcggtactggtcttttcgtcggtatctccacccccttgagcaatgcaggccccgtcgggtccctgattgcttatattttcatgggtacagtggtttacttcgtaacacagtcgctgggtgaaatggccacttttatccccgtgacgtcatccatcacagtcttctcaaagaggtttttatcacctgcattcggtgtttccaacggttacatgtactggttcaattgggccatcacgtatgcagtggaagtctccgttattggtcaagtcattgaatactggacaacgaaagttcctttgggggtttggattgccatattttgggtccttatcactctaatgaattttttccccgttaaagtttatggtgagtttgaattctgggtggcatcggtaaaagtcctggccatcatggggtacttgatatacgccttggttatcgtctgtggtgggtccaaacaaggtcctattggtttcaggtactggagaaatccaggtgcttgggggcccggtatcatctccagtgacaagaatgaagggcgttttctcggttgggtctcctctttgatcaacgccgccttcacgtaccaaggtactgaactggtcgggatcactgctggtgaagccgccaacccaagaaagaccgtccctagagctatcaacaaagttgtcttcaggattgtacttttttatatcatgtctttgttcttcattggtctcttggtcccatacactgacccccgtctatccgccagttccgctgtcattgcatcatcaccatttgtcatttccattcaaaacgctggtacttatgctttgccagacattttcaacgctattgtcttgatcactgttatctctgccgctaactcaaacgtttacgttggttcccgtgttttgtactctttggcccagaccggtaacgctccaaagcaatttggatacgtcactaaacaaggtgttccataccttggtgtcttgtctacagctgcattgggtcttttggccttcctggttgtcaacaacaacgccaacaccgcattcaactggttgatcaacatctccactttggctgggttatgtgcttggttattcattagtttgtcacacatcagattcatgcaagctttgaatcaacgtggtatctctcgtgatgatttgcccttcaaggctaaattcatgccctacggtgcctactacgcgtcctttttcgtcactgtcatcattttcattcaagggtttcaatcattctgtccattcagagtggccgacttctttacgtcctacatttccttaattcttttggctgtcgtgttcactggttgccagctatactacaaatgtagattcatttggaaactggaagacattgatatcgactctgacagaagagaaatcgaagctatcatttgggaagacgatgagccaaagaatttgtgggagaaattctgggcagccgttgcataa

SEQ ID NO: 17340 - protein, 611 aa, Saccharomyces bayanus
MGKFRNIISSKKWDEEQDNSEEQSIRDDSTNQIEHEMEVIDTSNKPVAYSIDEKQDNLKKKSGLMLDGTIGDINSITNSLTRSQIASHEQGGDDEEEEAHYEDKHVRRALKQRHIGMIALGGTIGTGLFVGISTPLSNAGPVGSLIAYIFMGTVVYFVTQSLGEMATFIPVTSSITVFSKRFLSPAFGVSNGYMYWFNWAITYAVEVSVIGQVIEYWTTKVPLGVWIAIFWVLITLMNFFPVKVYGEFEFWVASVKVLAIMGYLIYALVIVCGGSKQGPIGFRYWRNPGAWGPGIISSDKNEGRFLGWVSSLINAAFTYQGTELVGITAGEAANPRKTVPRAINKVVFRIVLFYIMSLFFIGLLVPYTDPRLSASSAVIASSPFVISIQNAGTYALPDIFNAIVLITVISAANSNVYVGSRVLYSLAQTGNAPKQFGYVTKQGVPYLGVLSTAALGLLAFLVVNNNANTAFNWLINISTLAGLCAWLFISLSHIRFMQALNQRGISRDDLPFKAKFMPYGAYYASFFVTVIIFIQGFQSFCPFRVADFFTSYISLILLAVVFTGCQLYYKCRFIWKLEDIDIDSDRREIEAIIWEDDEPKNLWEKFWAAVA

SEQ ID NO: 17341 - DNA, 1713 bp, Saccharomyces bayanus
  CDS (1)..(1713)
atgagtaaaaatgtggacattagcgtgtccaaagagggtcaatacgaacttaactccatctccacgataaaggaggaggagctggtagacgtccagtacgatggacagggtgccccggcggctatcgccgccggggggtgcattgcgaacgacgatgccaaggcggcagaggcgctaccccgggaggtgaaacggaacttgaagcagcggcatatagggatgattgctctgggaggcaccatcggcacgggcctcataataggtatcggtccgccgctggcgcatgcgggtcccgttggcgccctgatatcgtatatattcatggggaccgtcatttactcggtgacacagtcactgggggagatggcaacattcatacccgtgacgtcctcgttctccgtctttgcacagaggttcttgtcgcctgcccttggcgccaccaacggctacatgtactggctgtcgtggtgcttcaccttcgcactggaactatctgttctggggcaaatcatccagtattggacagatgctgtgcctctgtccgcttggatcgtaattttctggtgcctgctcacgctgatgaacatgttcccagtgaagtactacggggagttcgagttttgtattgcttccataaaggttatcgcgctgctcgggttcatcatctactcgttttgcatggtatgtggtgccggacagccggatggacccatcggattcaggtactggagaaatccaggagcctgggggcccggtatcatctccagtgacaagaacgaagggcgttttctcggttgggtctcctctttgatcaacgccgccttcacgtaccaaggtactgaactggtcgggatcactgctggtgaagccgccaacccaagaaaggccgtcccaagggcaattaagaaagttgtggtcaggatcctagtcttctacatcatgtcgctgtttttcataggccttttggttccgtacaacgacccgaaactggacagtgacggatcgtttgtgtccgcatcccccttcatgatcagcatcgagaattccggcaccaaggtcctcccagacatattcaacgcggtcgtgctgatcaccatagtctccgcgggcaactccaacgtgtacatcggctcaagggtcctgtacagtctatccaaaaacgacttggcgccccggttcctgtcgatcgtgaccaagggcggggtcccctactttgccgttctggcaacatctgtattcgggttcctggccttcttggaaacctccgcaggtagtggcaaggctttcaactggctgttaaacattactggtgtggcaggatttttcgcatggctgctgatttcattttcgcacatccgctttatgcaagcgataagcaaacgcggaatatcgaggaacgatctgccttacaaggctcgcatgatgccttatctagcctactacgcatcctttttcatcgccctgatagtcctgatccagggcttcactgcatttgcgcccagtttccagcctgtagatttcgttgccgcatacatatccgtcttcctatttgttgcaatctggttttcattccagctttggttcaagtgtcccataatcttgaagttgcaggacgtcgacatagattccgaccgccgcgaaatagaggagcaggtatggatagaacccttacgcaaaaccaagtggcagtgcgtgtgggatgtccttgcataa

SEQ ID NO: 17342 - protein, 570 aa, Saccharomyces bayanus
MSKNVDISVSKEGQYELNSISTIKEEELVDVQYDGQGAPAAIAAGGCIANDDAKAAEALPREVKRNLKQRHIGMIALGGTIGTGLIIGIGPPLAHAGPVGALISYIFMGTVIYSVTQSLGEMATFIPVTSSFSVFAQRFLSPALGATNGYMYWLSWCFTFALELSVLGQIIQYWTDAVPLSAWIVIFWCLLTLMNMFPVKYYGEFEFCIASIKVIALLGFIIYSFCMVCGAGQPDGPIGFRYWRNPGAWGPGIISSDKNEGRFLGWVSSLINAAFTYQGTELVGITAGEAANPRKAVPRAIKKVVVRILVFYIMSLFFIGLLVPYNDPKLDSDGSFVSASPFMISIENSGTKVLPDIFNAVVLITIVSAGNSNVYIGSRVLYSLSKNDLAPRFLSIVTKGGVPYFAVLATSVFGFLAFLETSAGSGKAFNWLLNITGVAGFFAWLLISFSHIRFMQAISKRGISRNDLPYKARMMPYLAYYASFFIALIVLIQGFTAFAPSFQPVDFVAAYISVFLFVAIWFSFQLWFKCPIILKLQDVDIDSDRREIEEQVWIEPLRKTKWQCVWDVLA

SEQ ID NO: 17343 - DNA, 1629 bp, Aspergillus fumigatus
  CDS (1)..(1629)
atgatcgaagcaaagatgacaccctttgaattcaatcaacatgtcaacgccgacaggctcgctcgtaagctctccgcccgccaggtgcagatgatcgccatcggcggcacaattgggacgggactcttcctgggaacaggcaaagctctcgcgacaggtgggcctgcgtcgatgcttatttcgtatgccatatgtggtgggattgtgttcgtcacgatgttaagcctgggggagatggcggcgtttattcccattgcgggttcgttctgtactttcgcagggcgcttcgttgacgatgctcttggtttcgctctgacttggaattactggtttaatgacgctgtctcaacggcggcggatgtcattgcactgcaactattgctgcagtattggacggataacttcccaggctgggcgatcagcttaatctttctgatttttgttattttacttaatgtgatgtctgtgagaatctacggagagattgaatattggctcagcttactcaaggtcatcacgattataatcttcatcattctcgggattgttgtcaactgcgggggcaataaggaccacaaatacatcggtgacaagtacttctatgtcggcgatgcccccttcgtaggtggaatcggtggattcgcctccgtctttgtcacggcatcgtttgcttatggcggcacggaatccattgccatcacagcgggagaaaccaaagacccagctaaaaacctgccgcgagtcgtccgcaatgtcttctggcgcatcgtcctcttctacatcatctccatcattctcatcggtctcaatgttccctacaactaccccaacctgtcaaagaaaaccaccgccaccagcccgttcaccatcgtcttcatggaagctggcagcgccgtggcaggcagcttcatcaacgccgtgctaatgaccagcgtcatctccgccgccaaccatgccctcttcgcagggtcccggcttctctacacgctcgcggtagacggccacgcccctcatttctttggccacctcaaccgcttccagatcccctgggtcgccgtgctagccacatccctcgtcagcggtctctgcttcggagccagctacatcggagccggccagctctggacctggttgcaaaatgaaaccagcatcgtcggcgtctccaaccaaatctcgtgggtctgcatcggcatcgcctccctgcgcttccgcgccgccatccgccggcagaacctcgagcatctcctccccttcaagaactggacgtaccccgtcggccccatcatcgccgtcgggctgaatatcgtcctgatcctcgtgcagggctggtcctgcttcagcccgtccttccaggccgtcgactttgtgtcgttctacatcgagatccctatcatgattgtcatgtttttggcctggaagctggttaagcagacgaggttcgtgcatctggatgagatggacttggttactgatcggtatgatctgaatgcggagcatgctgaaagcgatggcaatgccgatggtgatagcccgtcgcgggtcgggaggattctgcatatcaaacagttgcagagtgaaaagggcgtgctcgggaagctgaagcgagttgggatgtggctgttcctatag

SEQ ID NO: 17344 - protein, 542 aa, Aspergillus fumigatus
MIEAKMTPFEFNQHVNADRLARKLSARQVQMIAIGGTIGTGLFLGTGKALATGGPASMLISYAICGGIVFVTMLSLGEMAAFIPIAGSFCTFAGRFVDDALGFALTWNYWFNDAVSTAADVIALQLLLQYWTDNFPGWAISLIFLIFVILLNVMSVRIYGEIEYWLSLLKVITIIIFIILGIVVNCGGNKDHKYIGDKYFYVGDAPFVGGIGGFASVFVTASFAYGGTESIAITAGETKDPAKNLPRVVRNVFWRIVLFYIISIILIGLNVPYNYPNLSKKTTATSPFTIVFMEAGSAVAGSFINAVLMTSVISAANHALFAGSRLLYTLAVDGHAPHFFGHLNRFQIPWVAVLATSLVSGLCFGASYIGAGQLWTWLQNETSIVGVSNQISWVCIGIASLRFRAAIRRQNLEHLLPFKNWTYPVGPIIAVGLNIVLILVQGWSCFSPSFQAVDFVSFYIEIPIMIVMFLAWKLVKQTRFVHLDEMDLVTDRYDLNAEHAESDGNADGDSPSRVGRILHIKQLQSEKGVLGKLKRVGMWLFL

SEQ ID NO: 17345 - DNA, 1659 bp, Uromyces fabae
  CDS (1)..(1659)
atgagctcggacgatgtgaaggctctgggaggcgacctggagaaggcgcactctatcatggatcaagaattcgtaactgaaaaaggcaatggtactatcactgaagacaagcaagatggtcagatgcaaagacatctaaaaccacgtcacatgtcgatgatagctattggcggtactatcgggacgggattgtttattggatccggacaaggtcttaaccaaggtggcccggtaggccttcttctaggttatagcaccatgggcatcgttgtctacagtgtgatggtttcacttggcgagatggtaacaatgtttccgattactggctccttcgtgcattacgcttcccgattcgttgacccagcattagggtttgctcttggatggaactattggtattgttatgccattactttacctactgaaatcaccgctgcagggattgtgattcaatattggacaaaaagtgtgaatgtggccgtatggataacaattttcctagtggcttcatgcggtgtaaatttatttggagtcagatggtacggggaggcagaattttggtgttccgctgtcaaagtaattgctatcgtttgcttgattatacttggcattatcattgatttaggtggcggtccaaatcatgatcgaattggatttagatactggatttctcctggcccattcaatcaattgaatggcattcctggttccactggtcgattcctcgccttctggtcggtctttattcaagcatctttttcatatcaaggcacggaaatcgtagctttggcagcaggggaagctctcaacccgagaaagaccatccccaaagccatcaacagggtcttttatcgtatcctattattttatgttggtggtgtgactgtgataggattgctggtgccctacaattcaccagatttgcttggtggtactggagatgccacttcatccccatttgtgattgccatcaagtctgcaggtatctcagtgctgccagatgtgctgaatgctgtcattttggcagttgtattttcagcagctaattcagatttgtatgctgcctcaagaatgacgtttggtttagctactgatggaatggcgccagcaatattctcccgttgtacaagcaacggtttacccatcgctggattgatcctcactattggatttggtttgctagcctacatgaatgttaattcttctaccggaacagttttccagtggctcgcaaatttctcttctgtgacaggacttctaacgtggtggtctatctctcttgcctacatcaggttttaccacggcttgatacatcacaaaatagaccgcaatacctttgcatacaaggctccttaccaaccatggctctcttacttttctattactatgtctactttaatcatcttcttcaacggttttgaggttttcatgagcggaagttggtcaacttcgaagtttgtatcggcatatctttctattccaatgtttatcgtcttctttataacatggaagatctatcacaagactgcttttgttaaaattgatcagatggactttgtaacgggaaaacgcgaattcgattcaatggaacaaattgagagcgagaaagaagttgagccagttggcaaatttgcacaatttcttgaatggttaatgtag

SEQ ID NO: 17346 - protein, 552 aa, Uromyces fabae
MSSDDVKALGGDLEKAHSIMDQEFVTEKGNGTITEDKQDGQMQRHLKPRHMSMIAIGGTIGTGLFIGSGQGLNQGGPVGLLLGYSTMGIVVYSVMVSLGEMVTMFPITGSFVHYASRFVDPALGFALGWNYWYCYAITLPTEITAAGIVIQYWTKSVNVAVWITIFLVASCGVNLFGVRWYGEAEFWCSAVKVIAIVCLIILGIIIDLGGGPNHDRIGFRYWISPGPFNQLNGIPGSTGRFLAFWSVFIQASFSYQGTEIVALAAGEALNPRKTIPKAINRVFYRILLFYVGGVTVIGLLVPYNSPDLLGGTGDATSSPFVIAIKSAGISVLPDVLNAVILAVVFSAANSDLYAASRMTFGLATDGMAPAIFSRCTSNGLPIAGLILTIGFGLLAYMNVNSSTGTVFQWLANFSSVTGLLTWWSISLAYIRFYHGLIHHKIDRNTFAYKAPYQPWLSYFSITMSTLIIFFNGFEVFMSGSWSTSKFVSAYLSIPMFIVFFITWKIYHKTAFVKIDQMDFVTGKREFDSMEQIESEKEVEPVGKFAQFLEWLM

SEQ ID NO: 17347 - DNA, 1773 bp, Saccharomyces cerevisiae
  CDS (1)..(1773)
atgacaaattcaaaagaagacgccgacatagaggagaagcatatgtacaatgagccggtcacaaccctctttcacgacgttgaagcttcacaaacacaccacagacgtgggtcaataccattgaaagatgagaaaagtaaagaattgtatccattgcgctctttcccgacgagagtaaatggcgaggatacgttctctatggaggatggcataggtgatgaagatgaaggagaagtacagaacgctgaagtgaagagagagcttaagcaaagacatattggtatgattgcccttggtggtactattggtacaggtcttttcattggtttatccacacctctgaccaacgccggcccagtgggcgctcttatatcatatttatttatgggttctttggcatattctgtcacgcagtccttgggtgaaatggctacattcatccctgttacatcctctttcacagttttctcacaaagattcctttctccagcatttggtgcggccaatggttacatgtattggttttcttgggcaatcacttttgccctggaacttagtgtagttggccaagtcattcaattttggacgtacaaagttccactggcggcatggattagtattttttgggtaattatcacaataatgaacttgttccctgtcaaatattacggtgaattcgagttctgggtcgcttccatcaaagttttagccattatcgggtttctaatatactgtttttgtatggtttgtggtgctggggttaccggcccagttggattccgttattggagaaacccaggtgcctggggtccaggtataatatctaaggataaaaacgaagggaggttcttaggttgggtttcctctttgattaacgctgccttcacatttcaaggtactgaactagttggtatcactgctggtgaagctgcaaaccccagaaaatccgttccaagagccatcaaaaaagttgttttccgtatcttaaccttctacattggctctctattattcattggacttttagttccatacaatgaccctaaactaacacaatctacttcctacgtttctacttctccctttattattgctattgagaactctggtacaaaggttttgccacatatcttcaacgctgttatcttaacaaccattatttctgccgcaaattcaaatatttacgttggttcccgtattttatttggtctatcaaagaacaagttggctcctaaattcctgtcaaggaccaccaaaggtggtgttccatacattgcagttttcgttactgctgcatttggcgctttggcttacatggagacatctactggtggtgacaaagttttcgaatggctattaaatatcactggtgttgcaggcttttttgcatggttatttatctcaatctcgcacatcagatttatgcaagctttgaaataccgtggcatctctcgtgacgagttaccatttaaagctaaattaatgcccggcttggcttattatgcggccacatttatgacgatcattatcattattcaaggtttcacggcttttgcaccaaaattcaatggtgttagctttgctgccgcctatatctctattttcctgttcttagctgtttggatcttatttcaatgcatattcagatgcagatttatttggaagattggagatgtcgacatcgattccgatagaagagacattgaggcaattgtatgggaagatcatgaaccaaagactttttgggacaaattttggaatgttgtagcatag

SEQ ID NO: 17348 - protein, 590 aa, Saccharomyces cerevisiae
MTNSKEDADIEEKHMYNEPVTTLFHDVEASQTHHRRGSIPLKDEKSKELYPLRSFPTRVNGEDTFSMEDGIGDEDEGEVQNAEVKRELKQRHIGMIALGGTIGTGLFIGLSTPLTNAGPVGALISYLFMGSLAYSVTQSLGEMATFIPVTSSFTVFSQRFLSPAFGAANGYMYWFSWAITFALELSVVGQVIQFWTYKVPLAAWISIFWVIITIMNLFPVKYYGEFEFWVASIKVLAIIGFLIYCFCMVCGAGVTGPVGFRYWRNPGAWGPGIISKDKNEGRFLGWVSSLINAAFTFQGTELVGITAGEAANPRKSVPRAIKKVVFRILTFYIGSLLFIGLLVPYNDPKLTQSTSYVSTSPFIIAIENSGTKVLPHIFNAVILTTIISAANSNIYVGSRILFGLSKNKLAPKFLSRTTKGGVPYIAVFVTAAFGALAYMETSTGGDKVFEWLLNITGVAGFFAWLFISISHIRFMQALKYRGISRDELPFKAKLMPGLAYYAATFMTIIIIIQGFTAFAPKFNGVSFAAAYISIFLFLAVWILFQCIFRCRFIWKIGDVDIDSDRRDIEAIVWEDHEPKTFWDKFWNVVA

SEQ ID NO: 17349 - DNA, 1827 bp, Saccharomyces cerevisiae
  CDS (1)..(1827)
atgaagatgcctctaaagaagatgtttaccagcacgtctcctcgtaactcttcttctcttgacagtgatcatgacgcttactattcgaaacaaaatcctgacaatttccctgtaaaggagcaagaaatctataacattgacctggaagaaaacaatgtgtcctctcgttcatccacctctacatcaccttcagcaagggacgactctttcgcagttccagatggtaaagacgaaaacacgcggttgaggaaagatttaaaggcaagacatatttctatgatcgccattggtggttcattaggtacaggtctgcttataggtacaggtaccgccttattgacgggtggtccggttgcgatgttaattgcatatgcctttgtcggccttttagtcttttacaccatggcctgtcttggtgaaatggcttcttacattccattggatggttttacaagttatgcctcacgttacgtggatcctgcattaggttttgctattggttatacttaccttttcaaatatttcatcttacctcccaaccaacttactgctgctgctttggtcattcaatattggatcagcagagaccgtgttaaccctggtgtgtggattactatattcttggttgttattgtcgctatcaatgtcgtcggtgtaaaattctttggtgaatttgaattttggttgtccagtttcaaagtcatggtaatgttgggtctaatcctgttactatttattattatgcttggtggaggtcctaaccatgaccgcctagggtttagatactggcgtgatcctggtgcgttcaaagaatattcgacggctatcactggtggtaaaggtaaatttgtttcgttcgttgctgttttcgtttacagtcttttcagttacacgggtattgaattgacaggtatcgtttgttctgaagctgagaatccaagaaaaagtgttccaaaggcaattaaattgacagtttaccgtatcattgttttttacctatgcaccgttttccttttgggtatgtgcgttgcatacaatgaccctcgtttactttccacaaaaggtaagagtatgtctgctgcggcatctccattcgtggttgccattcaaaactcaggtattgaagtcttacctcatatcttcaatgcttgtgtcttggttttcgttttcagtgcttgtaactcagatttgtacgtttcttccagaaatttatatgcgttggcaattgatggtaaagcgccaaagatcttcgctaagacaagtagatggggtgttccttacaatgctttaatactctccgtgctgttttgtggcttggcgtacatgaatgtgtcttcaggatcagcaaagattttcaactactttgttaacgttgtttctatgttcggaatcttgagttggatcaccattttaattgtttacatctacttcgataaagcctgccgtgctcaagggattgacaaatcaaaatttgcttatgtcgctcctggccaacgttatggtgcttattttgctttattcttctgcattttgattgctttaatcaaaaacttcactgttttcctaggtcataaatttgattataaaacattcatcaccgggtatattggcctgcctgtctatatcatttcttgggctggttacaaattgatatacaaaaccaaagtgataaagtctaccgacgtggatttgtacacatttaaggaaatatacgatagagaagaagaagagggaagaatgaaggaccaagaaaaggaagagcgtttaaaaagtaacggtaaaaatatggagtggttctatgaaaaatttttgggtaatatcttctag

SEQ ID NO: 17350 - protein, 608 aa, Saccharomyces cerevisiae
MKMPLKKMFTSTSPRNSSSLDSDHDAYYSKQNPDNFPVKEQEIYNIDLEENNVSSRSSTSTSPSARDDSFAVPDGKDENTRLRKDLKARHISMIAIGGSLGTGLLIGTGTALLTGGPVAMLIAYAFVGLLVFYTMACLGEMASYIPLDGFTSYASRYVDPALGFAIGYTYLFKYFILPPNQLTAAALVIQYWISRDRVNPGVWITIFLVVIVAINVVGVKFFGEFEFWLSSFKVMVMLGLILLLFIIMLGGGPNHDRLGFRYWRDPGAFKEYSTAITGGKGKFVSFVAVFVYSLFSYTGIELTGIVCSEAENPRKSVPKAIKLTVYRIIVFYLCTVFLLGMCVAYNDPRLLSTKGKSMSAAASPFVVAIQNSGIEVLPHIFNACVLVFVFSACNSDLYVSSRNLYALAIDGKAPKIFAKTSRWGVPYNALILSVLFCGLAYMNVSSGSAKIFNYFVNVVSMFGILSWITILIVYIYFDKACRAQGIDKSKFAYVAPGQRYGAYFALFFCILIALIKNFTVFLGHKFDYKTFITGYIGLPVYIISWAGYKLIYKTKVIKSTDVDLYTFKEIYDREEEEGRMKDQEKEERLKSNGKNMEWFYEKFLGNIF

SEQ ID NO: 17351 - DNA, 1410 bp, Bacillus subtilis
  CDS (1)..(1410): transl_table=11
atgaaccagtctcaatcaggattaaaaaaggaattaaagacccgccatatgacaatgatttcgattgccggtgtaatcggagccggcctatttgtaggcagcggtccagtgattcactcgaccggtccgggtgccgttgtttcttacgcgttagccggattattggtgatttttattatgagaatgctcggtgagatgtctgccgtaaacccgacgagcggatcgttttctcaatacgctcacgacgccatcggaccgtgggcaggatttacaatcggctggctgtactggtttttctgggtgatcgtcatagcgatcgaagccattgccggtgctggcattattcaatactggttccatgatattccgctgtggctgacaagtttgatcttgaccattgtgctcaccctgacaaacgtctactccgttaagtctttcggtgagtttgaatattggttctccctcattaaagttgtgactatcattgcttttctaatcgttggttttgcctttatttttggctttgcaccgggcagtgagccagtcggtttttcgaatcttacaggcaaaggcggatttttcccggagggcatcagctccgtattgctcggcattgtcgttgtcatcttctcttttatgggaactgaaatcgttgccattgcagcaggggaaacatccaacccgatcgaatctgtgacaaaagccaccagatccgttgtatggcgcatcatcgtcttttacgtgggctcaatcgccattgtcgtggcgctgttgccatggaattcagcaaatattttagaaagccctttcgtcgctgtacttgagcatataggagtgcccgcagccgcacagattatgaactttatcgtcctcacagccgtactctcttgcctgaattcaggtttgtataccacatccagaatgctgtattcacttgcagaaagaaatgaagcgccgcgccgttttatgaaattgagcaaaaaaggcgttcccgtacaagccattgtggccgggacatttttctcttatatcgcggtcgtaatgaactatttttcaccggataccgtctttttattcttagtcaactcatcaggcgcaatcgctttactcgtctatcttgtcatcgccgtttcccagctgaaaatgcggaaaaaactcgaaaaaacaaacccagaagcactgaagatcaaaatgtggctcttccctttcctaacctacttgaccatcatcgccatttgcggaattttagtgtccatggcgtttattgattccatgagagacgagctgctgctgacaggcgtcatcacgggaatcgttctgatttcttaccttgtgttcagaaaacgcaaggtgagcgagaaagcggctgccaacccagtcacacagcagcaacccgatatcctgccttaa

SEQ ID NO: 17352 - protein, 469 aa, Bacillus subtilis
MNQSQSGLKKELKTRHMTMISIAGVIGAGLFVGSGPVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 17353 - DNA, 1428 bp, Bacillus subtilis
  CDS (1)..(1428): transl_table=11
gtgaatcttcaggagaacagcagccaacagctaaaacgcacaatgaaaagcaggcacctatttatgatctcattgggaggcgtcataggcacaggacttttcctcagtacgggctatacgctacatcaagccggacccggcggtacgatactcgcttatgtaatcggcgggttgatgatgtacctcgtcatgcaatgtctcggcgaattgtcggttgccaatgcggtgaccggctcttttcaaaaatatgctacaacatttatcggtccatctaccggttttatggtcggcatcatgtactggatcaattgggtggtgacggtaggctctgagtttaccgcatccggtattctcatgcagcgctggttccctgacagcagtgtatggatgtggagtgcgatttttgcagcccttctttttatatgcaacgcattttcagttaagttatttgcggaaactgaattttggttttccagcgtaaagattgtcaccattattttatttatcattttaggaggagccgccatgtttggcctgatctctttaaacggaacggcggatgctcctatgttgtcaaacttcacagatcatggcgggttgtttccaaatggctttctcgccgtttttatcgcgatgatatctgtgagcttcgccttttccggtacagagttaatcggcgttacagcaggagaatcagcaaatcctcaaaaggatataccgcgatccatccgtaatgtcgcatggagaaccgtgatttttttcattggcgctgtcttcatattatccgggttgatttcatggaaggacgcaggcgtgattgaaagcccgtttgtcgccgtatttgcggagatcggaattccttacgctgctgatattatgaatttcgtaatattaacagccttgctgtctgtcgccaactcaggcttatatgcttcgacccgtatgatgtggtctttagcaaatgaaaacatgatcagctcccgttttaagaaagtgacatctaaaggcattcctttaaatgccttaatgatcagtatggctgtatcttgtttatctctcgtttccagtatcgtggcccctggaactgtctatgtggtgatggtcgcaattgctggatttgcaggagtcgtggtctggatgagcattgccttgtcccaactcttgtttcgaaagagatttttgaaaaaagggggggatgtaaaagatctgacatttcgcacgccgctttatcctcttatgcctatagccgctctcttattatgttctgcttcttgtatcggtcttgcttttgatcccaatcaaagaatcgcacttttctgcggagttccttgtatcatcctttgctatctcatctaccatttcaaaagaaatgttacaaaagcgaaaaaaatcagccaagaggaatatccagccgatcacatcctataa

SEQ ID NO: 17354 - protein, 475 aa, Bacillus subtilis
MNLQENSSQQLKRTMKSRHLFMISLGGVIGTGLFLSTGYTLHQAGPGGTILAYVIGGLMMYLVMQCLGELSVANAVTGSFQKYATTFIGPSTGFMVGIMYWINWVVTVGSEFTASGILMQRWFPDSSVWMWSAIFAALLFICNAFSVKLFAETEFWFSSVKIVTIILFIILGGAAMFGLISLNGTADAPMLSNFTDHGGLFPNGFLAVFIAMISVSFAFSGTELIGVTAGESANPQKDIPRSIRNVAWRTVIFFIGAVFILSGLISWKDAGVIESPFVAVFAEIGIPYAADIMNFVILTALLSVANSGLYASTRMMWSLANENMISSRFKKVTSKGIPLNALMISMAVSCLSLVSSIVAPGTVYVVMVAIAGFAGVVVWMSIALSQLLFRKRFLKKGGDVKDLTFRTPLYPLMPIAALLLCSASCIGLAFDPNQRIALFCGVPCIILCYLIYHFKRNVTKAKKISQEEYPADHIL

SEQ ID NO: 17355 - DNA, 1722 bp, Trichoderma harzianum
  CDS (1)..(1722)
atgtcgaaagaggagagtggccatgtcactcccgagaagggcgacaatgtcgtcgactatcaggccagcacgacagtcctccccagcgagggccctgagcgcgacgccaactggttcacgcgcaatggcctcaacgtcgactccttcaagaagaagcactatggcccgggcatggtcgagcttgagcgtcccatgaaggctcgccatcttcacatgattgccattggtggttccattggtgctggtttcttcgtcggctcgggcggtgctctggccaaaggtggccctggttctctctttgtcgacttcctcattatcggtatcatgatgttcaacgtcgtgtacgctctcggtgaactcgccatcatgtaccccgtctctggttctttctacacatactctgctcgtttcatcgaccctgcctggggtttcgccatgggctggaactatgttcttcagtgggctgccgttcttccgcttgaattgacagtttgtggtattacgatatcgtactggaactcggaaatcaccacagccgcttggatctctctcttcctcggcgtcatcatcatcatcaacctgtttggcgctctcggctatgctgaagaggagttttgggcatcgtgcttcaagctggctgccaccgtcatcttcatgatcatcgcttttgtccttgtcctcggtggtggtcccaaggatggccgataccacgagtactggggtgcccgctactggtacgacccgggcgcgttcaagaacggcttcaagggcttctgctccgtcttcgtcaccgctgccttctccttctccggtactgagctggtcggtcttgccgctgccgagtctactaaccccaccaagaacatgcccggtgctatcaagcaggtcttctggcgtatcaccatcttttacatcctcggtctcttctttgtcggcctgctgatcaacagcgatgatcccgctctgctctcctctgccgcctacgctgactccaaggcctctccctttgtgcttgtcggcaagtacgctggcttgaagggtttcgaccacttcatgaacctcgtcattctcgcctccgtcttgtccatcggtgtctctggtgtgtatggtggatctcgaaccctgaccgctctggctcagcagggctatgctcccaagctcttcacctacattgacaagtctggccgtcccctgccctctgtcatcttcctcatcctgttcggcttcatcgcctatgtcagcttggatgccaccggtcccgttgtctttgactggcttcttgccatttccggcttggccgctctcttcacctggggctctgtctgccttgcccacattcgattccgcaaggcctggaagtaccacggccacactctggatgagattccattcaaggctgctggcggtgtctacggctcatacctcggccttttcatttgcgtcattgtcctgatggctcagttctataccgctattgcagcccctcccggatcaccaggcgttggtaccgcagaggacttcttcaagcagtacctggctgctcccgtcgtcctcggtttctggatcgttggatggctgtggaagcgccagcctttcttgagaaccaagaacattgacgttgacactggtctccgtgagtttgactgggacgagatcaacgcagagcgcacaagaattgctcccctgcctgcctggagacgcatcatccaccacaccttctaa

SEQ ID NO: 17356 - protein, 573 aa, Trichoderma harzianum
MSKEESGHVTPEKGDNVVDYQASTTVLPSEGPERDANWFTRNGLNVDSFKKKHYGPGMVELERPMKARHLHMIAIGGSIGAGFFVGSGGALAKGGPGSLFVDFLIIGIMMFNVVYALGELAIMYPVSGSFYTYSARFIDPAWGFAMGWNYVLQWAAVLPLELTVCGITISYWNSEITTAAWISLFLGVIIIINLFGALGYAEEEFWASCFKLAATVIFMIIAFVLVLGGGPKDGRYHEYWGARYWYDPGAFKNGFKGFCSVFVTAAFSFSGTELVGLAAAESTNPTKNMPGAIKQVFWRITIFYILGLFFVGLLINSDDPALLSSAAYADSKASPFVLVGKYAGLKGFDHFMNLVILASVLSIGVSGVYGGSRTLTALAQQGYAPKLFTYIDKSGRPLPSVIFLILFGFIAYVSLDATGPVVFDWLLAISGLAALFTWGSVCLAHIRFRKAWKYHGHTLDEIPFKAAGGVYGSYLGLFICVIVLMAQFYTAIAAPPGSPGVGTAEDFFKQYLAAPVVLGFWIVGWLWKRQPFLRTKNIDVDTGLREFDWDEINAERTRIAPLPAWRRIIHHTF

SEQ ID NO: 17357 - DNA, 1836 bp, Saccharomyces cerevisiae
  CDS (1)..(1836)
atgggcaggtttagtaacataataacgtccaataaatgggacgagaaacaaaacaacattggcgaacagagcatgcaggaattaccagaagaccagatagaacatgagatggaagcaatagatccaagtaataagacgaccccatactctattgatgagaaacagtacaacacaaaaaagaagcatgggtcattgcaaggtggcgcaattgctgatgtaaattcgataactaattcgttaacaagattgcaagttgtctctcatgaaacagatattaacgaggatgaagaagaagcccactatgaggataaacacgtgaagagagccttgaagcaaagacacattggtatgattgcactaggtggtacaatcggtactggtcttttcgttggtatctccactcccttgagtaatgctggccctgtggggtccctgattgcttacattttcatgggcaccattgtctacttcgttacccagtcacttggtgagatggctacgtttatccccgtgacatcatctatcactgtcttttcgaagaggttcttatcacctgcattcggtgtttctaacggctacatgtactggttcaattgggctattacttatgctgtggaggtttctgtcattggccaagttattgaatactggacagataaagttccattagcggcctggattgcgatattctgggtaattattactttgatgaattttttccctgtcaaagtttatggtgaatttgagttctgggtggcctctgttaaagttttagccattatgggttacttgatatatgctttgattattgtctgcggtggatcccaccagggccctatcggtttcaggtactggagaaatccaggagcctgggggccaggcatcatctccagtgataaaagtgaaggccgttttctcggatgggtctcctccttgattaatgctgcatttacgtaccaaggtactgaactggttgggatcaccgctggtgaagcggctaacccaagaaagaccgttccaagagctatcaataaagtcgtctttagaatcgtactattctatattatgtctttgttctttattggtctactggttccatacaacgattcccgtttatctgctagttctgctgttattgcatcatcacccttcgttatttccattcaaaacgctggtacttatgctcttccagatattttcaacgccgtggtgttgattactgttgtatctgccgctaattcgaatgtttacgttggttcccgtgttctttactctttagctaggactggtaacgcaccaaagcaatttggatacgtcaccagacagggtgttccatatctcggtgttgtttgcactgctgcattgggtcttttggcattcctggttgtcaataacaatgcaaacactgcatttaactggttgatcaacatttccactttggctgggttatgcgcctggttattcatctctttggcacatattaggttcatgcaagctttaaagcaccgtggtatttctcgtgatgatctgcccttcaaggccaaattgatgccttatggtgcctactacgcagccttttttgtcaccgtcatcatattcatccaagggttccaagcgttctgtccgttcaaagtttctgagtttttcacatcttacatctccttgattcttttagccgttgtgttcattggttgccagatatactacaaatgcagatttatttggaagctagaagatattgacatcgattccgacagaagagaaatcgaagcaattatttgggaagacgacgagcctaagaatttatgggagaaattctgggctgctgttgcatag

SEQ ID NO: 17358 - protein, 611 aa, Saccharomyces cerevisiae
MGRFSNIITSNKWDEKQNNIGEQSMQELPEDQIEHEMEAIDPSNKTTPYSIDEKQYNTKKKHGSLQGGAIADVNSITNSLTRLQVVSHETDINEDEEEAHYEDKHVKRALKQRHIGMIALGGTIGTGLFVGISTPLSNAGPVGSLIAYIFMGTIVYFVTQSLGEMATFIPVTSSITVFSKRFLSPAFGVSNGYMYWFNWAITYAVEVSVIGQVIEYWTDKVPLAAWIAIFWVIITLMNFFPVKVYGEFEFWVASVKVLAIMGYLIYALIIVCGGSHQGPIGFRYWRNPGAWGPGIISSDKSEGRFLGWVSSLINAAFTYQGTELVGITAGEAANPRKTVPRAINKVVFRIVLFYIMSLFFIGLLVPYNDSRLSASSAVIASSPFVISIQNAGTYALPDIFNAVVLITVVSAANSNVYVGSRVLYSLARTGNAPKQFGYVTRQGVPYLGVVCTAALGLLAFLVVNNNANTAFNWLINISTLAGLCAWLFISLAHIRFMQALKHRGISRDDLPFKAKLMPYGAYYAAFFVTVIIFIQGFQAFCPFKVSEFFTSYISLILLAVVFIGCQIYYKCRFIWKLEDIDIDSDRREIEAIIWEDDEPKNLWEKFWAAVA

SEQ ID NO: 17359 - DNA, 1725 bp, Schizosaccharomyces pombe
  CDS (1)..(1725)
atgctctccaaattttacgaagacatagattccaaattggaaaatgcaatgttatctcaaatagaaagcagtacaataacttgtgatggtaaatccctaaacacattgcctacccctaaacaagaggatgtcgagtttggcgttcctctgcagccagaagacactcaagatctccaaagaaagctgaagccccggcatatgcaaatgattgccataggaggatgcgttggcactggtctgtttgttggttcgggtaatgcactggccgatggtggtcctgctagtattcttatagccttcgcagtgataggaacttatgttttatttacaaccagcgcgttggcagaactctccgcaatttatcccgtttccggttcattttatacatacttttcgaaattcatcgacccggcatgggggtttgctgttggtatacagtattggttatcttttgccgtgaccgttccattagaacttacagttgccccgttgattattaatttttggaatgcatctggtccggtttcgatttggatttcagttttttacgtaattattatcgcgattaacatttggggaaccgaggggtatggtgaggtggaattttttttgagtatcatgaaagtcatttcagtcatcggttttgtaattctaagcataataattgcagcaggtggagtaccaactgatgatcgaggagtaatcggagtgtcatattggaaacaaccgttggtttttaacaatggattcaaagggttatgcgctgtttctgttatagctattttctccctgtcaggaaccgaactagttggtcttgccgcatcagaagcaaagaatcctcaaaaaacagttcccgcagcagtcaaacaaatattttggcgtattttcttgttctatattgttgctcttttcatgcttactttggtggttccgtctgacctacctgggctacgcacgagcgataactcaaatgtgctaatttcaccattcgttattgccattcaactggcaaatataagggcacttccgagcatcatgaacgtagtaattctgctttccacattatccgtaggaaattcagcttcctatgcggcgtcacgtgccttgtttgctttagcaaagaacggctatgcacctaagatttttaataaaactaacaaacgaggtcatccaatttatgcaattgccgtaacgcttttatttggttctatagcatacttcactgaagctggagttggcggcgcactctttggttggttgttatcaatatgtggtttgtcaacaacatttatatggggaagtatttgcctcgcccatattcaatttagaagagcgtggaaaatacaaaataggaaactagaagatcttccttaccgtagcatttttggagtatatggatctatttatggtgtggccatgacaatattggctttaattgcccaattttatgtcgcggtattcccaattggaaaaaaaccaaatccagtggatttttttcaggcatatatggctgcacccatattaattatcagctttgtggcatggaagttttttagacgtacatcatttgttcgtatcgaaaaaattgatctttcagagggtgcgcatggcgaacagaaacaaaatctcgaacccgtcatcaatatacccgttgaagagatagacttcccaatgaaagtagccaccaaggagagcatgaaaaatgtagagaaaaatgcgttatga

SEQ ID NO: 17360 - protein, 574 aa, Schizosaccharomyces pombe
MLSKFYEDIDSKLENAMLSQIESSTITCDGKSLNTLPTPKQEDVEFGVPLQPEDTQDLQRKLKPRHMQMIAIGGCVGTGLFVGSGNALADGGPASILIAFAVIGTYVLFTTSALAELSAIYPVSGSFYTYFSKFIDPAWGFAVGIQYWLSFAVTVPLELTVAPLIINFWNASGPVSIWISVFYVIIIAINIWGTEGYGEVEFFLSIMKVISVIGFVILSIIIAAGGVPTDDRGVIGVSYWKQPLVFNNGFKGLCAVSVIAIFSLSGTELVGLAASEAKNPQKTVPAAVKQIFWRIFLFYIVALFMLTLVVPSDLPGLRTSDNSNVLISPFVIAIQLANIRALPSIMNVVILLSTLSVGNSASYAASRALFALAKNGYAPKIFNKTNKRGHPIYAIAVTLLFGSIAYFTEAGVGGALFGWLLSICGLSTTFIWGSICLAHIQFRRAWKIQNRKLEDLPYRSIFGVYGSIYGVAMTILALIAQFYVAVFPIGKKPNPVDFFQAYMAAPILIISFVAWKFFRRTSFVRIEKIDLSEGAHGEQKQNLEPVINIPVEEIDFPMKVATKESMKNVEKNAL

SEQ ID NO: 17361 - DNA, 1404 bp, Escherichia coli
  CDS (1)..(1404)
atgcaaacaacacaacaaaatgcgccactgaagcgcacaatgaaaacgcgtcacctgattatgctttccttgggcggcgtgattggcacaggattattcttcaataccgggtacatcatttccaccactggagcggcgggaacgctgctggcctatctgattggtgcgctggtggtctggctggttatgcagtgtctgggcgagctgtcggtcgcgatgccggagaccggagcgtttcacgtttatgccgcgcgctatcttggtccggctaccgggtataccgtggcctggctttactggctgacctggaccgtggcgctgggttcgagctttaccgccgctggattctgtatgcagtactggtttccacaggtgccggtatgggtctggtgcgtggtgttctgcgcgattatttttggtctgaatgttatctccacgcgcttttttgccgaaggggagttctggttctcgctggtcaaagtggtcactatcatcgcctttatcatcctcggtggggcggcgattttcggctttattccgatgcaggatggctcgcccgcgccggggctgagtaatatcacggcagaaggctggttcccgcacggtggcttaccgattttgatgactatggtggcagtgaactttgctttttcgggtaccgagcttatcggcattgccgccggtgaaacggaaaacccgcgcaaagttatcccggtagcgattcgtactaccatcgcgcgactgattattttctttatcggcaccgtgtttgtgctggcagcgctgatcccgatgcagcaggtgggcgtggagaaaagcccgtttgtgctggtatttgagaaagtagggatcccgtacgccgctgatatttttaacttcgtgatcctgacggctattctttctgcagcgaactccgggttatatgcctccgggcgcatgctgtggtcgttgtcgaatgaacgtacgctaccggcctgttttgcgcgagtaacgaaaaacggcgtgccactgacggcgctgtcggtcagtatgctcggtggtgtgctggcgctgttttccagcgtggtggccccggacacggtatttgttgcgctgtcggcaatctccgggtttgcggtggtagcggtgtggctgagtatctgcgcctcgcattttgtttttcgtcgccgtcatctgcaacaaggtaaggcattgagtgaattacattatcgcgcgccgtggtatccgctggtgccagtattaggttttgtgctgtgcctggtggcctgtgttgggctggcattcgatccagcgcagagaattgcgttgtggtgcgggttaccgtttgttgcgttgtgctatggtgcttatttccttactcaaccccgaaacgcaaaacaggagccagaacatgtcgcagaataa

SEQ ID NO: 17362 - protein, 467 aa, Escherichia coli
MQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 17363 - DNA, 1413 bp, Bacillus subtilis
  CDS (1)..(1413): transl_table=11
atgcagaatcataaaaatgaattgcagcgcagcatgaaaagcaggcatttgtttatgattgctttgggaggggtgattggcactgggctgtttctaggctctggctttaccattagccaggcgggaccgctcggcgccattgccgcgtatatcatcggcggatttttaatgtatctcgtcatgctttgtttaggagaattggctgttgccatgccggtggccggatcgtttcaggcctacgccactaaatttctgggacagtcgacaggctttatgattggctggctgtattggttcagctgggccaatacagtagggttagagctgacgtcagcaggcattttgatgcaaaggtggctgccctccgttccgatctggatatggtgcctcgtgttcggcatcgtcatctttttgattaatgcgctctctgtcagaagctttgcggaaatggaattttggttttcaagcatcaaagtggcggcgatcatattatttattgtgattggcggagccgctgtgtttggcttgattgactttaaaggcggacaggagacaccctttttgtctaactttatgactgatagagggcttttccctaatggggtgctggccgttatgtttacgctggtcatggtaaacttctcgttccagggaacggagcttgtcggcattgcggcaggggaaagtgaaagcccggaaaaaacactgccaaagtccattcgaaatgttatttggcgcacgctgtttttctttgtgctcgctatgttcgtcttggttgccatccttccgtacaaaacggcgggggtgattgaaagcccgtttgtagcagtactcgatcaaatcggcatcccattttcggcagatatcatgaactttgtcatcttaacggccattttatctgttgctaattcgggattgtatgcggcgtcgcgtatgatgtggtcactttcatcaaatcaaatgggtccctcctttctcaccagactgacaaaaaaaggcgtgccgatgaatgccctgctgattacgctaggcatttcaggctgttcgctgctgacaagtgtcatggctgcagaaacagtgtatttatggtgtatctcaatctcgggcatggtgacagttgtcgcgtggatgtccatttgtgcgtcgcaatttttctttcgcaggcgtttcctggcagaaggcggaaatgtgaatgatctggagttcagaacgccgctttatccgctagtcccgattctcggattttgtttatatggctgcgtgttgatcagccttattttcattccggatcaaagaattggcttatactgcggtgtgccgatcattattttctgttatgcatactatcatctaagcatcaaaaagcgtataaatcatgaaacgattgaaaaaaagcagacagaggcgcaatag

SEQ ID NO: 17364 - protein, 470 aa, Bacillus subtilis
MQNHKNELQRSMKSRHLFMIALGGVIGTGLFLGSGFTISQAGPLGAIAAYIIGGFLMYLVMLCLGELAVAMPVAGSFQAYATKFLGQSTGFMIGWLYWFSWANTVGLELTSAGILMQRWLPSVPIWIWCLVFGIVIFLINALSVRSFAEMEFWFSSIKVAAIILFIVIGGAAVFGLIDFKGGQETPFLSNFMTDRGLFPNGVLAVMFTLVMVNFSFQGTELVGIAAGESESPEKTLPKSIRNVIWRTLFFFVLAMFVLVAILPYKTAGVIESPFVAVLDQIGIPFSADIMNFVILTAILSVANSGLYAASRMMWSLSSNQMGPSFLTRLTKKGVPMNALLITLGISGCSLLTSVMAAETVYLWCISISGMVTVVAWMSICASQFFFRRRFLAEGGNVNDLEFRTPLYPLVPILGFCLYGCVLISLIFIPDQRIGLYCGVPIIIFCYAYYHLSIKKRINHETIEKKQTEAQ

SEQ ID NO: 17365 - DNA, 1404 bp, Bacillus subtilis
  CDS (1)..(1404): transl_table=11
gtgaatacaaaccaagataacggaaatcagctccagcggacaatgaaatcacgccatttgttcatgatttcattgggcggagtgatcggaaccggtttcttccttggaaccgggtttaccattaaccaagcgggaccgctcggcgcggttctgtcctatttagtgggcggctttatcatgtttttgaccatgctctgcttaggagagctggcagtcgcctttcctgtgtcggggtccttccagacctatgccacgaaatttatcagcccggccttcgggtttgcgttcggctggctgtactggctcggctgggcggttacatgcgccattgaatttttatcagcggggcagctgatgcaacgctggtttccgcatatagacgtgtggatctggtgtctggtctttgcggcactgatgtttattttaaatgcgatcaccacaaaagcctttgcggaatctgaattctggttctcaggcattaaaattttgattatccttttatttattattctcggcggagctgccatgtttggcctgattgatctgaagggcggagagcaggcgccgtttttgacacatttttatgaagacgggttatttccgaacggcataaaggcaatgctgattacgatgattactgtgaactttgcgtttcaggggactgagctgatcggggttgcagccggagaaagtgaagaccctgaaaaaacgattccgcggtccatcaaacagacagtatggagaacgcttgtgttctttgtgctttcaatcattgtcattgccggcatgattccgtggaaacaggcgggtgtcgtggaaagtccatttgttgccgtatttgagcaaatcggaatcccatatgcagctgatatcatgaactttgttattttaatcgcactgttatctgttgcgaactcaggtttatacgcatcaacacgtattctgtacgcgatggcgaatgaaggacaagccttcaaagcgcttggcaaaacaaatcagcgcggtgtaccgatgtactcgttaatcgtaacgatggctgtggcctgcctatcacttctgacaaagtttgcgcaggctgaaaccgtatatatggtactgttatctttggcgggcatgagcgcgcaggtcggctggattacgatctcgctttcccaaatcatgttcagacgcaaatatatccgtgagggcgggaagatagaagatttgaaatttaaaacaccgctgtacccggtgcttccgctgatcggcctaacgttaaatacggtcgtgctcatcagtcttgcatttgatccggagcagcgtatcgcgctgtattgcggcgtaccgtttatgatcatttgctacatcatttatcatgtcgtcattaaaaaacgccagcaggcaaatcgtcagctagagctttaa

SEQ ID NO: 17366 - protein, 467 aa, Bacillus subtilis
MNTNQDNGNQLQRTMKSRHLFMISLGGVIGTGFFLGTGFTINQAGPLGAVLSYLVGGFIMFLTMLCLGELAVAFPVSGSFQTYATKFISPAFGFAFGWLYWLGWAVTCAIEFLSAGQLMQRWFPHIDVWIWCLVFAALMFILNAITTKAFAESEFWFSGIKILIILLFIILGGAAMFGLIDLKGGEQAPFLTHFYEDGLFPNGIKAMLITMITVNFAFQGTELIGVAAGESEDPEKTIPRSIKQTVWRTLVFFVLSIIVIAGMIPWKQAGVVESPFVAVFEQIGIPYAADIMNFVILIALLSVANSGLYASTRILYAMANEGQAFKALGKTNQRGVPMYSLIVTMAVACLSLLTKFAQAETVYMVLLSLAGMSAQVGWITISLSQIMFRRKYIREGGKIEDLKFKTPLYPVLPLIGLTLNTVVLISLAFDPEQRIALYCGVPFMIICYIIYHVVIKKRQQANRQLEL

SEQ ID NO: 17367 - DNA, 25 bp, Artificial sequence
  (1)..(25): primer
atggtttccgaaactaaaaccacag

SEQ ID NO: 17368 - DNA, 25 bp, Artificial sequence
  (1)..(25): primer
ttatttcttatcgttctgcgggaac

SEQ ID NO: 17369 - protein, 489 aa, Artificial sequence
  Variant (2)..(2): xaa in position 2 is any amino acid
  Variant (4)..(4): xaa in position 4 is any amino acid
  Variant (6)..(7): xaa in position 6 to 7 is any amino acid
  Variant (11)..(11): xaa in position 11 is any amino acid
  Variant (16)..(18): xaa in position 16 to 18 is any or no amino acid
  Variant (21)..(21): xaa in position 21 is any amino acid
  Variant (29)..(29): xaa in position 29 is any amino acid
  Variant (32)..(33): xaa in position 32 to 33 is any amino acid
  Variant (35)..(36): xaa in position 35 to 36 is any amino acid
  Variant (40)..(40): xaa in position 40 is any or no amino acid
  Variant (42)..(42): xaa in position 42 is any amino acid
  Variant (47)..(49): xaa in position 47 to 49 is any amino acid
  Variant (51)..(51): xaa in position 51 is any amino acid
  Variant (55)..(55): xaa in position 55 is any amino acid
  Variant (58)..(59): xaa in position 58 to 59 is any amino acid
  Variant (65)..(66): xaa in position 65 to 66 is any amino acid
  Variant (69)..(70): xaa in position 69 to 70 is any amino acid
  Variant (74)..(75): xaa in position 74 to 75 is any amino acid
  Variant (78)..(78): xaa in position 78 is any amino acid
  Variant (82)..(85): xaa in position 82 to 85 is any amino acid
  Variant (88)..(88): xaa in position 88 is any amino acid
  Variant (92)..(92): xaa in position 92 is any amino acid
  Variant (95)..(96): xaa in position 95 to 96 is any amino acid
  Variant (98)..(98): xaa in position 98 is any amino acid
  Variant (100)..(101): xaa in position 100 to 101 is any amino acid
  Variant (103)..(103): xaa in position 103 is any amino acid
  Variant (105)..(110): xaa in position 105 to 110 is any amino acid
  Variant (113)..(114): xaa in position 113 to 114 is any amino acid
  Variant (116)..(121): xaa in position 116 to 121 is any amino acid
  Variant (122)..(125): xaa in position 122 to 125 is any or no amino acid
  Variant (127)..(128): xaa in position 127 to 128 is any amino acid
  Variant (131)..(132): xaa in position 131 to 132 is any amino acid
  Variant (135)..(136): xaa in position 135 to 136 is any amino acid
  Variant (139)..(140): xaa in position 139 to 140 is any amino acid
  Variant (142)..(142): xaa in position 142 is any amino acid
  Variant (144)..(144): xaa in position 144 is any amino acid
  Variant (148)..(148): xaa in position 148 is any amino acid
  Variant (152)..(152): xaa in position 152 is any amino acid
  Variant (154)..(154): xaa in position 154 is any amino acid
  Variant (158)..(159): xaa in position 158 to 159 is any amino acid
  Variant (162)..(162): xaa in position 162 is any amino acid
  Variant (168)..(170): xaa in position 168 to 170 is any amino acid
  Variant (172)..(172): xaa in position 172 is any amino acid
  Variant (174)..(190): xaa in position 174 to 190 is any amino acid
  Variant (191)..(198): xaa in position 191 to 198 is any or no amino acid
  Variant (200)..(201): xaa in position 200 to 201 is any amino acid
  Variant (203)..(210): xaa in position 203 to 210 is any amino acid
  Variant (211)..(220): xaa in position 211 to 220 is any or no amino acid
  Variant (222)..(224): xaa in position 222 to 224 is any amino acid
  Variant (228)..(228): xaa in position 228 is any amino acid
  Variant (236)..(236): xaa in position 236 is any amino acid
  Variant (241)..(242): xaa in position 241 to 242 is any amino acid
  Variant (244)..(244): xaa in position 244 is any amino acid
  Variant (246)..(246): xaa in position 246 is any amino acid
  Variant (253)..(255): xaa in position 253 to 255 is any amino acid
  Variant (264)..(265): xaa in position 264 to 265 is any amino acid
  Variant (267)..(267): xaa in position 267 is any amino acid
  Variant (270)..(271): xaa in position 270 to 271 is any amino acid
  Variant (276)..(279): xaa in position 276 to 279 is any amino acid
  Variant (281)..(283): xaa in position 281 to 283 is any amino acid
  Variant (284)..(293): xaa in position 284 to 293 is any or no amino acid
  Variant (296)..(297): xaa in position 296 to 297 is any amino acid
  Variant (300)..(302): xaa in position 300 to 302 is any amino acid
  Variant (305)..(306): xaa in position 305 to 306 is any amino acid
  Variant (309)..(309): xaa in position 309 is any amino acid
  Variant (313)..(313): xaa in position 313 is any amino acid
  Variant (322)..(322): xaa in position 322 is any amino acid
  Variant (329)..(330): xaa in position 329 to 330 is any amino acid
  Variant (336)..(336): xaa in position 336 is any amino acid
  Variant (339)..(348): xaa in position 339 to 348 is any amino acid
  Variant (350)..(353): xaa in position 350 to 353 is any amino acid
  Variant (354)..(354): xaa in position 354 is any or no amino acid
  Variant (358)..(359): xaa in position 358 to 359 is any amino acid
  Variant (362)..(363): xaa in position 362 to 363 is any amino acid
  Variant (365)..(369): xaa in position 365 to 369 is any amino acid
  Variant (371)..(372): xaa in position 371 to 372 is any amino acid
  Variant (374)..(381): xaa in position 374 to 381 is any amino acid
  Variant (382)..(383): xaa in position 382 to 383 is any or no amino acid
  Variant (385)..(386): xaa in position 385 to 386 is any amino acid
  Variant (388)..(389): xaa in position 388 to 389 is any amino acid
  Variant (390)..(393): xaa in position 390 to 393 is any or no amino acid
  Variant (396)..(399): xaa in position 396 to 399 is any amino acid
  Variant (401)..(401): xaa in position 401 is any amino acid
  Variant (403)..(404): xaa in position 403 to 404 is any amino acid
  Variant (406)..(407): xaa in position 406 to 407 is any amino acid
  Variant (409)..(411): xaa in position 409 to 411 is any amino acid
  Variant (415)..(419): xaa in position 415 to 419 is any amino acid
  Variant (421)..(423): xaa in position 421 to 423 is any amino acid
  Variant (424)..(426): xaa in position 424 to 426 is any or no amino acid
  Variant (428)..(428): xaa in position 428 is any amino acid
  Variant (431)..(433): xaa in position 431 to 433 is any amino acid
  Variant (436)..(437): xaa in position 436 to 437 is any amino acid
  Variant (439)..(440): xaa in position 439 to 440 is any amino acid
  Variant (442)..(449): xaa in position 442 to 449 is any amino acid
  Variant (451)..(462): xaa in position 451 to 462 is any amino acid
  Variant (463)..(475): xaa in position 463 to 475 is any or no amino acid
  Variant (477)..(478): xaa in position 477 to 478 is any amino acid
  Variant (480)..(485): xaa in position 480 to 485 is any amino acid
  Variant (487)..(488): xaa in position 487 to 488 is any amino acid
LXRXLXXRHLXMIALXXXGGXIGTGLFLXSGXXIXXAGPXGXLLAYXXXGXMVYXLMXXLGELAXXMPXXGSFXXYAXRFVXXXXGFXLGWXYWXXWXVXXAXEXXXXXXVMXXWXXXXXXXXXXWXXIFXXLIXXLNXXSXRXFGEXEFWXSXIKVXXIIXFIILGXXXIXGXXXXXXXXXXXXXXXXXXXXXXXXXFXXGXXXXXXXXXXXXXXXXXXLXXXFSFXGTELIGIXAGESXXPXKXIPKAIRXXXWRILLFYVXXIXVIXXLIPYXXXXLXXXXXXXXXXXXXPFXXVFXXXGIXXAAXIMNXVILTAVLSXANSGLYXXTRMLWXLAXXXXXXXXXXKXXXXXGVPXXALXXTXXXXXLXXLXXXXXXXXXXYXXLXXXXXXSGXXXXIXWXXIXXSXXXFRRXXXXXGXXXXXXLXYKXXXYPXXPXXAXXXXXXXXLXXXXXXXXXXXXXXXXXXXXXXXXXYXXIXXXXXXYXXY

SEQ ID NO: 17370 - protein, 78 aa, Artificial sequence
  Variant (2)..(2): xaa in position 2 is Ile or Leu
  Variant (3)..(3): xaa in position 3 is Ala or Ser
  Variant (4)..(4): xaa in position 4 is Ile, Leu, Met or Val
  Variant (7)..(7): xaa in position 7 is any amino acid
  Variant (14)..(14): xaa in position 14 is any amino acid
  Variant (15)..(16): xaa in position 15 to 16 is any or no amino acid
  Variant (18)..(23): xaa in position 18 to 23 is any amino acid
  Variant (24)..(25): xaa in position 24 to 25 is any or no amino acid
  Variant (27)..(27): xaa in position 27 is Ala or Pro
  Variant (28)..(28): xaa in position 28 is any amino acid
  Variant (29)..(29): xaa in position 29 is Gly or Ser
  Variant (30)..(32): xaa in position 30 to 32 is any amino acid
  Variant (33)..(33): xaa in position 33 is Ala, Gly, Ser or Thr
  Variant (34)..(34): xaa in position 34 is Phe or Tyr
  Variant (35)..(37): xaa in position 35 to 37 is any amino acid
  Variant (38)..(38): xaa in position 38 is Ala, Gly or Ser
  Variant (39)..(39): xaa in position 39 is any amino acid
  Variant (40)..(40): xaa in position 40 is Ile, Leu, Met or Val
  Variant (41)..(41): xaa in position 41 is any amino acid
  Variant (42)..(42): xaa in position 42 is Phe, Trp or Tyr
  Variant (43)..(46): xaa in position 43 to 46 is any amino acid
  Variant (47)..(47): xaa in position 47 is Ala, Cys, Ser or Thr
  Variant (48)..(48): xaa in position 48 is Ile or Leu
  Variant (49)..(49): xaa in position 49 is Ala, Asp or Gly
  Variant (51)..(51): xaa in position 51 is Leu or Met
  Variant (52)..(52): xaa in position 52 is Ala, Cys, Ser, Thr or Val
  Variant (53)..(53): xaa in position 53 is Ala, Ser, Thr or Val
  Variant (54)..(55): xaa in position 54 to 55 is any amino acid
  Variant (57)..(58): xaa in position 57 to 58 is any amino acid
  Variant (59)..(59): xaa in position 59 is Ala, Gly or Ser
  Variant (60)..(60): xaa in position 60 is Ala, Ser or Thr
  Variant (61)..(63): xaa in position 61 to 63 is any amino acid
  Variant (64)..(64): xaa in position 64 is Phe, His or Tyr
  Variant (65)..(65): xaa in position 65 is Ala, Gly, Asn, Pro, Ser or Thr
  Variant (66)..(67): xaa in position 66 to 67 is any amino acid
  Variant (68)..(68): xaa in position 68 is Phe, His or Tyr
  Variant (69)..(69): xaa in position 69 is Ile, Leu or Val
  Variant (70)..(70): xaa in position 70 is Asp, Glu, Gly, Asn or Ser
  Variant (71)..(71): xaa in position 71 is any amino acid
  Variant (72)..(72): xaa in position 72 is Ala, Gly or Ser
  Variant (73)..(73): xaa in position 73 is any amino acid
  Variant (74)..(74): xaa in position 74 is Ala or Gly
  Variant (75)..(77): xaa in position 75 to 77 is any amino acid
  Variant (78)..(78): xaa in position 78 is Ala, Gly, Ser or Thr
MXXXGGXIGTGLFXXXGXXXXXXXXGXXXXXXXXXXXXXXXXXXXXXXXEXXXXXPXXXXXXXXXXXXXXXXXXXXXX

SEQ ID NO: 17371 - protein, 59 aa, Artificial sequence
  Variant (2)..(21): xaa in position 2 to 21 is any amino acid
  Variant (22)..(23): xaa in position 22 to 23 is any or no amino acid
  Variant (25)..(25): xaa in position 25 is any amino acid
  Variant (26)..(26): xaa in position 26 is Phe, Ile, Leu, Met or Val
  Variant (27)..(27): xaa in position 27 is Ala, Gly, Pro, Ser or Thr
  Variant (28)..(28): xaa in position 28 is Ala, Ser, Thr or Val
  Variant (29)..(30): xaa in position 29 to 30 is any amino acid
  Variant (31)..(31): xaa in position 31 is Phe or Tyr
  Variant (32)..(32): xaa in position 32 is Ala or Gly
  Variant (34)..(34): xaa in position 34 is any amino acid
  Variant (36)..(36): xaa in position 36 is Phe or Tyr
  Variant (38)..(38): xaa in position 38 is any amino acid
  Variant (39)..(39): xaa in position 39 is Ala or Ser
  Variant (40)..(40): xaa in position 40 is any amino acid
  Variant (41)..(41): xaa in position 41 is Phe, Ile, Leu or Val
  Variant (44)..(44): xaa in position 44 is any amino acid
  Variant (45)..(45): xaa in position 45 is Ala, Thr or Val
  Variant (46)..(46): xaa in position 46 is Ile, Met or Val
  Variant (47)..(47): xaa in position 47 is Ile, Leu, Met or Val
  Variant (48)..(49): xaa in position 48 to 49 is any amino acid
  Variant (50)..(50): xaa in position 50 is Ile, Leu or Val
  Variant (51)..(51): xaa in position 51 is Ala, Gly, Ile, Leu or Val
  Variant (52)..(58): xaa in position 52 to 58 is any amino acid
WXXXXXXXXXXXXXXXXXXXXXXNXXXXXXXXEXEXWXXXXKVXXXXXXXXXXXXXXXG

SEQ ID NO: 17372 - protein, 47 aa, Artificial sequence
  Variant (2)..(2): xaa in position 2 is Cys, Ser, Thr or Val
  Variant (4)..(4): xaa in position 4 is any amino acid
  Variant (5)..(5): xaa in position 5 is Ile, Leu, Met or Val
  Variant (7)..(7): xaa in position 7 is any amino acid
  Variant (8)..(8): xaa in position 8 is any or no amino acid
  Variant (10)..(10): xaa in position 10 is any or no amino acid
  Variant (13)..(13): xaa in position 13 is Ala, Gln, Ser or Thr
  Variant (14)..(15): xaa in position 14 to 15 is any amino acid
  Variant (17)..(18): xaa in position 17 to 18 is any amino acid
  Variant (19)..(19): xaa in position 19 is Ala, Asp, Asn, Ser, Thr or Val
  Variant (20)..(20): xaa in position 20 is Ile, Leu, Met or Val
  Variant (22)..(22): xaa in position 22 is any amino acid
  Variant (23)..(23): xaa in position 23 is Ala, Gly, Ser or Val
  Variant (24)..(29): xaa in position 24 to 29 is any amino acid
  Variant (31)..(33): xaa in position 31 to 33 is any amino acid
  Variant (35)..(35): xaa in position 35 is Phe or Tyr
  Variant (36)..(37): xaa in position 36 to 37 is any amino acid
  Variant (38)..(38): xaa in position 38 is Ala, Cys, Ser or Thr
  Variant (39)..(39): xaa in position 39 is Ile, Leu, Met or Val
  Variant (40)..(40): xaa in position 40 is any amino acid
  Variant (41)..(41): xaa in position 41 is Phe, Ile, Leu or Val
  Variant (42)..(42): xaa in position 42 is Ile, Leu, Met or Val
  Variant (43)..(43): xaa in position 43 is Ala, Cys, Gly, Ser or Val
  Variant (44)..(45): xaa in position 44 to 45 is any amino acid
  Variant (46)..(46): xaa in position 46 is Phe, Ile, Leu or Val
  Variant (47)..(47): xaa in position 47 is Asn, Pro or Ser
GXEXXGXXAXGEXXXPXXXXPXXXXXXXXRXXXFXXXXXXXXXXXXX

SEQ ID NO: 17373 - protein, 66 aa, Artificial sequence
  Variant (2)..(8): xaa in position 2 to 8 is any amino acid
  Variant (10)..(12): xaa in position 10 to 12 is any amino acid
  Variant (14)..(14): xaa in position 14 is Ala or Gly
  Variant (15)..(15): xaa in position 15 is Ala, Asp, Gly, Gln, Ser or Thr
  Variant (16)..(16): xaa in position 16 is any amino acid
  Variant (17)..(17): xaa in position 17 is Phe, Ile, Leu or Met
  Variant (19)..(19): xaa in position 19 is any amino acid
  Variant (20)..(20): xaa in position 20 is Ile or Val
  Variant (21)..(21): xaa in position 21 is Ile, Leu or Val
  Variant (22)..(22): xaa in position 22 is Ile, Leu or Met
  Variant (23)..(23): xaa in position 23 is any amino acid
  Variant (24)..(24): xaa in position 24 is Ala or Ser
  Variant (25)..(25): xaa in position 25 is Ala, Ile, Leu or Val
  Variant (26)..(26): xaa in position 26 is Ile, Leu, Met or Val
  Variant (28)..(28): xaa in position 28 is Ala, Cys, Ser or Val
  Variant (29)..(29): xaa in position 29 is any amino acid
  Variant (30)..(30): xaa in position 30 is Asn or Thr
  Variant (31)..(31): xaa in position 31 is any amino acid
  Variant (32)..(32): xaa in position 32 is Ala, Gly, Ser or Val
  Variant (33)..(33): xaa in position 33 is Ile, Leu, Met or Val
  Variant (34)..(34): xaa in position 34 is Phe or Tyr
  Variant (35)..(35): xaa in position 35 is Ala, Ser, Thr or Val
  Variant (36)..(36): xaa in position 36 is Ala, Cys, Gly, Asn, Ser or Thr
  Variant (37)..(37): xaa in position 37 is Ala, Gly, Ser, Thr or Val
  Variant (39)..(61): xaa in position 39 to 61 is any amino acid
  Variant (62)..(62): xaa in position 62 is any or no amino acid
  Variant (64)..(65): xaa in position 64 to 65 is any amino acid
  Variant (66)..(66): xaa in position 66 is Ala or Ser
FXXXXXXXGXXXAXXXXNXXXXXXXXSXXXXXXXXXXRXXXXXXXXXXXXXXXXXXXXXXXXPXXX

SEQ ID NO: 17374 - DNA, 1163 bp, Escherichia coli
  CDS (215)..(1009)
aagcttggctgtctcaggtttgttcctgattggttacggcgcgtttcgcatcattgttgagtttttccgccagcccgacgcgcagtttaccggtgcctgggtgcagtacatcagcatggggcaaattctttccatcccgatgattgtcgcgggtgtgatcatgatggtctgggcatatcgtcgcagcccacagcaacacgtttcctgaggaaccatgaaacagtatttagaactgatgcaaaaagtgctcgacgaaggcacacagaaaaacgaccgtaccggaaccggaacgctttccatttttggtcatcagatgcgttttaacctgcaagatggattcccgctggtgacaactaaacgttgccacctgcgttccatcatccatgaactgctgtggtttctgcagggcgacactaacattgcttatctacacgaaaacaatgtcaccatctgggacgaatgggccgatgaaaacggcgacctcgggccagtgtatggtaaacagtggcgcgcctggccaacgccagatggtcgtcatattgaccagatcactacggtactgaaccagctgaaaaacgacccggattcgcgccgcattattgtttcagcgtggaacgtaggcgaactggataaaatggcgctggcaccgtgccatgcattcttccagttctatgtggcagacggcaaactctcttgccagctttatcagcgctcctgtgacgtcttcctcggcctgccgttcaacattgccagctacgcgttattggtgcatatgatggcgcagcagtgcgatctggaagtgggtgattttgtctggaccggtggcgacacgcatctgtacagcaaccatatggatcaaactcatctgcaattaagccgcgaaccgcgtccgctgccgaagttgattatcaaacgtaaacccgaatccatcttcgactaccgtttcgaagactttgagattgaaggctacgatccgcatccgggcattaaagcgccggtggctatctaattacgaaacatcctgccagagccgacgccagtgtgcgtcggtttttttaccctccgttaaattcttcgagacgccttcccgaaattttgcaacgtcctgcaacggcgtaaatagtccggaagatgcgccgaagaaatagaaactggccaagctt

SEQ ID NO: 17375 - protein, 264 aa, Escherichia coli
MKQYLELMQKVLDEGTQKNDRTGTGTLSIFGHQMRFNLQDGFPLVTTKRCHLRSIIHELLWFLQGDTNIAYLHENNVTIWDEWADENGDLGPVYGKQWRAWPTPDGRHIDQITTVLNQLKNDPDSRRIIVSAWNVGELDKMALAPCHAFFQFYVADGKLSCQLYQRSCDVFLGLPFNIASYALLVHMMAQQCDLEVGDFVWTGGDTHLYSNHMDQTHLQLSREPRPLPKLIIKRKPESIFDYRFEDFEIEGYDPHPGIKAPVAI

SEQ ID NO: 17376 - DNA, 927 bp, Xenopus tropicalis
  CDS (1)..(927)
atgcctgtcatttccgagcccgtcgcctccagctgccccgagcaggggccagggaaggcggagaatcgggacgagctgcagtacttggatcagatcaagcatatcctagagcgtgggcaccgcaaggaagatcgcactggcaccgggaccgtatcggtattcggcatgcaagcccgctacagcctgcgagatcagtttcctttgctgacaacaaaacgtgtcttctggaaaggagtgctagaagaacttttgtggtttattaagggatgtaccaactcaaaagaactttctgcaaaaggtgtaaagatctgggatgcaaatggctcccgggaatttttggacaagcaaggattctcaaacagagaggaaggagatcttggaccagtgtatggctttcagtggaggcactttggtgctgaatacaaagacacttatacagattactcaggtcaaggtgttgaccaactaaggaatgtaattgaaacaatcaaaaacaacccagatgaccgaagaattataatgtgcagctggaaccctaaagatatttctcttatggctctgccgccttgtcacacactttgccagttctacgtaatcgataaagagttatcctgtcagctgtaccagcggtctggggacatgggcctgggagtgcccttcaacattgccagttatgccttgctcacttatatgattgctcatgtcactggattgaagccaggagactttgtccacaccttgggcgatgctcatgtttatcttaaccacactgaacctttaaagcttcaacttcaaagaacacctcgcccattccccaagctaaaaatcttgcgcaaagtggaaaacattgatgacttcactgcagatgattttctaatagaaggctataacccccacccctctattaaaatggaaatggctgtgtga

SEQ ID NO: 17377 - protein, 308 aa, Xenopus tropicalis
MPVISEPVASSCPEQGPGKAENRDELQYLDQIKHILERGHRKEDRTGTGTVSVFGMQARYSLRDQFPLLTTKRVFWKGVLEELLWFIKGCTNSKELSAKGVKIWDANGSREFLDKQGFSNREEGDLGPVYGFQWRHFGAEYKDTYTDYSGQGVDQLRNVIETIKNNPDDRRIIMCSWNPKDISLMALPPCHTLCQFYVIDKELSCQLYQRSGDMGLGVPFNIASYALLTYMIAHVTGLKPGDFVHTLGDAHVYLNHTEPLKLQLQRTPRPFPKLKILRKVENIDDFTADDFLIEGYNPHPSIKMEMAV

SEQ ID NO: 17378 - DNA, 780 bp, Saccharomyces cerevisiae
  CDS (1)..(780)
atgactatggacggaaaaaacaaagaagaagagcaatatcttgatctatgcaaaagaatcattgatgaaggtgaatttaggccagatagaacaggcactgacgctaacctattgtctgagcaaggtgttaagatttgggacggtaatggatctcgtgaatatttagataagatggggttcaaagataggaaagtaggagatctggggcccgtttacggatttcaatggaggcattttggtgctaaatacaagacgtgcgatgacgactatactggacaaggtattgatcaattgaaacaggttatacataaactaaagacaaatccctacgatagaagaatcattatgagtgcctggaacccagctgattttgacaaaatggctttgccgccatgccatattttttcacagttctatgtcagtttccccaaagaaggagaaggatccggtaagccccgcctttcatgcttattgtaccaacgttcttgtgatatggggttgggagtaccatttaacattgcatcatatgctttgttgactagaatgattgctaaagttgtcgacatggagccaggtgagttcattcatactttgggggatgcacatgtttataaagaccacattgatgccttgaaagaacaaatcaccagaaatccaagaccattcccgaaactaaagattaaaagggacgttaaagacattgatgatttcaagttgacagactttgaaattgaagattataatcctcatccaagaattcaaatgaaaatgagtgtataa

SEQ ID NO: 17379 - protein, 259 aa, Saccharomyces cerevisiae
MTMDGKNKEEEQYLDLCKRIIDEGEFRPDRTGTDANLLSEQGVKIWDGNGSREYLDKMGFKDRKVGDLGPVYGFQWRHFGAKYKTCDDDYTGQGIDQLKQVIHKLKTNPYDRRIIMSAWNPADFDKMALPPCHIFSQFYVSFPKEGEGSGKPRLSCLLYQRSCDMGLGVPFNIASYALLTRMIAKVVDMEPGEFIHTLGDAHVYKDHIDALKEQITRNPRPFPKLKIKRDVKDIDDFKLTDFEIEDYNPHPRIQMKMSV

SEQ ID NO: 17380 - DNA, 873 bp, Ateline herpesvirus 3
  CDS (1)..(873)
atggaggagccgcatgcagagcaccagtacctctctcaggtcaagcacattttaaattgtgggaattttaaacacgacagaacaggagttggaacattgagtgtttttggaatgcagtctagatacagcttagaaaaggattttcctctcttaacaactaagagagtattttggagaggtgttgtggaagaattgttgtggtttatcagaggatctactgacagcaaagagcttgcagcatctggtgtgcacatttgggatgcaaatggatctaggtcctatttagataagcttggtttctgtgatagagaagaaggagaccttggacctgtttatggattccaatggaggcattttggagcagaatatcaaggtcttaagcacaattatggtggagaaggcgttgatcaattaaagcagataattaataccatacacacaaacccaaccgatagaagaatgttgatgtgtgcttggaatgtcttagatgttccaaaaatggcgttgcccccctgtcatgtattgagtcagttttatgtgtgtgatggaaagctttcctgtcagttatatcaaagatcagctgatatgggactaggggtgccttttaacattgctagctattctctattaacttgtatgatcgcccatgtcactgatttagttcctggagaatttattcacactttaggagatgctcacatttatgtgaatcacattgatgctctcacagagcagcttacgcgaactcccaggcctttcccaacactaaagtttgccagaaagattgcatctattgatgattttaaagcaaatgacattattctggaaaactataacccttaccctagcataaaaatgcccatggctgtttaa

SEQ ID NO: 17381 - protein, 290 aa, Ateline herpesvirus 3
MEEPHAEHQYLSQVKHILNCGNFKHDRTGVGTLSVFGMQSRYSLEKDFPLLTTKRVFWRGVVEELLWFIRGSTDSKELAASGVHIWDANGSRSYLDKLGFCDREEGDLGPVYGFQWRHFGAEYQGLKHNYGGEGVDQLKQIINTIHTNPTDRRMLMCAWNVLDVPKMALPPCHVLSQFYVCDGKLSCQLYQRSADMGLGVPFNIASYSLLTCMIAHVTDLVPGEFIHTLGDAHIYVNHIDALTEQLTRTPRPFPTLKFARKIASIDDFKANDIILENYNPYPSIKMPMAV

SEQ ID NO: 17382 - DNA, 879 bp, Melanoplus sanguinipes entomopoxvirus
  CDS (1)..(879)
atggaaatcacatcatcagatgaatatcaatatttaaaaggtatatcagaaatattatctaatggaagaataaccaaaaatagaacaggtgtagatacaaaaactgtatatggtttaactatgaaatataaattagatgattcatttccattatttacaacaaaatcaatgttttggagaggaattgttgaagaattattatggtttatatctggatcaactaatacaaatattctaaaaaataaaggaatccatatttgggatgaaaatggatcattaaaatatataaaaaaacgtggttttaatgatagaaaagaaggtgatttaggtccagtttatggttttcaatggcgtcattttggtgctaaatatattgatatggatacaaattatacaaatcaaggatttgatcaattaacacatattataaataaaataaaaaataaacctgaatctagaaatataatattaacagcctggaatcctatagatgttgaaaatatggttataccaccttgtcattgttttgtacaatttcatgtaattaataataaatatcttacatgtcaaatgtatcaaagatcagctgatatgggtttaggtgtaccatttaatgttgctagttatagtttattgacttatatgattgcacatttaactaatttaaaaccatatgaatttattcataatattggtaatgcacatatatatgttaatcatattaatggattaaaaaaacaattagaacgtacaccaaacccatttccaaaattaaaaataaaaagacaagtagataatatagatgattttaaatttgatgattttgaattaattgattataaccatttgggaaaaataaaattagatatggttgtttaa

SEQ ID NO: 17383 - protein, 292 aa, Melanoplus sanguinipes entomopoxvirus
MEITSSDEYQYLKGISEILSNGRITKNRTGVDTKTVYGLTMKYKLDDSFPLFTTKSMFWRGIVEELLWFISGSTNTNILKNKGIHIWDENGSLKYIKKRGFNDRKEGDLGPVYGFQWRHFGAKYIDMDTNYTNQGFDQLTHIINKIKNKPESRNIILTAWNPIDVENMVIPPCHCFVQFHVINNKYLTCQMYQRSADMGLGVPFNVASYSLLTYMIAHLTNLKPYEFIHNIGNAHIYVNHINGLKKQLERTPNPFPKLKIKRQVDNIDDFKFDDFELIDYNHLGKIKLDMVV

SEQ ID NO: 17384 - DNA, 888 bp, Cercopithecine herpesvirus 9
  CDS (1)..(888)
atggcgatgaatcgttataacataaaacattccgaatatcaatacttggagcaagttaattttattttacacaatggtgtacaaaaaacagatcgaaccggaactggaacgttatctgtatttggaatgcaatctcgatataacttgagaaatgaatttcccttattaactacgaaacgggtattttggaaaggcgttgttgaagagttattatggtttattaaaggatcaacaaattctaccgagcttgtagaaaaaggagttaagatttggagcgcacatggatctaagcaatttttacacagcaatggatttgacaaccgtcaagagggggatttgggtcctgtgtatggatttcaatggagacattttggagctgaatatgttgacatgaacacaaattattttggacaaggagtagatcaattacaaaatgttattaatttaattaaaacgaacccaaacgacagaagaattattttatgcgcctggaacgctaaagatgtgcctttaatggctttgcctccatgtcatatgctatgccaattttacgttgctaataatgaattgtcgtgtcaaatgtatcaacgatccgctgatatgggactgggtgttcctttcaatattgcaagttatgcgctgcttacgtatatgattgcacatgttacagatttaaaaacgggtgacttagtccacaccataggagacgcgcatatttaccttaatcatatagaacctttaaaattacagttaacacgacaaccaaaacaattcccaactcttcgcattactcgaactgttaaagatattaacgattttaaagctgatgattttgtgttagaaggttataatccccataattcaattccaatggaaatgtctgtttaa

SEQ ID NO: 17385 - protein, 295 aa, Cercopithecine herpesvirus 9
MAMNRYNIKHSEYQYLEQVNFILHNGVQKTDRTGTGTLSVFGMQSRYNLRNEFPLLTTKRVFWKGVVEELLWFIKGSTNSTELVEKGVKIWSAHGSKQFLHSNGFDNRQEGDLGPVYGFQWRHFGAEYVDMNTNYFGQGVDQLQNVINLIKTNPNDRRIILCAWNAKDVPLMALPPCHMLCQFYVANNELSCQMYQRSADMGLGVPFNIASYALLTYMIAHVTDLKTGDLVHTIGDAHIYLNHIEPLKLQLTRQPKQFPTLRITRTVKDINDFKADDFVLEGYNPHNSIPMEMSV

SEQ ID NO: 17386 - DNA, 987 bp, Mycoplasma pneumoniae M129
  CDS (1)..(987): transl_table=4
atgagctttaaaataaccgttttaagttattgcaaaaactcttttaaaaaagttattcgcttattttgcaagcttaaaaaaagatttttatacaatgctacaccatcgaagtttaggagagttatgcagcagtatctagatttagcccgttatgttttagagcacggaaaataccgtccaaatcgcactgatactgctggcattggtgtctttggttaccagatgcactttgatatttcaaaacactttccgctcttgactacgaagaaggtgcactgaaagtcgattgtgcacgaacttttgtggttcattaagggtgacaccaatattaagtacctagtcgacaataaggtcaacatttggaatgaatgaccttacgaaagctttaaaaagtcacctcactttaacggtgagagtcaaaaggagttcattgaacggattcgacaagacgcgaagtttgcccaacagtttggtaacctcggacccgtttatggaaagcaatggcgtgactttaacggagtcgatcaattgaaaaaggtaattgcgcaaattaaggtaaatccgttttcgcggcgcttaattgtgtctagttgaaatcccaatgaggtggatcaaatgttgctcccgccttgtcattcactgtaccagttttacgtacaggacgggcagttgagctgccagttgtaccagcgcagtggtgatatttttctaggtatccccttcaacattgcgtcctactctcttctggtgtacttagttgctaaggaaactaacctaaaaccagggagctttgtccacaccattggcgatgcccacatttacgaaaatcacttggaacaaattaagttgcaattaacacgtcaacccaaaccattgcccaaggtagttttaaagagtgataaatcaatttttgattatcaattcgatgatattgaactggtggattacgaccaccaccctacaattaaaggagaggtagcagtttaa

SEQ ID NO: 17387 - protein, 328 aa, Mycoplasma pneumoniae M129
MSFKITVLSYCKNSFKKVIRLFCKLKKRFLYNATPSKFRRVMQQYLDLARYVLEHGKYRPNRTDTAGIGVFGYQMHFDISKHFPLLTTKKVHWKSIVHELLWFIKGDTNIKYLVDNKVNIWNEWPYESFKKSPHFNGESQKEFIERIRQDAKFAQQFGNLGPVYGKQWRDFNGVDQLKKVIAQIKVNPFSRRLIVSSWNPNEVDQMLLPPCHSLYQFYVQDGQLSCQLYQRSGDIFLGIPFNIASYSLLVYLVAKETNLKPGSFVHTIGDAHIYENHLEQIKLQLTRQPKPLPKVVLKSDKSIFDYQFDDIELVDYDHHPTIKGEVAV

SEQ ID NO: 17388 - DNA, 888 bp, Invertebrate iridescent virus 6
  CDS (1)..(888)
atggatattaataatgaagaaaaacaatatttaaatttattagaaaaagttctttttcaaggcgaagatcgtgacgatagaacaggaattggaactaaaaatgtatttggagaacaattaaaatttaatttaagaacatcttttccgttactaactacaaaaaaagttttttggaaaggagttgtagaagaactcttatggtttattagcgggagtacagatgtttctgtattaaatcaaaaaggagttaaaatttggaataaaaatgcagaatcgttttatacacaacaaaatctttttaaaaaaaatgatttaggacctatttatggttttcagtggagacattatggtgaaaattatattgggtgcgataataaatatggtggtatagatcaactcaaaaatattattacaacaattcaaaatgaaccttgggatagaagaatgatattattagcttggaacccaaaggataattctaaaatggcacttcctccttgtcattgtatagcacattttgatgtaagttcaaaaataaatggtaaaagagaattgtcttgtcatttatttcaaagatctgcagatatggggttgggagttccttttaacatagcaagttatgcattattaacacatataatagctcatgtctcatcaaccaatacagaattaattgttcctggagattttgttcacacattaagtaatgttcatatttataaaaatcatattaaagctcttacagaacaaatatcgagaattccaagaaaatttccaactttagaaattataaataaaaataaaaatattgatgcattttcaagtaaagattttgtattaaaagattataatccatatccagctttagaaatggaaatggcgttataa

SEQ ID NO: 17389 - protein, 295 aa, Invertebrate iridescent virus 6
MDINNEEKQYLNLLEKVLFQGEDRDDRTGIGTKNVFGEQLKFNLRTSFPLLTTKKVFWKGVVEELLWFISGSTDVSVLNQKGVKIWNKNAESFYTQQNLFKKNDLGPIYGFQWRHYGENYIGCDNKYGGIDQLKNIITTIQNEPWDRRMILLAWNPKDNSKMALPPCHCIAHFDVSSKINGKRELSCHLFQRSADMGLGVPFNIASYALLTHIIAHVSSTNTELIVPGDFVHTLSNVHIYKNHIKALTEQISRIPRKFPTLEIINKNKNIDAFSSKDFVLKDYNPYPALEMEMAL

SEQ ID NO: 17390 - DNA, 1479 bp, Arabidopsis thaliana
  CDS (1)..(1479)
atggcttctactggtgaaactatatgtaacaatggccaaagcgcagtttcagtaacaaggaggaggagttaccaagttgtaatagcggcgacaagagacatgggtcttggtatggacatgaaacttccttgggatctaccttcagagtatcagtttttccaagatgttacaactaggacatccgatcccacgaagaggaacgcgactataatgggaagaaaatcatgggaatctactcctctagagattcgtcctcttcctggtcggctcaatattgtcttgacaaagtctagctgccacaacattgccattgatgagaatgtactggtgtctagtagcatggaatcggctcttgaacttctagccactgagccctattccttgtccattgagaaggtctttgtcataggaggcggcgagttgttaaggaattatatgaatgcatccatctgtgatgctatccacctaaccgaaatcgatataagcgtgccatgtgacgcatttgcaccgagagtggatacttctctgtaccgtccgtggtactcatcatttccagttgtggaaaatggaattcggtatagtttcaacacttatgtccgaagaaaagatgccattgttggctccggtgaaaagaaaagtgttgctgagtcagatttgaaggagtactcgtttttgcctaagatggttttcgagaggcatgaggagtttggttacttgaatcttgttcaaaacattatatctagtggagacatgaatgacaatagtactctttctaaatttggctgtcagatgcggttcaatctgcgcaagactttcccgcttctcacgaccaagaaaatattctggcttggtgttgtagaggaaatactacaacttatcagtggttcaaacaatcccaaggaaaacggtagtcatatatgggacaccgatgaggcaaaagaatatcttgacagtttcggagtgaatgccaccgaagaagatggagacaacccattcttgcatggacttcactggaaacattgtgatgctaggtttgtgattcaagaattcagtcagctctctgatgttataaacaaaataaagaacaatcctcatgatcaaaggatcatgcttgccgcttgtaatccattagatttcaagttgtcggtatctccttgtcatacgttcacacagttctatgtggcaaatggtgaagtttcttgtcaaatataccaaagctcaaccgaagcgagtatcgggattcctttcagtatcgctacatactctcttttgacatgcatcatcgctcatgtttgcgatcttggagctggtgatttcatccatgtgattggacaagcctatattaacaaagctcacgtcaaggctatacaaaaacagcttcaaatctcccctaaacccttcccgattttgaaaatcaaccctgagaaaaagaagatggacaactttgaggcctctgatttggaactcatgaggatataa

SEQ ID NO: 17391 - protein, 492 aa, Arabidopsis thaliana
MASTGETICNNGQSAVSVTRRRSYQVVIAATRDMGLGMDMKLPWDLPSEYQFFQDVTTRTSDPTKRNATIMGRKSWESTPLEIRPLPGRLNIVLTKSSCHNIAIDENVLVSSSMESALELLATEPYSLSIEKVFVIGGGELLRNYMNASICDAIHLTEIDISVPCDAFAPRVDTSLYRPWYSSFPVVENGIRYSFNTYVRRKDAIVGSGEKKSVAESDLKEYSFLPKMVFERHEEFGYLNLVQNIISSGDMNDNSTLSKFGCQMRFNLRKTFPLLTTKKIFWLGVVEEILQLISGSNNPKENGSHIWDTDEAKEYLDSFGVNATEEDGDNPFLHGLHWKHCDARFVIQEFSQLSDVINKIKNNPHDQRIMLAACNPLDFKLSVSPCHTFTQFYVANGEVSCQIYQSSTEASIGIPFSIATYSLLTCIIAHVCDLGAGDFIHVIGQAYINKAHVKAIQKQLQISPKPFPILKINPEKKKMDNFEASDLELMRI

SEQ ID NO: 17392 - DNA, 1698 bp, Arabidopsis thaliana
  CDS (1)..(1698)
atgaggtgtttgcaaaactccgcaaagactctacctttagcgtttaaatcggcattgctgcctttgtctcaaaggtggttctgtaaattttctcctaagccatcctcattgacaaacattttcaaggtttcaatttcaaccatggcaaacactctcaatggaaatgtgatcatgacttcaaagcctcagagtacttaccaagttgtggtagctgcaaccaaggaaatgggtattggtaaagacggaaaacttccatggaatttgcctaccgatctcaagttcttcaaggatttaactttgtccacttcggattctgctaagaagaacgctgttgttatgggtaggaaaacgtgggagtctattcccaaaaagtataggccactctctggtcgcctgaatgttgtcttgtctcgttctagcggtttcgatatagccaacactgaaaatgttgtaacttgcagtagcatagattctgctctagacttattagctgcacctccgtttagtctgtccattgagaaagtgtttgtaataggaggtggcgacatattgagggaagctttgaataaaccgagctgtgaagccatccacataactgagattgatacaagtatcgactgtgatacatttattcccacggttgacacttctgcatatcagccttggtgttcgtcgtttccaatatgtgaaaatggtcttcgattttccttcacgactcatgttcgtgtaaagagttcttctgccggtgaagcctctgatgagagtgatgggtcaaaggttcttcaagttgattggaagaagttttcttctgttcttcctaaaatgatttttgaccggcatgaggaatatctctacttaaatctggtcaaagagataatctcaaatggaaacttaaaagacgataggacagggactggtacattatctaaatttggttgtcagatgaaattcaatttacgcaggaattttccacttctgacgacaaagagagttttctggagaggtgttgttgaggaacttctatggttcataagcggttcaaccaatgcaaaggtacttcaagaaaagggtatccgtatatgggatgggaatgcgtcgagagcatatcttgatggtattggactgactgagagagaggaaggtgaccttggacccgtttatggatttcagtggagacactttggtgctaagtacacagatatgcatgctgattatactggccaaggatttgatcagctcttagatgtaattaacaagatcaagaacaatcctgatgatcgacggattataatgtcagcttggaatccttctgatcttaagctgatggcacttcctccatgccacatgtttgcacagttttatgttgcaaatggagaactttcatgtcaaatgtatcagcgttcagccgatatgggtctcggcgtaccgtttaacattgcctcatactcccttcttacatgcattcttgctcacgtctgcgatcttgttcctggtgattttatccatgtgattggagatgctcatgtttacaaaaaccatgtcaggcctctgcaagagcaacttgagaacccaccaaaaccttttcctgttttgaagataaatccagagaagaaagatatagattcttttgttgcggatgactttgagctcattggctatgatcctcacaagaaaatagatatgaaaatggctgtttag

SEQ ID NO: 17393 - protein, 565 aa, Arabidopsis thaliana
MRCLQNSAKTLPLAFKSALLPLSQRWFCKFSPKPSSLTNIFKVSISTMANTLNGNVIMTSKPQSTYQVVVAATKEMGIGKDGKLPWNLPTDLKFFKDLTLSTSDSAKKNAVVMGRKTWESIPKKYRPLSGRLNVVLSRSSGFDIANTENVVTCSSIDSALDLLAAPPFSLSIEKVFVIGGGDILREALNKPSCEAIHITEIDTSIDCDTFIPTVDTSAYQPWCSSFPICENGLRFSFTTHVRVKSSSAGEASDESDGSKVLQVDWKKFSSVLPKMIFDRHEEYLYLNLVKEIISNGNLKDDRTGTGTLSKFGCQMKFNLRRNFPLLTTKRVFWRGVVEELLWFISGSTNAKVLQEKGIRIWDGNASRAYLDGIGLTEREEGDLGPVYGFQWRHFGAKYTDMHADYTGQGFDQLLDVINKIKNNPDDRRIIMSAWNPSDLKLMALPPCHMFAQFYVANGELSCQMYQRSADMGLGVPFNIASYSLLTCILAHVCDLVPGDFIHVIGDAHVYKNHVRPLQEQLENPPKPFPVLKINPEKKDIDSFVADDFELIGYDPHKKIDMKMAV

SEQ ID NO: 17394 - DNA, 1164 bp, Deinococcus radiodurans R1
  CDS (1)..(1164): transl_table=11
ttgaggtatttcacgcccccgcccggcgcggtctactgcccgcatgaacctagaaccctaccagcaggcttcgcccgagcgcctgcgcctttacctgtccctcttcgccatggtcgcgctgaccgtgctgctcggcggccagcggacgggcgacctcggcgtgcgcggcaccctacggcgcagcgcctttgcacgcggcatgtttgccgacatcggggccatcagcacgctgggggcgctttatctcgtcctgaacggcagaacctccgtgcgggtgcccgctgctatcgccacgttgtttgtcggaagttttgcgctgctgcccgcactggcctacgaagactgggccgccatgcaggagcgcaggcagtgaaacagtacctcgattttctccgccacatccgcgaccacgggaccgacaagatggaccgcaccggcaccggcacccgctcggtgttcgggtatcagatgcgcttcgacctctctgaaggctttcccctggtcacgaccaagcgggtgcacctgaagtccatcatctacgagctgctgtggtttctgcgcggcgacagcaacgtgcgctggctgcaggagcacggcgtgaccatctgggacgaatgggcgcgcgagggcggcgaactcgggccggtctacggcgtgcagtggagaagctggcccgactatggcggcgggcagattgaccagatttcgcaggtcatcgagcaaatcaagacgaatccggactcaagaaggctgattgtctccgcctggaacgtggcgcagattgacgagatggccctccccccctgccacctgctctttcagttctacgtggcggacgggaaactcagttgccagctctaccagcgcagcgccgacagctttctgggcgtgccgttcaacatcgccagttacgcgctgctgaccatgatggtggcccaggtctgcggcctcgaacccggcgagttcatctggacgggtggcgactgccacatctacagcaatcacatggagcaggtggagcgccaactgaagcgcgagccgaggcccttgccgaagatgcggctcaatcccgcagtcaaagacatgtttgctttccagtacgaggactttacgttggaagggtacgacccgcatccgggcatcaaggcggaggtggcggtatga

SEQ ID NO: 17395 - protein, 387 aa, Deinococcus radiodurans R1
MRYFTPPPGAVYCPHEPRTLPAGFARAPAPLPVPLRHGRADRAARRPADGRPRRARHPTAQRLCTRHVCRHRGHQHAGGALSRPERQNLRAGARCYRHVVCRKFCAAARTGLRRLGRHAGAQAVKQYLDFLRHIRDHGTDKMDRTGTGTRSVFGYQMRFDLSEGFPLVTTKRVHLKSIIYELLWFLRGDSNVRWLQEHGVTIWDEWAREGGELGPVYGVQWRSWPDYGGGQIDQISQVIEQIKTNPDSRRLIVSAWNVAQIDEMALPPCHLLFQFYVADGKLSCQLYQRSADSFLGVPFNIASYALLTMMVAQVCGLEPGEFIWTGGDCHIYSNHMEQVERQLKREPRPLPKMRLNPAVKDMFAFQYEDFTLEGYDPHPGIKAEVAV

SEQ ID NO: 17396 - DNA, 801 bp, Mycobacterium tuberculosis CDC1551
  CDS (1)..(801): transl_table=11
gtgtcaatcgtgacgccatacgaggacctgctgcgcttcgtgctcgaaacgggtacgcccaaatccgaccgcaccggcaccggaacccgcagcctgttcggccagcagatgcgctatgatttgtcggccggtttcccgctgctcactaccaagaaagtccatttcaaatcggtagcctacgagctgctgtggtttttgcgcggcgattccaatatcggttggctgcacgagcacggagtcaccatctgggacgaatgggcaagtgatacaggcgaactcgggccgatctacggtgtacaatggcgatcgtggccggctccatccggtgagcacatcgaccagatcagcgcggcgctggatttgctgcgcaccgatcccgattcccggcgcatcatcgtgtcggcctggaacgtcggcgaaatcgagcggatggcgctgccgccctgtcatgcgttcttccagttctacgtcgccgatggccggctgagctgtcagctctaccaacgcagcgccgacctgtttctgggtgtgccgttcaacatcgccagctatgcgttgctcacccacatgatggccgcccaggccggcttgtcggtcggcgagttcatctggaccggtggcgactgccacatctacgacaatcacgtcgagcaagtacggctgcagctcagccgcgagccgcggccatatccgaaactacttctagccgaccgggattcaatcttcgagtacacctatgaagacatcgttgtgaagaactacgatccgcatccggcgatcaaagctccagtcgcggtatga

SEQ ID NO: 17397 - protein, 266 aa, Mycobacterium tuberculosis CDC1551
MSIVTPYEDLLRFVLETGTPKSDRTGTGTRSLFGQQMRYDLSAGFPLLTTKKVHFKSVAYELLWFLRGDSNIGWLHEHGVTIWDEWASDTGELGPIYGVQWRSWPAPSGEHIDQISAALDLLRTDPDSRRIIVSAWNVGEIERMALPPCHAFFQFYVADGRLSCQLYQRSADLFLGVPFNIASYALLTHMMAAQAGLSVGEFIWTGGDCHIYDNHVEQVRLQLSREPRPYPKLLLADRDSIFEYTYEDIVVKNYDPHPAIKAPVAV

SEQ ID NO: 17398 - DNA, 840 bp, Agrobacterium tumefaciens str. C58
  CDS (1)..(840): transl_table=11
gtgctattatattcccttgatatcagggaatcggcggcagaacgcatgaaacaatatctcgatcttctccggcatgtgatggaaaccggctccgaccgcggagaccgcaccggcaccggcacgcgttcggtattcggttaccagatgcgtttcgacctttccgaaggttttccggttctcaccacaaagaaactgcatctgcgctccatcatccatgagctgctgtggttcctaaacggcgataccaatattgcctatctcaaggaaaatggtgtttccatctgggatgaatgggccgatgagaacggcgatctcggtccggtctatggcgcgcaatggcggtcctggccagcgcctgatggccgccatatcgaccagatcgcgcttctgatcgaggcgcttaaaaccaatcccaattcccgccgccacatcgtttcggcctggaacccggcgctggtggacgaaatggcgctgccgccctgccattgcctgttccagttctatgtgtccgatggaaagctgtcctgccagctttaccagcgctcggccgatattttcctcggcgtgcccttcaatatcgcatcctacgcgctgctgacgctgatggtggcgcaggtcgtgggcctcaagcccggcgatttcgttcatacccttggtgatgcgcatatctacgccaaccatttcgaacaggcgcagctgcagatgacgcgtacgccgaaggccttgccgaccatgcgcctcaaccctgatgtgaagaaccttttcggctttaagttcgaggactttacgctggagaattacgaggccgattcaagcatcaaggcaccgatcgcggtatga

SEQ ID NO: 17399 - protein, 279 aa, Agrobacterium tumefaciens str. C58
MLLYSLDIRESAAERMKQYLDLLRHVMETGSDRGDRTGTGTRSVFGYQMRFDLSEGFPVLTTKKLHLRSIIHELLWFLNGDTNIAYLKENGVSIWDEWADENGDLGPVYGAQWRSWPAPDGRHIDQIALLIEALKTNPNSRRHIVSAWNPALVDEMALPPCHCLFQFYVSDGKLSCQLYQRSADIFLGVPFNIASYALLTLMVAQVVGLKPGDFVHTLGDAHIYANHFEQAQLQMTRTPKALPTMRLNPDVKNLFGFKFEDFTLENYEADSSIKAPIAV

SEQ ID NO: 17400 - DNA, 870 bp, Shrimp white spot syndrome virus
  CDS (1)..(870)
atggagggagaacatcaatatttgaacctagtcagggagatcctagaaagaggagtgaagaaggacgatagaactggaacaggaactctatccatttttggaccccaaatgaggttctctcttcgagacgacactattccagttctcactaccaagaaaattttctggagaggagttgtggaagaactcttgtggttcatcaggggcaatacagacgccaaagaattggccaagaagaagatacacatctggaacgctaatgggtcgcgggaatttttggacagtagagggttatacgatagagcagagggagatttgggacccgtatacggattccaatggcgtcattttggtgctgaatatgatacctgttcttccgattatactggaaagggtattgatcaattggccaatatactaaagaccctgagagaaaatccagatgatagaaggatgattatgacggcatggaatcctatggatcttcaccttatggctcttcctccatgccacatgactgctcaattttatgtggctaatggagaattgtcgtgccagttgtatcagcgaagcggagatgtcgggttgggcgtgcccttcaatattgcatcatactctcttctgactcatctgatggccagtatggtgggtctaaaaccgggagagtttatcctcactcttggtgacgcacacatttataatacccacattgaggtgttaaagaagcagttgtgccgcgtccctagaccattccctaagttgaggattttaatggctccagaaaaaattgaggactttactatcgacatgttttatcttgaggggtatcaaccacacagtggaaacttgcagatgaaaatggctgtttga

SEQ ID NO: 17401 - protein, 289 aa, Shrimp white spot syndrome virus
MEGEHQYLNLVREILERGVKKDDRTGTGTLSIFGPQMRFSLRDDTIPVLTTKKIFWRGVVEELLWFIRGNTDAKELAKKKIHIWNANGSREFLDSRGLYDRAEGDLGPVYGFQWRHFGAEYDTCSSDYTGKGIDQLANILKTLRENPDDRRMIMTAWNPMDLHLMALPPCHMTAQFYVANGELSCQLYQRSGDVGLGVPFNIASYSLLTHLMASMVGLKPGEFILTLGDAHIYNTHIEVLKKQLCRVPRPFPKLRILMAPEKIEDFTIDMFYLEGYQPHSGNLQMKMAV

SEQ ID NO: 17402 - DNA, 1116 bp, Salmonella enterica subsp. enterica serovar Typhi str. CT18
  CDS (1)..(1116): transl_table=11
gtgaggttgattttgtctatcctactgaatcgagactttacgaacggtcagtttgccagtggttcgtatgccaaagtggttgaaacggtgctcaactctggcgttcacgcgggtgatcgcaccggaaccggcacaaaaagcgtttcatatgtcccttcctactacatgctgactggcggctctgttccacttatctccggaaaagccgtcaacctgaagccgttactggttgagctggagtggtatctcaaaggaacgggcaacattcagttcctgaaagacaatggcgtcaaaatctgggatgcctgggctgatgaaaatggcgatttaggcccggtctatggcaagcaatggcgtcggtgggaagacacccgcatcgtgagccatagcgagtatttgagcaaaatcgacacgttccgtgagcgcgggtacaaggtcgaggggtatctgggcgtaagtgaagatcgcgttgtgttgtcacgtgaaatcgaccagctacagcgtatcgttcacacgcttcgcaccaacccgacagatcgtcgcatcctgctgaatgcctggaatgttggcgaactggaagacatgaagctgccgccatgccatttcgtgttttcactgtggagtcgcaagctggactttgagacccgactgacgatggccaccgacattggcattcagcacaaccgccacggccacgagtccatttacacccagatgctgtgtcttctggaaagagatggcggcattacggaaaacctgctggacgagctgggcatcccgaaacgcatcctgaactcatgcctggtgcagcgcagcgtcgatacctttgttggtatgccgttcaatattgccggttacggcattctcacccacttcctcgcgaagatcaccggccacatggctggcgcattcgtgcattttggctttgacgttcatctctacgacaaccacatgggaggcgttgaggagctgatgaagcgcgagccgcccaaagagtccgacccggttgtcatttttccgcatgaatgggccgaactggacgacttcaaatgggaaggtgtgcaggtgtgcggctacagccctcttccgtggatcaaggttccagtggcggtgtga

SEQ ID NO: 17403 - protein, 371 aa, Salmonella enterica subsp. enterica serovar Typhi str. CT18
MRLILSILLNRDFTNGQFASGSYAKVVETVLNSGVHAGDRTGTGTKSVSYVPSYYMLTGGSVPLISGKAVNLKPLLVELEWYLKGTGNIQFLKDNGVKIWDAWADENGDLGPVYGKQWRRWEDTRIVSHSEYLSKIDTFRERGYKVEGYLGVSEDRVVLSREIDQLQRIVHTLRTNPTDRRILLNAWNVGELEDMKLPPCHFVFSLWSRKLDFETRLTMATDIGIQHNRHGHESIYTQMLCLLERDGGITENLLDELGIPKRILNSCLVQRSVDTFVGMPFNIAGYGILTHFLAKITGHMAGAFVHFGFDVHLYDNHMGGVEELMKREPPKESDPVVIFPHEWAELDDFKWEGVQVCGYSPLPWIKVPVAV

SEQ ID NO: 17404 - DNA, 1002 bp, Cercopithecine herpesvirus 17
  CDS (1)..(1002)
atgattgtcctggtgcatctcggtatctgctacgttaaaaaaattatacccgtttgcgtggctggaatcgcggccgcacgactccgggttttttccgcacccgaaggtgccgcggccgtccgctgcgcgtgccgcggcgaccacggcgagctgcagtacttggcgcacctggatttaattattaaacacggcgtgcagagggaggacaggacgggcgtgggcaccaggtccgtgttcgggcttcaggcccgatataacctcagggacgagtttcctctgttaaccaccaaaagggtgttttggaggggcgtcgtggaggagttgctgtggtttatcaggggctccaccgactccaccgaactgtcgcgccgcggcgtaaaaatttgggacgcgcacgggtcccgcgcctttttggcggcgcagggcttcggggaccgccgcgagggcgatctggggccggtgtacgggttccagtggagacattttggggcggagtacaggggggccgacgccaactacgagggtcagggggtggaccagctgcgttacgtggtggatctaattaacaggcggccccacgatcggcgcatcgttatgtgcgcgtggaaccccgcggacctcgcgcggatggctctccctccttgtcacgttttgtgtcagttttacgtggctcggggggagctgtcctgccagctgtaccagaggtccgccgacatgggcctcggggtcccgtttaacatcgccagctacgccctcctgacgtatctgatcgctcacgtcacgggcctgaccccgggagactttgtgcacaccttgggtgacgcccacgtttacaacaaccacgttgatcccctgctgcttcagctgcggaggaccccgcgtccgtttccgcggctgaagattttgagaaaggtggcgcgtctggaggactttacgcgcgcggatctgagtctcgagggctacgacccccatccccacatagagatggagatggccgtttga

SEQ ID NO: 17405 - protein, 333 aa, Cercopithecine herpesvirus 17
MIVLVHLGICYVKKIIPVCVAGIAAARLRVFSAPEGAAAVRCACRGDHGELQYLAHLDLIIKHGVQREDRTGVGTRSVFGLQARYNLRDEFPLLTTKRVFWRGVVEELLWFIRGSTDSTELSRRGVKIWDAHGSRAFLAAQGFGDRREGDLGPVYGFQWRHFGAEYRGADANYEGQGVDQLRYVVDLINRRPHDRRIVMCAWNPADLARMALPPCHVLCQFYVARGELSCQLYQRSADMGLGVPFNIASYALLTYLIAHVTGLTPGDFVHTLGDAHVYNNHVDPLLLQLRRTPRPFPRLKILRKVARLEDFTRADLSLEGYDPHPHIEMEMAV

SEQ ID NO: 17406 - DNA, 960 bp, Danio rerio
  CDS (1)..(960)
atgcccgacacggcagtggaagtgacaaacggacattgcgttaacggagaaagcaagaaagaagaaacaaacggagggaaaaaggagttttctctgttttgcgacgagcgcgggtatttgagtctggtggagtttattttgcagaatggagcgaagaaaggcgacaggacaggcacaggagtgatctctgtgttcgggacacaagccagatacagtctcagagatcagtttccgttgctgacgaccaaaagagttttctggaaaggcatattggaggagctgctgtggttcatcaagggttcaacaaacgccaaagatctgtcggagaagggtgtgaggatttgggatgctaacggctccagagagtttctggataagaacggattcaccgatcgggaggaaggagatctgggtccagtttatggatttcagtggaggcattttggagccgaatacaaagatatgcatactgattattctggagaaggagtcgatcagttacagaaagttattgacaccatcaagtcaaacccagaggaccgaaggatcatcatgtgtgcctggaatcctaaagatctccctctgatggcgctgccgccctgtcatgcgttgtgtcagttttacgtgtcgaacggtgagttgtcatgtcagctgtaccagcgatcgggagacatcggcctcggtgtcccattcaacatcgccagctacgccctgctgacctacatgatcgcccacatcactggactcaagcctggggatttcgttcatacattaggtgacgcccacatctacaccaatcacatcgagcctttaaaagagcagattcagcgagagccgcgtccgttccccaaactccggattaaacgcaaagttgaacaaattaatgatttctgtgctgaagattttgagatctatgattatgacccacatcctacaatcaaaatgcaaatggctgtttag

SEQ ID NO: 17407 - protein, 319 aa, Danio rerio
MPDTAVEVTNGHCVNGESKKEETNGGKKEFSLFCDERGYLSLVEFILQNGAKKGDRTGTGVISVFGTQARYSLRDQFPLLTTKRVFWKGILEELLWFIKGSTNAKDLSEKGVRIWDANGSREFLDKNGFTDREEGDLGPVYGFQWRHFGAEYKDMHTDYSGEGVDQLQKVIDTIKSNPEDRRIIMCAWNPKDLPLMALPPCHALCQFYVSNGELSCQLYQRSGDIGLGVPFNIASYALLTYMIAHITGLKPGDFVHTLGDAHIYTNHIEPLKEQIQREPRPFPKLRIKRKVEQINDFCAEDFEIYDYDPHPTIKMQMAV

SEQ ID NO: 17408 - DNA, 1878 bp, Schizosaccharomyces pombe 972h-
  CDS (1)..(1878)
atgtcacaacctttgcatgccaggtttgctaccagggctgtaaaaaatcccatgatccttgagaaagagcgacaacttacggattctaaatatcatattttggtcgctgcaacgggttcggttgcggcgataaaattgacattaatcgttaaatccctactgacatacaagggcgtcgacgttcaagtcgttttaacggatccggctcgtaactttgttgagaaagaggacttaacggctttgggtgtcaatgtttataacaatgcggatgattggaaaaattgggacggactcgaatgtcctatcacacatattgagctacgtcgatgggcacatcttttgttaattgcccctttaagtgcaaatactatggccaaaatggcaaatggtctctgtgacaatttacttacctctcttatacgtgcctgggcccctttaaaaccaattctcttggctcccgcaatgaataccttgatgtggactaatcctataactcaggaacatttgagcgctattagcagaatatacaagaatagtgaatttatcatgccaatcgagaaagtgcttgcctgtggtgatattggcatgggcggtatggccgaatggagaaacattgtaggcagagttgccgataaattgcagctagaacaaaagtctgtcttgccgaacgctgtgaaaaacatcgatggacaagatgatgactctagtgaacaaactgctgcttttgaagagtacgatgatgatgatgatgacgatgttgatgataatgaacaatccaacagtatgattgaaacttctgcaaatgcagatattacccccaaggcctctcttttaccctctactacagaatcttctataagcaaagatcacgagacctcccaagctccattaggctcggaatcggtggatactcaggcctctgaaaatgttactaccaaacccgaacctcctgtaccatttacttcctccgaatatagaaatacagaagaagagcaatacctaaatttgattcgatatatccttgaaaatggccagtcgcggcccgatcgcacgggaactggtacgagatcggtatttgctcctccacaactacgcttttctttaaggaataatactctacctcttctcactacaaagcgtgtttttttacgtggtgtgcttgaagagttactttggtttattcacggtgatactaatgccaatcatttaagtgaaaaagggattcatatatgggatggcaatggcagtagagaattcctagacagcagagggcttactgatcgtaaagttggtgacctcggtcctatatatggttttcaatggagacatttcggagcgcaatatgttgattgcgatactgactataccaataaaggagtggatcagctggctcaggttatatctaccctcaaattaaacccttatgaccgtcgtataattctttcagcttggaacccattagctattcctgaaatggctttaccaccttgccatatattttgccagttttatgtcagtgagccttgcaagcctgggggaaagccccaactttctagtatgatgtatcagcgctctgccgacatggggcttggagttccttttaacattgcttcttattctctcttaacacatatgatagctcacatgtgcggctatgaagctgccgaatttgttcacgtaatgggtgattgtcatatatacaatgatcatttagaggcattacaaactcagttggaaagagttcctaaagctttccctaagttgtttttcaaacgtgatgctaaagacatagggtctattgatagtttcagcgttgatgatttcgcagttgaaggttataatccttatggccctattaaaatgaaaatgagtgtctaa

SEQ ID NO: 17409 - protein, 625 aa, Schizosaccharomyces pombe 972h-
MSQPLHARFATRAVKNPMILEKERQLTDSKYHILVAATGSVAAIKLTLIVKSLLTYKGVDVQVVLTDPARNFVEKEDLTALGVNVYNNADDWKNWDGLECPITHIELRRWAHLLLIAPLSANTMAKMANGLCDNLLTSLIRAWAPLKPILLAPAMNTLMWTNPITQEHLSAISRIYKNSEFIMPIEKVLACGDIGMGGMAEWRNIVGRVADKLQLEQKSVLPNAVKNIDGQDDDSSEQTAAFEEYDDDDDDDVDDNEQSNSMIETSANADITPKASLLPSTTESSISKDHETSQAPLGSESVDTQASENVTTKPEPPVPFTSSEYRNTEEEQYLNLIRYILENGQSRPDRTGTGTRSVFAPPQLRFSLRNNTLPLLTTKRVFLRGVLEELLWFIHGDTNANHLSEKGIHIWDGNGSREFLDSRGLTDRKVGDLGPIYGFQWRHFGAQYVDCDTDYTNKGVDQLAQVISTLKLNPYDRRIILSAWNPLAIPEMALPPCHIFCQFYVSEPCKPGGKPQLSSMMYQRSADMGLGVPFNIASYSLLTHMIAHMCGYEAAEFVHVMGDCHIYNDHLEALQTQLERVPKAFPKLFFKRDAKDIGSIDSFSVDDFAVEGYNPYGPIKMKMSV

SEQ ID NO: 17410 - DNA, 864 bp, Streptococcus pyogenes MGAS315
  CDS (1)..(864): transl_table=11
atgcttacagaaaggttattagagatgacaaaagctgaccagatttttaaagctaatattcaaaaaattataaacgaaggatcattgagtgagcaagcacgtcctaaatataaagatggtcgaacagctcattctaagtatattactggggcgtttgctgaatatgatttagctaaaggagagtttcccatcacaactttacgacccattccaattaaatctgctataaaggaattattttggatatatcaagatcagtctaacagtttagatgtgctagaagctaaatataatgttcattattggaatgaatgggaagttgaccagacacgtactattgggcaacgttatggtgctgtagtcaaaaaacatgatatcatctcaaaaatactaaagcaattagcagaaaatccttggaatcgtcgtaatgtcatttctctctgggactatgaagcatttgaggagacaaaagggttgttgccatgtgcctttcaaatcatgtttgatgttagacgtgtaggggaagatctttatttagatgctagtttgacgcaacgttctaatgacatattagttgctcatcacatcaatgccatgcaatacgttgccttgcagatgatgattgctaaacattttggatggaaaataggtaagttcttttattttgttaacaatttacatatttatgacaaccaatttgatcaggctcaagaattgctaaaacgacagccagttgctagtcagcctaagcttgttttaaatgttccagataggactaatttctttgatattaaaccagatgattttgaattacaaaattatgatccagtgaagcctcagttgcactttgaccttgctatttaa

SEQ ID NO: 17411 - protein, 287 aa, Streptococcus pyogenes MGAS315
MLTERLLEMTKADQIFKANIQKIINEGSLSEQARPKYKDGRTAHSKYITGAFAEYDLAKGEFPITTLRPIPIKSAIKELFWIYQDQSNSLDVLEAKYNVHYWNEWEVDQTRTIGQRYGAVVKKHDIISKILKQLAENPWNRRNVISLWDYEAFEETKGLLPCAFQIMFDVRRVGEDLYLDASLTQRSNDILVAHHINAMQYVALQMMIAKHFGWKIGKFFYFVNNLHIYDNQFDQAQELLKRQPVASQPKLVLNVPDRTNFFDIKPDDFELQNYDPVKPQLHFDLAI

SEQ ID NO: 17412 - DNA, 876 bp, Heliothis zea virus 1
  CDS (1)..(876)
atgcagacaaactgggaagagcaccaatacttgaacacgatcagaagtatcattgaaactggtaatcgccgcatggatcgcaccaaagtgggcaccctgtctcactttggagtgatgcatcggtactcgttgagggacaatagtctgcctctgttgacgaccaagactgtctttgtcaagggcgtcatcgaggagctcttgtggatgatttccggatcgaccaatgccaaagagctgagccgaaagggtgtacacatttggagcggcaacagtagtcgaagcgttttggattcgctcggcttcaccgacagacaagagggcgatctgggacccgtgtacggattccagtggagacactcgggcaccaagtatgtagactgcgagacagactattcgggtcagggtgttgatcaattgcagacaatcattgacactctcaagaccaatccaacagacaggaggatcgtaatgtgttcatggaatcctgcagatttgcaccaaatggcactaccaccgtgtcactgtttggctcagttttactcgtacgatggcaaattgtcatgcttaatgtatcagaggagtgccgacatgggcctcggtgtaccctttaacattgcaagctattctatgttgacgcacatgattgctcacattaccggcctgaaagcgcacgagttcgtacacaccattggcgacgctcacgtgtatttaaatcacatcgagccattaaaggtgcaactcgaacgggagccgagaccttttcccaagctggagtttgctcgtaaagttgaaaatattgacagttttaagtacgaagattttataataaaaggttacgatccatacccgaagattcccatggttctggctgtttag

SEQ ID NO: 17413 - protein, 291 aa, Heliothis zea virus 1
MQTNWEEHQYLNTIRSIIETGNRRMDRTKVGTLSHFGVMHRYSLRDNSLPLLTTKTVFVKGVIEELLWMISGSTNAKELSRKGVHIWSGNSSRSVLDSLGFTDRQEGDLGPVYGFQWRHSGTKYVDCETDYSGQGVDQLQTIIDTLKTNPTDRRIVMCSWNPADLHQMALPPCHCLAQFYSYDGKLSCLMYQRSADMGLGVPFNIASYSMLTHMIAHITGLKAHEFVHTIGDAHVYLNHIEPLKVQLEREPRPFPKLEFARKVENIDSFKYEDFIIKGYDPYPKIPMVLAV

SEQ ID NO: 17414 - DNA, 1827 bp, Plasmodium falciparum 3D7
  CDS (1)..(1827)
atgatggaacaagtctgcgacgttttcgatatttatgccatatgtgcatgttgtaaggttgaaagcaaaaatgaggggaaaaaaaatgaggtttttaataactacacatttagaggtctaggaaataaaggagtattaccatggaaatgtaattccctagatatgaaatatttttgtgcagttacaacatatgtgaatgaatcaaaatatgaaaaattgaaatataagagatgtaaatatttaaacaaagaaactgtggataatgtaaatgatatgcctaattctaaaaaattacaaaatgttgtagttatgggaagaacaagctgggaaagcattccaaaaaaatttaaacctttaagcaataggataaatgttatattgtctagaaccttaaaaaaagaagattttgatgaagatgtttatatcattaacaaagttgaagatctaatagttttacttgggaaattaaattactataaatgttttattataggaggttccgttgtttatcaagaatttttagaaaagaaattaataaaaaaaatatattttactagaataaatagtacatatgaatgtgatgtattttttccagaaataaatgaaaatgagtatcaaattatttctgttagcgatgtatatactagtaacaatacaacattggattttatcatttataagaaaacgaataataaaatgttaaatgaacaaaattgtataaaaggagaagaaaaaaataatgatatgcctttaaagaatgatgacaaagatacatgtcatatgaaaaaattaacagaattttacaaaaatgtagacaaatataaaattaattatgaaaatgatgatgatgatgaagaagaagatgattttgtttattttaattttaataaagaaaaagaagagaaaaataaaaattctatacatccaaatgattttcaaatatataatagcttgaaatataaatatcatcctgaataccaatatttaaatattatttatgatattatgatgaatggaaataaacaaagtgatcgaacgggagtaggtgttttaagtaaattcggatatattatgaaatttgatttaagtcaatatttcccattattaactacgaagaaattatttttaagaggaattattgaagaattgctttggtttattagaggagaaacaaatggtaatacgttgttaaataagaatgtaaggatatgggaagctaatggtactagggaatttttagataatagaaaattatttcatagagaagttaacgatttaggacctatttatggttttcaatggagacatttcggtgctgaatatacaaatatgtatgataattatgaaaataaaggagtggatcaattaaaaaatataataaatttaattaaaaatgatcctacaagtagaagaattcttttgtgtgcatggaatgtaaaagatcttgaccaaatggcattacctccttgtcatattttatgtcagttttatgttttcgatgggaaattatcatgtattatgtatcaaagatcatgtgatttagggctaggagtaccttttaatattgcttcttattctatttttactcatatgattgcacaagtctgtaatttgcaacctgcgcagttcatacacgttttaggaaatgcacatgtttataataatcacattgatagtttaaaaattcaacttaacagaataccctatccattcccaacacttaaattaaatccagatattaaaaatattgaagattttacaatttcggattttacaatacaaaattatgttcatcatgaaaaaatttcaatggatatggctgcttaa

SEQ ID NO: 17415 - protein, 608 aa, Plasmodium falciparum 3D7
MMEQVCDVFDIYAICACCKVESKNEGKKNEVFNNYTFRGLGNKGVLPWKCNSLDMKYFCAVTTYVNESKYEKLKYKRCKYLNKETVDNVNDMPNSKKLQNVVVMGRTSWESIPKKFKPLSNRINVILSRTLKKEDFDEDVYIINKVEDLIVLLGKLNYYKCFIIGGSVVYQEFLEKKLIKKIYFTRINSTYECDVFFPEINENEYQIISVSDVYTSNNTTLDFIIYKKTNNKMLNEQNCIKGEEKNNDMPLKNDDKDTCHMKKLTEFYKNVDKYKINYENDDDDEEEDDFVYFNFNKEKEEKNKNSIHPNDFQIYNSLKYKYHPEYQYLNIIYDIMMNGNKQSDRTGVGVLSKFGYIMKFDLSQYFPLLTTKKLFLRGIIEELLWFIRGETNGNTLLNKNVRIWEANGTREFLDNRKLFHREVNDLGPIYGFQWRHFGAEYTNMYDNYENKGVDQLKNIINLIKNDPTSRRILLCAWNVKDLDQMALPPCHILCQFYVFDGKLSCIMYQRSCDLGLGVPFNIASYSIFTHMIAQVCNLQPAQFIHVLGNAHVYNNHIDSLKIQLNRIPYPFPTLKLNPDIKNIEDFTISDFTIQNYVHHEKISMDMAA

SEQ ID NO: 17416 - DNA, 861 bp, Enterobacteria phage RB69
  CDS (1)..(861): transl_table=11
atgaaacaataccaatacctgattaatgatatcctagaaaatggctacgaaacagacgaccgtacaggcacaggcactattgccctgttcggaactaaattgcgatgggacctgactaaaggattccctgcagtaacaaccaagaagcttgcatggaaagcttgtattgccgaactactgtggttcatgtctggttctaccaatgttaatgatttgcgtattcgtactcatggtagtctaattgaaggtaaaactatttgggacgacaactatgaaaatcaggcaaaagaccttggatatcatagcggcgaacttggtcctatttatggtaagcaatggcgtgattttggtggtgtagaccaattggtcaaaactatcgaccgtattaaagctcttcctaatgatcgtcgacaaatagtttctgcatggaaccctgccgaaattgaccaaatggctcttcctccttgtcatatgttctatcaatttaatgtgcgtaatggacatcttgatttacaatggtatcaacgcagtgtagatgttttcttgggcctgccgttcaacatcgcctcgtacgctgccttgacgcatattgtagcgaagatgtgtaaccttatcccgggtgatttagtgttctcaggcggcaacacgcatatctacagcaatcatgtagaacaatgcaaagaagttcttcgtcgtgaacctaaagagttgtgttctcttgaaattaattggcctagtaattttgagaattggcctacaaaaatccaaatggactgggttactggaacgatgacacattctgatttcgttcttaaaaattacgaatctcatccaactatcaaagctaaaatggcggtataa

SEQ ID NO: 17417 - protein, 286 aa, Enterobacteria phage RB69
MKQYQYLINDILENGYETDDRTGTGTIALFGTKLRWDLTKGFPAVTTKKLAWKACIAELLWFMSGSTNVNDLRIRTHGSLIEGKTIWDDNYENQAKDLGYHSGELGPIYGKQWRDFGGVDQLVKTIDRIKALPNDRRQIVSAWNPAEIDQMALPPCHMFYQFNVRNGHLDLQWYQRSVDVFLGLPFNIASYAALTHIVAKMCNLIPGDLVFSGGNTHIYSNHVEQCKEVLRREPKELCSLEINWPSNFENWPTKIQMDWVTGTMTHSDFVLKNYESHPTIKAKMAV

SEQ ID NO: 17418 - DNA, 804 bp, Porphyromonas gingivalis W83
  CDS (1)..(804): transl_table=11
ttgcgtggtatgaaacagtatttggatctgcttcgccgcatcctcgacgagggagtacgaaaagaagaccgcacgggtacgggtacgatcagcgtattcggccatcagatgtgctttgaccttgaagagggatttcccttgcttacgaccaagcgattgcacttgaagtccattatatacgaactgctttggttcctcagaggtgacacgaacgtgcattacctgcaggaacatggcgtacgcatttggaacgaatgggctgatgagaacggcgatttgggacctatatatggctaccagtggcgcagttggccggactatcggggagggcatatagaccaaatgcaggaggtgctgcgccagctgcgcgaagaaccggacagccggcgcattatcgtatgctcgtggaatgtaggccagcttgccgatatgcatctgcctccatgccactgtttcatgcagttctatgtcgctgacggccggctgagcctgcaactctatcagcgcagtgccgattcttttctgggcataccgttcaacatagcttcgtatgcactcctgctacaaatgatcgctcatgtcacagggctgaaacccgggcgattcgtacatacactgggcgacgcccatatctatcttaaccacctcgaacaggtacagctacaactgagtcgtgagccgagagcgttgccccgaatggtactgaatccggaggtgtccgatctcttcgacttccgatacgaagacttccgactcgaagggtatgatccgcatccgcacattgcgggcgttgtagcagtctga

SEQ ID NO: 17419 - protein, 267 aa, Porphyromonas gingivalis W83
MRGMKQYLDLLRRILDEGVRKEDRTGTGTISVFGHQMCFDLEEGFPLLTTKRLHLKSIIYELLWFLRGDTNVHYLQEHGVRIWNEWADENGDLGPIYGYQWRSWPDYRGGHIDQMQEVLRQLREEPDSRRIIVCSWNVGQLADMHLPPCHCFMQFYVADGRLSLQLYQRSADSFLGIPFNIASYALLLQMIAHVTGLKPGRFVHTLGDAHIYLNHLEQVQLQLSREPRALPRMVLNPEVSDLFDFRYEDFRLEGYDPHPHIAGVVAV

SEQ ID NO: 17420 - DNA, 840 bp, Bacteriophage 44RR2.8t
  CDS (1)..(840): transl_table=11
atgattcaatataaagacttagttgaagatgttatcgcgaatggccgtcgcaaaaccgatcgcaccggtgttggcactcggtcagtatttggccgaatgctgcgattcgatttgtctaaaggtttccctgcggtgacgtgcaaacagctagcgtggaaatcggtagttggcgaattgctgtggtttatcagcggctccactaacgtcgaccatcttcgcaggataacccatgggccgaattccgataagcgaactatttgggatgccaactatgaagaacaggcaatcaatcttggatattctgatggttatttaggcccggtatatggcaagcagtggcgtcagtttggcaataagaacccagtcgatcagttgcaaaaagttatcgaccaaatcaaatcgaatccagattcccgccgtcttctggttgttgcttggaacccggaagatatcgatgctatggctctgccaccatgccatttcgcattccaattcgaagtatatgaaggcaaattgagtcttatgtggtcccaacgaagcgtcgacgtcgggttgggtctcccattcaatatcgcttcttacgccctcttggttcacattattgcaggcatatgcggtcttgaagtcggcgaacttgtattttctggtgcagatgtccacgtttacgagaatcacgtcgatgatttggttgaaatcttctggcgggatccacgtccgctgccgaaacttgcctactacgacgtagctaatttggctgaattgcgcaccatgactgttgacgactacgttctgacggaatatgatcctcacccgccaatcaagatgccgatggccgtatga

SEQ ID NO: 17421 - protein, 279 aa, Bacteriophage 44RR2.8t
MIQYKDLVEDVIANGRRKTDRTGVGTRSVFGRMLRFDLSKGFPAVTCKQLAWKSVVGELLWFISGSTNVDHLRRITHGPNSDKRTIWDANYEEQAINLGYSDGYLGPVYGKQWRQFGNKNPVDQLQKVIDQIKSNPDSRRLLVVAWNPEDIDAMALPPCHFAFQFEVYEGKLSLMWSQRSVDVGLGLPFNIASYALLVHIIAGICGLEVGELVFSGADVHVYENHVDDLVEIFWRDPRPLPKLAYYDVANLAELRTMTVDDYVLTEYDPHPPIKMPMAV

SEQ ID NO: 17422 - DNA, 834 bp, Bacteriophage Aeh1
  CDS (1)..(834): transl_table=11
atgaaagcttatctagatatcatcaattatactttcgagaacggcgaagatgaaatggatcggacgggtgtgggtacccgttctgttcttggtcaagtgtttcgacacgatatggcagacggtttccccgctgttaccacaaagacgttagcgtggaaagctgttcgcggtgagtgtctgtggtttatgaacggttttacaaacgttgaagttcttcgagcgatgacatatggcgttggatcgtcttccaaaacgatttgggacgataatttcaatcatcaaggggtagcactgggttacaccgatggtgagcttggtcctgtttatggcaagcaatggcgcgactttaacggcgttgatcaacttgctaaagctatcgaacgaatcaagactaatccagaatgtcgtcgtaatatcgtttgtgcttggaatccggttgatcttgacaaaatggctctgcctccttgtcacgttctgttccgtttcagcgttaagcgcggccggttgaatctgacttggtatcagcgttctgtggatactttcttgggtctgccgtttaacatcgctagttatggcctgctgcttgaaatcgtagcccagatcaccggatacaaagctggcattcttaccggtatgctcgatgatacacatatctatcacaatcactttgaacaagttcaagagcaattacagcgtgaaccacacaagcttccgacattgaagtttaaaaaccgctttacaaccctggaagaagcgtgtaatctgtctgtagatgatattgaactagaggattacaagtgccactcagctatcaaagcacctatggcagtgtaa

SEQ ID NO: 17423 - protein, 277 aa, Bacteriophage Aeh1
MKAYLDIINYTFENGEDEMDRTGVGTRSVLGQVFRHDMADGFPAVTTKTLAWKAVRGECLWFMNGFTNVEVLRAMTYGVGSSSKTIWDDNFNHQGVALGYTDGELGPVYGKQWRDFNGVDQLAKAIERIKTNPECRRNIVCAWNPVDLDKMALPPCHVLFRFSVKRGRLNLTWYQRSVDTFLGLPFNIASYGLLLEIVAQITGYKAGILTGMLDDTHIYHNHFEQVQEQLQREPHKLPTLKFKNRFTTLEEACNLSVDDIELEDYKCHSAIKAPMAV

SEQ ID NO: 17424 - DNA, 900 bp, Bacteriophage Felix 01
  CDS (1)..(900): transl_table=11
atgtcacaagctgatttgagttacaaaaatatcctgaaccatgttttatccgttggtgaactacgtactacacgaactggagatgttatctctgcatttgctccaccacaatttcgttttgatatgcgtactggttttccactcttaacatctaaacaggtgtttacacggcaagttattggggaagctttatggttcctgaatggtgagaataaacttagtgaactccgttaccgtacttggggtgaaaatgatggggaacgctggactatctggtcagatgattttaaacgctggttaagctctaattattcttctgaacaagactggttagaagatgcaggtggaagaatctacggagttcagtggagaaactttgaaggtcataatggttgtgttgtagaccagttagaaaccttagtaacgaagatgaaaggtgatatcacagaccgttacatgcttgtcaatgcttggaatgcagcagatattgcagctaactcaatggctttagcaccttgtcatgttatgtttcagatttatatcactaacgaaggtgaagttgacttacaatggtatcagcgttctgtagacacctttttaggacttccgtttaacattgcatcttatggttttattctggaagtactttgcaagatgactgggtacactccacgatacttgataggtgtctttggggatactcagatttatcagaaccatatgaagcaggtttatgaattgatgaataatgaagagttccatgcaccaacttttgagattggtctaccacttaacacgctaagtgacctaaaacaccttactgcgagtgattttattggtggtattaacaactacaaacacgcagggaagattgaagcacctttgtcagtaggtaagtaa

SEQ ID NO: 17425 - protein, 299 aa, Bacteriophage Felix 01
MSQADLSYKNILNHVLSVGELRTTRTGDVISAFAPPQFRFDMRTGFPLLTSKQVFTRQVIGEALWFLNGENKLSELRYRTWGENDGERWTIWSDDFKRWLSSNYSSEQDWLEDAGGRIYGVQWRNFEGHNGCVVDQLETLVTKMKGDITDRYMLVNAWNAADIAANSMALAPCHVMFQIYITNEGEVDLQWYQRSVDTFLGLPFNIASYGFILEVLCKMTGYTPRYLIGVFGDTQIYQNHMKQVYELMNNEEFHAPTFEIGLPLNTLSDLKHLTASDFIGGINNYKHAGKIEAPLSVGK

SEQ ID NO: 17426 - DNA, 1023 bp, Eremothecium gossypii
  CDS (1)..(1023)
atgagctggcgcagcttgaaagaccctacttacgcgaggcaagctcattatatatatcagctaaccttgcaacggaatatgggtcttcctaatctgaaaatggattcagttaaatcggacacgaggtcgtcggtcaatgcagaggagcagcagtaccttgacttgtgcaagcgcatcattgagcatggtgaattcagacctgatagaactggtaccggcacgtactcgttatttgcgccgccgcaacttcggttcgatctgagtggcgataagtttccgctactaaccaccaagaaggtatttacgcggggcatcatacttgaactattatggttcatagcaggctgcacggacggtaagaagctatcggaacagggggttaaaatctgggagggaaacgggtcgagagaatatttagacggactagggttgcacgaccgccgggaaggtgatctcgggccggtttacggattccaatggcgccacttcggagcggaatacgggacatgcgatgacgattatacgggaaagggtgtggaccagctgagggagctaatagataagattaagaacaagccatatgaccgtcgcattatcttgtcggcttggaatcccgcagatttcccaaagatggcgcttcctccatgtcatgtgctctcccagttctatgtaagttttggacctgaaggcagcagacctaagctctcttgccagctctaccaacggtcttgcgacatgggtcttggtgttccatttaatattgcatcgtatgccctcctgacgaaaatgattgcaatggtgtgtgacatggacgctggtgaattcatccatacaatgggagacgcacatgtctacagtgaccatatagctgcgctaaaagaacaaatcgaacgtgtccccagggaattccccaacttacgtattaaaagaaaggtgacagatatagacgattttaccctcgatgacttcgagattacggactataatccacaccccagaatacaaatgaatatgagcgtttag

SEQ ID NO: 17427 - protein, 340 aa, Eremothecium gossypii
MSWRSLKDPTYARQAHYIYQLTLQRNMGLPNLKMDSVKSDTRSSVNAEEQQYLDLCKRIIEHGEFRPDRTGTGTYSLFAPPQLRFDLSGDKFPLLTTKKVFTRGIILELLWFIAGCTDGKKLSEQGVKIWEGNGSREYLDGLGLHDRREGDLGPVYGFQWRHFGAEYGTCDDDYTGKGVDQLRELIDKIKNKPYDRRIILSAWNPADFPKMALPPCHVLSQFYVSFGPEGSRPKLSCQLYQRSCDMGLGVPFNIASYALLTKMIAMVCDMDAGEFIHTMGDAHVYSDHIAALKEQIERVPREFPNLRIKRKVTDIDDFTLDDFEITDYNPHPRIQMNMSV

SEQ ID NO: 17428 - DNA, 870 bp, Anopheles gambiae str. PEST
  CDS (1)..(870)
atgaatgaagaggaacaagcatatttgcagttaattcgtgacattatcaataaaggaagcaaacgcctcgaccgcacgggtgttggtaccttgtcgatatttggagcccagatgcgatttagtctacgcgacgggatcataccgttgttaacaacaaaaaaggtattctttagaggagtggccgaagaactactttggtttatcaagggctcgacgaatgtcaaggatttgcaagcaaagggagtacgcatttgggatggtaacagcactcgagagtatctggattcgtgcggcttcaccgatcgtgaggaaggggatttgggcccggtatatgggtttcagtggcgccactttggtgccacctacaaaacatgccacgacgattacacaggtcagggaatagatcagctggctgaagtgatcgacaaaattaagaacaatccctacgatcgtcgaatcatcatgtgcgcttggaatccttctgatattcctaacatggcactaccgccatgccactgcttggcacagtttttcgttagtgatggagagctgtcgtgtcagatgtatcaacgttcggccgacgtaggtctgggcgtgccctttaacattgccagctactccttgctgacccacatgatcgcgcatgtcaccggactaaaggcaggagagtttatccataccaccggcgacactcacatttatttgaatcacgtcgatggcttgcgtgagcaaatagaaaggacgcccaaaaaattcccaacactcgtttttaaacgaaaggtagaatcaattgacaattttacctatgacgattttgaaatcttgaattacaacccccagtctgcgataaaaatgaagatggcagtttaa

SEQ ID NO: 17429 - protein, 289 aa, Anopheles gambiae str. PEST
MNEEEQAYLQLIRDIINKGSKRLDRTGVGTLSIFGAQMRFSLRDGIIPLLTTKKVFFRGVAEELLWFIKGSTNVKDLQAKGVRIWDGNSTREYLDSCGFTDREEGDLGPVYGFQWRHFGATYKTCHDDYTGQGIDQLAEVIDKIKNNPYDRRIIMCAWNPSDIPNMALPPCHCLAQFFVSDGELSCQMYQRSADVGLGVPFNIASYSLLTHMIAHVTGLKAGEFIHTTGDTHIYLNHVDGLREQIERTPKKFPTLVFKRKVESIDNFTYDDFEILNYNPQSAIKMKMAV

SEQ ID NO: 17430 - DNA, 1107 bp, Neurospora crassa
  CDS (1)..(1107)
atgacagtcaccacatccgagcccgttgcgccagcgcagtcgcagtcgcaaacctcctctcgcaccaacccaacatcaaagcgtcatgaagaataccaatacctcgatctcgtccgtcaaattctggacgaaggtgaactccgtgaagaccgaacaggaacaggcacctactccatcttcgccccgacccccctgaagttcgccctctctcgaccctcctcctcctccccctcctcggggtcctcctccgatccatcctcgccagactacacctacacccccatcctcccgctccttacgaccaagcgggtcttcaccaaagccgtcctcctcgagctcctctggttcatctccgcctcgacctcctccaccacgctctccgcccagggagtcaaaatctgggatggtaacggatcccgcgccttcctcgacatgctcggtctttcccaccgcaaagaaggtgacctaggtcccgtatatggtttccaatggcggcactttggcgccgaatacgtcgattgcgagaccgattacaccgggcagggcgtggaccaactccagcgcatcatcgacactctccgcaacaacccgtacgatcgcagactgattctgagtgcatggaaccccaaggacatgagccagatggtgctgccgccttgtcacatgtttgcgcagttttatgtgtcgtacccggggtcgaggacacggggtggtgcaacacagacacagaataaggaaggggaactggacacaccaccaaaggagaagaagccaaggggtcacttgcactgccagttgtatcaaaggtcgtgtgacatgggactgggtgtgccctttaacattgccagctacgcgctgctgacgcacatgctcgcgcacgtgtgtgacttggtgccggggagcttgacccatgttatgggcgatgcgcatgtctatctcaaccatgtggacgcgctcaagacgcagctggagcgcgagccgagggagttcccgacgctggagatccagagggagaagggaggtagtatcgatgggtggaaggccgaggattttgttatcaaggggtacgagccacacaagacgattgctatggaaatgtctgtgtag

SEQ ID NO: 17431 - protein, 368 aa, Neurospora crassa
MTVTTSEPVAPAQSQSQTSSRTNPTSKRHEEYQYLDLVRQILDEGELREDRTGTGTYSIFAPTPLKFALSRPSSSSPSSGSSSDPSSPDYTYTPILPLLTTKRVFTKAVLLELLWFISASTSSTTLSAQGVKIWDGNGSRAFLDMLGLSHRKEGDLGPVYGFQWRHFGAEYVDCETDYTGQGVDQLQRIIDTLRNNPYDRRLILSAWNPKDMSQMVLPPCHMFAQFYVSYPGSRTRGGATQTQNKEGELDTPPKEKKPRGHLHCQLYQRSCDMGLGVPFNIASYALLTHMLAHVCDLVPGSLTHVMGDAHVYLNHVDALKTQLEREPREFPTLEIQREKGGSIDGWKAEDFVIKGYEPHKTIAMEMSV

SEQ ID NO: 17432 - DNA, 1020 bp, Magnaporthe grisea 70-15
  CDS (1)..(1020)
atggcagacgcaggtgctaaaccagcccagaatggcacagaaagacatgaagagtaccaatatctcgatcttgtgcgcgagatactcgacaatggcgagcacaggccagacaggaccggcacgggcacatactccatcttcgcaccgcgccccctcaagttctccctcaacaaggacggcacgccaatcctccctctgctgacgacgaagcgcgtcttctcgcgggccgtgatcctcgagctgctgtggttcgtgtcgggcgcgacgtcggcgaagcccctgagcgacgccggggtcaagatctgggacggcaacggcagccgtgagttcctggacgggctgggattgcagcaccgcgaggtgggcgacctgggccccgtctacggcttccaatggcgccactttggcgccgaatacaccgactgccacgcagactacacgggccagggcgtcgaccagctcgccgaggtcgtgcacaagctccgcacgaacccgtacgaccgccgcatggttcttagtgcttggaaccccaaggacctcaagcttatggtcctgccgccgtgccacatgtttgcgcagttttacgtctcgtatcccaaggccggcagtgacagcaacggcaacggaaacaccacagaaggcgcggaccagacgtcatcgccatccaagccaaagggccacctccactgccagctctaccagcggtcctgcgacatgggcctaggcgtgcccttcaacattgccagctacgcactgctgacgcacatgattgcgcgtgccacgggtctagtgcccgggtcgctgacgcacgtcatgggcgatgctcacgtctacgccgaccacgtcgacgcactccggacgcagctggagcgcgagccgaggccgttccccgagctcgagatcaacaggcccgaggtcccggagggtggcgacggcgtcattgacggctggaagctcgaggactttgtcatcaaggggtatgacccgcacaaggctattgctatgaagatgtctgtctga

SEQ ID NO: 17433 - protein, 339 aa, Magnaporthe grisea 70-15
MADAGAKPAQNGTERHEEYQYLDLVREILDNGEHRPDRTGTGTYSIFAPRPLKFSLNKDGTPILPLLTTKRVFSRAVILELLWFVSGATSAKPLSDAGVKIWDGNGSREFLDGLGLQHREVGDLGPVYGFQWRHFGAEYTDCHADYTGQGVDQLAEVVHKLRTNPYDRRMVLSAWNPKDLKLMVLPPCHMFAQFYVSYPKAGSDSNGNGNTTEGADQTSSPSKPKGHLHCQLYQRSCDMGLGVPFNIASYALLTHMIARATGLVPGSLTHVMGDAHVYADHVDALRTQLEREPRPFPELEINRPEVPEGGDGVIDGWKLEDFVIKGYDPHKAIAMKMSV

SEQ ID NO: 17434 - DNA, 978 bp, Gibberella zeae PH-1
  CDS (1)..(978)
atgaccatctcacagaataacacagatcccagtccctctaatggctcaaaatttatcaaccatgaagagaaccagtaccttgacctcgttcgggaaattcttgagaccggcgagcgtcgaccagatcgtaccggtacaggaacattctcaatcttcgctcctcgacccctgaaattcgccctcaacaacaacgggacccccattctccccctccttaccacgaagcgtgtcttcactcgcgccgtcattgccgagctcctctggttcattgagggtaacacctcttccaagagtctcagtgaggccggtatcaagatctgggatggaaacggctcgcgcgaatttctcgataaccttggtcttcaacatcgtgaggtcggcgacctaggtcctgtatacggcttccaatggcggcactttggcgctgagtacgtcgatgccaagacagattataccggccagggcgtagaccagcttgccgagatcattcacaagctacgaaccaacccttatgaccgccgcttagttctttctgcctggaaccctgccgacatgaagaagatggttctaccgccttgtcatatgtttgcccagttctacgtatcctatccccgaagcaaggacgagaactcagaggagaagccccaaggacaccttcactgtcagttatatcaacgatcttgcgacatgggtctgggcgttcccttcaacattgctagctacgcgctgctgacacacatgatggcacacgtctgtgagctggtccctggaagccttacccatgtcatgggtgatgctcatgtgtacctcgatcacgttgatgccctcaaggtccaacttgagcgcgagccgcgaaactttcccgagttggaaattgccagagaaaagggtggaagcattgatggatggaaggcagatgactttaccgtcaagggatatgacccccataaaacaattgctatgaagatgtctgtatga

SEQ ID NO: 17435 - protein, 325 aa, Gibberella zeae PH-1
MTISQNNTDPSPSNGSKFINHEENQYLDLVREILETGERRPDRTGTGTFSIFAPRPLKFALNNNGTPILPLLTTKRVFTRAVIAELLWFIEGNTSSKSLSEAGIKIWDGNGSREFLDNLGLQHREVGDLGPVYGFQWRHFGAEYVDAKTDYTGQGVDQLAEIIHKLRTNPYDRRLVLSAWNPADMKKMVLPPCHMFAQFYVSYPRSKDENSEEKPQGHLHCQLYQRSCDMGLGVPFNIASYALLTHMMAHVCELVPGSLTHVMGDAHVYLDHVDALKVQLEREPRNFPELEIAREKGGSIDGWKADDFTVKGYDPHKTIAMKMSV

SEQ ID NO: 17436 - DNA, 1665 bp, Ustilago maydis 521
  CDS (1)..(1665)
atggcgatgcctcgcgtgttcctcgcgcgacacggcgagaccgaatggtccatctcgggccagcacactggtcgatccgatatcccactcaccccacacggtgaagaggtgatgcgacaacttgcgcccagcatcgtcggcgtcggcaacggcaagttgattgacccgactagactcaatcacatctttgtcagtccacgcaagcgatcgcagcgtacgcttgagatcatgctacagcacatccccgcctcgcagcgtttgggcatccctgacgtcgagatcgtccaggactgccgcgagtgggactacggtgcgtacgaagggctcaagacggacgagattcgagccaaacatcccggatgggatatctggaccgaaggaacacccgatcatcctgacagacccgacgagctgccaggtgagtcggcacagcacatgagcgatcgtgttgactcggtcatcgctaaaatccgcagtctgcaatctgggcatgtcgacaagcgcaatcagggtcacgatgtgggcagtaagacgtgcgatgttctacttgtatgccacggtcacttcaaccgggtgttcgttgctcgatggctcggtttaccgctgaccaacggacgtttgttcgaaatggatgcaggcggaatggtggtcctcggctatgcgcatcacagctttgctgaacctaccgtcgccggtatcttctcgtccaaaactggccccaagggtgacaaggaaggtgctcccggctcgtgtgggtcagcgaaacacgaagaatcgcagtacctcgagctggttcaacgagttatctcaacgggcgaatcaagaccggatcgaacgggcacaggtacgctcgcacttttcgctccgcaaccgagtttgcgattcgacttgacgaacggcaccttgcctctgctcaccaccaagcgagtgttcttccgcggagtgctggaggagttactctggttcgtgggtggtaaaaccgatgccaagcttctcaccgagaagagcgtgcacatttgggacggcaacggatctcgggccttcctcgactctcgtggactctcgcatcgtcgggaaggcgatctaggacccgtctatggtttccaatggcgacactttggtgctacgtacaaagactgtgataccgactacgccggtcagggtgtcgatcaactggcttccgtgatcgacaagattcgcaacaatcctaccgatcgtcgtatcttgctcagcgcatggaacccggcagatctcgaactgatggcgcttccgccatgccacatgtttgctcaattctttgtctcgaacctggacgcctattcgaagggtcaaggtaaaaagcacctctcgtgccagatgtaccagcgttcctgcgaccttgggttgggtgtacctttcaacattgctagctatgcgttgctaacctacatgatcgccaaagtgaccgattgcgaacccaaggaactcatactggcaatgggtgatgctcacgtttacaaggaccatgtgcaaccgctcaaggcgcagttggagagagacccgcttcccttccctaagctcaagatcgaaagggacgtcaaggatattgacgactttacgttcgatgatttcgtcgtgcaaggttacaaatgtcacggaaagatcgatatgaagatgagcgtttag

SEQ ID NO: 17437 - protein, 554 aa, Ustilago maydis 521
MAMPRVFLARHGETEWSISGQHTGRSDIPLTPHGEEVMRQLAPSIVGVGNGKLIDPTRLNHIFVSPRKRSQRTLEIMLQHIPASQRLGIPDVEIVQDCREWDYGAYEGLKTDEIRAKHPGWDIWTEGTPDHPDRPDELPGESAQHMSDRVDSVIAKIRSLQSGHVDKRNQGHDVGSKTCDVLLVCHGHFNRVFVARWLGLPLTNGRLFEMDAGGMVVLGYAHHSFAEPTVAGIFSSKTGPKGDKEGAPGSCGSAKHEESQYLELVQRVISTGESRPDRTGTGTLALFAPQPSLRFDLTNGTLPLLTTKRVFFRGVLEELLWFVGGKTDAKLLTEKSVHIWDGNGSRAFLDSRGLSHRREGDLGPVYGFQWRHFGATYKDCDTDYAGQGVDQLASVIDKIRNNPTDRRILLSAWNPADLELMALPPCHMFAQFFVSNLDAYSKGQGKKHLSCQMYQRSCDLGLGVPFNIASYALLTYMIAKVTDCEPKELILAMGDAHVYKDHVQPLKAQLERDPLPFPKLKIERDVKDIDDFTFDDFVVQGYKCHGKIDMKMSV

SEQ ID NO: 17438 - DNA, 3207 bp, Gallus gallus
  CDS (1)..(3207)
atgagcaggcatcccggatgggatgcggtgtccctccttgacctccctgcgcgttttggcctcctaagtgcccgaatgcctcgttggtaccgaagtgagaaatcccgaaccgcgggtgcgtacccatcaggtgggacgtgcggcgctcagcctcaaaccatcctactggattcaaagggatcccgctcagtgcgtggcctgaagaatatgtgcgcacaaagatttgctgcaaacctgcccttactttggcaattgaaggtggcaatacaggtttgtgatcccgctctaatccgtaacatcagtgctgatgaaggagagctcatgcaccgtatgccacttcattcttgggatgagcaaagcagtgcaggcgccagagaggctttcccactgcagaaaggagacgtgcgtgatttggcctctgcagtgcagctggagtcagtgctggtgctgaaagcctttgaggggggagttcatttatatcaacatgttttgaaatgtttccattttgatgaaaaatgcactgctgcaaaggaaaacattttgatggaaaagccagccaatattttaggtactgttcgaagacaggatggcggtttattacaacccgcagatgaaggaaatgaacatatttcaaggacgtatgcagatgtagagttctgcttgctcatctgtgtcagtgctgggcctgaagaggagctaacccagctgtcctgcagaaactctcctactgtccagcacgagcagcttccctccgagaaagaacatgaagtcctcttggttatttataatacacttgctatggctgaatggtcaccagtgtgcgccaaccaggcaggaggaaatgaatctccgggaaaacctgaagagtacgtatgcagggttgtgctggaagccttcaggcccaggtctccacttaggcttgctctggtttgctttgcctttcatgctcgctggagtcaagaggttctgcctttaactttatctgaagttggggagaaatatgtagatgaagaggtaaagaaagctttgattggtattaagcacatgaaaattatgatggaaagaaatgaagataagcacatagatctgatgaaaaccttgaagaagagcagtgaagaaaaacaggaagctttgcggcttatggatgaagtaaaggaaagattagaagaagaagaaagacaatgccaagcatctttgaaaaatctatgggatgaatgtgaaacttgtttagaaagtacctgcatgcgattctatacgacttgcagacgtggtttatcaacatttagaagcaaggttgaagattttttgaggaaaatacctccacttattttcccttttcgtgaagatcaaggaaaagacatccagtttaatgaaaagcctgagaaagaggatactcagctagtaaaaatggaagatctgtttagccaactgttatcagacatgggctcagtgtttgacagaagtttcatgtttttcaagcagatgcaaaaagaatttgaccaatcctttcaaacatatttcatgtctgatctggatttgagtgaatcccccagcatgcctgctttacctgaggccattaccagaaatgatggcttacagaaagactggggtataccggccttcctgcagacagtctttgatttcagcaagacagtgtttgaaggtgtcagtgaggtgattactgaggtattcgatgaatacaaagataatagaagagatttgccagaacaagccaaaggttctgacaggggtggcatgttctcaaaaattgtgtcaggacgtcaaaggactctgtgcaaagagcttcgagagaattcctctggatgcacacagtttcatgagagatgtcagaaatgtcaagacaatcttttgcatgattgcccaaatgttcctgaactgcacatgaagtttgatgaagcctttaagctggttaatctctctggtgagcagtatgagcagattctccagatggttcagcgtcatacagaagacacttcctacctgctgaacaaaatgaaagaaagatttgggtgggtgtctgagttatccaatatgaccatcggaccagaaaatattttcaatatagttaagtcaagcaaacctcctcttgaaatcaatgagaacacctcgcacgcaggttttcagaggcggcgctcacggggcctcccggagggggcggggagggaggtggcagcccgcccctgcgtgccgctgcgcgggaaggaaggcttttggcgggctcggcggggacgggcggacagccggagcgcacccggctgcggggaccgcccgtgccgcctcctgcccgccatgccggccgcggaggaaccgtcgagcggcctggagggcggcgagccgcagtatctgcagcaggtgcggcacatcctgcagcacggccaccgaaaggaggaccgcacgggcaccggcaccatctccgtcttcggcatgcaggcgcggtacagtctgagagatcagttcccactgctgacaacaaagagggtgttctggaaaggagtgctggaggagctactgtggtttatcaagggttctacaaatgccaaagagctctctgcaaagggtgtgaagatttgggatgccaatgggtcacgtgagttcctggataagcaggggttttgcaccagagaagagggggacttgggaccagtttatggtttccaatggaggcattttggagcagattacaaagacatgcacacagattattccaaccaaggagttgatcagttacaaaaagtgattgagatgatcaaaaccaatccagatgacagaagaatcatcatgtgtgcttggaatcccaaagatatttctctgatggctttgccaccttgccatgctctttgccagttctatgttctaaatggtgaactgtcttgccaactgtatcagaggtctggagatatgggactaggagtgcctttcaacatcgccagctattcgctgctcacatacatgattgcccacgtcacagggctgaagcctggggaattcatacacaccttaggagatgctcacatatatctgaatcatgtggagcctctaaaagttcaacttcaaagggagcccagacctttacccaaactcagaattcttcgtaaggttgaagacatcagtgactttaaggcagaagattttcagattgaagattataatcctcatccacctattaagatggagatggctgtttaa

SEQ ID NO: 17439 - protein, 1068 aa, Gallus gallus
MSRHPGWDAVSLLDLPARFGLLSARMPRWYRSEKSRTAGAYPSGGTCGAQPQTILLDSKGSRSVRGLKNMCAQRFAANLPLLWQLKVAIQVCDPALIRNISADEGELMHRMPLHSWDEQSSAGAREAFPLQKGDVRDLASAVQLESVLVLKAFEGGVHLYQHVLKCFHFDEKCTAAKENILMEKPANILGTVRRQDGGLLQPADEGNEHISRTYADVEFCLLICVSAGPEEELTQLSCRNSPTVQHEQLPSEKEHEVLLVIYNTLAMAEWSPVCANQAGGNESPGKPEEYVCRVVLEAFRPRSPLRLALVCFAFHARWSQEVLPLTLSEVGEKYVDEEVKKALIGIKHMKIMMERNEDKHIDLMKTLKKSSEEKQEALRLMDEVKERLEEEERQCQASLKNLWDECETCLESTCMRFYTTCRRGLSTFRSKVEDFLRKIPPLIFPFREDQGKDIQFNEKPEKEDTQLVKMEDLFSQLLSDMGSVFDRSFMFFKQMQKEFDQSFQTYFMSDLDLSESPSMPALPEAITRNDGLQKDWGIPAFLQTVFDFSKTVFEGVSEVITEVFDEYKDNRRDLPEQAKGSDRGGMFSKIVSGRQRTLCKELRENSSGCTQFHERCQKCQDNLLHDCPNVPELHMKFDEAFKLVNLSGEQYEQILQMVQRHTEDTSYLLNKMKERFGWVSELSNMTIGPENIFNIVKSSKPPLEINENTSHAGFQRRRSRGLPEGAGREVAARPCVPLRGKEGFWRARRGRADSRSAPGCGDRPCRLLPAMPAAEEPSSGLEGGEPQYLQQVRHILQHGHRKEDRTGTGTISVFGMQARYSLRDQFPLLTTKRVFWKGVLEELLWFIKGSTNAKELSAKGVKIWDANGSREFLDKQGFCTREEGDLGPVYGFQWRHFGADYKDMHTDYSNQGVDQLQKVIEMIKTNPDDRRIIMCAWNPKDISLMALPPCHALCQFYVLNGELSCQLYQRSGDMGLGVPFNIASYSLLTYMIAHVTGLKPGEFIHTLGDAHIYLNHVEPLKVQLQREPRPLPKLRILRKVEDISDFKAEDFQIEDYNPHPPIKMEMAV

SEQ ID NO: 17440 - DNA, 897 bp, Candida glabrata CBS138
  CDS (1)..(897)
atgacagttacaaacttagaagagaaacaatacttagatttgtgtgagagaattataaaagagggtgaatttagaccagacagaacaggtacaggtacgtatagtcttttcgcacctccacagcttaggtttagtttgaaagatgacacttttcctctattaactaccaagaaagtttttacgaaaggtatcatcttagaactgttgtggtttattgcaggctgtactgacgctaagaaactatccgatcaaggtgttaaaatatgggaaggaaatgggtcccgtgaatacttggacaagatgggttttgttgacagaagagaaggtgatctaggtccagtctatggtttccaatggagacattttggtgctgaatacaagacctgtgaagatgactacacaggtcaaggtgttgatcaactgaaagaagttatccacaagttgaagacaaatccatacgacagaagaataatcatgagtgcgtggaacccacctgattttcctaaaatggcattgcctccatgtcatgttttttcccaattttacgttaactttccaaaggatggcaagccacaactttcttgcctgttataccagagatcttgtgatatgggccttggtgttcctttcaatattgcatcttatgcactattaacaaaaatgattgcacatgtttgtgatatggaaccaggtgaatttattcacacattaggtgatgcccatgtatataaggaccacgttgatgcattgaaggaacaaatatcaagaactccaagagacttcccaaaactgaggataaataggaaggtatctgacattgatgactttaaatttgaggattttgtgttagaggaatacgatccacatccaagaattcaaatgaatatgagtgtttaa

SEQ ID NO: 17441 - protein, 298 aa, Candida glabrata CBS138
MTVTNLEEKQYLDLCERIIKEGEFRPDRTGTGTYSLFAPPQLRFSLKDDTFPLLTTKKVFTKGIILELLWFIAGCTDAKKLSDQGVKIWEGNGSREYLDKMGFVDRREGDLGPVYGFQWRHFGAEYKTCEDDYTGQGVDQLKEVIHKLKTNPYDRRIIMSAWNPPDFPKMALPPCHVFSQFYVNFPKDGKPQLSCLLYQRSCDMGLGVPFNIASYALLTKMIAHVCDMEPGEFIHTLGDAHVYKDHVDALKEQISRTPRDFPKLRINRKVSDIDDFKFEDFVLEEYDPHPRIQMNMSV

SEQ ID NO: 17442 - DNA, 939 bp, Kluyveromyces lactis NRRL Y-1140
  CDS (1)..(939)
atgacgctgagcgatgaaaacgtgaagagagttaagcttgaggctgttaacgcggaagaacagcagtatttggatttatgtgaaaggattatcaatgagggagaattcagaccagatagaactggtacagggacttattccctttttgcgcctccacagttacggtttaatttgagcaatgatactttcccgcttctcactacgaagagagtgtttacgaaaggtattattttggagctcttatggtttgttgctggatgtacagacgggaagaaattatcagaacaaggcgttaagatatgggaaggtaacggttctcgtgagtacctggactcacttgggttgactgacagaagagagggggatttaggaccagtttacgggttccaatggagacattttggggccgaatataagacatgtgatgatgattatagtggtcaaggtgttgatcagttgaaggagattattcataagttgaagacaaatccatacgacagaagaataattctttctgcatggaaccctccggatttccccaagatggctttaccgccatgccatgttttctcgcaattttacgtcagtttccccaagggagaaggtgccaaaccaagattgtcatgtgtactttatcagagatcatgtgatatgggtctaggagtaccctttaacatcgcgtcgtatgcgctactgacgaagatgattgctatggtctgtgatatggaacctggtgaatttattcacactttgggtgatgcgcatgtttataaagatcatgttgatgcattaaggacacaaattgccagagagccaagagctttcccaaaattgaagataaagagaaatgtcagtgatatcgacgatttcaaatacgaagacttcgaaataactgactataaccctcatgggaagattcaaatgaagatgagcgtttga

SEQ ID NO: 17443 - protein, 312 aa, Kluyveromyces lactis NRRL Y-1140
MTLSDENVKRVKLEAVNAEEQQYLDLCERIINEGEFRPDRTGTGTYSLFAPPQLRFNLSNDTFPLLTTKRVFTKGIILELLWFVAGCTDGKKLSEQGVKIWEGNGSREYLDSLGLTDRREGDLGPVYGFQWRHFGAEYKTCDDDYSGQGVDQLKEIIHKLKTNPYDRRIILSAWNPPDFPKMALPPCHVFSQFYVSFPKGEGAKPRLSCVLYQRSCDMGLGVPFNIASYALLTKMIAMVCDMEPGEFIHTLGDAHVYKDHVDALRTQIAREPRAFPKLKIKRNVSDIDDFKYEDFEITDYNPHGKIQMKMSV

SEQ ID NO: 17444 - DNA, 951 bp, Debaryomyces hansenii CBS767
  CDS (1)..(951)
atgacggtatctacaaacacagcagagcaaacatacttggatttgtgtgaacgtatcataaatgaaggagaacatcgtccagatagaactggaacgggtactaaatcgctttttgctcctccacagttgagatttaatctctcagacgatacattccctctacttactacaaagaaggttttttcgagagcaatcattcatgagttgttatggttcgtgcaaggatgtacagatgctaaaaagttgtcggaaaagggtgtgaagatttgggaaggcaatggatcaagagaatacttggactcaatagggttgacggaccgtcgtgagggcgatttaggtccagtttatgggttccaatggaggcattttggggcagagtacaaggattgcgatgccgattattcgggacaaggggttgatcaattacaggatgttataaaagaattgaaaacaaatccatacgacaggagaattatcatgtcagcatggaatccaccagattttgctaagatggcattgccaccttgccatgtattctgccaattttgcgtcaactttccaaacgagactccagactctaacacaaataaacaacaaaagacgtcgtccagaccaaaattatcgtgtttactataccaacgttcatgtgatatgggattgggtgttccattcaatattgcttcgtatgccttattaaccaagatgattgcacatatagtcgacatggattgtggtgagtttatccatacattaggtgatgctcatgtgtatttggaccatgtagatgctctaaaagaacaattggtcagaactcctaaagatttccctaaattaataatcaaggaagaaagaaaagatgaaatcaagtctattgatgatttcaaatttgaagattttgaaataattggctacgatccttatggtcccattaaaatgaaaatgagtgtttag

SEQ ID NO: 17445 - protein, 316 aa, Debaryomyces hansenii CBS767
MTVSTNTAEQTYLDLCERIINEGEHRPDRTGTGTKSLFAPPQLRFNLSDDTFPLLTTKKVFSRAIIHELLWFVQGCTDAKKLSEKGVKIWEGNGSREYLDSIGLTDRREGDLGPVYGFQWRHFGAEYKDCDADYSGQGVDQLQDVIKELKTNPYDRRIIMSAWNPPDFAKMALPPCHVFCQFCVNFPNETPDSNTNKQQKTSSRPKLSCLLYQRSCDMGLGVPFNIASYALLTKMIAHIVDMDCGEFIHTLGDAHVYLDHVDALKEQLVRTPKDFPKLIIKEERKDEIKSIDDFKFEDFEIIGYDPYGPIKMKMSV

SEQ ID NO: 17446 - DNA, 891 bp, Yarrowia lipolytica CLIB99
  CDS (1)..(891)
atgaccactctcaacgaacaaggatacctcgatctgtgcgcacgcgtgatcgaagagggtgaatcacgtgacgaccgaaccggcaccgggactctctctctgtttgccccccctcagcttcgattcgatctgtccaacgacattcttcccctgctcaccaccaagcgagtcttctaccgaggcgttctggaggagcttttgtggtttgtggctggatgcaccgacggcaaaaaactgagcgagaaaaacattcacatctgggacggaaatggatctaaggagttcctggaaaaggccgggctgggccacagacgagagggagacctgggaccggtctatggcttccaatggcgccatttcggagccgagtacaagaattgtgacacggattacactggccaaggcgtggaccagctcaaacaggtgatacacactctcagaaccaaccctcacgaccgtcgaatcattctgtctgcatggaaccccgccgatctcccaaagatggcgcttcctccctgtcacatgttttgccagttttatgtgtcgtacaaaaactcggaacgaggacgtctgtcgtgtcagctgtatcagcgatcatgtgacctgggtcttggagtccccttcaacattgcctcctacgctctgctcacccgaatgattgcccaggtcaccgatttggactgtggagagctcattcacaccatgggagacgcccatgtgtacaaggatcacgtggacgcactcaagcagcagattgctcgaacgccaggccagttccccaagctcacttttgcacgagatatcaaggacattgacggtttcaactacgaggactttgtgctcgagggatacaagccccagtccaagattgagatgcagatgagcgtttag

SEQ ID NO: 17447 - protein, 296 aa, Yarrowia lipolytica CLIB99
MTTLNEQGYLDLCARVIEEGESRDDRTGTGTLSLFAPPQLRFDLSNDILPLLTTKRVFYRGVLEELLWFVAGCTDGKKLSEKNIHIWDGNGSKEFLEKAGLGHRREGDLGPVYGFQWRHFGAEYKNCDTDYTGQGVDQLKQVIHTLRTNPHDRRIILSAWNPADLPKMALPPCHMFCQFYVSYKNSERGRLSCQLYQRSCDLGLGVPFNIASYALLTRMIAQVTDLDCGELIHTMGDAHVYKDHVDALKQQIARTPGQFPKLTFARDIKDIDGFNYEDFVLEGYKPQSKIEMQMSV

SEQ ID NO: 17448 - DNA, 978 bp, Canis familiaris
  CDS (1)..(978)
atgcccgcccccggctccgagctgcagcgcccgccatcgccgcccgccgcgcagaagccgcgcgcccggccgcagccgcctccccacggggagctgcagtacctggggcaggtggagcacatcctgagctgcggggcccggaagcacgaccgcacgggcacgggcacgctgtcggtgttcggcatgcaggcgcgctacagcctgagagatgaatttcctctgctgacaaccaaacgtgtattttggaagggtgttttggaggagttgctgtggtttatcaagggatccacaaacgctaaggaactgtcttccaggggagtgaaaatctgggatgccaatgggtctcgagactttttggacagcctgggattcgccaaccgagaagaaggggatttaggcccaatttatggctttcagtggaggcattttggggcagaatacaaagataaggattcagattattcaggtcaaggagtcgaccagctgcaaaaagtgattgacacaatcaaaaccaaccctgacgacagaagaattattctgtgtggttggaatccaaaagatcttcctctgatggccctacctccgtgccatgccctctgccagttctatgtggtgaacggtgagctgtcctgccagctataccagaggtcaggagacatggggctgggcgtgcccttcaacatcgccagctacgccctgctcacctacatgatcgcacacatcacaggcctgaagccaggtgacttcatacatactttgggagatgcgcatatttacctgaatcacattgagccgctgaaaatacagctgcagcgagaaccaaggcctttcccgaagctcagaatccttcgaagagttgagaaaattgatgacttcaaggctgaagactttcagatcgaggggtctgcgaatttcaagaattacacatcagctgttaaccccaaatttgagcaagctgaggaacaccagcattcttaa

SEQ ID NO: 17449 - protein, 325 aa, Canis familiaris
MPAPGSELQRPPSPPAAQKPRARPQPPPHGELQYLGQVEHILSCGARKHDRTGTGTLSVFGMQARYSLRDEFPLLTTKRVFWKGVLEELLWFIKGSTNAKELSSRGVKIWDANGSRDFLDSLGFANREEGDLGPIYGFQWRHFGAEYKDKDSDYSGQGVDQLQKVIDTIKTNPDDRRIILCGWNPKDLPLMALPPCHALCQFYVVNGELSCQLYQRSGDMGLGVPFNIASYALLTYMIAHITGLKPGDFIHTLGDAHIYLNHIEPLKIQLQREPRPFPKLRILRRVEKIDDFKAEDFQIEGSANFKNYTSAVNPKFEQAEEHQHS

SEQ ID NO: 17450 - DNA, 1257 bp, Canis familiaris
  CDS (1)..(1257)
atgcccgcccccggctccgagctgcagcgcccgccgtcgccgcccgccgcgcagaagccgcgcgcccggccgcagccgcctccccacggggagctgcagtacttggggcaggtggagcacatcctgagctgcggggcccggaagcacgaccgcacgggcacgggcacgctgtcggtgttcggcatgcaggcgcgctacagcctgagagatcatgcgtggacacagcggaccgctctggcccacgagcggacacggtctggggttgtctgcctcccagtagacaccgggacgggacctgcctgggctgggccacgggcttcgctgcagagcccccttcttttttttattgctcctcctcctgtctctccgacctggcccctcggttttgcaaagtatttaaaaattggagcgaacgaatacggtcgggtcagcggcgcgcgggaagagggcgcgaacccagaggggctgggccggaacttgcggttccatgaatttcctctgctgacaaccaaacgtgtattttggaagggtgttttggaggagttgctgtggtttatcaagggatccacaaacgctaaggaactgtcttccaggggagtgaaaatctgggatgccaatgggtctcgagactttttggacagcctgggattcgccaaccgagaagaaggggatttaggcccaatttatggctttcagtggaggcattttggggcagaatacaaagataaggattcagattattcaggtcaaggagtcgaccagctgcaaaaagtgattgacacaatcaaaaccaaccctgacgacagaagaattattctgtgtggttggaatccaaaagatcttcctctgatggccctacctccgtgccatgccctctgccagttctatgtggtgaacggtgagctgtcctgccagctataccagaggtcaggagacatggggctgggcgtgcccttcaacatcgccagctacgccctgctcacctacatgatcgcacacatcacaggcctgaagccaggtgacttcatacatactttgggagatgcgcatatttacctgaatcacattgagccgctgaaaatacagctgcagcgagaaccaaggcctttcccgaagctcagaatccttcgaagagttgagaaaattgatgacttcaaggctgaagactttcagatcgaggggtctgcgaatttcaagaattacacatcagctgttaaccccaaatttgagcaagctgaggaacaccagcattcttaa

SEQ ID NO: 17451 - protein, 418 aa, Canis familiaris
MPAPGSELQRPPSPPAAQKPRARPQPPPHGELQYLGQVEHILSCGARKHDRTGTGTLSVFGMQARYSLRDHAWTQRTALAHERTRSGVVCLPVDTGTGPAWAGPRASLQSPLLFFIAPPPVSPTWPLGFAKYLKIGANEYGRVSGAREEGANPEGLGRNLRFHEFPLLTTKRVFWKGVLEELLWFIKGSTNAKELSSRGVKIWDANGSRDFLDSLGFANREEGDLGPIYGFQWRHFGAEYKDKDSDYSGQGVDQLQKVIDTIKTNPDDRRIILCGWNPKDLPLMALPPCHALCQFYVVNGELSCQLYQRSGDMGLGVPFNIASYALLTYMIAHITGLKPGDFIHTLGDAHIYLNHIEPLKIQLQREPRPFPKLRILRRVEKIDDFKAEDFQIEGSANFKNYTSAVNPKFEQAEEHQHS

SEQ ID NO: 17452 - DNA, 918 bp, Apis mellifera
  CDS (1)..(918)
atgaatgaatatgaaataattacatcacaggaatgctttcaaaatgaaaaaaaacatgaagaatatcaatatttaaatttgatcgaaaaaatcattaaagatggaacaagaaaagatgatcgtactggcgtgggaacgttgtccattttcggaacccagatgagatttaatttacgaaataatatatttccattattaactacaaaacgcgtattttggaaaggtgtagtggaggaattgttatggtttattaaaggatccacaaatgcaaagaaattaagtgaaaaggatgttcatatttgggatgcaaatagttcacgtgaattcttagattcttgtggttttatagatagagaagaaggagatttaggtcctatttatggatttcaatggagacattttggtgcaacatataaagatatgtacaaagattataatggagaaggtattgatcaattaaaagaagttatagataagatacgatattctcccaatgatagaagaattataatgacagcatggaatccaattgatattccaaaaatggctttacctccttgtcattgtttcgttcaattttatgtaagcaatgaagaattatcatgccaactttatcaaagaagtgcggatatgggtcttggtgtaccatttaatattgcatcttattctttattaatttatatactggcacatattacaaacttgaagccaggtgaatttatacatacaatgggcgattgtcatgtataccttaatcatatatccgcacttaaggaacaaatcaaacgtgtaccaaaaccatttccatatttaaaaatcattagaaacgttgaagatataaacgattttacagcaaatgattttgaactgattggatatgacccacatgcaaaaatctctatgccaatggccgtttaa

SEQ ID NO: 17453 - protein, 305 aa, Apis mellifera
MNEYEIITSQECFQNEKKHEEYQYLNLIEKIIKDGTRKDDRTGVGTLSIFGTQMRFNLRNNIFPLLTTKRVFWKGVVEELLWFIKGSTNAKKLSEKDVHIWDANSSREFLDSCGFIDREEGDLGPIYGFQWRHFGATYKDMYKDYNGEGIDQLKEVIDKIRYSPNDRRIIMTAWNPIDIPKMALPPCHCFVQFYVSNEELSCQLYQRSADMGLGVPFNIASYSLLIYILAHITNLKPGEFIHTMGDCHVYLNHISALKEQIKRVPKPFPYLKIIRNVEDINDFTANDFELIGYDPHAKISMPMAV

SEQ ID NO: 17454 - DNA, 1965 bp, Aspergillus nidulans FGSC A4
  CDS (1)..(1965)
atgccttctgcgcttacttttgatttgcatcggaagtgttctactactaaagcgcgcgcaagcaccctccacctccctcatggatccgtctcgctcccaatcttcatgcctgtcgcgacacaggcaagtctcaagggccttacatatgaccaattgaaacaaacagggtgcatgctctgcctcaataacacgtaccaccttggcttgaagccagggcaggctgtactggatgaggtagggggagcacatgcgctgcaaggctggaatcgcaacatcctaacagacagcggtggctttcaaatggtttctcttctcgagctcgcggaagtcactgaggagggtgtccggtttctgtcaccgcacgatggcacgccgatgctgctcacaccggaacactcaatctcactacagaattccattgggtccgatattatcatgcagcttgacgatgtgatagcgactacatcgccagatcacgaacggattcatgaagccatggagcgctcggtgcgctggctagatcggtgcattgcagcccacaaaaccccagaaacgcagaatttattctgcattattcaagggggactggatctagagctgcgaaaacggtgctgcgcggagatggtagcacgcgacacgccaggaattgcgataggtgggctgtcaggtggagaggcgaaagaggatttctgtaaagttgttgatacatgtactggtctccttccggaatataagccgcgatatgtgatgggcgtgggctatcaggaggacttgattgtgggagtggcccttggagcggacatgttcgactgtgtatggccgacaagaactgccccaagggaagaaggaggttccggcattacgagagcctatctccaccacctggctgctaaagagacagccggggcgcatctgatagagtcaagcacgacagggtacaaaatgactgtctcactggacactcccagagaaaatgccaccaccgccaccgccggtcctcaacccccagcccacaacccctctcacgaagaacaccaatacctcaacctgatccgccaaatccttgcggaaggcgagcaccgccctgaccggacgggcacgggaacacgctcaatcttcgccccaaaccctatgcgcttctcgctctcgaagcccagccccacgaacccatctacaaagatcccaatcctccccctcctcaccacaaaacgcgtcttcttgcgcgccgtccttgccgaacttctctggttcatatccggctcaacatcaagcattccgctctccgaagcgggcatcaaaatctgggatgggaacggatcgcgtgagttcctcgacaaagtcgggctctcgcaccgcgaagttggcgacctcggccccgtatacggattccagtggcgccatttcggggctgagtatgtcgatgcccatacggattatacagggcagggagttgaccagttagcggacattgtgaggaagattaaggagacgccgtttgatcgccggatcatcatgtcggcgtggaatccagcggacctgaagaagatggcgcttccgccttgccatatgtttgcgcagtactatgtttcttatcctgagggcattgaggatgggaagggcaaaggcaagggagagttgagctgtttgttgtaccagaggagttgtgatatggggctgggcgtcccattcaacattgcttcatatgcgttgctgacgcacatcattgctcatgcgacggatttgaacccggggaagttgatccatactatgggtgatgcgcacgtatacctggaccatgtggaagccttggaagagcagttgactagggaacctacggattttccagagttgaagattaagagggaggaccgggggagcggagttattgacggctggaaagaagaggaattcgaggtcattggctatgcgcctcacaaggcgatcaagatgaaaatgagtgtttag

SEQ ID NO: 17455 - protein, 654 aa, Aspergillus nidulans FGSC A4
MPSALTFDLHRKCSTTKARASTLHLPHGSVSLPIFMPVATQASLKGLTYDQLKQTGCMLCLNNTYHLGLKPGQAVLDEVGGAHALQGWNRNILTDSGGFQMVSLLELAEVTEEGVRFLSPHDGTPMLLTPEHSISLQNSIGSDIIMQLDDVIATTSPDHERIHEAMERSVRWLDRCIAAHKTPETQNLFCIIQGGLDLELRKRCCAEMVARDTPGIAIGGLSGGEAKEDFCKVVDTCTGLLPEYKPRYVMGVGYQEDLIVGVALGADMFDCVWPTRTAPREEGGSGITRAYLHHLAAKETAGAHLIESSTTGYKMTVSLDTPRENATTATAGPQPPAHNPSHEEHQYLNLIRQILAEGEHRPDRTGTGTRSIFAPNPMRFSLSKPSPTNPSTKIPILPLLTTKRVFLRAVLAELLWFISGSTSSIPLSEAGIKIWDGNGSREFLDKVGLSHREVGDLGPVYGFQWRHFGAEYVDAHTDYTGQGVDQLADIVRKIKETPFDRRIIMSAWNPADLKKMALPPCHMFAQYYVSYPEGIEDGKGKGKGELSCLLYQRSCDMGLGVPFNIASYALLTHIIAHATDLNPGKLIHTMGDAHVYLDHVEALEEQLTREPTDFPELKIKREDRGSGVIDGWKEEEFEVIGYAPHKAIKMKMSV

SEQ ID NO: 17456 - DNA, 1566 bp, Cryptosporidium hominis
  CDS (1)..(1566)
atgagtgaaaagaacgtttcaattgttgtggcagcttctgttttgagcagtgggataggaattaacggacaattaccttggtctatatctgaggatttgaaatttttttcaaagataactaataataaatgtgactcgaataagaagaatgcactaattatgggaagaaaaacatgggattcaattggaagaagacctcttaaaaatagaataattgtcgttatttcctccagcttaccacaagatgaagccgatcctaatgttgttgtatttagaaaccttgaagactcaatagagaatcttatgaatgatgactcaattgagaatattttcgtctgtggtggtgaatccatatacagggatgctttaaaggataactttgtagatagaatatacttaacaagggtggcactagaagatatagaatttgacacttatttcccagaaatacctgagacattcttaccagtatatatgtctcagacattctgtactaagaatatctcttatgattttatgatttttgaaaaacaagaaaaaaaaactttacaaaattgtgaccctgccagaggtcaattaaagtccattgatgatacagttgatcttcttggtgaaatatttgggattagaaaaatgggaaatagacacaagtttccaaaagaagaaatctacaacactccaagtattcgattcggaagagaacattatgagtttcagtacctggaccttctttctagggtcttagagaatggagcttatagggaaaataggacaggcattagtacatattcaatatttggtcagatgatgagatttgatatgagagaatcttttccacttttgactacaaaaaaagttgcaatcagatccatttttgaggagttaatatggtttattaagggagatactaatggaaatcatttgattgagaaaaaagtttatatttggtcaggaaatggctcgaaagaatatttggaaagaattggtttagggcatagagaggagaatgatttgggcccgatctatggttttcagtggagacattacaatggagagtacaaaacgatgcatgacgattataccggagttggagttgatcagcttgcaaaacttattgagaccctaaagaataacccaaaggatagaaggcatatactaacagcctggaatccatctgccctatctcaaatggctcttccgccttgccatgtgctttctcagtattatgttaccaatgataattgtcttagttgcaacctttatcaaaggagttgtgacttgggattaggatctccatttaacattgcatcttatgctatacttaccatgatgcttgctcaagtttgtggttatgaaccaggtgagcttgctatttttattggagatgcccatatctatgaaaatcacctaacacaattaaaagaacaattaagccgcactccacgtccatttccacaactcaaattcaaaagaaaagttgaaaatattgaagactttaaatgggaagacatcgaattaatcggatattatccatatcccactattaaaatggacatggcggtataa

SEQ ID NO: 17457 - protein, 521 aa, Cryptosporidium hominis
MSEKNVSIVVAASVLSSGIGINGQLPWSISEDLKFFSKITNNKCDSNKKNALIMGRKTWDSIGRRPLKNRIIVVISSSLPQDEADPNVVVFRNLEDSIENLMNDDSIENIFVCGGESIYRDALKDNFVDRIYLTRVALEDIEFDTYFPEIPETFLPVYMSQTFCTKNISYDFMIFEKQEKKTLQNCDPARGQLKSIDDTVDLLGEIFGIRKMGNRHKFPKEEIYNTPSIRFGREHYEFQYLDLLSRVLENGAYRENRTGISTYSIFGQMMRFDMRESFPLLTTKKVAIRSIFEELIWFIKGDTNGNHLIEKKVYIWSGNGSKEYLERIGLGHREENDLGPIYGFQWRHYNGEYKTMHDDYTGVGVDQLAKLIETLKNNPKDRRHILTAWNPSALSQMALPPCHVLSQYYVTNDNCLSCNLYQRSCDLGLGSPFNIASYAILTMMLAQVCGYEPGELAIFIGDAHIYENHLTQLKEQLSRTPRPFPQLKFKRKVENIEDFKWEDIELIGYYPYPTIKMDMAV

SEQ ID NO: 17458 - DNA, 1758 bp, Plasmodium berghei
  CDS (1)..(1758)
atggaagacttatctgaaacattcgatatatatgcaatatgtgcatgttgtaaagttctgaacgatgatgaaaaggttagatgctttaataataaaacgtttaagggaattggaaatgcgggggtgttaccttggaaatgtaatttaatcgatatgaaatattttagttctgtaacatcatatataaatgaaaataattatataagattgaaatggaaaagagataaatatatggaaaaacataatttaaaaaataatgtagaactaaatactaatataatttcttcaactaataatttacaaaatattgtagtaatgggaaaaaaaagttgggaaagtattcccaaaaaatttaaacctttacaaaatcgaataaacattattttgtctagaactttgaaaaaagaagatattgtaaacgaaaataataatgaaaataataatgttattataattaaaagtgtagatgatttatttcctattttaaaatgcacaaaatattacaaatgttttattatagggggttcgtctgtttataaagaatttttagatcgtaatttaataaaaaaaatatattttacaagaataaataattcttataattgtgatgttttattcccagaaataaacgaaaatttgtttaaaataacttcaataagtgatgtatataatagtaacaacacaactttagattttataatttatagtaagacaaaagaaataaatccaaatgaggaagtacctaataatacatttttaggtgtatgtgatgaacaaaataaagcctttgatgatgaagacgattatacatatttcagtttcaataaaaataaagaaaatattaaaaaaaattctgaacatgctcataattttaaaatatataatagcataaaatataaaaatcatcatgaatatcaatatttaaatattatatatgatatgataatgcatggaaataaccaagatgatagaacaggtggtgtgttaagtaaatttggatatatgatgaaatttaatttaaatgaatattttccattattaacaacaaaaaaattatttataagaggtattatcgaagaattattgtggtttataagaggggaaacaaatggaaatactttgttagaaaaaaacgtaagaatatgggaagctaatggaacaagggaatttttagatagaaaattatttcatagagaagttaatgatctcggtccaatttatggatttcaatggaggcattttggtgctgaatatacagatatgcatgataattataaagacaaaggagttgatcaattaaaaaatattataaatttaattaaaaatgatcctacttgtagacgaattattttgtgtgcatggaatgtaaaagatttagatcaaatggcattacctccttgtcatattttatgtcaattttatgtttttgacggaaaattatcatgtattatgtatcaaagatcttgtgatttagggcttggggttccattcaatattgcttcctattctatatttacatatatgatagcacaagtatgtaacttacaggcagctgaatttatacatgtattgggtaatgctcatgtttataataatcatattgaaagcttaaagattcagttaaatagaactccttacccttttcctactcttaaattaaatcctgacattaaaaatatcgaggattttacaatttctgattttactgttcaaaattatgttcatcacgataaaataaatatggatatggcagcttaa

SEQ ID NO: 17459 - protein, 585 aa, Plasmodium berghei
MEDLSETFDIYAICACCKVLNDDEKVRCFNNKTFKGIGNAGVLPWKCNLIDMKYFSSVTSYINENNYIRLKWKRDKYMEKHNLKNNVELNTNIISSTNNLQNIVVMGKKSWESIPKKFKPLQNRINIILSRTLKKEDIVNENNNENNNVIIIKSVDDLFPILKCTKYYKCFIIGGSSVYKEFLDRNLIKKIYFTRINNSYNCDVLFPEINENLFKITSISDVYNSNNTTLDFIIYSKTKEINPNEEVPNNTFLGVCDEQNKAFDDEDDYTYFSFNKNKENIKKNSEHAHNFKIYNSIKYKNHHEYQYLNIIYDMIMHGNNQDDRTGGVLSKFGYMMKFNLNEYFPLLTTKKLFIRGIIEELLWFIRGETNGNTLLEKNVRIWEANGTREFLDRKLFHREVNDLGPIYGFQWRHFGAEYTDMHDNYKDKGVDQLKNIINLIKNDPTCRRIILCAWNVKDLDQMALPPCHILCQFYVFDGKLSCIMYQRSCDLGLGVPFNIASYSIFTYMIAQVCNLQAAEFIHVLGNAHVYNNHIESLKIQLNRTPYPFPTLKLNPDIKNIEDFTISDFTVQNYVHHDKINMDMAA

SEQ ID NO: 17460 - DNA, 840 bp, Enterobacteria phage T5
  CDS (1)..(840): transl_table=11
atgcaacaatacttaaaaattttgacagatgtaattttactaggtgaaccccgtaatgaccgtacaggaacgggcacagtttcaatttttgattcctatgctaagtttgacctacgtgaagggttcccggctgtaactactaaacgcctagcctggaaatcagtagtaggagaacttttatggttcttgtctggttccacaaatcttcatgatctacgtgtattcacatttggtcgtgacgaaggacagtggaccatctggactccaaattatgaagaccaagctataagtatggggtatgataagggtaatctaggaccagtatatggtaaacagtggcgtaactttggtgggcgagatcagattctagaacttattgaaggactcaagaataatcctcatggccgcagacatctagtttctgcatggaacgtagctgaacttgataaaatggcattacccccttgccactacggcttccagtgctatgtaagtaacgatggatacctagatcttaaatggacacaacgctctgtggattgtttcctcggtttacctttcaatattgctagctatgctttgctaacgcatatattagcaaaactgacaggattaaaacctcgttatcttatctttagtggcggtgatactcatatctataatgaccacatggaacaggtagaagaacaggtaaaacgcaagccacgccctctaccgactctagtaatgccagaatttgtagatctttacgacttactagaaaataatacggcagcttggtcattccatttagaggggtacgatcctcacccagctcttaaagctaagatgtcttcttaa

SEQ ID NO: 17461 - protein, 279 aa, Enterobacteria phage T5
MQQYLKILTDVILLGEPRNDRTGTGTVSIFDSYAKFDLREGFPAVTTKRLAWKSVVGELLWFLSGSTNLHDLRVFTFGRDEGQWTIWTPNYEDQAISMGYDKGNLGPVYGKQWRNFGGRDQILELIEGLKNNPHGRRHLVSAWNVAELDKMALPPCHYGFQCYVSNDGYLDLKWTQRSVDCFLGLPFNIASYALLTHILAKLTGLKPRYLIFSGGDTHIYNDHMEQVEEQVKRKPRPLPTLVMPEFVDLYDLLENNTAAWSFHLEGYDPHPALKAKMSS

SEQ ID NO: 17462 - DNA, 864 bp, Streptococcus pyogenes MGAS10394
  CDS (1)..(864): transl_table=11
atgcttacagaaaggttattagagatgacaaaagctgaccagatttttaaagctaatattcaaaaaattataaatgaaggatcattgagtgagcaagcacgtcctaaatataaagatggtcgaacagctcattctaagtatattactggggcgtttgctgaatatgatttagctaaaggagagtttcccatcacaactttacgacctattccaattaaatctgctataaaggaattattttggatatatcaagatcagtctaacagtttagatgtgctagaagctaaatataatgttcattattggaatgaatgggaagttgaccagacacgtactattgggcaacgttatggtgctgtagttaaaaaacatgatatcatctcaaaaatactaaagcaattagcagaaaatccttggaatcgtcgtaatgtcatttctctctgggactatgaagcatttgaggagacaaaagggttgttgccatgtgcctttcaaatcatgtttgatgttagacgtgtaggggaagatctttatttagatgctagtttgacgcaacgttctaatgacatattagttgctcatcacatcaatgccatgcaatacgttgccttgcagatgatgattgctaaacattttggatggaaaataggtaagttcttttattttgttaacaatttacatatttatgacaaccaatttgatcaggctcaagaattactaaaacgacagccagttgccagtcagcctaagcttgttttaaatgttccagatgggactaatttctttgatattaaaccagatgattttgaattacaaaattatgatccagtgaagcctcagttgcactttgaccttgctatttaa

SEQ ID NO: 17463 - protein, 287 aa, Streptococcus pyogenes MGAS10394
MLTERLLEMTKADQIFKANIQKIINEGSLSEQARPKYKDGRTAHSKYITGAFAEYDLAKGEFPITTLRPIPIKSAIKELFWIYQDQSNSLDVLEAKYNVHYWNEWEVDQTRTIGQRYGAVVKKHDIISKILKQLAENPWNRRNVISLWDYEAFEETKGLLPCAFQIMFDVRRVGEDLYLDASLTQRSNDILVAHHINAMQYVALQMMIAKHFGWKIGKFFYFVNNLHIYDNQFDQAQELLKRQPVASQPKLVLNVPDGTNFFDIKPDDFELQNYDPVKPQLHFDLAI

SEQ ID NO: 17464 - DNA, 861 bp, Lymphocystis disease virus - isolate China
  CDS (1)..(861)
atggctaatgaagaaggttatttaaatcaacttaagtatattttagcaaatggaagacttaaaattgatagaactggaacaggtactctttcagtatttggtttacagaatagatatgatttaagtacattccctttattcactacaaaaagaatgttttggcgtggaatagtagaagaacttttatggttccttaaaggatctacaaattctttaaatttatcaaaaaaatctgtacatatttgggatgcttatggatcaaaatctaatttaaatcgattaggatttaatcatcgtgaagaaggtgatttaggtcctatttatgggtttcaatggagacattttggagctaattatataaattgtcatactaattatgaaggtcagggtatagatcaattacaaataattataacaaaattaaaaacaaatccaaatgatagacgtattttaatgactgcttggaatccatctgatatagatcaggctgttttacctccatgtcatgtattgtgtcaattttatgctatagacaatattttatcttgtcaatgttatcaaagatcagcagatatgggattaggtgtaccttttaatgtagcttcttatgcattattaacatatttaattgctcaagctgttgatatgaaaccaggtgaatttattcatacgctaggagatgctcatatttatttagatcatataaaagctataaaagaacaattaactcgatcaataaaaccttcacctgttgtaatattaaaaaaaaagtctgataatttatgtgattttaaatttgaagattttgaattgttagattataatcctcatccagctatctcgttagatttatctatttaa

SEQ ID NO: 17465 - protein, 286 aa, Lymphocystis disease virus - isolate China
MANEEGYLNQLKYILANGRLKIDRTGTGTLSVFGLQNRYDLSTFPLFTTKRMFWRGIVEELLWFLKGSTNSLNLSKKSVHIWDAYGSKSNLNRLGFNHREEGDLGPIYGFQWRHFGANYINCHTNYEGQGIDQLQIIITKLKTNPNDRRILMTAWNPSDIDQAVLPPCHVLCQFYAIDNILSCQCYQRSADMGLGVPFNVASYALLTYLIAQAVDMKPGEFIHTLGDAHIYLDHIKAIKEQLTRSIKPSPVVILKKKSDNLCDFKFEDFELLDYNPHPAISLDLSI

SEQ ID NO: 17466 - DNA, 972 bp, Burkholderia mallei ATCC 23344
  CDS (1)..(972): transl_table=11
atgaaacagtatctcgatctcgttcgcaccattctcgataccggcacctggcagagcaaccgcacgggcattcgcacgatcggcatccccggcgcgatgctgcgcttcgatctgcagcagggctttcccgcagtgacgacgaaaaagctcgcgttcaagtccgcgatcggcgagctcgtcggctttctgcgcgcgacgcgcagcgcggccgatttccgcgcgctcggctgcaaggtatgggacgcgaatgcgaatgagaacgcgcagtggctcgcgaatccgtatcgccgcggcgtcgacgacctcggcgacgtgtacggcgtccaatggcggcgctggccgggctacaaggtgctcgacgcgcatgccgacgcgcagatcgccgatgcgacgtcgcgcggttttcgcgccgtcgcgcgcttcgacgaggacggcgcgcagaaggtgctgctacacaaggcgatcgaccagttgcgagactgcctcgacacgatcgtgcgcgacccgtcgagccggcgcatcctgttccacggctggaatcccgcggtgctcgacgagatcgcgctgcccgcgtgccatctgctgtatcaattcctgccgaatgtcgagcgtcgcgaaatctcgctgtgcctgtacatccgcagcaacgacgtcgggctcggcacgccgttcaatctcgccgaaggcgcggcgctcctcacgctcgttggccggctgacgggctatacgccgcgctggttcacgtacttcatcggcgatgcgcacatctacgagaatcagctcggcatgctcaagcagcagctcgaacgcgagccgttcgacagcccgcggctcgagatcgccgagcgcgtgcccgagtacgcgaaaacggggcagtacgagccacaatggcttgaacgcatcgagccgtcggatttcacgctcgtcggctatcgtcaccacgaaccgctgagcgcgccgatggccgtttga

SEQ ID NO: 17467 - protein, 323 aa, Burkholderia mallei ATCC 23344
MKQYLDLVRTILDTGTWQSNRTGIRTIGIPGAMLRFDLQQGFPAVTTKKLAFKSAIGELVGFLRATRSAADFRALGCKVWDANANENAQWLANPYRRGVDDLGDVYGVQWRRWPGYKVLDAHADAQIADATSRGFRAVARFDEDGAQKVLLHKAIDQLRDCLDTIVRDPSSRRILFHGWNPAVLDEIALPACHLLYQFLPNVERREISLCLYIRSNDVGLGTPFNLAEGAALLTLVGRLTGYTPRWFTYFIGDAHIYENQLGMLKQQLEREPFDSPRLEIAERVPEYAKTGQYEPQWLERIEPSDFTLVGYRHHEPLSAPMAV

SEQ ID NO: 17468 - DNA, 990 bp, Burkholderia pseudomallei K96243
  CDS (1)..(990): transl_table=11
atgctgcgctatccgggtctcagcgagctctacctcgcgacgctcagggacgtctgcggcgcgtacgaataccggagcgcgccgcgcgggcacgcggagcgcgaaatcatcggctacggcgcacggatcgacgatccgcgcgcgcgcttttgccggcatgcggcgcgcaagcagaacgtcgtcttcaactacgccgaggcgctatggtatctgtccgggcgcaacgatctcgaattcatcgcgcactacgcaccgtcgatggcgcgctacagtccggacggcaagcatctgcccggcaccggctacggcgcgcgcctgctgcattacggcgagcgcgggctcgaccagatcgagcgcgcgctcgacatcctgtcgcgcgacgacgccgagagcaagcgcgtcgtgctgcagatcttcagcgccgacgaggaactgtaccggcgcaacatcgacgtgtcgtgcacgctcggcctgcaactgctgctgcgcgaaggccggctgcacatggtcgcgttcatgcgcgcgaacgacgcgtacatcgggctgctgaacgacgtgttctcgttcacgttcctgcaggagtacctcgcgtcgcggctcggctgcgagctcggcacgtatgcgcatcaggtgggctcgatccacgtgtacgacgacaatctgccgcgcgtgcaggcgctgctcgacgacagcgatgcggcgatcgtcaccgccgccgcgccgccgcgcatgccggcgggcacgcgcgccgcgacgatcgcgcgcgtgctcgagcacgaaggccggattcgcgccgggcgcgtgtcgctcgccgcgcttcgcgacatcgatctcgatccgtactggcgcgacgtgctcggtctcttctggatctatcgcgagatcaaggcgggcaacccgccgcccgacgaggcgctcgcgttcgtcggcccgttccatcgcgcctatctgatgaaccggtgggacatggcgtccgcctcgctccaataa

SEQ ID NO: 17469 - protein, 329 aa, Burkholderia pseudomallei K96243
MLRYPGLSELYLATLRDVCGAYEYRSAPRGHAEREIIGYGARIDDPRARFCRHAARKQNVVFNYAEALWYLSGRNDLEFIAHYAPSMARYSPDGKHLPGTGYGARLLHYGERGLDQIERALDILSRDDAESKRVVLQIFSADEELYRRNIDVSCTLGLQLLLREGRLHMVAFMRANDAYIGLLNDVFSFTFLQEYLASRLGCELGTYAHQVGSIHVYDDNLPRVQALLDDSDAAIVTAAAPPRMPAGTRAATIARVLEHEGRIRAGRVSLAALRDIDLDPYWRDVLGLFWIYREIKAGNPPPDEALAFVGPFHRAYLMNRWDMASASLQ

SEQ ID NO: 17470 - DNA, 1692 bp, Acanthamoeba polyphaga mimivirus
  CDS (1)..(1692)
atgaaaaaattcaatattatagcggccataaataatgattctattattggagtcaaagagtatggaacattttcaatgccttggccttatctcaaagatgatatgaatcattttagaaaaattacaacagacactggatcaatcgaatctggtgtcaatgcgataatcgtgggatttaatacatggcaaaccttaccgtcttcttatagaaatattcgatcgagatttaacattgttatttctcgagatgacgaaactgatggtcaatttcataaatatgtaaagacatttgatgaagccattgaatttgcttcgtcactcactaatttaaatgaaatttttgtaataggaggaggtgttatatacgatttagccttaaaacataaactattggataaactttatttgacacatgttggatcaaattatccaattgatgacaatgttgaaaaagttgtgcattttccattgacatggtcaaaaatagaaaaaatgtgtgattcaaattttctagaattggattcagaaatttctaaacacgatattggaaaaaatatattgttgagatttcaagaatattctgtaaaaaaagaattatattgggccatcgaatatttgaaaaaaaataccagtctagataataaaggaattattggagataaaggggcaaccggaagtaaaggttatagtctagaacaacatgattattattcgaccgagtatttttggaacttttatgaattcattactaggaaagtttttgacttatttaattcgtccaatgaaatttcaattcccagtgaggaatgtccagaaaatcaatatattgaactggtaaaaacaattatggagaaaggtattgttaaacaaacaagaaactcaatcaccaaatctatttttggatatcaactcaaatacgacttatcaaagggatatccaattcaaacaataaaacgatcttatcccaaggccatattcgaggaattaatgtggatgattcgaggacaaactgatgtttcaattctccagaaaaaaggagtgcatgtttgggataaaaattcatcaaaagattttttgtcaaaatataatcttccatatgaagaaggagatattggtccaggatacggttttcaaatgagatattggggagctgagtacactgattgtaaaacatcttaccaaggacaaggtattgatcaattaaacaaatgtattgaatctattcaaaataatcctcacgacagaagaatcatgataaatctttggaattgttctgatttagataaaatggcacttgcaccatgtcatttttgctatatgtttggagtagatctttatgaggttccaactacatctggaaaaaagggtagattgaattgtcatttagttcaaaggagttgggatgttctacttggttggaatactacaacagctgctctattgacttatttaattgctaatcattgtgatcttgatcctggtattttggtacacagtatttctgatgctcacatatatcagtcacatattgattctggtgctattagtcaattgctccaaagaaagtgtagaaaatttcccaatttagtaattcgtaataaaaaagaaaaaatcgatgattatgaattcgatgacttaatcatagaaaattattatccttgtccttctatttctgcagaaatgattgcttaa

SEQ ID NO: 17471 - protein, 563 aa, Acanthamoeba polyphaga mimivirus
MKKFNIIAAINNDSIIGVKEYGTFSMPWPYLKDDMNHFRKITTDTGSIESGVNAIIVGFNTWQTLPSSYRNIRSRFNIVISRDDETDGQFHKYVKTFDEAIEFASSLTNLNEIFVIGGGVIYDLALKHKLLDKLYLTHVGSNYPIDDNVEKVVHFPLTWSKIEKMCDSNFLELDSEISKHDIGKNILLRFQEYSVKKELYWAIEYLKKNTSLDNKGIIGDKGATGSKGYSLEQHDYYSTEYFWNFYEFITRKVFDLFNSSNEISIPSEECPENQYIELVKTIMEKGIVKQTRNSITKSIFGYQLKYDLSKGYPIQTIKRSYPKAIFEELMWMIRGQTDVSILQKKGVHVWDKNSSKDFLSKYNLPYEEGDIGPGYGFQMRYWGAEYTDCKTSYQGQGIDQLNKCIESIQNNPHDRRIMINLWNCSDLDKMALAPCHFCYMFGVDLYEVPTTSGKKGRLNCHLVQRSWDVLLGWNTTTAALLTYLIANHCDLDPGILVHSISDAHIYQSHIDSGAISQLLQRKCRKFPNLVIRNKKEKIDDYEFDDLIIENYYPCPSISAEMIA

SEQ ID NO: 17472 - DNA, 858 bp, Vibrio fischeri ES114
  CDS (1)..(858): transl_table=11
atgaccgtgaagcagtatttagatttatgccaacgcattgtagatgaaggaacttggatcgaaaacgagcgcacaggaaagcgttgtttaacggtgattaatgcggatttaacttatgatgtagaaaatggtgttttccctcttgtgacaacgcgtaaaagcttttggaaagcggcagtagctgaaatgattggttatattcgtggttacgatagcgcagaagacttccgtaaaattggaacaaaaacatgggatgcgaatgctaaccttaacgatgcatggctaaacaaccctcatcgtaaaggtgatgatgacatgggccgagtatatggtgtgcaaggtcgttcatgggcaaaaccaaatggtgagtttgtcgatcaactgaaaaaaatcattgatgatttaagtcagggaattgatgatcgtggtgagattttaaatttttataacccaggtgagtttgatatgggatgtttgcgtccgtgtatgtactcacaccatttttcattacttggtgatacgttatatttaaacagtacgcaacgttcatgtgatgttccgctagggcttaatttcaatatggttcaagtgtatttcttattagcgatagtggcacaaattacagggcataaagcaggtaaggcgtaccataagattgtaaatgcacatatttatgaagaccaacttgaactaatgcaaagtgtgcagctaaagcgtgaaccgttacaagccccaatctttaaaataaaccctgaaattaagtcactagaagatttagaaacatgggtaactatggatgactttgaagtgattggctatgaaagccacgaagcaattaagtatcctttttctgtttaa

SEQ ID NO: 17473 - protein, 285 aa, Vibrio fischeri ES114
MTVKQYLDLCQRIVDEGTWIENERTGKRCLTVINADLTYDVENGVFPLVTTRKSFWKAAVAEMIGYIRGYDSAEDFRKIGTKTWDANANLNDAWLNNPHRKGDDDMGRVYGVQGRSWAKPNGEFVDQLKKIIDDLSQGIDDRGEILNFYNPGEFDMGCLRPCMYSHHFSLLGDTLYLNSTQRSCDVPLGLNFNMVQVYFLLAIVAQITGHKAGKAYHKIVNAHIYEDQLELMQSVQLKREPLQAPIFKINPEIKSLEDLETWVTMDDFEVIGYESHEAIKYPFSV

SEQ ID NO: 17474 - DNA, 795 bp, Neisseria gonorrhoeae FA 1090
  CDS (1)..(795): transl_table=11
atgaaggcctatttggacttgatgcgccacgtcctcgacaacggtacggacaaatcagaccgcaccggtacgggtacgcgctccgtattcggttatcagatgcgttttgacttgggcaaaggttttccgctgctgacgaccaaaaagctgcatttgcgctcgataatccacgagctgctttggttcctcaaaggcgataccaatatcaaatacctgaaggataacaatgtttccatttgggacgagtgggcggacgaaaacggcgacttgggcccggtttacggctaccaatggcgcagctggcccgcgcccgacggcaggcatatcgaccaaatcgccaatgtggtggaacaaattaagaaaaaccccgactcgcgccgcctgattgtgtcggcgtggaatccggctttggtcgatgagatggccttgccgccctgccacgcgctgtttcagttttacgttgccgacggcaaactgtcctgccagctttaccagcgtagtgcagatattttccttggtgtgccgtttaatattgccagctacgcgctgttgacgatgatgatggcgcaagtgtgcgggctggaggcgggcgagtttgtccatacgtttggcgacgcgcatttgtaccgtaaccatttcgaacaggccgcattgcagttggaacgcgaaccgcgcgccttgcctgtgatgaaaatcaatcctgaagtcaaggatttgtttgccttcaagtttgaagatttcgagttggaaggctacgatccgcatccgcacatcaaggcggtagtgtcggtttag

SEQ ID NO: 17475 - protein, 264 aa, Neisseria gonorrhoeae FA 1090
MKAYLDLMRHVLDNGTDKSDRTGTGTRSVFGYQMRFDLGKGFPLLTTKKLHLRSIIHELLWFLKGDTNIKYLKDNNVSIWDEWADENGDLGPVYGYQWRSWPAPDGRHIDQIANVVEQIKKNPDSRRLIVSAWNPALVDEMALPPCHALFQFYVADGKLSCQLYQRSADIFLGVPFNIASYALLTMMMAQVCGLEAGEFVHTFGDAHLYRNHFEQAALQLEREPRALPVMKINPEVKDLFAFKFEDFELEGYDPHPHIKAVVSV

SEQ ID NO: 17476 - DNA, 795 bp, Bacteroides fragilis NCTC 9343
  CDS (1)..(795): transl_table=11
atgaaacaatatttagacctgctcgaccgagtgttgacggagggaatagaaaaaggtgaccgtaccggaacgggaaccatcagtgtcttcggacaccagatgcgtttcaacctggacgagggattcccttgcctgactaccaagaaacttcatctgaaatcaatcatttacgaactactgtggttcctcaaaggagacacgaatgtgaaatatttgcaggaccacggcgtacgcatctggaacgaatgggcggacgaaacaggcgatctgggacatatatatggataccagtggcgttcgtggccaacctacgacggaggatttatcgaccagatcagcgaagctgtagatgccatcaagcacaatcccgattcacgccgcatcattgtcagtgcatggaatgtaggagacctggatcacatgaacctccctccttgccacgcattcttccagttttacgtagcaaacggacggctgagcctgcaactctatcaacgcagcgccgatatcttcctgggggtacctttcaatatagcatcttatgcattgctgctgcagatgatggcgcaagtcaccggtctgcaggcaggagactttatccacacactgggcgacgcacatatctacctgaaccacctggaacaggtgaaactccagctcagccgggaaccgcgcccactaccacaaatgaagatcaatccggacgtgaaaaacatcttcgacttccaattcgaggactttgaattagtaaattatgatccgcacccgcacatcgctggaaaagttgcggtataa

SEQ ID NO: 17477 - protein, 264 aa, Bacteroides fragilis NCTC 9343
MKQYLDLLDRVLTEGIEKGDRTGTGTISVFGHQMRFNLDEGFPCLTTKKLHLKSIIYELLWFLKGDTNVKYLQDHGVRIWNEWADETGDLGHIYGYQWRSWPTYDGGFIDQISEAVDAIKHNPDSRRIIVSAWNVGDLDHMNLPPCHAFFQFYVANGRLSLQLYQRSADIFLGVPFNIASYALLLQMMAQVTGLQAGDFIHTLGDAHIYLNHLEQVKLQLSREPRPLPQMKINPDVKNIFDFQFEDFELVNYDPHPHIAGKVAV

SEQ ID NO: 17478 - DNA, 972 bp, Pseudomonas syringae pv. syringae B728a
  CDS (1)..(972)
atgaagcaatatctggaactggtcgctcatgtgatcaagcacgggaccttgcaagccaaccgtaccggcgtgaacaccatcagctttccgggggcgatgctgcgttatgacttgcaggaaggttttccggcgatcaccacacggcgcatggccttcaaatcggccatcggcgagatggtcggctttctgcgtggcgtaaacaacgccgccgaattccgcgaactgggctgcaaggtctgggatcagaacgccaacgaaaacgctcagtggctgaacaacccgttccgcaagggcgaggacgatctgggcgaaatctacggcgtgcaatggcgcaagtggcctgcctacaagcgtatcgatgccggcaatgtcgcggccatcgaactggcgctgggccaggggtatcgtcagattgccgagtccgaagaagacggccagtcgttcgtggtcctgtacaaggccatcgaccagattcgccagtgcgtcgacaccatcatcaacgacccgggcagccggcggatcctgttccacggctggaactgcgcacagctcgatgaaatggccctgccgccgtgccacctgctgtaccagctgcacccgaacccgcagacccgcgaaatctcgctgacgctgtacatccgctccaacgatctgggcctcggtacgccgttcaacctgacagaaggcgccgcgctgctaagcctcatcggccgtctgaccggctacacgccgcgctggttcacctacttcatcggcgatgcccacgtgtacgaaaaccacctggacatgctcaacgaacagatgacccgcgagccgtacccgatgcccaaactggtgatctccgatcgtgtgcccgagtttgccaagaccggtgtgtaccagcctgaatggctggggctgatcgagccgtccgacttcaccctggaaggctaccagcaccacccggcaatgacggcaccgatggcggtttga

SEQ ID NO: 17479 - protein, 323 aa, Pseudomonas syringae pv. syringae B728a
MKQYLELVAHVIKHGTLQANRTGVNTISFPGAMLRYDLQEGFPAITTRRMAFKSAIGEMVGFLRGVNNAAEFRELGCKVWDQNANENAQWLNNPFRKGEDDLGEIYGVQWRKWPAYKRIDAGNVAAIELALGQGYRQIAESEEDGQSFVVLYKAIDQIRQCVDTIINDPGSRRILFHGWNCAQLDEMALPPCHLLYQLHPNPQTREISLTLYIRSNDLGLGTPFNLTEGAALLSLIGRLTGYTPRWFTYFIGDAHVYENHLDMLNEQMTREPYPMPKLVISDRVPEFAKTGVYQPEWLGLIEPSDFTLEGYQHHPAMTAPMAV

SEQ ID NO: 17480 - DNA, 1002 bp, Macaca fuscata rhadinovirus
  CDS (1)..(1002)
atgattgtcctggtgcatctcggtatctgctacgttaaaaaaattatacccgcttgcttgtctggaatagcggccgtgcgttgtcgcgtttctcgcggatccgaggttgccgcggcgcgtgccccggacggccgcggcgagcacggcgagctgcagtacctggcgcacctggatttaatcatcagacacggcgttcagagggatgacaggacgggcgtgggaaccaggtccgtgtttgggcttcaggcccgatataaccttagggacgagtttcccctgttgaccaccaaaagggtgttctggaggggcgtcgtggaggagttgttgtggtttatcagaggctccaccgactccaccgaactgtcgcgccgcggcgtaaaaatttgggacgcgcacgggtcccgcgccttcttggcggcgcagggctttggggaccgccgcgagggcgacctggggccggtgtacgggttccagtggaggcactttggggcggagtacaggggggccgatgcagactacgaaggtcaaggggtggaccagctgcgctacgtggtggacctgatcgtcagacggccccacgatcggcgaattgtcatgtgcgcgtggaaccccgcggaccttgcgaggatggccctcccgccgtgtcacgttttgtgtcagttttacgtggctcggggggagctgtcatgccagctgtaccagaggtccgccgacatgggcctcggggtcccgtttaacattgccagctacgccctcctgacgtatctaatagcgcacgtcacgggcctgaccccgggagactttgtacacaccctgggggatgcccacgtttacaacaaccacgttgggcccctgctgcttcagctggggaggaccccgcgtcctttcccgcggttgaagattctgagaaaggtgacgcgtctggaggactttacgcgtgcggacctgagtctcgagggttacgacccccacccccacatagagatggagatggccgtttga

SEQ ID NO: 17481 - protein, 333 aa, Macaca fuscata rhadinovirus
MIVLVHLGICYVKKIIPACLSGIAAVRCRVSRGSEVAAARAPDGRGEHGELQYLAHLDLIIRHGVQRDDRTGVGTRSVFGLQARYNLRDEFPLLTTKRVFWRGVVEELLWFIRGSTDSTELSRRGVKIWDAHGSRAFLAAQGFGDRREGDLGPVYGFQWRHFGAEYRGADADYEGQGVDQLRYVVDLIVRRPHDRRIVMCAWNPADLARMALPPCHVLCQFYVARGELSCQLYQRSADMGLGVPFNIASYALLTYLIAHVTGLTPGDFVHTLGDAHVYNNHVGPLLLQLGRTPRPFPRLKILRKVTRLEDFTRADLSLEGYDPHPHIEMEMAV

SEQ ID NO: 17482 - DNA, 858 bp, Enterobacteria phage RB43
  CDS (1)..(858): transl_table=11
atgaaacagtatcttgatattatcaggttggttctggcaaatggtgttgaatcaaccgaccgcactggtgtaggtactatccgtatctttggtgcgcaaacccgctggaacctcgcagaaggtttcccagcaacgaccagcaaacagctattcttcaaaccgtgtaagcatgaattgcaatggttcctgtccggttctactaacgttgatgaactacgtgaaatgacctggggaataggaagcgataaacgcactatttgggacgataactacgaaaatcaggctaaatcgctgggatactctcatggttatctggggccaatctacggtcatcaatggcgttcgttcggtggtgatttgtatggaaatcacagcgttgaccagattgctcggatcgtcaacgaactgaaaaccacaccagacgatcgcgggatcatcgtttccgcatggaaccctgttgatctggataaaatggcattgcgtccgtgtcactgtttcttccagttcgtcgtaatcaacggtaaactgtctctacagtggtatcagcgttcggttgatgtcttcttagggttgccgttcaatatcgcctcctacgctctcctgacgcatattatcgctgatatttgcgggtacgaagtaggtgatctggtttggacaggtggtgatgtccatatctacaaaaacgcaatcgagcaagcgaaagaactattgaagccggaacgtgaaccgttaccgcttccgaccctctacatgccgaaggtaaatagcttacttgatttggatcaagaattctttgactccatccatttgaaagattataatcatcacggctcgctaaaagcagctatggcagtataa

SEQ ID NO: 17483 - protein, 285 aa, Enterobacteria phage RB43
MKQYLDIIRLVLANGVESTDRTGVGTIRIFGAQTRWNLAEGFPATTSKQLFFKPCKHELQWFLSGSTNVDELREMTWGIGSDKRTIWDDNYENQAKSLGYSHGYLGPIYGHQWRSFGGDLYGNHSVDQIARIVNELKTTPDDRGIIVSAWNPVDLDKMALRPCHCFFQFVVINGKLSLQWYQRSVDVFLGLPFNIASYALLTHIIADICGYEVGDLVWTGGDVHIYKNAIEQAKELLKPEREPLPLPTLYMPKVNSLLDLDQEFFDSIHLKDYNHHGSLKAAMAV

SEQ ID NO: 17484 - DNA, 852 bp, Haemophilus influenzae 86-028NP
  CDS (1)..(852): transl_table=11
atgaagcaatatcttgatctttgtcgccgcattgttagtgaaggggagtgggttgctaatgaacgtacaggtaagcattgcctcacggtcattaatgcagatttagaatatgatgtggcgaataatcaatttccgctgattactacccgtaaaagttattggaaagcggccattgctgaatttctaggttatattcgtggatatgacaatgccgctgatttccgcgcacttggcacgaaaacttgggatgctaatgcgaatgtaaatgcagcttggcttgcaaatccgcatcgtagaggcgttgatgatatggggcgcgtatatggtgtgcaaggcagagcatggcgtaagcctaatggagaaaccatagatcagctacgtaaaattgttaataacttaacgaaaggtattgatgatagaggagagattttaactttttttaaccctggggaatttgatcttggttgtcttcgtccttgtatgcacacgcatactttttctcttgtgggcgatactttacatcttactagttatcaacgttcctgtgatgttccgcttggattgaatttcaatcaaattcaggtgtttaccttcttagcgcttatggctcagatcacgggcaaaaaagccggcaaggcatatcataaaattgtgaatgcgcatatttatgaagatcagcttgagttaatgcgtgacgtacaacttaaacgcgagcctttcccattgccaaaattagaaatcaatccagatataaaaacgcttgaagatttagaaacttgggtcacgatggatgattttaaagtcgttggctatcaatctcatgagccaattaaatatcctttttccgtctaa

SEQ ID NO: 17485 - protein, 283 aa, Haemophilus influenzae 86-028NP
MKQYLDLCRRIVSEGEWVANERTGKHCLTVINADLEYDVANNQFPLITTRKSYWKAAIAEFLGYIRGYDNAADFRALGTKTWDANANVNAAWLANPHRRGVDDMGRVYGVQGRAWRKPNGETIDQLRKIVNNLTKGIDDRGEILTFFNPGEFDLGCLRPCMHTHTFSLVGDTLHLTSYQRSCDVPLGLNFNQIQVFTFLALMAQITGKKAGKAYHKIVNAHIYEDQLELMRDVQLKREPFPLPKLEINPDIKTLEDLETWVTMDDFKVVGYQSHEPIKYPFSV

SEQ ID NO: 17486 - DNA, 822 bp, Corynebacterium jeikeium K411
  CDS (1)..(822): transl_table=11
gtggcaccccagcagcagccgagttccatccccaccccatacgaggatcttctgcgggagatcctcgagaccggcacccccaagggcgatcgcaccggcacgggtaccaccagcctgtttggccgccagatccgctacgacctctccgcaggtttcccgctgatcactaccaagtcggtacatgtgaagtccgtggtgggtgaactgctgtggttcctccgcggagattccaacgtgcgctggctacaggagaacggtattcgcatctggaacgagtgggctgacgagaacggtgatctaggcccggtatacggcgtgcagtggcgcagctggccgactccaaacggccagcacatcgaccagatcgccggcgcgttggaaactctgcaaactaacccggattcgcgtcgcaatatcgtcagcgcctggaacgtctcggagctggacaacatggcccttccaccatgccacctgctgttccagctgtacgtggccaacggcaagctgagttgccagctgtaccagcgcagcgcggacatgttcctgggcgtgccgttcaacatcgccagctactcgctgctgacccacatgttcgcccagcaggcgggcctggaggtcggcgagttcatctggaccggcggtgattgccacatctacgacaatcacgtggagcaggttaagctgcagctttcccgcgatgcccgcccgtatccgcagctgaagctgaacaaggctgcggacatgttttcttacgacttttccgatatcgagttcaccggctacgacccgcatccggtgattaaggcaaaggtggccgtgtaa

SEQ ID NO: 17487 - protein, 273 aa, Corynebacterium jeikeium K411
MAPQQQPSSIPTPYEDLLREILETGTPKGDRTGTGTTSLFGRQIRYDLSAGFPLITTKSVHVKSVVGELLWFLRGDSNVRWLQENGIRIWNEWADENGDLGPVYGVQWRSWPTPNGQHIDQIAGALETLQTNPDSRRNIVSAWNVSELDNMALPPCHLLFQLYVANGKLSCQLYQRSADMFLGVPFNIASYSLLTHMFAQQAGLEVGEFIWTGGDCHIYDNHVEQVKLQLSRDARPYPQLKLNKAADMFSYDFSDIEFTGYDPHPVIKAKVAV

SEQ ID NO: 17488 - DNA, 897 bp, Rhodobacter sphaeroides 2.4.1
  CDS (1)..(897)
atggcacatccggaacagcagtatctcgaccttctggcccagacgctggagcggggcgaccggcgggttgaccggaccggggtggggacgctctcgctgttcggggcgatgctgcggttcgacctgtccggtggacaggtgccgatcctgaccaccaaacgcgtctactggaagacggcggtgaaggagatgctctggttcctcaccgggggcaccaacatccggccgctcctgcaggagaatgtgcggatctggagcgactggccgctggccgcctaccggcgggagagcggcgaggagatctctcaggccgcgttcgagcagcgcgtcctcgaggatgaggctttcgccgcgcgctggggcgagctcgggcccgtctatggcaagcaatggcggcgctggctcgggcccgacgggcacgagcacgaccagatcgcggccctgatcgagacactgcggaccaatccgtcgagccggcggatgctgtttcatgcgtggaacgtggcggaggtggggcagatggcgctgccgccctgccacatggtctatcagtatcatgtgacttcggacgggcggctgaatgcgcttctctaccagcggtcggtcgaccttctgctcggggcgccgttcaatttcgtgggggccgcggctctgcaactcatgatcgcgcagcaggccgggctcgtgccgggcgatctggtctgggtggggggcgacacgcatctctacctcaaccatctcgatcaggcgcgcgagcagacgggccgggcgccgcgggactggccccggatgcgtctcctgcggcgggcggacagcatcgacgattaccgcatcgaggatttcgcggtggagggctacgacccccatccggcgatcgcggcggaggtggcggtctga

SEQ ID NO: 17489 - protein, 298 aa, Rhodobacter sphaeroides 2.4.1
MAHPEQQYLDLLAQTLERGDRRVDRTGVGTLSLFGAMLRFDLSGGQVPILTTKRVYWKTAVKEMLWFLTGGTNIRPLLQENVRIWSDWPLAAYRRESGEEISQAAFEQRVLEDEAFAARWGELGPVYGKQWRRWLGPDGHEHDQIAALIETLRTNPSSRRMLFHAWNVAEVGQMALPPCHMVYQYHVTSDGRLNALLYQRSVDLLLGAPFNFVGAAALQLMIAQQAGLVPGDLVWVGGDTHLYLNHLDQAREQTGRAPRDWPRMRLLRRADSIDDYRIEDFAVEGYDPHPAIAAEVAV

SEQ ID NO: 17490 - DNA, 957 bp, Lactobacillus gasseri
  CDS (1)..(957)
atggcaactttagagcaaccatacttggatttactaaataaaattatgattgaaggtcatgataaggaagatagaactggcacggggacaagaagtatatttggagctcaaatgcggtttaatctgagtgagggttttcctattttaactactaaacgagttccttttggtcttattaaaagtgaattgttgtggtttttaagaggagatactaatattcggtttctattagaacacaataatcatatttgggatgaatgggcgttcaaaaactgggttgaaagtgatgaatatcatggccctgatatgactaattttggactcagaagtcaagaagacgccaaatttaagcaagtctatcaagaagagatgaagaaatttgatgagcgaatcttagctgaccgggatttcgcagtcaaatttggtaatcttggagatgtttatggcgctcaatggcgtcactggcaaaagcgagagggtggttttattgatcaaattcaaaatgtgattgatcaaattaaaaagacgccatattcaagaagattgattgttagtgcctggaatccagaagatgtaccaaattcagcactcccaccttgtcatgttttatttcaattttatgttaatgatggtcgtttaagcgttcagctttatcagcgatcaggagatatgtttttaggagttccctttaatattgcgagctattctttactagttaatttaattgctcaagaaactggtcttaaaccaggtgaatttattcatactttaggggatgcgcatatttatcgaaaccattttgatcaagtaaaagaattattgactagaaaaccatatgactcgccaaagctttggctaaatcctgataagaaaaagattgaagactttgaaatgtcagatattaaactcgttgactataagcatcatggtactattaaagctcccgtagctgtttag

SEQ ID NO: 17491 - protein, 318 aa, Lactobacillus gasseri
MATLEQPYLDLLNKIMIEGHDKEDRTGTGTRSIFGAQMRFNLSEGFPILTTKRVPFGLIKSELLWFLRGDTNIRFLLEHNNHIWDEWAFKNWVESDEYHGPDMTNFGLRSQEDAKFKQVYQEEMKKFDERILADRDFAVKFGNLGDVYGAQWRHWQKREGGFIDQIQNVIDQIKKTPYSRRLIVSAWNPEDVPNSALPPCHVLFQFYVNDGRLSVQLYQRSGDMFLGVPFNIASYSLLVNLIAQETGLKPGEFIHTLGDAHIYRNHFDQVKELLTRKPYDSPKLWLNPDKKKIEDFEMSDIKLVDYKHHGTIKAPVAV

SEQ ID NO: 17492 - DNA, 795 bp, Magnetospirillum magnetotacticum MS-1
  CDS (1)..(795)
atgcagcaatatctcgacctgttgcgccgcatccgcgccgagggcgtgaccaagaccgaccgcaccggcaccggcaccaccagcgtgttcggccaccagatgcgcttcgacctgtcggcgggctttcccctggtgaccaccaagaagctccacacccgctccatcttcgtcgagcttttgtggttcctgcggggcgataccaatatccgttatctcaaggacaacaaggtctccatctgggacgaatgggccgatgccgacggcgatctggggccggtctacggcaagcagtggcggtcctgggcctgccccgacgggcgcaccgtcgatcagatcacccaggtggtggagatgatcaagaagagcccggattcgcgccgcctgatcgtctcggcctggaacccggccgatatcgagtccatggcgctcccgccctgccactgcctgtttcagttctatgtggccgagggccgcctgtcctgccagctttaccagcgctcggcagacgtcttcctgggcgtgcccttcaacatcgcctcctatgccctgctgacccatatgatggcccaggtgacggggctggaggtcggcgacttcgtccatacgttcggcgacgcccatctgtactccaaccacatggagcaggcggagctgcagttgtcgcgcgcgcccttggccctgccccggctggagctgaacccggatgtgaaggacctgttcgccttcaccatggacgacatcaaggtggtggactaccagtgccacgcccatatctccgccccggtggcggtatga

SEQ ID NO: 17493 - protein, 264 aa, Magnetospirillum magnetotacticum MS-1
MQQYLDLLRRIRAEGVTKTDRTGTGTTSVFGHQMRFDLSAGFPLVTTKKLHTRSIFVELLWFLRGDTNIRYLKDNKVSIWDEWADADGDLGPVYGKQWRSWACPDGRTVDQITQVVEMIKKSPDSRRLIVSAWNPADIESMALPPCHCLFQFYVAEGRLSCQLYQRSADVFLGVPFNIASYALLTHMMAQVTGLEVGDFVHTFGDAHLYSNHMEQAELQLSRAPLALPRLELNPDVKDLFAFTMDDIKVVDYQCHAHISAPVAV

SEQ ID NO: 17494 - DNA, 969 bp, Leuconostoc mesenteroides subsp. mesenteroides ATCC 8293
  CDS (1)..(969)
atgtctcaaaatgaacaacaatatctcgacctcgcacaaaagattcttgatgaaggatcacataaaggagaccgcactggtactggaacacgttcattgttcggtacacaaatgcgatttaacctggctgaaggattcccccttttaactaccaaaaaggttttctttggtttgattaaaagtgaacttttatggttcttaagaggagataataatatccgattcttacttgaacacaataatcatatctgggatgaatgggcgtttaaaaagtggattgaatctgataaatataccggtcccgatatgactaattttggtcttcgttcacaaactgatgaaaattttgccaaaatatacaaagaacaaaaagacattttcgttaacaacattctcaatgatgacgaattcaaggaagaatttggttatattggaaatgtttatggaaaattgtggcgcagctgggaaacaaatagtctgaccgccggtgatgaaaccgttgatcaggtcgccagacttattgatcaaattaaggaaacaccgaattcacgtcgcctcattttaacagcttggaatgctgagaccacaccgcaagcgcccttaccttcttgtcacgtacttagtcagttttatgttgcggacggtaaactcagtttgcaaatgtatcaacgctctggtgactttttccttggtgttccattcaatattgccagctattcactgttgctacacatggtggcagctcaaactggctacgaagttggtgaatttattcataccattggtgacacgcatatctacaataatcatgttgatcaaataactgaacaattgtcacggcctatgcacaaattaccaaaactatggctaaatccggaagttaaatcattgtttgattatacgatggatgacatcaaaatattagattacgatagtgaaccggccattaaagcgcccgtagctgtctaa

SEQ ID NO: 17495 - protein, 322 aa, Leuconostoc mesenteroides subsp. mesenteroides ATCC 8293
MSQNEQQYLDLAQKILDEGSHKGDRTGTGTRSLFGTQMRFNLAEGFPLLTTKKVFFGLIKSELLWFLRGDNNIRFLLEHNNHIWDEWAFKKWIESDKYTGPDMTNFGLRSQTDENFAKIYKEQKDIFVNNILNDDEFKEEFGYIGNVYGKLWRSWETNSLTAGDETVDQVARLIDQIKETPNSRRLILTAWNAETTPQAPLPSCHVLSQFYVADGKLSLQMYQRSGDFFLGVPFNIASYSLLLHMVAAQTGYEVGEFIHTIGDTHIYNNHVDQITEQLSRPMHKLPKLWLNPEVKSLFDYTMDDIKILDYDSEPAIKAPVAV

SEQ ID NO: 17496 - DNA, 852 bp, Haemophilus somnus 129PT
  CDS (1)..(852)
atgcgtcaatatttaaatttatgtcaacgtattattgatcaaggtcattgggtcgaaaacgaacgcacgggaaaacgttgcttaacggttattaacgccgatctcacctatgatgttgcaaacaaccaatttcctttaattacgactagaaaaagttactggaaagcggctatcgctgaatttttaggctatattcgaggctatgacaatgctgctgattttcgtaaattaggcactaaaacatgggacgcaaatgccaatgaaaatcaagcatggctcaataatccggtacgtaaaggtacagacgatatggggagagtatatggtgtacaaggtcgtcgttggcggaaaccgaacggagaaactgtcgatcagctacgtaaaatcgtcaataacctgagcaaaggaattgatgatcgaggagagattttaacctttttcaatcccggtgaaattgatctgggttgcttacgcccttgcatgcacactcacacattttctttactgggcgatacactttatttaaccagttatcaacgttcatgtgatgttccgctgggactcaatttcaatcaaattcaagtgtttacattcttagcattaatggcacaaattaccggcaaaaaagcgggacaagcctatcataaaattatcaatgcacatatttacgaagatcagtttgaattaatgcgtgatgtacagcttaaaagagagccgtttccgcttcctcgattagaaattaatcctgatattaaaaccttggaagatttagaaacttgggtaacaatggacgacttcaaagtgattggctatcaatgccatgaggcgattaaataccccttctcagtttaa

SEQ ID NO: 17497 - protein, 283 aa, Haemophilus somnus 129PT
MRQYLNLCQRIIDQGHWVENERTGKRCLTVINADLTYDVANNQFPLITTRKSYWKAAIAEFLGYIRGYDNAADFRKLGTKTWDANANENQAWLNNPVRKGTDDMGRVYGVQGRRWRKPNGETVDQLRKIVNNLSKGIDDRGEILTFFNPGEIDLGCLRPCMHTHTFSLLGDTLYLTSYQRSCDVPLGLNFNQIQVFTFLALMAQITGKKAGQAYHKIINAHIYEDQFELMRDVQLKREPFPLPRLEINPDIKTLEDLETWVTMDDFKVIGYQCHEAIKYPFSV

SEQ ID NO: 17498 - DNA, 828 bp, Fusobacterium nucleatum subsp. vincentii ATCC 49256
  CDS (1)..(828): transl_table=11
atgggagctaaatttgataaaatatataaaaatatagttgatacaatagcagaaaaaggaatttggagtgaagggaatgtcagaacaaagtatgcagatggtacagctgcacattataaaagttatataggttatcaatttagacttgacaactcagatgatgaagcacacctaataacttcaagatttgcaccaagtaaagcaccaataagagaactatattggatatggatattacaatcaaataatgtagatgttttagataaattaggttgtaaattttgggatgagtggaaaatgcaagatggaactattggaaaggcttatggttatcaaatagccaaagaaacttttggacaaaaatctcaacttcattatgttataaatgagcttaaaaataatcctaatagcagaaggattatgacagaaatttggatacctaatgaactttctgaaatggcattgacaccttgtgtacatttaactcaatggtcagtaattgggaataaattatatttagaagttagacaaagaagttgtgatgtggcattaggtttagttgctaatgtttttcaatattcagttttacataaattagtagcacttgaatgtggacttgaaccagcagaaataatctggaatattcataatatgcacatctatgatagacattatgataaattaatagagcaagtcaatagaaaaacatttgagcctgcaaaaataaaaataaataattttaaatcaatatttgattttaaacctgatgatatagaaataattgattataagtatggagaaaaagttagctatgaggtggctatttaa

SEQ ID NO: 17499 - protein, 275 aa, Fusobacterium nucleatum subsp. vincentii ATCC 49256
MGAKFDKIYKNIVDTIAEKGIWSEGNVRTKYADGTAAHYKSYIGYQFRLDNSDDEAHLITSRFAPSKAPIRELYWIWILQSNNVDVLDKLGCKFWDEWKMQDGTIGKAYGYQIAKETFGQKSQLHYVINELKNNPNSRRIMTEIWIPNELSEMALTPCVHLTQWSVIGNKLYLEVRQRSCDVALGLVANVFQYSVLHKLVALECGLEPAEIIWNIHNMHIYDRHYDKLIEQVNRKTFEPAKIKINNFKSIFDFKPDDIEIIDYKYGEKVSYEVAI

SEQ ID NO: 17500 - DNA, 795 bp, Dechloromonas aromatica RCB
  CDS (1)..(795)
atgcagccctacctcgacctgatgcgccacgtgctggacaacggcaatgacaaatccgaccgtaccggcactggcacgcgctccgtcttcggctggcagatgcgctttgacctgagccagggcttcccggtgatgacgaccaagaagctgcacctgaaatcgatcatccacgaactgctgtggttcatccagggcgacaccaacatcaagtacctgcaggaaaacggcgtcaagatctgggacgaatgggccgatgaaaacggcgatctcggcccggtctacggcaagcagtggcgccgctgggaaacgccggacggccgcgtcatcgaccagatcacgcaactggtcaacagcctgaagaacaatccggattcccgccgccacatcgtctccgcctggaaccccggcgatgtggacaacatggccctgccaccctgccactgccttttccagttttacgtcgcaaacggcaagctgtcctgccagctctaccagcgcagcgccgacattttcctcggcgtgccattcaacatcgcctcctatgccctgttcacgatgatgctggcgcaggtttgcggctaccagccaggcgaattcgtccatacctttggcgacgctcatctttactcgaaccacttcgagcaggcaaaactacagctttcccgcgacacccgccccctgccaaccatgtggatcaatccggaagtgaaggacctgttcgccttccgcttcgaggatttccgcctcgaaggctacgacccgcacccgcacatcccggccccggtggccgtttaa

SEQ ID NO: 17501 - protein, 264 aa, Dechloromonas aromatica RCB
MQPYLDLMRHVLDNGNDKSDRTGTGTRSVFGWQMRFDLSQGFPVMTTKKLHLKSIIHELLWFIQGDTNIKYLQENGVKIWDEWADENGDLGPVYGKQWRRWETPDGRVIDQITQLVNSLKNNPDSRRHIVSAWNPGDVDNMALPPCHCLFQFYVANGKLSCQLYQRSADIFLGVPFNIASYALFTMMLAQVCGYQPGEFVHTFGDAHLYSNHFEQAKLQLSRDTRPLPTMWINPEVKDLFAFRFEDFRLEGYDPHPHIPAPVAV

SEQ ID NO: 17502 - DNA, 795 bp, Ralstonia eutropha JMP134
  CDS (1)..(795)
atgaaacagtacctcgacttcatgcgccatgtgttcgagcatggcaccgaaaaggccgaccgcaccggcaccggcacgcgctcggtcttcggctaccagatgcgcttcgacctgagccagggcttcccggtggtcaccaccaagaagctgcacctgaagtcgatcatcctcgaactgctgtggttcctgcaaggctcgaccaatgtgcgctggctgcaggagaacggcgtcagcatctgggacgaatgggccgacgagaacggcgaactgggcccggtctacggctcccagtggcgttcgtggccgacgcccgacggccgccatgtcgaccagatcaccgacctgctgaaccagatccgcgagaaccccgattcgcgccgcctgattgtctcggcctggaacgtggccgacatcccgcgcatgaagctgccgccgtgccatgcgttcttccagttctacgtggccgatgggcgtctgtcgtgccaactctatcagcgcagcgccgacatcttcctcggcgtgccgttcaacatcgccagctacgcgctactcacgcacatgatcgcgcagcagaccgggctggacgtcggcgatttcgtctggaccggcggcgattgccatatctacagcaaccactacgagcaggtgcagacgcagctgtcgcgtgagccgctgccactgccgacgctgaagatcgtgcgcaagccggacagcatcttcgactaccgctacgaagatttcgagctggtcggctaccagtcgcatcccgccatcaaggcaccggtggccgtatga

SEQ ID NO: 17503 - protein, 264 aa, Ralstonia eutropha JMP134
MKQYLDFMRHVFEHGTEKADRTGTGTRSVFGYQMRFDLSQGFPVVTTKKLHLKSIILELLWFLQGSTNVRWLQENGVSIWDEWADENGELGPVYGSQWRSWPTPDGRHVDQITDLLNQIRENPDSRRLIVSAWNVADIPRMKLPPCHAFFQFYVADGRLSCQLYQRSADIFLGVPFNIASYALLTHMIAQQTGLDVGDFVWTGGDCHIYSNHYEQVQTQLSREPLPLPTLKIVRKPDSIFDYRYEDFELVGYQSHPAIKAPVAV

SEQ ID NO: 17504 - DNA, 852 bp, Haemophilus influenzae R2846
  CDS (1)..(852)
atgaaacaatatcttgagctttgtcgccgcattgttagtgaaggggaatgggttgccaatgagcgtacaggtaagcgctgtctcaccgttattaatgcagatttagaatatgatgtggcgaataatcaatttccgctgattactacccgtaaaagttattggaaagcggccattgctgaatttctaggttatattcgtggatatgacaatgccgctgatttccgcgcacttggcacgaaaacttgggatgctaatgcgaatgaaaatgcagcttggcttgcaaatccgcatcgtagaggcgttgatgatatggggcgcgtatatggtgtgcaaggcagagcatggcgtaagcctaatggagaaaccatcgatcagctacgtaaaattgttaataacttaacgaaaggtattgatgatagaggagaaattttaactttttttaaccctggggaatttgatcttggttgtcttcgtccttgtatgcacacgcatactttttctcttgtgggcgatactttacatcttactagttatcaacgttcctgtgatgttccgcttggattgaatttcaatcaaattcaggtgtttaccttcttagcacttatggctcagatcacgggcaaaaaagccggcaaggcataccataaaattgtgaatgcgcatatttatgaagatcagcttgagttaatgcgtgacgtacaacttaaacgtgagcctttcccattgccaaaattagaaataaatccagatataaaaacgcttgaagatttagaaacttgggtcacgatggatgattttaaagtcgttggctatcaatctcatgagccgattaaatatcctttttccgtctaa

SEQ ID NO: 17505 - protein, 283 aa, Haemophilus influenzae R2846
MKQYLELCRRIVSEGEWVANERTGKRCLTVINADLEYDVANNQFPLITTRKSYWKAAIAEFLGYIRGYDNAADFRALGTKTWDANANENAAWLANPHRRGVDDMGRVYGVQGRAWRKPNGETIDQLRKIVNNLTKGIDDRGEILTFFNPGEFDLGCLRPCMHTHTFSLVGDTLHLTSYQRSCDVPLGLNFNQIQVFTFLALMAQITGKKAGKAYHKIVNAHIYEDQLELMRDVQLKREPFPLPKLEINPDIKTLEDLETWVTMDDFKVVGYQSHEPIKYPFSV

SEQ ID NO: 17506 - DNA, 873 bp, Bifidobacterium longum DJO10A
  CDS (1)..(873)
atggctttgaccgaagaacaactcgcagatattcgctcccgtatccccgcacgtcccgaaacggacattccgatgccctatgaggacctggtgcgcaagatcctgaccgaaggcacgctgaagtccgatcgcaccggcaccggcacgatttccctgttcggccagcagatgcgctttgacctgtcgaagtacttcccgttgctgaccaccaagaccgtgttcttcaaaggcctggcctatgagctgctgtggtttttgaagggttcctccaacatcaactggctgctggagcacaacgtgcatatttgggatgagtgggcggacgagaacggcgatctgggcccggtctatggcgtgcagtggcgttcctggcccgcgccgacccccgaggacccgaatcgcaccatcgaccagatctccaatgtgctcgacctcatcaagcatcatccggattcgcgccgcatgatcgtctccgcgtggaatccggccgaggtggagaagatggcgttgccgccctgccacgcgctcttccagttctacgtggccgacgacaagctaagctgccagctgtaccagcgttcctgcgacatgttcctcggcgtgccgttcaatatcgcctcctactcgctgctcaccatgatgatggcgcagcaggccgggctcaagccgggcgaattcgtctggaccggcggcgactgccatgtttacgacaaccacgtcgaccagttccttgagcagctgggccgcaagccctacccgtacccgaccatcgagatccgtaaggccgattccctgttcgactaccagtatgaggacttcaaggtcgtcggctaccagcatcaccccactattaaggcacctgttgcggtctga

SEQ ID NO: 17507 - protein, 290 aa, Bifidobacterium longum DJO10A
MALTEEQLADIRSRIPARPETDIPMPYEDLVRKILTEGTLKSDRTGTGTISLFGQQMRFDLSKYFPLLTTKTVFFKGLAYELLWFLKGSSNINWLLEHNVHIWDEWADENGDLGPVYGVQWRSWPAPTPEDPNRTIDQISNVLDLIKHHPDSRRMIVSAWNPAEVEKMALPPCHALFQFYVADDKLSCQLYQRSCDMFLGVPFNIASYSLLTMMMAQQAGLKPGEFVWTGGDCHVYDNHVDQFLEQLGRKPYPYPTIEIRKADSLFDYQYEDFKVVGYQHHPTIKAPVAV

SEQ ID NO: 17508 - DNA, 972 bp, Burkholderia cepacia R18194
  CDS (1)..(972)
atgaaacagtatctcgacctcgttcgtaccattctcgataccggcacctggcaggagaaccgcacgggaatccgcaccatcagcatgccgggcgcgatgctgcgcttcgacctgcagcaaggcttcccggccgtgacgaccaagaagctcgcgttcaagtccgcgatcggtgaactggtcggcttcctgcgcgcgtcgcgcagcgcggccgatttccgcgctctcggctgcaaggtgtgggacgcgaacgcgaacgagaacgcgcaatggctcgcgaacccgtatcgccagggcgtcgacgatctcggtgacgtgtacggcgtgcaatggcgccagtggccgggctacaaggtgctcgacgcgggtgccgatgcgcagatcgacgatgcgacgcgccgcggcttccggatcgtcacgcgtttcgacgaagacggcgcgccgaaggtgctgctttacaaggcgatcgaccagttgcgccagtgcctggatacgatcatggagaacccggccgaccgtcgcatcctgtttcacgcgtggaatccggccgtgctcgaccagatcgcgctgcccgcatgccatctgctgtaccagttcctgccgaatgcgacgaagcgcgaaatctcgctgtgcctgtacatccgcagcaacgacgtcggcctcggcacgccgttcaacctgacggaaggggccgcgctgctggaactcgtcggccggctgacgggctatacgccgcgctggttcacgtacttcatcggcgacgcccatatctacgagaaccagctcgacatgctgcagcgccagctcacgcgcgagccttacgacagcccgcggctcgagattgccgagcgcgtgccggaatacgcgaagacgggcgtctacgcgcccgagtggctggagcagatcgagccgtccgatttctcgctcgtcggctaccgccaccatgagccgctgaccgcgccgatggcggtctga

SEQ ID NO: 17509 - protein, 323 aa, Burkholderia cepacia R18194
MKQYLDLVRTILDTGTWQENRTGIRTISMPGAMLRFDLQQGFPAVTTKKLAFKSAIGELVGFLRASRSAADFRALGCKVWDANANENAQWLANPYRQGVDDLGDVYGVQWRQWPGYKVLDAGADAQIDDATRRGFRIVTRFDEDGAPKVLLYKAIDQLRQCLDTIMENPADRRILFHAWNPAVLDQIALPACHLLYQFLPNATKREISLCLYIRSNDVGLGTPFNLTEGAALLELVGRLTGYTPRWFTYFIGDAHIYENQLDMLQRQLTREPYDSPRLEIAERVPEYAKTGVYAPEWLEQIEPSDFSLVGYRHHEPLTAPMAV

SEQ ID NO: 17510 - DNA, 945 bp, Listeria monocytogenes str. 1/2a F6854
  CDS (1)..(945): transl_table=11
atgaaacaatatttggatttagaaaagtacgttttagagaatggaacacaaaaaggagatcgcactgggactggaacaatcagcacatttggttatcaaatgcgttttgatttgcaggaaggctttccaattatgacaacaaaacgggtaccatttaaacttgtagtaagtgaactgctatggtttttacatggagatacgaatattcgctaccttttacagcataataataacatttggaatgaatgggcttttgagcgttttgtgaaaagcgatgattacaagggcgaagatatgacagactttggactaagagcggaacgtgatccggctttcaaagaagtatatcaagcggagatggagaagtttaaaacacgtattatagaagatgaagcgttcgcgaataaatatggtgagctaggtaatatttacggtaaacaatggcgtgaatggaaaacttcacaaggagaaacaattgatcagttagcggatttgattgaaatgattaaaacgaatccgaactcacgtcgtttgattgtgtctgcttggaatccagaagatattccgaatatggctttaccgccatgtcattcgctattccaattttatgtagcggacggaaaattatcatgtcagctgtatcaacgtagtgccgatatattcctaggtgtaccatttaatattgcgagttatgcacttctcacacatctgattgcacgtgaagtaggactggatgttggcgagtttatccatactatgggagacgcgcatctttataacaatcatattgaacaagtgaaagaacagttatctagaacaccgcacgcgcttccaaaattagtactttcagataaaccagcaacgatttttgattttgaagtagcagatatttcacttgatggctataatccagatccatcgattaaagcaccaatttcagtataa

SEQ ID NO: 17511 - protein, 314 aa, Listeria monocytogenes str. 1/2a F6854
MKQYLDLEKYVLENGTQKGDRTGTGTISTFGYQMRFDLQEGFPIMTTKRVPFKLVVSELLWFLHGDTNIRYLLQHNNNIWNEWAFERFVKSDDYKGEDMTDFGLRAERDPAFKEVYQAEMEKFKTRIIEDEAFANKYGELGNIYGKQWREWKTSQGETIDQLADLIEMIKTNPNSRRLIVSAWNPEDIPNMALPPCHSLFQFYVADGKLSCQLYQRSADIFLGVPFNIASYALLTHLIAREVGLDVGEFIHTMGDAHLYNNHIEQVKEQLSRTPHALPKLVLSDKPATIFDFEVADISLDGYNPDPSIKAPISV

SEQ ID NO: 17512 - DNA, 957 bp, Bacillus cereus G9241
  CDS (1)..(957): transl_table=11
atgaaacatgctgaaaatgaatacttaaatttatgccgtcatgtaatggaacatggtacgaagaaagaagatcgtacagggacaggaactgtatctgtatttggatatcaaatgcgttttgatttaagtaaaggttttcctttattaacgacaaagagagtaccgtttcgccttgtagcaagtgaattgctatggtttatgaaaggtgatacaaatattcgctatttattgcagcataataataacatttggaatgaatgggcatttaagagctgggtagaaagcgacgagtatactggtcctgacatgactgatttcggtcttcgttcacaacaagatgaggaatttaaagtgcagtacgatgagcaaatggaattatttaaaaagaacgttttagaagatgatgatttctcaaataaatatggttatttaggagacgtatacggtaagcagtggcgtgcttggaaaacgacagctggtgagacacttgatcaattaaaggatgtaattgaaatgattaagaagacgccagattcacgtcgcctaattgtttctgcttggaatcctgaagatgtaccaagtatggcattaccgccttgtcatacactattccaattttatgtagcggatggcaaactttcttgtcagctatatcaaagaagtggtgacatattccttggaattccatttaacattgcaagctactcactactaacacatttaattgcacatgaatgcggacttgaagtgggagaatttgttcatacgattggagatgcacacatttatacgaatcattttgagcaagtagaaaagcaattggcacgtgaaccacgtcagttcccggaacttacactaaatccagatgtgaaatctgtgtttgattttgaaatggaagacttaacgattgaaggatatgatccacacccagcaattaaagcaccggttgcagtataa

SEQ ID NO: 17513 - protein, 318 aa, Bacillus cereus G9241
MKHAENEYLNLCRHVMEHGTKKEDRTGTGTVSVFGYQMRFDLSKGFPLLTTKRVPFRLVASELLWFMKGDTNIRYLLQHNNNIWNEWAFKSWVESDEYTGPDMTDFGLRSQQDEEFKVQYDEQMELFKKNVLEDDDFSNKYGYLGDVYGKQWRAWKTTAGETLDQLKDVIEMIKKTPDSRRLIVSAWNPEDVPSMALPPCHTLFQFYVADGKLSCQLYQRSGDIFLGIPFNIASYSLLTHLIAHECGLEVGEFVHTIGDAHIYTNHFEQVEKQLAREPRQFPELTLNPDVKSVFDFEMEDLTIEGYDPHPAIKAPVAV

SEQ ID NO: 17514 - DNA, 951 bp, Rubrivivax gelatinosus PM1
  CDS (1)..(951)
atgcagcagttccacgacatgctgcagcacatcctcgatcacggctcgcgccagctcaacgcgcgcaccggcgaggaggtgctcttcgtgccgggctacaccctgcgcttcgacatggccgacggcttcccggctatcacgacgaagcagctgttcttcaagatggccaagggcgagctcttcggcttcttccgcggcttcaccagcgcggcgcagttccgcgagatcggctgcaccgtctggaacgacaacgccaacaagaccaaggcctggctggccaatccctaccggcagggcgaggacgacctcggtcgcttcggctacctgcagtggacggactggcgcgactggcgtgaggcgaccacgccggcgcagcgcgacgagatgctggcccagggctacgaggtgagagcgcacgacgccgagcgcggcgtgtggatcttgcgtcgcagcatcaaccagctcgagaccagcctgcacgccgtgatgaccaacccgagcgatcggggcatcatcctgagcggctggaacccggccgagatcgaccagggcgcgctgcgcagctgccacgtgagctacatgctccaggtcgacgtcgccaccggcacgctgcacctgacgctctggcagcgcagcttcgatgcgccgctcgcctacaacgtcgccatcggcgcgatgtacctggagatcatggcgcgcctggcgggcctgaaggctggcacgttcacgcacttcatctcggacgcgcacatctacgccaagcacatcccgggcgtgaaggagatgctcgcgcgcgagcacttcccgcaaccaaccctggacctgggcaacatcccgacgctgacctcggccgccgagatccccggcatcttcgcgacgctcgatcccaatcaggtgaagctggtcaactaccagcaccacccgaagatcgcattcgagatgacgccgtaa

SEQ ID NO: 17515 - protein, 316 aa, Rubrivivax gelatinosus PM1
MQQFHDMLQHILDHGSRQLNARTGEEVLFVPGYTLRFDMADGFPAITTKQLFFKMAKGELFGFFRGFTSAAQFREIGCTVWNDNANKTKAWLANPYRQGEDDLGRFGYLQWTDWRDWREATTPAQRDEMLAQGYEVRAHDAERGVWILRRSINQLETSLHAVMTNPSDRGIILSGWNPAEIDQGALRSCHVSYMLQVDVATGTLHLTLWQRSFDAPLAYNVAIGAMYLEIMARLAGLKAGTFTHFISDAHIYAKHIPGVKEMLAREHFPQPTLDLGNIPTLTSAAEIPGIFATLDPNQVKLVNYQHHPKIAFEMTP

SEQ ID NO: 17516 - DNA, 786 bp, Rubrivivax gelatinosus PM1
  CDS (1)..(786)
atgcgcgaccacggtgtggtcaaggccgaccgcaccggcaccggcaccaccagcgtgttcggccaccagatgcgcttcgacctgcgcgagggctttccgctggtcacgaccaagaaggtccatctcaagagcatcgtcctcgaactgctgtggttcctgcgcggcgacgggaacgccacctggctgcaggaacgcggcgtgacgatctgggacgagtgggccgcgcccgacggcgacctcggcccggtctatggtgtgcagtggcgcagttggcccacgccggacggcggccacgtcgaccagatcgccgaggtggtgaagcagctcaagaccaaccctgattcgcggcgcatcatcgtcagcgcgtggaacgtggccgacttgccgaagatggcactgatgccctgccacgccttcttccagttctatgtggcgcccggcgactcgccttcggctcggggtcggctgtcgtgccagctctaccagcgcagcgccgacatcttcctcggcgtgcccttcaacatcgccagctacgcgctgctgacgcacatgctggcgcagcagtgcgacctggaggtgggcgacttcgtctggaccggcggcgactgccacatctacagcaaccaccgcgagcaggtcgagctgcagctctcgcgcgcgccgcgcccctaccccacgctgcagatcaagcgccggccgccgtcgatcttcgactacgcctacgaggacttcgagatcatcggctacgacccgcacccggccatcaaggcgccggtcgcggtctga

SEQ ID NO: 17517 - protein, 261 aa, Rubrivivax gelatinosus PM1
MRDHGVVKADRTGTGTTSVFGHQMRFDLREGFPLVTTKKVHLKSIVLELLWFLRGDGNATWLQERGVTIWDEWAAPDGDLGPVYGVQWRSWPTPDGGHVDQIAEVVKQLKTNPDSRRIIVSAWNVADLPKMALMPCHAFFQFYVAPGDSPSARGRLSCQLYQRSADIFLGVPFNIASYALLTHMLAQQCDLEVGDFVWTGGDCHIYSNHREQVELQLSRAPRPYPTLQIKRRPPSIFDYAYEDFEIIGYDPHPAIKAPVAV

SEQ ID NO: 17518 - DNA, 972 bp, Pseudomonas fluorescens PfO-1
  CDS (1)..(972)
atgaagcaatatctcgatctggtgtcgcacgtcatcaacaacggcaccaaacaggccaaccgtaccggcgtgaacaccatcagctttccgggcgccatgttgcgcttcgacctgcaggaaggtttcccggcgatcaccacccgcaagatggccttcaaatcggccatcggcgagatgtgcggctttctgcgtggcgtgaacaacgccgccgaattccgtgcgctgggctgcaaggtctgggatcagaacgccaacgaaaacgcccagtggctggccaacccgttccgccagggcgaagacgacctcggcgaaatctacggcgtgcaatggcgcaaatggccggcgtacaagcagatcccgctgagcaacaccgcggccatcgaacaaaccttgagcaacggctacaagcagattgcccagggcgaagaagacggccaggcctacgtggtcttgtacaaagccatcgatcaagtgcgccagtgcgtcgatacgatcatcaaggacccgggcagccgccgcatcctgttccacggctggaactgcgcccagctcgatgaaatggccctgccgccgtgccatctgctgtaccagttccacccgaatgtcgagaccaaagagatctccctgaccctctacatccgttccaacgacctgggcctgggcacgccgttcaatctcaccgaaggcgccgcgctgctgagcctgatcggtcgcctgaccggctacacgccgcgctggttcacctatttcatcggtgacgcccacgtctacgaaaaccacctggacatgctcaacgaacagctcaagcgcgagccgttcgccatgccgaaactgaagatttcggatcgcgtgccggagtttgccaagaccggtgtttatcagccggaatggctggaactggtggagccgagtgacttctcgctggaaggctacgagcaccatgcgccgatgaccgcgccgatggcggtctga

SEQ ID NO: 17519 - protein, 323 aa, Pseudomonas fluorescens PfO-1
MKQYLDLVSHVINNGTKQANRTGVNTISFPGAMLRFDLQEGFPAITTRKMAFKSAIGEMCGFLRGVNNAAEFRALGCKVWDQNANENAQWLANPFRQGEDDLGEIYGVQWRKWPAYKQIPLSNTAAIEQTLSNGYKQIAQGEEDGQAYVVLYKAIDQVRQCVDTIIKDPGSRRILFHGWNCAQLDEMALPPCHLLYQFHPNVETKEISLTLYIRSNDLGLGTPFNLTEGAALLSLIGRLTGYTPRWFTYFIGDAHVYENHLDMLNEQLKREPFAMPKLKISDRVPEFAKTGVYQPEWLELVEPSDFSLEGYEHHAPMTAPMAV

SEQ ID NO: 17520 - DNA, 972 bp, Burkholderia fungorum LB400
  CDS (1)..(972)
atgaaacaatacctcgacctcgtccgcacgattctcgacaccggcacgtggcaggagaaccgcaccggcatccgcaccatcagcatgccgggcgccatgttgcgcttcgaccttcagcaaggctttcccgcggtcaccacgaaaaagctggcgttcagatcggcggtgggcgaactgatcgggtttctgcgcgcctcgcgcagcgccgcggatttccgcgacctcggctgcaaggtgtgggacgccaacgccaaccagaatccgcagtggctcgccaatccctatcgcgaggggccggacgatctcggcgacgtctacggcgtgcaatggcgccagtggcccgcctacaaggtgttgaacgcagacgcgagcgcgcagcttggcgacgcgactgcacgcggcttccgggtggtgacgggattcgaagaagacggcagccgcaaagtgctgctgtacaaggcgatcgaccagttgcgccagtgtctggacaccatcatgcagaacccggcggaccgccgcattctgtttcacgcgtggaaccccgccgtgctggatcagatcgcgctgcccgcttgccacctgctttatcagttcgtgccgaacgcggtgcgcaaggaaatttcgctgtgcctgtacatccgcagcaacgacgtcgggctcggcacgccgttcaatctgaccgagggcgcggcgttgctgcacctggtcggtcgtctgacgggttatacgccgcgctggttcacgtatttcatcggcgacgcgcacatctacgagaaccagctcgacatgctgcagcagcaactcaagcgcgagccctatgaaagtccggctttcgcgatttccgaccgcgtgccggagtatgcgaaaaccggcgtgtacgagccggaatggctcgaaaagatcgagccggcggatttctcgctggtcggctaccggcatcacgagccgctcacggcgccgatggccgtttga

SEQ ID NO: 17521 - protein, 323 aa, Burkholderia fungorum LB400
MKQYLDLVRTILDTGTWQENRTGIRTISMPGAMLRFDLQQGFPAVTTKKLAFRSAVGELIGFLRASRSAADFRDLGCKVWDANANQNPQWLANPYREGPDDLGDVYGVQWRQWPAYKVLNADASAQLGDATARGFRVVTGFEEDGSRKVLLYKAIDQLRQCLDTIMQNPADRRILFHAWNPAVLDQIALPACHLLYQFVPNAVRKEISLCLYIRSNDVGLGTPFNLTEGAALLHLVGRLTGYTPRWFTYFIGDAHIYENQLDMLQQQLKREPYESPAFAISDRVPEYAKTGVYEPEWLEKIEPADFSLVGYRHHEPLTAPMAV

SEQ ID NO: 17522 - DNA, 945 bp, Novosphingobium aromaticivorans DSM 12444
  CDS (1)..(945)
atgtccatcctgcgcgattccggccgccattacgaatggcaatatctcgatctcatgcgccgcatttgggaacatggcgacgagcgggtagatcggaccggcgtcggtacgcggtcggtcttcggtgctgagctcagattcgatctttccgatgggcggatgccgttgctcactaccaaacgcgtctactggaagacggcaacgcgtgagttcctatggttcctgaccggcaataccaatatccgccccctctgcgcgcagggtgtggagatctggaccgattggccgctcgaccgttaccgcaaggagaccggggacgacatttcgcggaaggacttttcggcacggatcgtcgcggacgaggcattcgcgttgcggtggggcgaccttggaccggtctatggcaagcaatgggtggactggccggtgttcgagcctgtgggcgacggcctgttccgccgacgcgaagccggcgtgaaccaggtggcggacgtggttgattcgctgcggcataatcccggcagcaggcgtcacatcatcgagggttggaacgtcgccgagatcgaccggatggcgctgcctccctgccacaagacataccagttccacgtcagcggcaatcggctgaacggcttgctctatcaacgcagttgcgacgtcgcgctggggcttcccttcaacctgtggggcgccgcactgctcgtacgtctgctggcccagcaatgtgaccttcaacccggcgaactggtttggatgggtggagatacgcatctctacctgaaccacgcggatctcgttgaagcgcaactttcgcgggaaccggagggtgatccgcgccttgccatcctgcggcgaccggatagtatcttcggttaccggatcgaggatttcgaggtgaccggatatgcaccgcaggggcacctttccgcgcctgttgccgtctga

SEQ ID NO: 17523 - protein, 314 aa, Novosphingobium aromaticivorans DSM 12444
MSILRDSGRHYEWQYLDLMRRIWEHGDERVDRTGVGTRSVFGAELRFDLSDGRMPLLTTKRVYWKTATREFLWFLTGNTNIRPLCAQGVEIWTDWPLDRYRKETGDDISRKDFSARIVADEAFALRWGDLGPVYGKQWVDWPVFEPVGDGLFRRREAGVNQVADVVDSLRHNPGSRRHIIEGWNVAEIDRMALPPCHKTYQFHVSGNRLNGLLYQRSCDVALGLPFNLWGAALLVRLLAQQCDLQPGELVWMGGDTHLYLNHADLVEAQLSREPEGDPRLAILRRPDSIFGYRIEDFEVTGYAPQGHLSAPVAV

SEQ ID NO: 17524 - DNA, 795 bp, Cytophaga hutchinsonii
  CDS (1)..(795)
atgaaacaatatcacgaccttatgcagcacatcctggatcagggtgtaaaaaaagaagaccgcaccggtaccggcaccgtcagtgtatttggataccagatgcgctttaatctgcaggaaggttttcctttattaacgacaaagaagctgcacatgcgttccattacgcatgagttgctgtggtttttacagggcgatacaaatatcaaatatctaaaggataacaatgtttctatctgggatgaatgggcggatgagaacggcaacttagggccggtttacggttatcagtggcgttcgtggcctacgccagacgggaagcatattgatcagatcactaacgtggtgaatatgataaaaaataatccggattcaagaaggctgattgttagcgcatggaacgtaggggagattgaaaaaatgaagctgccgccatgccacgcgttctttcagttttatgtagccgacggaaaattgtcgtgccagctctatcagcgcagtgcagatgtattcttaggtgtaccgtttaatattgcttcctatgctttgttaacgatgatggttgcacaggtatgcggtttacaggcgggcgattttgtacatacattaggagatgcgcatttatattccaatcaccttgaacaggcaaagctgcaattgagccgtgacttcagaccattgcctgcgatgaagattaatccggatgtgaagtcaatctttgattttaagtttgaagatttcaccttggaaggatacgatccgcatccgcatattaaggctgcagtagcggtgtag

SEQ ID NO: 17525 - protein, 264 aa, Cytophaga hutchinsonii
MKQYHDLMQHILDQGVKKEDRTGTGTVSVFGYQMRFNLQEGFPLLTTKKLHMRSITHELLWFLQGDTNIKYLKDNNVSIWDEWADENGNLGPVYGYQWRSWPTPDGKHIDQITNVVNMIKNNPDSRRLIVSAWNVGEIEKMKLPPCHAFFQFYVADGKLSCQLYQRSADVFLGVPFNIASYALLTMMVAQVCGLQAGDFVHTLGDAHLYSNHLEQAKLQLSRDFRPLPAMKINPDVKSIFDFKFEDFTLEGYDPHPHIKAAVAV

SEQ ID NO: 17526 - DNA, 834 bp, Microbulbifer degradans 2-40
  CDS (1)..(834)
atgaagcaatatttagatttaatgcgccatgtgcgcgataccggtaccaaaaaagaagatcgcaccggtactggcactgtgagtgtatttggctaccaaatgcgcttcgatttaagtgaaggtttcccgttggttaccaccaaaaagtgccatttaaagtcgattattcacgagctactttggtttttaaagggtgagactaacactcaataccttaccgataacggcgtgcgtatttggaatgagtgggcaacagaagagggcgatttgggcccagtttacggcgcacagtggcgctcttggcctacgccagatggcggctcgctcgatcagtttgcattgctagttgagcaaataaaaaataaacccgactcgcgtcgccatattatttctgcgtggaacccagcgttgctacccgacgagggcgtgtcgccacaggataacgtgcgcaatggcaaaatggccctgccgccttgtcacaccctgtttcagttttacgtggccgacaataaattaagctgccagctgtaccagcgcagtgccgatattttcttgggggtgccctttaatatcgcatcctacgccctgttaaccatgatggtggcgcaggtaacgggtttagagttgggggattttgtgcacacctttggtgatgcgcatctttacctgaatcacctagagcaagttgaaacgcagttggccagagagcccttgccactacccacgatgaaaattaaccctgaagtaaaagatatttttagcttcaaatttgaagactttgaactggtagattaccaggctcacccgcacattagtgcgcctatatcgatatag

SEQ ID NO: 17527 - protein, 277 aa, Microbulbifer degradans 2-40
MKQYLDLMRHVRDTGTKKEDRTGTGTVSVFGYQMRFDLSEGFPLVTTKKCHLKSIIHELLWFLKGETNTQYLTDNGVRIWNEWATEEGDLGPVYGAQWRSWPTPDGGSLDQFALLVEQIKNKPDSRRHIISAWNPALLPDEGVSPQDNVRNGKMALPPCHTLFQFYVADNKLSCQLYQRSADIFLGVPFNIASYALLTMMVAQVTGLELGDFVHTFGDAHLYLNHLEQVETQLAREPLPLPTMKINPEVKDIFSFKFEDFELVDYQAHPHISAPISI

SEQ ID NO: 17528 - DNA, 960 bp, Oenococcus oeni PSU-1
  CDS (1)..(960)
atgagccgaaatgaagaacaatacctaaaccttgcccgacgtattttggaaaccggggcctcgaaaatggatcggaccaagactggaacacactcgatttttggtgcgcaaatgcgttttgatctctctgaggggtttcctttgctgaccagtaaaaaagtcgcatttggacgaattaaatcggaattattgtggttcttgcgcggtgacaataatattcgttttctcctgcaacaccacaatcatatttgggacgaatggccctttaaaaaatgggtcgaaagcaatgagtataaaggccccgatatgactgattttggtttgcgcacgcaaaaagatccaattttcgccgaacagtataaagagcaaaagaaaatctttgttgatcgaattttaaacgatgacgaattcagcaaaaaattcggaacaatcggggatgtttacggaaagctttggcgtcattggccggatgccaacgacgatggcagcgtagaccaaataacccgtttaatcaatgaaattaaagttaatcccaactcccgtcgtttaattttaacagcttgggatcccgaaacaacgccgtttgccactctgccttcatgtcatgttatgagtcaattttatgtagtagacggaaaaattagcctacaaatgtaccaaagatcggccgattattttttgggagtaccctttaacatcgccagttactcgcttctgctttcaatggttgccgcacaaaccggattagaagtcggtgaatttattcatacgattggtgatgcccatatttacaacaaccacgttgaccaaattaaagagcagttgtcaaaaccaacacataaacttccgactctgaagcttaatccagacgtgaagtcaattttcgattatgaaatgagcgatattaaacttgagaattatattcacgaagatgtaattaaagctccgatcgctgtttga

SEQ ID NO: 17529 - protein, 319 aa, Oenococcus oeni PSU-1
MSRNEEQYLNLARRILETGASKMDRTKTGTHSIFGAQMRFDLSEGFPLLTSKKVAFGRIKSELLWFLRGDNNIRFLLQHHNHIWDEWPFKKWVESNEYKGPDMTDFGLRTQKDPIFAEQYKEQKKIFVDRILNDDEFSKKFGTIGDVYGKLWRHWPDANDDGSVDQITRLINEIKVNPNSRRLILTAWDPETTPFATLPSCHVMSQFYVVDGKISLQMYQRSADYFLGVPFNIASYSLLLSMVAAQTGLEVGEFIHTIGDAHIYNNHVDQIKEQLSKPTHKLPTLKLNPDVKSIFDYEMSDIKLENYIHEDVIKAPIAV

SEQ ID NO: 17530 - DNA, 951 bp, Pediococcus pentosaceus ATCC 25745
  CDS (1)..(951)
atgcttgaagaacaataccttaatttggaaagatatgttttggaaaatgggcatctcaaaggagaccgtacccaaactggtaccctaagtacttttggatatcaaatgcgttttgatttaagtgaaggttttccattactaacgaccaagagagtcccttttggtttgattaagagtgagttactctggtttttaaaaggcgataccaatattagatatttacttcaacataataatcatatttgggatgaatgggcttttaaaaagtgggttgaaagtgatgaatatcagggaccagacatgaccgattttggtcaccgctcactgactgatcctgaattcaatgaactctataaaattgaaaaacaacgttttacagaacaaattttggaagatgatacattttctgctaaatatggtgatcttggaaatgtttacggtagccaatggcgagcatggaagactagtactggtgagactatcgatcaaatttcaaatgttattgatatgattaagaataatcctaactcaagaagaatgatcgtttcggcttggaatcctgaagatgtgccaacctcagcattacctccgtgtcattcactatttcaattttatgtggctgatgggaaacttagctgtcaactgtatcaacgcagtggcgatattttcttaggaattcctttcaatattgctagctatgccttgcttacagaattaattgcgaaagcgactggtttagaagtgggagaatttatccataccatcggtgatgctcacatttattctaatcatctggatcaggttaaagaacaattagaacgtactccacgtccggctcctaaattgaaatttaaacaagtgcatgacagtatctttgactatgaaccaggagatattgtggttgaaggatatgatcctcatccaaccattaaagcaccggtagcagtttaa

SEQ ID NO: 17531 - protein, 316 aa, Pediococcus pentosaceus ATCC 25745
MLEEQYLNLERYVLENGHLKGDRTQTGTLSTFGYQMRFDLSEGFPLLTTKRVPFGLIKSELLWFLKGDTNIRYLLQHNNHIWDEWAFKKWVESDEYQGPDMTDFGHRSLTDPEFNELYKIEKQRFTEQILEDDTFSAKYGDLGNVYGSQWRAWKTSTGETIDQISNVIDMIKNNPNSRRMIVSAWNPEDVPTSALPPCHSLFQFYVADGKLSCQLYQRSGDIFLGIPFNIASYALLTELIAKATGLEVGEFIHTIGDAHIYSNHLDQVKEQLERTPRPAPKLKFKQVHDSIFDYEPGDIVVEGYDPHPTIKAPVAV

SEQ ID NO: 17532 - DNA, 840 bp, Streptococcus suis 89/1591
  CDS (1)..(840)
atgactaaagcagatattatttttaaagaaaacattcgtaagattatggaagagggcgttttttcagaaaatgctcgcccacgttacaaggatggaaatgtcgctaattccaagtacgttacaggcgcctttgctgagtatgacttgtctaagggggagtttcctattacaacacttagacctattccgattaaatcagccatcaaggaaattctctggatttaccaagaccagaccaatgatttgtcggttttacaggaaaaatacggtgtccagtattggaatgactgggaagttgaaggaacaggcacaatcggtgaacgctatggtgcaattgttaaaaagcatgacatcatttcaaaaatcctcaagcaattggaggaaaatccatggaaccgccgtaatgtgatttctttgtgggattatgaagcatttgaccaatccgcgggtcttttgccatgtgcctttcagaccatgtttgacgttcggcgagtggatggggagatttatttggatgcaactctaactcaacggtcaaatgatatgttggtagcccatcatatcaacgctatgcagtatgtagcccttcagatgatgattgctaaacattttggctggaaggttgggaagtttttctatttcatcaacaatcttcacatctatgataatcagtttgaacaggctgaagaattactccgtcgcacaccatctgaagttgagccacgtttggtcttaaatgttcctgacggcaccaatttctttgacattcgggcagaagattttgagttggtggactacaatccagttaaaccgcagttaaaattcgatttagcaatttaa

SEQ ID NO: 17533 - protein, 279 aa, Streptococcus suis 89/1591
MTKADIIFKENIRKIMEEGVFSENARPRYKDGNVANSKYVTGAFAEYDLSKGEFPITTLRPIPIKSAIKEILWIYQDQTNDLSVLQEKYGVQYWNDWEVEGTGTIGERYGAIVKKHDIISKILKQLEENPWNRRNVISLWDYEAFDQSAGLLPCAFQTMFDVRRVDGEIYLDATLTQRSNDMLVAHHINAMQYVALQMMIAKHFGWKVGKFFYFINNLHIYDNQFEQAEELLRRTPSEVEPRLVLNVPDGTNFFDIRAEDFELVDYNPVKPQLKFDLAI

SEQ ID NO: 17534 - DNA, 795 bp, Thiobacillus denitrificans ATCC 25259
  CDS (1)..(795)
atgaaaccctatctcgacctgatgcgccacgtgcttgagcacggcacacgcaaagacgaccgcaccggcaccggcaccctgtcggtcttcggctggcagacgcgctacgaccttgccgcgggctttccgctcgtcacgaccaagaaatgtcacctgcgctcgatcgttcacgaactgctatggtttctccagggcgacacgaacatccgctatctgaaggaaaacggcgtctcgatctgggacgagtgggccgacgagaacggcgatctcggcccggtctacggccatcagtggcgttcgtggcctaaagccgacggcggggtgatcgaccagatcgccgaggccgtgaagacgctcaggaccaaccccgattcgcgccgcatcatcgtctcggcgtggaacgttgccgacctcgacaggatggcgctggcgccctgccacgcgttcttccagttctacgttgccgaaggcaggttgagttgccagctctaccagcgcagcgccgacatcttcctcggcgtgccgttcaacatcgcctcctacgcgctgctgacactgatgatggcgcaggtgacgggcctgaagccgggtgacttcgtacatacgctcggtgacgcccacctctacgtgaaccacttggagcaggcgcgcgagcagctttcccgcgaaccgcgcccgctgcccacgatgacgctcaatcccgacgtgaccgacatcttcggctttcgcttcgaggatttcacgctcggcggctacgacccgcacccggcgatcaaggcgccggtcgcggtatga

SEQ ID NO: 17535 - protein, 264 aa, Thiobacillus denitrificans ATCC 25259
MKPYLDLMRHVLEHGTRKDDRTGTGTLSVFGWQTRYDLAAGFPLVTTKKCHLRSIVHELLWFLQGDTNIRYLKENGVSIWDEWADENGDLGPVYGHQWRSWPKADGGVIDQIAEAVKTLRTNPDSRRIIVSAWNVADLDRMALAPCHAFFQFYVAEGRLSCQLYQRSADIFLGVPFNIASYALLTLMMAQVTGLKPGDFVHTLGDAHLYVNHLEQAREQLSREPRPLPTMTLNPDVTDIFGFRFEDFTLGGYDPHPAIKAPVAV

SEQ ID NO: 17536 - DNA, 984 bp, Erythrobacter litoralis HTCC2594
  CDS (1)..(984): transl_table=11
atggcaagcgtctcgattccgtccgagctcatggggcccagcaactcggaacgccattccgaatggcaatatctcgacctgatgcggcgcatctgggcggagggcagcgagcgggtcgatcgcacgggtgtcggcacgcgttcggtgttcggggcacaattgcggttcgacctggccgatggggctatgccgctgctcacaacgaagcgggtctactggaaaaccgcgacgcgcgagatgctgtggttcctgaccggtgacacgaatatccgcccgctggtgctgcagggagtcaagatctggaatgagtggccgcatgcccgctatgttaacgaaacgggcgaggacattgcgctcgacgatttcatccagcgcatcgccgatgacgaggcctttgctgaacgctggggggatctcggcccggtctatggcaagcaatgggtcgattggccgacctatcgttatcgcaaggacgggctgtacgagaaaagcgaaggcatcaaccagatcgccgaggttgtcgaaagcctcaagaccaatcctggcagccgccgccacatcatcgaaggctggaatgtcgccgagcttgaccgcatggcgctgccgccctgccacaagacctatcaatttcacgtcgctaaggacgatcaagggcgcgatcgcctgaattgtctgctttaccagcgcagttgcgatgtcgcgctcggtctgcctttcaacctgtggtcggcagcgctgttgcagcgcatgatggcgcagcagaccgacctggaaccgggcgagctggtctggatgggcggagacacgcatctctacctcaatcacgagcacttgatcaccgagcagctgaatcgggaaccgcaaggccatcccacgcttgaaatagtaaggcggcccgacagcatattcgactaccggatcgaggatttcgtggtgcataattacgaaccgcaccctccgatcaaagcacctgttgcggtctga

SEQ ID NO: 17537 - protein, 327 aa, Erythrobacter litoralis HTCC2594
MASVSIPSELMGPSNSERHSEWQYLDLMRRIWAEGSERVDRTGVGTRSVFGAQLRFDLADGAMPLLTTKRVYWKTATREMLWFLTGDTNIRPLVLQGVKIWNEWPHARYVNETGEDIALDDFIQRIADDEAFAERWGDLGPVYGKQWVDWPTYRYRKDGLYEKSEGINQIAEVVESLKTNPGSRRHIIEGWNVAELDRMALPPCHKTYQFHVAKDDQGRDRLNCLLYQRSCDVALGLPFNLWSAALLQRMMAQQTDLEPGELVWMGGDTHLYLNHEHLITEQLNREPQGHPTLEIVRRPDSIFDYRIEDFVVHNYEPHPPIKAPVAV

SEQ ID NO: 17538 - DNA, 840 bp, Lactococcus lactis subsp. cremoris SK11
  CDS (1)..(840)
atgacttacgcagatcaagtttttaaacaaaatatccaaaatatcctagataatggtgttttttcagaaaatgcaagaccaaagtataaggatggtcaaatggcgaatagcaaatatgtcactggttcattcgttacttatgatttgcaaaagggggagtttccaattaccactttgcgtccaattccaatcaaatctgctattaaagaattgatgtggatataccaagaccaaacaagtgagctttctgttctcgaagagaagtatggagtcaaatactggggagaatggagaattggtgatggtacgattgggcaacgttatggtgcaacagtcaaaaaatataatatcattggtaaattattagaaggcttggccaaaaatccatggaatcgtcgtaatatcatcaacctttggcagtatgaagattttgaggaaacagaaggtcttttaccatgtgctttccaaacgatgtttgatgtccgtcgagaaaaagatggtcagatttatttggatgccacactgattcaacgttcaaacgatatgcttgtggcccaccatatcaatgcgatgcaatatgttgctttgcaaatgatgattgcaaaacatttttcttggaaagttgggaaattcttttattttgtaaataatttacatatttatgataatcagtttgagcaggcaaatgaattaatgaagcgaacagcttctgaaaaagaacctcgtttggtccttaatgttcctgatggtacaaactttttcgatattaaacctgaagattttgaacttgtggactatgagccagtaaaacctcaattgaaatttgatttagcaatttaa

SEQ ID NO: 17539 - protein, 279 aa, Lactococcus lactis subsp. cremoris SK11
MTYADQVFKQNIQNILDNGVFSENARPKYKDGQMANSKYVTGSFVTYDLQKGEFPITTLRPIPIKSAIKELMWIYQDQTSELSVLEEKYGVKYWGEWRIGDGTIGQRYGATVKKYNIIGKLLEGLAKNPWNRRNIINLWQYEDFEETEGLLPCAFQTMFDVRREKDGQIYLDATLIQRSNDMLVAHHINAMQYVALQMMIAKHFSWKVGKFFYFVNNLHIYDNQFEQANELMKRTASEKEPRLVLNVPDGTNFFDIKPEDFELVDYEPVKPQLKFDLAI

SEQ ID NO: 17540 - DNA, 912 bp, Lactobacillus delbrueckii subsp. bulgaricus ATCC BAA-365
  CDS (1)..(912)
atgacggaaggcaatgacaaaaatgaccggaccgggacggggaccagaagcctctttggggcccagatgcgctttgacttaagccagggcttcccgatcttgacgaccaagagggtgcctttcggcctgatcaagagcgaacttttgtggttcttgcggggggacaccaacatccgtttcttgcttgaacataaaaaccacatttgggacgaatgggcctttaaaaattgggtgaccagcccggaataccagggcccggacatgactgattttggccttaggagtcaaaaggacccagggtttaaggcagtctatgacgaagaaatgcaaaagttctgccagcggattttggatgatgaagcttttgcccaaaaatacggcaacctgggcgacgtctatggggcccagtggcggcactggggtaagcgggacggcggctttatcgaccagatcgcggacgtgattgagcagatcaagaccaatcccgactcccgccgcttgatcgtaacggcatggaacccggaagacgttccttccagcgccctgccgccgtgccatgtcctcttccagttttacgtggctgacggcaagctcagcttgcagctttaccagcgctcaggcgacatgttcttaggcgtgcccttcaacattgccagctactctttgctcttgtccttgattgcccgggagaccggcctggaagtgggcgagtttgtgcatactattggggatgcccacatttacaagaaccactttgcccaagtggaagagcagctgaaaagaaagccgtttgacgcgccaactttgtggctgaatccagggaagaaaaaagtagctgattttgaaatggctgatattaaattggtcaactaccagcacgggtctacaatcaaggccccggttgccgtttag

SEQ ID NO: 17541 - protein, 303 aa, Lactobacillus delbrueckii subsp. bulgaricus ATCC BAA-365
MTEGNDKNDRTGTGTRSLFGAQMRFDLSQGFPILTTKRVPFGLIKSELLWFLRGDTNIRFLLEHKNHIWDEWAFKNWVTSPEYQGPDMTDFGLRSQKDPGFKAVYDEEMQKFCQRILDDEAFAQKYGNLGDVYGAQWRHWGKRDGGFIDQIADVIEQIKTNPDSRRLIVTAWNPEDVPSSALPPCHVLFQFYVADGKLSLQLYQRSGDMFLGVPFNIASYSLLLSLIARETGLEVGEFVHTIGDAHIYKNHFAQVEEQLKRKPFDAPTLWLNPGKKKVADFEMADIKLVNYQHGSTIKAPVAV

SEQ ID NO: 17542 - DNA, 861 bp, Streptococcus thermophilus LMD-9
  CDS (1)..(861)
atgacgaaagcagacactatttttaaagaaaatatcactaaaatcatggaagagggagtttggtcagagcaagcacgtcctaaatacaaggatggcacaacagccaattccaaatacatcacagggtcttttgcagaatatgatttgagcaagggagagtttccaattacgactctgcgtcccattgctatcaaatctgccatcaaagaagtgttctggatctatcaagaccagacaaatagcctagatgtgcttgaagataagtataatgttcattattggaatgactgggaagttgaaggcgtccctgctaataatggggacaagcgttcaatcggtcagcgttatggggcagtcgttaagaagcacgatattattaatcgtttgttagcacagttagaagccaatccttggaatcgccgtaatgtcatttccctttgggattacgaggccttcgaggagacagctggacttcagccttgtgccttccagaccatgtttgatgttcgtcgtgtgggtgaggatgtttatttggatgccactttgacgcagcgctcaaacgatatgttggtggcccatcacattaatgctatgcagtatgtggcacttcagatgatgattgccaagcattttggttggaaagttggtaaattcttttatttcatcaacaacctccatatctatgacaatcaatttgaacaagctgaggaactcctcaagcgtcagccgtctgattgtcaaccacgcttggtcctcaatgttcctgatgaaactaatttctttgatatcaaaccagaagattttgaattggtggactatgatcctgttaaacctcaactcaaatttgacttagcaatttaa

SEQ ID NO: 17543 - protein, 286 aa, Streptococcus thermophilus LMD-9
MTKADTIFKENITKIMEEGVWSEQARPKYKDGTTANSKYITGSFAEYDLSKGEFPITTLRPIAIKSAIKEVFWIYQDQTNSLDVLEDKYNVHYWNDWEVEGVPANNGDKRSIGQRYGAVVKKHDIINRLLAQLEANPWNRRNVISLWDYEAFEETAGLQPCAFQTMFDVRRVGEDVYLDATLTQRSNDMLVAHHINAMQYVALQMMIAKHFGWKVGKFFYFINNLHIYDNQFEQAEELLKRQPSDCQPRLVLNVPDETNFFDIKPEDFELVDYDPVKPQLKFDLAI

SEQ ID NO: 17544 - DNA, 804 bp, Arthrobacter sp. FB24
  CDS (1)..(804): transl_table=11
gtgagcattccaacgccctatgaagacctcctgcgtgacgtccttgccaacggcacgcacaaatctgaccgcaccggcaccggcacgctcagcgtgttcgggcggcagatgcgctttgacctcagccaaagctttccgctgatcaccaccaagcgcgttcatttcaagtcggtggcagttgaacttctatggttcctgcgcggcgaaaccaacgtgaaatggatgcaggaccagggcgtcaccatctggaacgaatgggccgacgccgacggcgaactgggtcccgtttacggcgtgcagtggcgcagctggccgacgcccgacggcggccacatcgaccagatcgccgagctggtggagaacctcaaatccaacccggactcgcgccggcacatcgtctccgcctggaacgtggctgagcttcaggacatggccttgccgccgtgccacgcgttcttccagttctacgttgctgacggcaagctgtcctgccagctgtaccagcgctccgcggacaccttccttggcgtcccgtttaacatcgcttcctatgcgctgctgacctgcatgctggcccaacaggtgggcctggagcccggcgagttcgtctggaccggcggcgacgtgcacatctacgacaaccacatggaccaggtgctcaagcagctgaagcgggagccgtacgaatacccgcagctgaagatcctccgcaagccggactccatttttgactacacgctggacgacttcgaagtggtcggataccagcaccaccctacgattaaggcgccgatcgcagtatga

SEQ ID NO: 17545 - protein, 267 aa, Arthrobacter sp. FB24
MSIPTPYEDLLRDVLANGTHKSDRTGTGTLSVFGRQMRFDLSQSFPLITTKRVHFKSVAVELLWFLRGETNVKWMQDQGVTIWNEWADADGELGPVYGVQWRSWPTPDGGHIDQIAELVENLKSNPDSRRHIVSAWNVAELQDMALPPCHAFFQFYVADGKLSCQLYQRSADTFLGVPFNIASYALLTCMLAQQVGLEPGEFVWTGGDVHIYDNHMDQVLKQLKREPYEYPQLKILRKPDSIFDYTLDDFEVVGYQHHPTIKAPIAV

SEQ ID NO: 17546 - DNA, 795 bp, Azotobacter vinelandii AvOP
  CDS (1)..(795): transl_table=11
atgaaacagtacctcgacctgatgcgcctggtgcgcgagcacggcaccttcaagagcgaccgcaccggcaccggcacgttttccgtgttcggccaccagatgcgcttcgacctggccgagggcttcccgctggtcaccaccaagaagtgccacctcaaatccatcgtccacgagctgctgtggttcctgaagggcgacaccaacatccgctacctgaaggaaaacggcgtgtcgatctgggacgagtgggccgacgggaacggcgacctcggcccggtctacggctaccagtggcgcagttggccggcaccggacggccggcacatcgaccagatagccaatgtcgtgaacatgatccgcgacaacccggattcgcgccggctgatcgtctcggcctggaacccggcgctgatcgacgagatgaagctgccgccgtgccatgcgctgttccagttctacgtggccgatggccggctcagctgccagctctatcagcgctcggcggacatcttcctcggcgtgcccttcaacatcgccagctacgcgctgctgatcctgatgatggcgcaggtcacgggcctcgcgcccggcgagttcgtctggaccggcggcgactgccacctctacgccaaccacttggagcaggccgacctgcagctctcccgcgaaccgctgccgctgccgaccatgcagctcgaccccgacgtgaaggacctgttcgccttccgcttcgaggacttcgagctggtcggctaccagtcccatccgcacatcaaggcgccggtggcgatctga

SEQ ID NO: 17547 - protein, 264 aa, Azotobacter vinelandii AvOP
MKQYLDLMRLVREHGTFKSDRTGTGTFSVFGHQMRFDLAEGFPLVTTKKCHLKSIVHELLWFLKGDTNIRYLKENGVSIWDEWADGNGDLGPVYGYQWRSWPAPDGRHIDQIANVVNMIRDNPDSRRLIVSAWNPALIDEMKLPPCHALFQFYVADGRLSCQLYQRSADIFLGVPFNIASYALLILMMAQVTGLAPGEFVWTGGDCHLYANHLEQADLQLSREPLPLPTMQLDPDVKDLFAFRFEDFELVGYQSHPHIKAPVAI

SEQ ID NO: 17548 - DNA, 972 bp, Burkholderia vietnamiensis G4
  CDS (1)..(972): transl_table=11
atgaaacagtacctcgacctcgttcgcaccatcctcgacaccggcacctggcaggagaaccgcacgggaatccgtaccatcagcatgcccggcgcgatgctgcgcttcgacctgcagcaaggctttccggccgtgacgacgaagaagctcgcgttcaagtcggcgatcggcgagctggtcgggttcctgcgtgcatcgcgcagcgcggccgatttccgtgcgctcggctgcaaggtgtgggacgcgaacgcgaacgacaacgcgcagtggctcgcgaatccttaccgtcgcggcgtcgacgatctcggcgacgtgtacggcgtgcaatggcggcaatggcccggctacaaggtgctggacgcgagcgccgacgcgcagatcgccgacgcgacgcgccgcggcttccggatcgtcacgcagttcgacgaagacggtgcgccgaaggtgctgctctacaaggcgatcgaccagctgcgccagtgcctcgacacgatcatcgagaacccgtccgaccgtcgcatcctgtttcatgcgtggaacccggccgtgctcgaccagatcgcattgcccgcttgccatctgctgtatcagttcctgccgaacgccgcgaagcgcgagatttcgctgtgcctgtacatccgtagcaacgacgtcgggctcggcacgccgttcaacctgaccgaaggcgccgcgctgctgtcgctggtggggcggctgaccggctatacgccgcgctggttcacgtacttcatcggcgacgcgcacatctacgagaaccagctcgacatgctgcagcagcagctcacgcgcgagccgtacgacagcccgcggctcgagatcgccgagcgcgtgcccgactacgcgaagacgggcgtctatgcgccggagtggctcgagctgatcgagccgtcggacttctcgctcgtcggctatcggcatcatgagccgctgagcgcgccgatggcggtctga

SEQ ID NO: 17549 - protein, 323 aa, Burkholderia vietnamiensis G4
MKQYLDLVRTILDTGTWQENRTGIRTISMPGAMLRFDLQQGFPAVTTKKLAFKSAIGELVGFLRASRSAADFRALGCKVWDANANDNAQWLANPYRRGVDDLGDVYGVQWRQWPGYKVLDASADAQIADATRRGFRIVTQFDEDGAPKVLLYKAIDQLRQCLDTIIENPSDRRILFHAWNPAVLDQIALPACHLLYQFLPNAAKREISLCLYIRSNDVGLGTPFNLTEGAALLSLVGRLTGYTPRWFTYFIGDAHIYENQLDMLQQQLTREPYDSPRLEIAERVPDYAKTGVYAPEWLELIEPSDFSLVGYRHHEPLSAPMAV

SEQ ID NO: 17550 - DNA, 972 bp, Burkholderia cenocepacia AU 1054
  CDS (1)..(972): transl_table=11
atgaaacagtatctcgatctcgttcgtaccattctcgataccggcacctggcaggagaaccgcacgggaatccgcaccatcagcatgccgggcgcgatgctgcgcttcgacctgcagcaaggcttcccggccgtgacgaccaagaagctcgcgttcaagtccgcgatcggcgagctggtcggcttcctgcgcgcgtcgcgcagcgcggccgatttccgcgcgctcggctgcaaggtgtgggatgcgaacgcgaacgagaacgcgcagtggctcgcgaacccgtatcgccagggcgtcgacgatctgggcgacgtatatggcgtgcaatggcgccagtggccgggctacaaggtgctcgatgcgaacgccgacgcgcagatcgccgatgcgacgcgccgcggcttccggatcgtcacgcgtttcgacgaagatggcgcgccgaaggtgctgctgtacaaggcgatcgaccagctgcgccagtgcctggacacgatcatggagaacccgtccgatcgccgcatcctgtttcacgcgtggaatccggccgtgctcgaccagatcgcgctgcccgcgtgccatctgctgtaccagttcctgccgaacgcgacgaagcgcgagatctcgctgtgcctgtacatccgcagcaatgacgtcggcctcggcacgccgttcaacctgacggaaggggccgcgctgctgtcgctcgtcggtcggctgacgggctatacgccgcgctggttcacgtatttcatcggcgacgcgcacatctacgagaaccagctcgacatgctgcagcagcagctcacgcgcgagccgtacgaaagcccgcggctcgagattgccgagcgcgtgcccgagtacgcgaagacgggcgtctatgcgccggaatggctggagcaggtcgagccgtccgatttctcgctcgtcggctatcggcaccatgagccgttgactgcgccgatggcggtctga

SEQ ID NO: 17551 - protein, 323 aa, Burkholderia cenocepacia AU 1054
MKQYLDLVRTILDTGTWQENRTGIRTISMPGAMLRFDLQQGFPAVTTKKLAFKSAIGELVGFLRASRSAADFRALGCKVWDANANENAQWLANPYRQGVDDLGDVYGVQWRQWPGYKVLDANADAQIADATRRGFRIVTRFDEDGAPKVLLYKAIDQLRQCLDTIMENPSDRRILFHAWNPAVLDQIALPACHLLYQFLPNATKREISLCLYIRSNDVGLGTPFNLTEGAALLSLVGRLTGYTPRWFTYFIGDAHIYENQLDMLQQQLTREPYESPRLEIAERVPEYAKTGVYAPEWLEQVEPSDFSLVGYRHHEPLTAPMAV

SEQ ID NO: 17552 - DNA, 795 bp, Chromohalobacter salexigens DSM 3043
  CDS (1)..(795): transl_table=11
atgcaaccctatctcgacttaatgcgccacgtgctcgagaacggcgtggaaaaaagtgaccgcaccggcacggggacgctcagcgtcttcggccatcaaatgcgcttcgatctggccgcgggatttccgctggtgaccaccaagaagctgcatttgcgctcgatcatccacgaactgctgtggttcttgcgcggcgacaccaacatcgcctatctcaaggaaaatcgcgttcgcatctgggatgaatgggccgacgagaacggcgatctggggcccgtgtatggctaccaatggcgtagctggccgcgtccggatggcggccatgtcgatcagatcgccaatgtcgtcgagcagatcaagcgcaaccccgattcccgccgcctcatcgtctcggcctggaacccggcactggtcgacgagatggcgttgccgccgtgccacgccctgttccagttctatgtcgccgaggggcggctgtcctgccagctgtatcagcgcagcgccgacatcttcctcggcgtgccgttcaacatcgccagctacgcgttgttgacccacatggtggcgcaggcctgtgacctggcgccgggcgagttcgtgcacaccctgggggatgcccacctgtacctcaaccatctcgagcaggcacgcttgcaattgagccgcgagcctcgcgcgctgcctcgcctggtgctcaatccacgggtcaaggatgtgttcgccttcacgttcgatgacatcgccatcgaagactacgatccgcatccacacatcaaggcggaggtggccgtatga

SEQ ID NO: 17553 - protein, 264 aa, Chromohalobacter salexigens DSM 3043
MQPYLDLMRHVLENGVEKSDRTGTGTLSVFGHQMRFDLAAGFPLVTTKKLHLRSIIHELLWFLRGDTNIAYLKENRVRIWDEWADENGDLGPVYGYQWRSWPRPDGGHVDQIANVVEQIKRNPDSRRLIVSAWNPALVDEMALPPCHALFQFYVAEGRLSCQLYQRSADIFLGVPFNIASYALLTHMVAQACDLAPGEFVHTLGDAHLYLNHLEQARLQLSREPRALPRLVLNPRVKDVFAFTFDDIAIEDYDPHPHIKAEVAV

SEQ ID NO: 17554 - DNA, 972 bp, Burkholderia pseudomallei 668
  CDS (1)..(972)
atgaaacagtatctcgatctcgttcgcaccattctcgataccggcacctggcagagcaaccgcacgggcattcgcacgatcggcatccccggcgcgatgctgcgcttcgatctgcagcagggctttcccgcagtgacgacgaaaaagctcgcgttcaagtccgcgatcggcgagctcgtcggctttctgcgcgcgacgcgcagcgcggccgatttccgcgcgcttggctgcaaggtgtgggacgcgaatgcgaatgagaacgcgcagtggctcgcgaatccgtatcgccgcggcgtcgacgacctcggcgacgtgtacggcgtccaatggcggcgctggccgggctacaaggtgctcgacgcgcatgccgacgcgcagatcgccgatgcgacgtcgcgcggttttcgcgccgtcgcgcgcttcgacgaggacggcgtgcagaaggtgctgctgcacaaggcgatcgaccagttgcgagactgcctcgacacgatcgtgcgcgacccgtcgagccggcgcatcctgttccacggctggaatcccgcggtgctcgacgagatcgcgctgcccgcgtgccatctgctgtatcaattcctgccgaacgtcgagcgtcgcgaaatctcgctgtgcctgtacatccgcagcaacgacgtcgggctcggcacgccgttcaatctcgccgaaggcgcggcgctcctcacgctcgttggccggctgacgggctatacgccgcgctggttcacgtacttcatcggcgatgcgcacatctacgagaatcagctcggcatgctcaagcagcagctcgaacgcgagccgttcgacagcccgcggctcgagatcgccgagcgcgtgcccgagtacgcgaaaacggggcagtacgagccgcaatggcttgaacgcatcgagccgtcggatttcacgctcgtcggctatcgtcaccacgaaccgctgagcgcgccgatggccgtttga

SEQ ID NO: 17555 - protein, 323 aa, Burkholderia pseudomallei 668
MKQYLDLVRTILDTGTWQSNRTGIRTIGIPGAMLRFDLQQGFPAVTTKKLAFKSAIGELVGFLRATRSAADFRALGCKVWDANANENAQWLANPYRRGVDDLGDVYGVQWRRWPGYKVLDAHADAQIADATSRGFRAVARFDEDGVQKVLLHKAIDQLRDCLDTIVRDPSSRRILFHGWNPAVLDEIALPACHLLYQFLPNVERREISLCLYIRSNDVGLGTPFNLAEGAALLTLVGRLTGYTPRWFTYFIGDAHIYENQLGMLKQQLEREPFDSPRLEIAERVPEYAKTGQYEPQWLERIEPSDFTLVGYRHHEPLSAPMAV

SEQ ID NO: 17556 - DNA, 990 bp, Burkholderia pseudomallei S13
  CDS (1)..(990)
atgctgcgctatccgggtctcagcgagctctacctcgcgacgctcagggacgtctgcggcgcgtacgaataccggagcgcgccgcgcgggtacgcggagcgcgaaatcatcggctacggcgcacggatcgacgatccgcgcgcgcgcttttgccggcatgcggcgcgcaagcagaacgtcgtcttcaactacgccgaggcgctgtggtatctgtccgggcgcaacgatctcgaattcatcgcgcactacgcaccgtcgatggcgcgctacagtccggacggcaagcatctgcccggcaccggctacggcgcgcgcctgctgcattacggcgagcgcgggctcgaccagatcgagcgcgcgctcgacatcctgtcgcgcgacgacgccgagagcaagcgcgtcgtgctgcagatcttcagcgccgacgaggaactgtaccggcgcaacatcgacgtgtcgtgcacgctcggcctgcaactgctgctgcgcgaaggccggctgcacatggtcgcgttcatgcgcgcgaacgacgcgtacatcgggctgctgaacgacgtgttctcgttcacgttcctgcaggagtacctcgcgtcgcggctcggctgcgagctcggcacgtatgcgcatcaggtgggctcgatccacgtgtacgacgacaatctgccgcgcgtgcaggcgctgctcgacgacagcgatgcggcgatcgtcaccgccgccgcgccgccgcgcatgccggcgggcacgcgcgccgcgacgatcgcgcgcgtgctcgagcacgaaggccggattcgcgccgggcgcgtgtcgctcgccgcgcttcgcgacatcgatctcgatccgtactggcgcgacgtgctcggtctcttctggatctatcgcgagatcaaggcgggcaacccgccgcccgacgaggcgctcgcgttcgtcggctcgttccatcgcgcctatctgatgaaccggtgggacatggcgtccgcctcgctccaataa

SEQ ID NO: 17557 - protein, 329 aa, Burkholderia pseudomallei S13
MLRYPGLSELYLATLRDVCGAYEYRSAPRGYAEREIIGYGARIDDPRARFCRHAARKQNVVFNYAEALWYLSGRNDLEFIAHYAPSMARYSPDGKHLPGTGYGARLLHYGERGLDQIERALDILSRDDAESKRVVLQIFSADEELYRRNIDVSCTLGLQLLLREGRLHMVAFMRANDAYIGLLNDVFSFTFLQEYLASRLGCELGTYAHQVGSIHVYDDNLPRVQALLDDSDAAIVTAAAPPRMPAGTRAATIARVLEHEGRIRAGRVSLAALRDIDLDPYWRDVLGLFWIYREIKAGNPPPDEALAFVGSFHRAYLMNRWDMASASLQ

SEQ ID NO: 17558 - DNA, 831 bp, Clostridium thermocellum ATCC 27405
  CDS (1)..(831): transl_table=11
atgagtaaagctgatgagatttttatagccatgtgcaaagacattcttgaaaacggagtgtcttccgaaggagaaaaagtaagagcaagatgggctgacggaactcctgcccatacaatcaagaaatttggcgttgtgaacagatatgatttgtcggaggagtttccaatccttaccttaaggccgacaaatctgaaagctgcaattgatgagctgctttggatatggcaaaagaaatccaataatataaaagacctcaacagtcatatttgggacagctgggccgatgaaaacggttcgataggcaaggcgtacggttatcaattaagtattaagcataaatatcccgaaggagagtttgaccaggttgacaggattatctatgacttaaagcacaatccttacagcagaaggattattgccaacatgtacaatcatagtgaccttcatgaaatgaacctgtatccttgcgcatacagcataactttcaatgtcaccggaagaaaattgaacgcaatacttaatcagcgttcccaggatgttttggtggcgaacaactggaatgtggcccaatatgcaattttagtacatatgtttgcacaagtctgcgatttggaagttggagaacttgtgcatgttattgccgatgcccatatatatgacaggcatataccgttggtaaaagaacttatacaaaggactccttatccagcaccgaagctatggattaatcccgagaaaaaagatttttatgattttaaagttgaagattttgtgctggaggactatcaggccgggccccagataaaaaacatccctgttgccatctaa

SEQ ID NO: 17559 - protein, 276 aa, Clostridium thermocellum ATCC 27405
MSKADEIFIAMCKDILENGVSSEGEKVRARWADGTPAHTIKKFGVVNRYDLSEEFPILTLRPTNLKAAIDELLWIWQKKSNNIKDLNSHIWDSWADENGSIGKAYGYQLSIKHKYPEGEFDQVDRIIYDLKHNPYSRRIIANMYNHSDLHEMNLYPCAYSITFNVTGRKLNAILNQRSQDVLVANNWNVAQYAILVHMFAQVCDLEVGELVHVIADAHIYDRHIPLVKELIQRTPYPAPKLWINPEKKDFYDFKVEDFVLEDYQAGPQIKNIPVAI

SEQ ID NO: 17560 - DNA, 855 bp, Polaromonas sp. JS666
  CDS (1)..(855): transl_table=11
atgaacacccctcccgaaacccgccctgaccgccccattcgttcccagtacgaagacttcatgcgccatgtggacgcgcacggcgtcttcaaggccgatcgcaccggcaccggcaccaaaagcgtgtttggttaccagatgcgctttgatttgaacgaaggctttccgctggtgaccaccaaaaaggttcacctcaaatccatcgtgcaggaactgctgtggtttctgaccgggagcagcgacaacaactggctgaaagaacgcggcgtgacgatttgggatgagtgggcccgcgaagacggtgacctgggcccggtctatggcgtgcaatggcgcagttggccgacgcctgacggcgggcatattgaccagatcagcgaagtcatcaagacgctgaaaaccaaccctgactcgcgccgcatcatcgtgagcgcctggaacgtggctgacctgtccaaaatggcgctgatgccttgccacgcattttttcagttctacgtcgcgcctgccactgaagctggcggtaaaggcaagctcagctgccagctctaccagcgcagcgccgacattttcctcggcgtgcccttcaacattggcagctacgcgctgctcacgcacatggtggcgcagcagtgcgacctggacgtgggcgacttcatctggacgggcggcgactgccacatctacagcaaccacgccgagcaggtggccctgcaactgagccgggcccccttcccctatccgacactccacatcaagcgcaagcccgagtcgatcttcgactaccagttcgacgatttcgagttccttgactaccagcaccatgcggccatcaaggcgccggtagcggtgtag

SEQ ID NO: 17561 - protein, 284 aa, Polaromonas sp. JS666
MNTPPETRPDRPIRSQYEDFMRHVDAHGVFKADRTGTGTKSVFGYQMRFDLNEGFPLVTTKKVHLKSIVQELLWFLTGSSDNNWLKERGVTIWDEWAREDGDLGPVYGVQWRSWPTPDGGHIDQISEVIKTLKTNPDSRRIIVSAWNVADLSKMALMPCHAFFQFYVAPATEAGGKGKLSCQLYQRSADIFLGVPFNIGSYALLTHMVAQQCDLDVGDFIWTGGDCHIYSNHAEQVALQLSRAPFPYPTLHIKRKPESIFDYQFDDFEFLDYQHHAAIKAPVAV

SEQ ID NO: 17562 - DNA, 795 bp, Exiguobacterium sp. 255-15
  CDS (1)..(795): transl_table=11
atgaaacagtatcatcaactttgtcaggaaattttaacgaacggcgtaaaaaaagaagatcggacgggaaccggaaccatcagtatttttggtcatcaaatgcggttctcgttgcaggatggttttccgatggtgacgacaaaaaagttacatatgaagtcgatcattcatgaattgatctggtttatctccggtgaaacgaacatctcttatttacaagagaacggtgtccgcatttggaacgagtgggcggacgaaaacggtaatctcggaccggtttatggtgcccagtggcgttcttttccgaaaccggatggaacgaccgtcgatcaattagcggatgtgattgaacagatcaaagtcaatccggactcccgtcgtttgattgtcagtgcctggaatcccggacaactggaggagatggccttaccgccctgccatttgttgttccagttttacgtagcagacggaaaactgtcttgtcagctctatcagcggtcggcggacgtcttccttggagtcccgttcaatattgcttcctatgctttgttgacgcacatgattgctcatgtctgtaaacttgaagtcggcgattttgttcatactttaggagattcccatatttattcgaaccatctggatcaagtgaatctccagttgagccggaatccgaaacctttgccgacgattcgatttgcccgtgaagtcgagcgcattgaagactttacgtttgacgatatcatcatcgaaggctacgaccctgatccgcatattaaaggagtcgtcgccgtatga

SEQ ID NO: 17563 - protein, 264 aa, Exiguobacterium sp. 255-15
MKQYHQLCQEILTNGVKKEDRTGTGTISIFGHQMRFSLQDGFPMVTTKKLHMKSIIHELIWFISGETNISYLQENGVRIWNEWADENGNLGPVYGAQWRSFPKPDGTTVDQLADVIEQIKVNPDSRRLIVSAWNPGQLEEMALPPCHLLFQFYVADGKLSCQLYQRSADVFLGVPFNIASYALLTHMIAHVCKLEVGDFVHTLGDSHIYSNHLDQVNLQLSRNPKPLPTIRFAREVERIEDFTFDDIIIEGYDPDPHIKGVVAV

SEQ ID NO: 17564 - DNA, 795 bp, Methylobacillus flagellatus KT
  CDS (1)..(795): transl_table=11
atgaaggtctatcacgacttgatgcgccacgtactggagcagggccacaagaaggaagaccgcaccggcaccggtacgctgtccgtattcggctaccagatgcgcttcgacctgtccgagggctttccgctgctgaccaccaagaaggttcacctgaagtccattattcatgagctgctctggtttttgcagggcagtaccaacattgcctacctcaaggaaaacggcgtgaccatctgggacgagtgggcggatgccgagggcaacctggggccagtgtacggctaccagtggcgcaattggcccaaaccggatggaggccatatcgatcagatcagcgaagtgatagcggccatcaagcgtaatccggactctcgccgtctgattgtgtccgcatggaatgtcgccgatgttgacaagatgaaattgccgccttgccatgcgtttttccagttctatgtggcggatggcaagctttcgtgccagttgtaccagcgtagtgcggatatctttctcggcgtaccgttcaatatcgcctcctatgccttgctcaccatgatggtggcgcaggtatgtgatctcaagcttggcgattttgtacatacactgggtgatgcgcatatctatctcaatcatctcgagcaggtgaaggagcaattgtcgcgtgagccttatcctctgcctgtgatgcggatcaatcccgaggtcaaggatatctttgctttccgtttcgaggatttcacactggagaattaccagtcgcatcccgctatcaaggcccccgttgcagtgtag

SEQ ID NO: 17565 - protein, 264 aa, Methylobacillus flagellatus KT
MKVYHDLMRHVLEQGHKKEDRTGTGTLSVFGYQMRFDLSEGFPLLTTKKVHLKSIIHELLWFLQGSTNIAYLKENGVTIWDEWADAEGNLGPVYGYQWRNWPKPDGGHIDQISEVIAAIKRNPDSRRLIVSAWNVADVDKMKLPPCHAFFQFYVADGKLSCQLYQRSADIFLGVPFNIASYALLTMMVAQVCDLKLGDFVHTLGDAHIYLNHLEQVKEQLSREPYPLPVMRINPEVKDIFAFRFEDFTLENYQSHPAIKAPVAV

SEQ ID NO: 17566 - DNA, 963 bp, Sphingopyxis alaskensis RB2256
  CDS (1)..(963): transl_table=11
atgacagggaaagaaggggagcacgtcttggctgattccatccactatgaactgcaatatctcgacctgatgcgccgtatctgggtcgacggtgacgagcgcgtcgaccgcaccggcgtcggcacgcgctcgctgttcggtgagacgatgcgattctcgctgaaggacgacgccatccccctgctcacgacgaagcgcgtttattggaagactgcactgcgcgaactgctttggtttctcacgggcgacaccaatatccgtccgctcgttgcgcaaggcgtaaagatctggaccgactggccgctcgagaaatatcgcaaggcgaccggcgaggcgatcagcgccacggatttcgaagcgcggatcgtcgcagacgcggattttgcggccaaatggggcgaccttggtcccgtctacggtcatcaatgggtcaactggccgcgctacgagccggcgggcggcggtctgtttcgccgcgccgaccacgggtataaccagattgcggcgctgatcgactcgctcaagaacaatccggggtcacggcgccacatcttcaccggctggaatgtcgccgatctcgaccggatggcgttgccgccgtgccatatgacctatcagttccatgttcgcagcgacggcggattgtcgtgcctgctctttcagcgctcgtgcgatcttggtcttggcttcgcgttcaacattttcgaggcggcgttgctcacgcggatggtcgccgagcaatgcggcctttacgcgcatgaggtcgtgtggaccggtggcgacgtccatctctatctcaaccacgccgagctggtcgaacagcagttggcgcgcgtaccggagggaaagccccggctccgcatcctgcgccgaccgcccagcattttcgaatatcggttcgaggatttcgtggtcgaggattacgcgccgcaagcgcatatttccgcgccggtggcggtctga

SEQ ID NO: 17567 - protein, 320 aa, Sphingopyxis alaskensis RB2256
MTGKEGEHVLADSIHYELQYLDLMRRIWVDGDERVDRTGVGTRSLFGETMRFSLKDDAIPLLTTKRVYWKTALRELLWFLTGDTNIRPLVAQGVKIWTDWPLEKYRKATGEAISATDFEARIVADADFAAKWGDLGPVYGHQWVNWPRYEPAGGGLFRRADHGYNQIAALIDSLKNNPGSRRHIFTGWNVADLDRMALPPCHMTYQFHVRSDGGLSCLLFQRSCDLGLGFAFNIFEAALLTRMVAEQCGLYAHEVVWTGGDVHLYLNHAELVEQQLARVPEGKPRLRILRRPPSIFEYRFEDFVVEDYAPQAHISAPVAV

SEQ ID NO: 17568 - DNA, 795 bp, Shewanella amazonensis SB2B
  CDS (1)..(795): transl_table=11
atgaagcagtatctcgacttaatgaagcacatcctcgataaggggacagataaaagtgacagaaccggtacaggcacccgttcggttttcggttatcagatgcgctttgacctcaatgaggggtttccgctggttaccaccaagaagtgccacctgcgctccatcattcatgaactgctgtggttcctgaaaggtgaaaccaatgtggattatctgcacgaaaacaaggtgtcgatttgggacgagtgggccgatgaaaagggcaatctgggacctgtctatggcgcccaatggcgcagctggccaacccctgatggccgccatattgatcagatttctcaagttattgagcagattaaagccacgccggactctcgccggttaatcgtatcagcctggaacgtgggagagctggataaaatggcgctggcaccctgccatgcgtttttccaattttacgtggccgatggcaaactgagctgccagctctatcagcgttcctgtgatgtgttcctgggcctgccgtttaatattgccagttatgcgctgctgaccatgatggtggcgcagcagtgtaatcttggcttgggcgatttcgtttggaccggtggggatacccacctctacagcaaccacatggagcagactcaattgcagctctcacgggagcctcgtcctctgcccaccatgaagatcctccgccatccagagtcgatttttgattaccgtttcgaagactttgaactcagtggttacgacccccatccccacatcaaggcgcccgttgctatctaa

SEQ ID NO: 17569 - protein, 264 aa, Shewanella amazonensis SB2B
MKQYLDLMKHILDKGTDKSDRTGTGTRSVFGYQMRFDLNEGFPLVTTKKCHLRSIIHELLWFLKGETNVDYLHENKVSIWDEWADEKGNLGPVYGAQWRSWPTPDGRHIDQISQVIEQIKATPDSRRLIVSAWNVGELDKMALAPCHAFFQFYVADGKLSCQLYQRSCDVFLGLPFNIASYALLTMMVAQQCNLGLGDFVWTGGDTHLYSNHMEQTQLQLSREPRPLPTMKILRHPESIFDYRFEDFELSGYDPHPHIKAPVAI

SEQ ID NO: 17570 - DNA, 795 bp, Ralstonia metallidurans CH34
  CDS (1)..(795): transl_table=11
atgaaacagtacctcgacttcatgcgccatgtgtacgagcatggcaccgaaaagtccgaccgcaccggcaccggtacgcgctcggtcttcggctaccagatgcgcttcgacctgaacgagggctttcccgtcgtcaccacgaaaaagctgcacctgaagtcgatcatccatgaactgctgtggttcctgcagggctcgaccaacatcaagtacctgaaggacaacggcgtcaccatctgggacgaatgggccgatgccaacggcgaactgggcccgatctacggctaccagtggcgcgcatggccgacaccggacggtcgccatatcgaccagatcaccgaggtcgtgcagcagatccgcgacaaccccgattcgcgccggctgattgtgtcggcctggaacgtgggcgagatcccgcagatgaagctgccgccctgccacgcgttcttccagttctacgtggccgatggcaagctgtcctgccagctctaccagcgcagcgccgacattttcctcggcgtgccgttcaacatcgccagctacgcgctgctgacgcacatgatcgcgcagcaatgcgacctgggcgtgggcgatttcgtgtggaccggtggcgactgccacatctacagcaaccacttcgagcaggtggagacgcagctttcgcgcgagccgatgaagctgccaacgctgcgaatcaagcatcgtcccgacagcatcttcgactacaagtacgacgatttcgagctggtcggctatgagtcgcaccccgcgatcaaggcgccggtggccgtatga

SEQ ID NO: 17571 - protein, 264 aa, Ralstonia metallidurans CH34
MKQYLDFMRHVYEHGTEKSDRTGTGTRSVFGYQMRFDLNEGFPVVTTKKLHLKSIIHELLWFLQGSTNIKYLKDNGVTIWDEWADANGELGPIYGYQWRAWPTPDGRHIDQITEVVQQIRDNPDSRRLIVSAWNVGEIPQMKLPPCHAFFQFYVADGKLSCQLYQRSADIFLGVPFNIASYALLTHMIAQQCDLGVGDFVWTGGDCHIYSNHFEQVETQLSREPMKLPTLRIKHRPDSIFDYKYDDFELVGYESHPAIKAPVAV

SEQ ID NO: 17572 - DNA, 975 bp, Enterococcus faecium DO
  CDS (1)..(975): transl_table=11
atgggtagaagattaggaggaaaaaggatggaacaagcgtatcttgacttaggaagaaaattgttggaagaagggcatcgtaaagaagacagaacaggcacaggcacattaagcttattcggataccaaatgcggtttgatctgcaaaaagggtttcctttgttaacaacgaaacgagtaccttttggattgatcaaaagcgaattgctttggtttttaaaaggagatacgaatatccgctatctattacaaaataaaaaccatatttgggatgaatgggcatttgaacgctacatcaaaagtccagactataatggaccagatatgactgattttggccatagatgtttgacagatcctgaattcaatgaagaatataaaaagcagagcaagcttttttgcgagaagatcctaaccgatgattcctttgctgaaacatacggcgatcttggacacatctacggctatcaatggcgtcactgggaaacaaaagacggtggctttatcgatcaaatcaaacaagtgatcgaagcaatcaaaaagactcctgattctagaagattgatcgtttctgcatggaatccggaagatgttcctagcatggctttgcctccttgtcatacgatgtttcaattttatgttcaagagggacggctaagctgccaattgtatcaacgcagtggggatgtgtttctaggcgttccgttcaacattgcaagttatgcgttgctgactcacctaattgcacatgaaacaggtttagcggttggcgaatttgttcacacattaggagatgctcatctttatatcaatcatatcgaacaaatgaaagaacaattgagccgagaaatacgcgcatttccgactttagttttgaatcaggaaaagcagtcagtatttgattttgagatggaagatatccaattagaaggatatgacccacatccggcgatcaaagctcctatcgctgtttag

SEQ ID NO: 17573 - protein, 324 aa, Enterococcus faecium DO
MGRRLGGKRMEQAYLDLGRKLLEEGHRKEDRTGTGTLSLFGYQMRFDLQKGFPLLTTKRVPFGLIKSELLWFLKGDTNIRYLLQNKNHIWDEWAFERYIKSPDYNGPDMTDFGHRCLTDPEFNEEYKKQSKLFCEKILTDDSFAETYGDLGHIYGYQWRHWETKDGGFIDQIKQVIEAIKKTPDSRRLIVSAWNPEDVPSMALPPCHTMFQFYVQEGRLSCQLYQRSGDVFLGVPFNIASYALLTHLIAHETGLAVGEFVHTLGDAHLYINHIEQMKEQLSREIRAFPTLVLNQEKQSVFDFEMEDIQLEGYDPHPAIKAPIAV

SEQ ID NO: 17574 - DNA, 795 bp, Mesorhizobium sp. BNC1
  CDS (1)..(795): transl_table=11
atgcgccaatatctcgatctgcttgcccatgtgctcgaaaacggcatcgaccgcgaagaccggactggcaccggcacgcgcggcgtcttcgggtatcagatgcgcttcgacctttcggacgggtttccggtgctgaccacgaaaaagctgcatctccggtcgatcatctatgagcttttatggttcctgaagggcgataccaatatccgctaccttcaggagaacggtgtgacgatatgggacgagtgggccgatgagaacggcgacctcgggccagtttatggcgcgcagtggcgatcctggcccgcgccggacgggcggcatatcgaccagattgcgaatcttctcaatggattgagggaaaatccttattcgcggcgtcacatcgtgacggcctggaacccggctgagatcgacgggatggccttgccgccctgccattgccttttccaattccatgtggccgaggggcgtctctcatgccagctctaccagcgctcggcggacatcttccttggcgtgcccttcaacatcgcctcctatgcgctgcttaccatgatgatcgcgcaggttaccggcctgaagccgggcgacttcgttcacacgcttggcgatgcgcatctttacaagaaccacttcgaccaggcgcgcgagcagctgacgcgcacgccgaagccgctgccgacgatgtggatcaacccggaggtggatgatctcttcgcctttggctacgaggattttcgtttggagggctatgtggccgatccgacgatccgcgcgcccatcgccgtatag

SEQ ID NO: 17575 - protein, 264 aa, Mesorhizobium sp. BNC1
MRQYLDLLAHVLENGIDREDRTGTGTRGVFGYQMRFDLSDGFPVLTTKKLHLRSIIYELLWFLKGDTNIRYLQENGVTIWDEWADENGDLGPVYGAQWRSWPAPDGRHIDQIANLLNGLRENPYSRRHIVTAWNPAEIDGMALPPCHCLFQFHVAEGRLSCQLYQRSADIFLGVPFNIASYALLTMMIAQVTGLKPGDFVHTLGDAHLYKNHFDQAREQLTRTPKPLPTMWINPEVDDLFAFGYEDFRLEGYVADPTIRAPIAV

SEQ ID NO: 17576 - DNA, 807 bp, Kineococcus radiotolerans SRS30216
  CDS (1)..(807): transl_table=11
gtggctgagcagcggatcgacacccagtacgaggacctgctgcggcacgtcctcgccaccggcacccccaagtccgaccgcaccggcacgggcacccgcagcgtcttcggccaccagctgcgctacgacctgtccgcggggttcccgctggtcacgaccaagcgcgtgcacttcaagtcgatcgcgctggagctgctgtggttcctgcgcggggacggcaacgtccgctggctgcaggaacgcggggtcaccatctgggacgagtgggccgacgagaacggcgacctcggtcccgtctacggcgtgcagtggcgttcctggccgacgcccgacggccgccacgtggaccagatcgcccaggtcctgcacaccctgcgcacggacccggactcccggcggatggtcgtctcggcgtggaacgtcgccgagctggacaggatggcgctggccccctgccacgcgttcttccagttccacgtggccgacgggaagctgtcctgccagctctaccagcgctccgcggacctcttcctcggggtgccgttcaacatcgccagctacgcgctgctgacgcacctggtggcggccgaggtcggtctcgaggtcggcgacttcgtctggaccggcggcgacgtccacgtctacgacaaccacgtcgagcaggtgaccgagcagctcacccgcaccccgtacccgttcccgcgcctcgcggtccgcccggcggggctgttcgagcacgagtacgaggacttcgaggtcctcgactaccgccaccaccccgcgatcaaggcgcccgtggcggtctga

SEQ ID NO: 17577 - protein, 268 aa, Kineococcus radiotolerans SRS30216
MAEQRIDTQYEDLLRHVLATGTPKSDRTGTGTRSVFGHQLRYDLSAGFPLVTTKRVHFKSIALELLWFLRGDGNVRWLQERGVTIWDEWADENGDLGPVYGVQWRSWPTPDGRHVDQIAQVLHTLRTDPDSRRMVVSAWNVAELDRMALAPCHAFFQFHVADGKLSCQLYQRSADLFLGVPFNIASYALLTHLVAAEVGLEVGDFVWTGGDVHVYDNHVEQVTEQLTRTPYPFPRLAVRPAGLFEHEYEDFEVLDYRHHPAIKAPVAV

SEQ ID NO: 17578 - DNA, 834 bp, Silicibacter sp. TM1040
  CDS (1)..(834): transl_table=11
atgcagcagtatcatgacgctttgcagcatattcttgatcacggggtcgagacgacggatcgtaccggcaccggcactctgtcgtgttttggaatgcagcaacgttatgatctggccgaagggttccctttggtgacgaccaaaaagctgcatctgcgctcgatcatacatgagctgttgtggttcctgtccggggatacaaacataagatatctcaaagagaacggtgtttcgatctgggacgaatgggcggatgaaaacggcgatcttggtccggtctatggctaccagtggcgcaagtttccacgactagagctcgccgagggcacgcttggagatgagccactctatcgggcaggcacggtggatcagatcagcgagctgctggatatgatccgcaagagccccgacagccgccgtctgatcgtcaccgcatggaaccccggcgatgtgccggatatggcgctgccgccctgtcacagcctgtggcaactgcgcatcctgggcggcaagatgcacctgcagctctaccagcgctctgcggatatgttcctcggtgtgccgttcaatatcgcttcatatgctttgttgttgcacatgctcgcccatgtgaccggctatgaggtgggcagttttgtgcatacgatgggggacgcgcatatctattccaaccacatggaacaggtgaaactgcagctctcgcgcagccccaagtccctgccgcagctgcgcattgcgcgcgatgtgtcttctatttttgatttcaaatacgaggattttgaaatcctcggctatgatcccgaccccgtcatcaaggccccggtcgcggtctaa

SEQ ID NO: 17579 - protein, 277 aa, Silicibacter sp. TM1040
MQQYHDALQHILDHGVETTDRTGTGTLSCFGMQQRYDLAEGFPLVTTKKLHLRSIIHELLWFLSGDTNIRYLKENGVSIWDEWADENGDLGPVYGYQWRKFPRLELAEGTLGDEPLYRAGTVDQISELLDMIRKSPDSRRLIVTAWNPGDVPDMALPPCHSLWQLRILGGKMHLQLYQRSADMFLGVPFNIASYALLLHMLAHVTGYEVGSFVHTMGDAHIYSNHMEQVKLQLSRSPKSLPQLRIARDVSSIFDFKYEDFEILGYDPDPVIKAPVAV

SEQ ID NO: 17580 - DNA, 795 bp, Nitrobacter hamburgensis X14
  CDS (1)..(795): transl_table=11
atgaaccagtaccacgatctgctcgaacgtattctcagcgacggcgcggagaagcatgaccgtaccggcaccggaacattgtccatcttcgggcatcagatgcgtttcaatctcgcatcgggatttccgatgctgaccaccaagaagcttccgctcaagtcgatcgtgcatgaactgctctggttcctgaagggcgagaccaacgtcaggtatctgagggagcacggcgtctcgatctgggacgagtgggccgacgccaacggcgatctcggcccggtctacggttcgcagtggcgctcatggcccgcgccggacggacgcagcatcgaccagatcgccaacgtagtcgacatgatcgggcgcagtccggattcgcggcggctgatcgtcagcgcgtggaatccggccgatgtcgacaagatggcgctgccgccgtgccactgcctgtttcagttctatgttgccgacggaaaactgtcgtgccagctttatcagcgctcggcggatgtgtttctgggggtgcccttcaacatcgcgtcctatgcgttgctgacgatgatggtcgcgcaggtcacggggctcaagcccggggacttcgtgcacagcctcggcgacgcgcacctctatttgaatcacctcgatcaggcacggcttcaactcacgcggccgacacgatcgctgccgacgatgacgatcaatcccgaggtgaagagtatcttcgcgttccgctacgaggatttcaaactcgagaactacgatccccatccgcatatcaaggcagaggtcgcggtgtga

SEQ ID NO: 17581 - protein, 264 aa, Nitrobacter hamburgensis X14
MNQYHDLLERILSDGAEKHDRTGTGTLSIFGHQMRFNLASGFPMLTTKKLPLKSIVHELLWFLKGETNVRYLREHGVSIWDEWADANGDLGPVYGSQWRSWPAPDGRSIDQIANVVDMIGRSPDSRRLIVSAWNPADVDKMALPPCHCLFQFYVADGKLSCQLYQRSADVFLGVPFNIASYALLTMMVAQVTGLKPGDFVHSLGDAHLYLNHLDQARLQLTRPTRSLPTMTINPEVKSIFAFRYEDFKLENYDPHPHIKAEVAV

SEQ ID NO: 17582 - DNA, 795 bp, Shewanella denitrificans OS-217
  CDS (1)..(795): transl_table=11
atgaagcaatatctagcattaatggagcacatactggcccatggcgcggtgaaaacagatagaaccggaacgggcactcgttcagtctttggctatcagatgcgcttcgatttaaatcaagggttccccttagttaccactaaaaagtgtcacctacgttctatcatacatgagctgctatggtttctgcagggcgacaccaatgtggcgtatctacatgagcataatgtgagtatttgggatgaatgggccgatgataaaggcaatttgggcccagtgtatggcgctcagtggcgcagctggccgacccaatccggtaaggcggtggatcaaatcagccagatcatagaacaaatcaagactcagccagattcgagacgcctaatcgtctcggcatggaatgtgggcgaactggataaaatggcattagcgccttgtcatgccttgttccagttttatgtcgccgatggcaagttgtcttgccagctgtatcaacgaagctgtgatgtcttcttaggactgccctttaatattgccagttatgccttgttgaccatgatggtcgctcaacagtgcgatctcgccttgggtgattttgtctggactggcggtgatacccacttgtattccaatcatatggaacagactaagctgcagctaagtcgcgagcctcatgccctgccacaaatgaatatattacgtaagccagaatcgatttttgattatcaattcgatgattttgagttggttaattatcagcctcacccacacattaaagcgcctgtggccatctag

SEQ ID NO: 17583 - protein, 264 aa, Shewanella denitrificans OS-217
MKQYLALMEHILAHGAVKTDRTGTGTRSVFGYQMRFDLNQGFPLVTTKKCHLRSIIHELLWFLQGDTNVAYLHEHNVSIWDEWADDKGNLGPVYGAQWRSWPTQSGKAVDQISQIIEQIKTQPDSRRLIVSAWNVGELDKMALAPCHALFQFYVADGKLSCQLYQRSCDVFLGLPFNIASYALLTMMVAQQCDLALGDFVWTGGDTHLYSNHMEQTKLQLSREPHALPQMNILRKPESIFDYQFDDFELVNYQPHPHIKAPVAI

SEQ ID NO: 17584 - DNA, 852 bp, Shewanella frigidimarina NCIMB 400
  CDS (1)..(852): transl_table=11
atgaaacagtatttagacctgtgtaaacgcattgtcgatgaaggcgagtgggttaataacgcacgaacaaacaaaaagtgcctaactgtcattaatgccgacttagtttatgatgttggtaacaatcaatttcctttagtgaccacacgtaaaagcttctggaagtctgccatagccgagatcttaggatatttacgtggctaccaaaatgcggccgattttagagctttaggcactaaaacatgggacgccaatgccaatgaaaaccaagcatggctagataacccaaatcgtaaaggtcctgatgatatggggctgatatacggggcgttagggcgtgcatttccaaagcctgatggtggtcatgtcgatttactgcaacaaatcgtcgacgacctcagtaatggtatagataaccgcggtgagattttaaccttctatcatccaggagcatttgacttaggttgcttgcgaccatgtatgtacgaacaccatttttcattactcggtgatactttgtacctcaacagcacacagcgcagttgtgatgttccactagggttaaacttcaacatggtacaagtatatgtattacttgcgttaatggcccagattactggccataaacctggtaaggcataccataagatagtcaacgctcatatttacgaagaccaacttgaacccatgcgggatgtccagctcgcgcgcgaaccgtttgcatcgcctaagctaatcatcaatccaaaaattaaaaccctaaaagacatcgaaacttgggtaaccttggatgactttagcgttgaagattatcaacatcacgatgcgattaaataccctttcgcagtgtaa

SEQ ID NO: 17585 - protein, 283 aa, Shewanella frigidimarina NCIMB 400
MKQYLDLCKRIVDEGEWVNNARTNKKCLTVINADLVYDVGNNQFPLVTTRKSFWKSAIAEILGYLRGYQNAADFRALGTKTWDANANENQAWLDNPNRKGPDDMGLIYGALGRAFPKPDGGHVDLLQQIVDDLSNGIDNRGEILTFYHPGAFDLGCLRPCMYEHHFSLLGDTLYLNSTQRSCDVPLGLNFNMVQVYVLLALMAQITGHKPGKAYHKIVNAHIYEDQLEPMRDVQLAREPFASPKLIINPKIKTLKDIETWVTLDDFSVEDYQHHDAIKYPFAV

SEQ ID NO: 17586 - DNA, 1500 bp, Cryptosporidium parvum
  CDS (1)..(1500)
atgagtaaaaagaacgtttcaattgttgtggcagcttctgttttgagtagaggaataggaattaacggacaattaccttggtctatatctgaggatttgaaatttttttcaaagataactagtaataattgtgactcgaataagaagaatgcactaattatgggaagaaaaacatgggattcaattggaagaagacctcttaaaaatagaaaaatagtcgttatttcctctagcttaccacaagatgaagccgatcctaatgttattgtatttagaaaccttgaagattcaataaagaatcttatgaatgatgacacaattgagaatatttttgtctgtggtggtgaatccatatacagggatgctttaaaggataactttgtagatagaatatacttaacaagggtggcactagaagatatagaatttgacacttatttcccagaaatacctgagacattcttaccagtatatatgtctcagacattctgtactaagaatatctcttatgattttatggtttttgaaaaacaagaaaaaaaaactttgcaaaattgtgaccctgtaagaggtcaattaaagtccatagatgatactgttgatcttcttggtgaaatatttgggattagaaaaatgggaaatagacacaagtttccaaaagaagaaatctacaacactccaagtattcgattcggaagagaacattatgagtttcagtacctagaccttctttctagggtcttagagaatggagcttatagagaaaataggacaggcattagtacatattcaatatttgggcagatgatgagatttgatatgagagaatcttttccacttttgactacaaaaaaagttgcaatcaggtccatttttgaggaattaatatggtttattaagggagatactaatggaaatcatttgattgagaaaaaggtttatatttggtcaggaaatggctcgaaagaatatttggaaagaattggtttagggcatagagaggagaatgatttgggcccgatctatggttttcagtggagacattacaatggagagtacaaaacgatgcatgatgattatactggagttggagttgatcagcttgcaaaacttattgagaccttaaagaataacccaaaggatagaagacatatactaacagcctggaatccatctgctctatctcaaatggctcttccgccttgccatgtgctttctcagtactatgttaccaatgataattgtcttagttgtaacctttatcaaaggagttgtgacttgggattaggatctccatttaacattgcatcctatgccatacttaccatgatgcttgctcaagtttgtggttatgaaccaggtgagcttgctatttttattggagatgcccatatctatgaaaatcacctaacacaattaaaagaacaattaagccgcactccacgtccatttccgcaactcaaattcaagagaaaagttgaaaatattgaagatttttag

SEQ ID NO: 17587 - protein, 499 aa, Cryptosporidium parvum
MSKKNVSIVVAASVLSRGIGINGQLPWSISEDLKFFSKITSNNCDSNKKNALIMGRKTWDSIGRRPLKNRKIVVISSSLPQDEADPNVIVFRNLEDSIKNLMNDDTIENIFVCGGESIYRDALKDNFVDRIYLTRVALEDIEFDTYFPEIPETFLPVYMSQTFCTKNISYDFMVFEKQEKKTLQNCDPVRGQLKSIDDTVDLLGEIFGIRKMGNRHKFPKEEIYNTPSIRFGREHYEFQYLDLLSRVLENGAYRENRTGISTYSIFGQMMRFDMRESFPLLTTKKVAIRSIFEELIWFIKGDTNGNHLIEKKVYIWSGNGSKEYLERIGLGHREENDLGPIYGFQWRHYNGEYKTMHDDYTGVGVDQLAKLIETLKNNPKDRRHILTAWNPSALSQMALPPCHVLSQYYVTNDNCLSCNLYQRSCDLGLGSPFNIASYAILTMMLAQVCGYEPGELAIFIGDAHIYENHLTQLKEQLSRTPRPFPQLKFKRKVENIEDF

SEQ ID NO: 17588 - DNA, 879 bp, Bacteriophage beta
  CDS (1)..(879): transl_table=11
ttggcttatgcagatttagtatattcaaatgttgtaaaagaaattttggatcatggtatatgggataaagatcaagatgttagaactaaatgggcagatggtacgccagcttatacaaagagtgttatttctactcagatgaagtttgataataaggaagtaccgatcctaacacaaaaaagagtagcttggaaaaccgcaattaaagagattcttgctttttggaaagacaaagaatatcgcttcgattattttcacaaacacaatattcacatttgggatgaatgggaaataaaagatggaaaatggaagggaacaattggcccaagttatggatatcaaatgggaaaactagttcgaaaaggagaactattagacattgtccatggtgaacctacttataaaatgttagatcaagtagactacttacttgatcaacttaacacaaatccatcaagtcgaagacatattacatctttatggaacattcatgaccttgatgaaatggcactaaatccttgtgtttggaatactcaatggcttgtaaaagaaggaagtcttcatttgattgttggagtcccgagtaatgatatgggacttggcaatccattcaatgttttccagtactatgttcttcaaagaatgattgctcaagtaacaggatatgaaatcggtacattgactttcaatatcaatgatgctcatatttacgagagacatattgaacctttagaaaaacaaatcagtttgccttcatacccagctccaattttacgtatcaatccagaaattaaaaacttttatgatttcacaattgatgattttgatctcgttggttatgaacatggccctactatttctatggaagtggcaatctaa

SEQ ID NO: 17589 - protein, 292 aa, Bacteriophage beta
MAYADLVYSNVVKEILDHGIWDKDQDVRTKWADGTPAYTKSVISTQMKFDNKEVPILTQKRVAWKTAIKEILAFWKDKEYRFDYFHKHNIHIWDEWEIKDGKWKGTIGPSYGYQMGKLVRKGELLDIVHGEPTYKMLDQVDYLLDQLNTNPSSRRHITSLWNIHDLDEMALNPCVWNTQWLVKEGSLHLIVGVPSNDMGLGNPFNVFQYYVLQRMIAQVTGYEIGTLTFNINDAHIYERHIEPLEKQISLPSYPAPILRINPEIKNFYDFTIDDFDLVGYEHGPTISMEVAI

SEQ ID NO: 17590 - DNA, 1734 bp, Daucus carota
  CDS (1)..(1734)
atgtataaagccctaatttcatccacatttcctcttctaaactcactttcacaaactttggctctccgatcggcttctttgtacttgcttaccaattgcaacttatcatcatcaaacttctctcattgccatcggtttactacatatatggctagcgaacgtctcgcaaatcctactaatggaagtggcattacacgccctgatccacaaagaacttatcaggttgtggttgctgcaacccaaaatatgggtatcggtaaggatggtaaattgccctggaggttaccttctgacatgaaatttttcaaggatgtcaccatgactacatcagatcctttgaaaaggaatgcagtcataatgggtaggaaaacttgggaaagtattcccattcaacatcgccctctgccaggacgtcttaatgttgttttgactcgttctgggagttttgatattgcaactgtcgaaaatgtcgtaatatgtggtagcatgatttctgctttggaattattagcaggatctccttattgtgtttcagttgagaaggtttttgtcattgggggtggccagatatatagggaagctctcaatgctcctggatgtgatgcagtccacatcactgaaattgaagaacacatagaatgtgataccttcattcctcttctcgatgaatcagtttttcagccatggtactcatcattcccattggtggagaacaaaattcgttattgtttcacgacttatgttcgtgtgaggaattctgttgcggagctcacaagtcagaccaacggctgttcatctgatagtaaatcagattctggtaattttgaaattcagaatttctcttttcttcccaagacagtttttgagaaacatgaggagtatttgtatctgggattggttgagaatatcatttctaatggtgtgacaaagaatgataggacacgtactggtactgtctctatatttggttgccagatgcggtttaatttgcgcaaatcttttccactcctcacaactaagaaagtgttttggaggggagttgttgaggaactactgtggttcattagtggctcaactaatgctaagattctaaaagagaagggcgttaatatttgggaaggcaatggatcaagggagtatcttgacagtattggtttgacggatagagaagaaggtgacttggggcctatatatggttttcagtggagacactttggtgcaaggtatactgatatgcatgctgactactcaggccagggatttgatcagttgctagatgttatttcaaagataaaaaataatcctgatgataggaggatcattcaatcagcttggaatccatctgatctcaggctaatggcacttccaccctgtcacatgtttgcacagttctatgtagccaatggcgagttatcttgtcaaatgtatcagcgctctgctgatatgggtctcggtgttccattcaacattgcagcatatgcacttttgacatgcatgattgctcatgtttgtgacctggttcctggagactttgttcattctattggtgatgctcatgtctactcgaaccacctgtcagacctcttcgagaccagcttcagaatgttgcctaagacctttccggttttgaagatcaattctggagaaaaggacattgactcatttgaggctgctgatttcaaactcattggttatgatccgcaccagaaaatcgaaatgaaaatggcagtataa

SEQ ID NO: 17591 - protein, 577 aa, Daucus carota
MYKALISSTFPLLNSLSQTLALRSASLYLLTNCNLSSSNFSHCHRFTTYMASERLANPTNGSGITRPDPQRTYQVVVAATQNMGIGKDGKLPWRLPSDMKFFKDVTMTTSDPLKRNAVIMGRKTWESIPIQHRPLPGRLNVVLTRSGSFDIATVENVVICGSMISALELLAGSPYCVSVEKVFVIGGGQIYREALNAPGCDAVHITEIEEHIECDTFIPLLDESVFQPWYSSFPLVENKIRYCFTTYVRVRNSVAELTSQTNGCSSDSKSDSGNFEIQNFSFLPKTVFEKHEEYLYLGLVENIISNGVTKNDRTRTGTVSIFGCQMRFNLRKSFPLLTTKKVFWRGVVEELLWFISGSTNAKILKEKGVNIWEGNGSREYLDSIGLTDREEGDLGPIYGFQWRHFGARYTDMHADYSGQGFDQLLDVISKIKNNPDDRRIIQSAWNPSDLRLMALPPCHMFAQFYVANGELSCQMYQRSADMGLGVPFNIAAYALLTCMIAHVCDLVPGDFVHSIGDAHVYSNHLSDLFETSFRMLPKTFPVLKINSGEKDIDSFEAADFKLIGYDPHQKIEMKMAV

SEQ ID NO: 17592 - DNA, 972 bp, Pseudomonas fluorescens
  CDS (1)..(972): transl_table=11
atgaagcaatatcttgatctggtggcccacgtcatcaacaacggcaccaagcaggccaaccgcaccggtgtgaacaccatcagcttccccggggccatgctgcgctacgacctcaaggaaggtttcccggccatcaccacccgcaagatggccttcaagtcggccatcggcgagatggtcggcttcctgcgcggggtgaacaacgccgccgagtttcgtgcgctgggctgcaaggtctgggaccagaacgccaacgaaaacgcccagtggctggccaacccgttccgccagggcgacgacgacctgggcgagatctacggcgtgcagtggcgcaagtggccggcctacaaacagatcaagaccagcaaccaggcggccatcgacctggcgctgagccagggctaccggcagatcgccgcgggcgaggaagacggccagggctacgtggtgctgtacaaggccatcgaccaggtgcgccagtgcgtcgacaccatcatcaacgacccgggcagccggcggatcctgttccacggctggaactgcgcccagctggatgaaatggccttgccgccgtgccacctgctgtaccagttccaccccaatgtccagacccgggaaatctccctgaccctctacatccgctccaacgacctgggcctgggcacgccgttcaacctcaccgagggtgctgcgctgctgagcctgatcggccgcctgaccggctacacgccgcgctggttcacctatttcatcggtgatgcccacgtctatgaaaaccatctggacatgctcaacgaacagctcaagcgcgagccgttcccgatgcccaagctggtgatttccgagcgtgtgccggagttcgccaagaccggcgtctaccagccggagtggctggagctgatcgaaccgagcgacttctccctggaaggctatgagcaccacgcgcccatgacggcgccgatggcggtctga

SEQ ID NO: 17593 - protein, 323 aa, Pseudomonas fluorescens
MKQYLDLVAHVINNGTKQANRTGVNTISFPGAMLRYDLKEGFPAITTRKMAFKSAIGEMVGFLRGVNNAAEFRALGCKVWDQNANENAQWLANPFRQGDDDLGEIYGVQWRKWPAYKQIKTSNQAAIDLALSQGYRQIAAGEEDGQGYVVLYKAIDQVRQCVDTIINDPGSRRILFHGWNCAQLDEMALPPCHLLYQFHPNVQTREISLTLYIRSNDLGLGTPFNLTEGAALLSLIGRLTGYTPRWFTYFIGDAHVYENHLDMLNEQLKREPFPMPKLVISERVPEFAKTGVYQPEWLELIEPSDFSLEGYEHHAPMTAPMAV

SEQ ID NO: 17594 - DNA, 1569 bp, Theileria parva
  CDS (1)..(1569)
atggcggaagattactctggattacctttcgttaaattgttagtagcgataacgccagaaaatggaattggaatcagtaatggactaccatggccacacatcaaaagggactttctttttatgttcagggcaacgacttatgttgatccagaattcaaagaaaagcacccaggagctcaaaatgtaataatcattggtagaaagacatacgatagccttccagaaggaacttttccactgaagaacagaatcaacgttgttatatcaagaaatcttactgaggttccaggtggattagtatttccttcaatgccagctgcgattcgtcacgttactgaacatctcaactactataagatcttcataatgggtatttttcatctaaatataaaacatttaggaggaagctacgtctatagggatgctcttgatgcaagaattgttgataaaatgtacgttacaagggtaaacaagaattacaagtgtgaagtgttcttcccaaagatccctgatgacttcgttataactggaattagtaaaacgttctcaagtgaagacacaacatatgactttgtgacgtacgaaagaaaagatttaattgttgatgatcgcgttaaaaaaacatttgaagagatgttgttgactggagagaaatttgcaactaaggatcaattggtgaaagcttgcccatcactgaaggttagatacagccaggaacttcagtatcttgaaattctagctgacatcttaaacactggatatcacaaaaagaatagaacaggcgtggattgtattgcaaaattcggttaccaaatgaggtttgacctttcagaatcatttccgttattaacaacaaagaaagtcttcttaagaggaatcattgaggagcttatttggtttattaaaggtagcacaaacggcaatgaattgctgaaaaagaatgtaagaatctgggagctgaatggagcaagaagttttctggataacctgggattttttgatcgcgaagaacatgacctaggacctgtttacggattccaatggcgtcatttcggtgccaaatacgtagatatgcacacagactacagtaaccaaggaattgaccagctatcactggtcattgataggatcaagaataacccagataacagaagattgattgtgtgttcgtggaacgtagcagacctgtcaaagatggcattgcctccatgtcatctgctattccaattttttgtagcagatggaacattgtcgtgtatgatgcaccaaaggtcatgtgatatgggactaggagtaccatttaacattgcatcatactcattactgacctacatgatagcccaaatatgtggactaaaaccgggagaatttgtacacaaccttggagatgcccacatatacaataaccatattgacgcaatcaaggaacagattagtagagttccttatccattcccaaccctaagactaaacaaagatataacaaggattgaagacttcacaatcgatgacattaaggtggaaaattaccgttcacacccggtaatcaagatggagatggctgcataa

SEQ ID NO: 17595 - protein, 522 aa, Theileria parva
MAEDYSGLPFVKLLVAITPENGIGISNGLPWPHIKRDFLFMFRATTYVDPEFKEKHPGAQNVIIIGRKTYDSLPEGTFPLKNRINVVISRNLTEVPGGLVFPSMPAAIRHVTEHLNYYKIFIMGIFHLNIKHLGGSYVYRDALDARIVDKMYVTRVNKNYKCEVFFPKIPDDFVITGISKTFSSEDTTYDFVTYERKDLIVDDRVKKTFEEMLLTGEKFATKDQLVKACPSLKVRYSQELQYLEILADILNTGYHKKNRTGVDCIAKFGYQMRFDLSESFPLLTTKKVFLRGIIEELIWFIKGSTNGNELLKKNVRIWELNGARSFLDNLGFFDREEHDLGPVYGFQWRHFGAKYVDMHTDYSNQGIDQLSLVIDRIKNNPDNRRLIVCSWNVADLSKMALPPCHLLFQFFVADGTLSCMMHQRSCDMGLGVPFNIASYSLLTYMIAQICGLKPGEFVHNLGDAHIYNNHIDAIKEQISRVPYPFPTLRLNKDITRIEDFTIDDIKVENYRSHPVIKMEMAA

SEQ ID NO: 17596 - DNA, 1572 bp, Theileria annulata
  CDS (1)..(1572)
atgtcagaagattatagcggattaccttttgttaaaatattagtggctattactccagaaaatggaattggtatcaaaaatggattaccgtggccacacatcaagcgagactttctgtttatgttcagagcaacaacttatgttgaccctgaatttaaagaaaaacaccctggagctgaaaatgtaataatcattggtagaaatacatatgatagccttccagaatcagtatttcctcttaaaaacagaatcaacatcgttatctcgagaaatcttacagaggttcctggtggattggtattctcatcaattccatctgctattaggcatgtaacagaaaatctaaactactataaaatattcatcatgggtattttcaatgtagttgttttaaaatatttaggaggaagccatgtatatagagaagttctaaatgctaaaattgtagataaaatgtacgtcacaagagtaaataagaactatgagtgtgaagtgttctttccaaaaatacctgatgactttgtaataacaggaattagtaaaacattttctagcgaggatacaagttatgactttgtgctatacgagaggaaggatctaattgaggaaatgaaagagaaaaaaacatttgaacagatgttgttgacaggggagaaatttgcagttaaggaaccattggttaaagcatgccctagattgaaggttagatacagccaagagctccagtatcttgaaattctagcagatatcttaaataacggatatcataaaaagaatagaacaggagttgattgcattgccaaattcggataccaaatgaggttcgacctgtcacaatcatttccattattaacaacaaagaaagtcttcttaagaggaatcattgaggaacttatttggttcatcagaggcagtacaaatggtaacgagttattaaaaaagaacgtaagaatatgggagttaaatggagcgagaagttttctagataacctgggattctatgatcgtgaagaacaagatttaggacctgtttacggattccaatggcgtcattttggagccaaatacatcgatatgcacgcagattacactgatcaaggaatagaccagttatcattggtaattgaaaggatcaagaataacccagataacagaagattaattgtatgttcatggaatgtggcagacttgtcaaagatggcattaccgccatgtcatctattattccaattttttgtagctgatgggactttgtcatgtatgatgcatcagaggtcatgtgatatgggacttggagttccatttaacatagcatcatactcattattaacatacatgatcgcccacatttgcggactaaaaccgggagaatttgttcataaccttggtgatgctcacatatataataaccatattgacgcaataaaagaacaaatcagtagagtaccatatccattcccaacacttaaactaaataaagaaattacaagaattgaagactttacaattgatgacattaaggtggaaaactataggtgtcacccgttaatcaagatggagatggctgcataa

SEQ ID NO: 17597 - protein, 523 aa, Theileria annulata
MSEDYSGLPFVKILVAITPENGIGIKNGLPWPHIKRDFLFMFRATTYVDPEFKEKHPGAENVIIIGRNTYDSLPESVFPLKNRINIVISRNLTEVPGGLVFSSIPSAIRHVTENLNYYKIFIMGIFNVVVLKYLGGSHVYREVLNAKIVDKMYVTRVNKNYECEVFFPKIPDDFVITGISKTFSSEDTSYDFVLYERKDLIEEMKEKKTFEQMLLTGEKFAVKEPLVKACPRLKVRYSQELQYLEILADILNNGYHKKNRTGVDCIAKFGYQMRFDLSQSFPLLTTKKVFLRGIIEELIWFIRGSTNGNELLKKNVRIWELNGARSFLDNLGFYDREEQDLGPVYGFQWRHFGAKYIDMHADYTDQGIDQLSLVIERIKNNPDNRRLIVCSWNVADLSKMALPPCHLLFQFFVADGTLSCMMHQRSCDMGLGVPFNIASYSLLTYMIAHICGLKPGEFVHNLGDAHIYNNHIDAIKEQISRVPYPFPTLKLNKEITRIEDFTIDDIKVENYRCHPLIKMEMAA

SEQ ID NO: 17598 - DNA, 1500 bp, Plasmodium chabaudi
  CDS (1)..(1500)
atgaatactgatggaataccctccgttgataagttacaaaatattgtagtaatgggaaaagcaagttgggaaagcatcccctcaaaatttaagccattacaaaatcgaataaatattatattgtctagaacattgaaaaaagaagatcttgcaaaagaatataataatgttattataattaatagtgtggatgatttatttcctattttaaaatccataaaatattataaatgttttgttataggaggtgcatctgtttataaagaatttttagatcgtaatttaataaaaaaaatatattttacaagaataaataatgcttatacgtgtgatgttttatttccagatatcaatgaagatttatttaaaataacatcaattagtgatgtatatagtagtaataacacgactttagattttgtaatttatagtaagacaaaagaaatacctgaagaaattaatcccaacgatgaaatatttaataacgcatttttaggtgtgtgtgatgaaaaaaatacaaattttgatgatgaagatgattatacatatttcagttttaataaacataaagataatattaaaaaaaattcagagcatgctcatcattttaaaatatataatagtataaaatataaacatcatcctgaatatcaatatttaaatattatatatgatataataatgcatggaaataaacaagatgatagaacaggtgttggtgtattaagtaaatttggatatatgatgaaatttaatttaagtgaatattttccattattaacaacaaaaaaattatttgtaagaggtatcattgaagagttgctatggtttataaggggagaaacaaatggaaatacattattagaaaaaaacgtaagaatatgggaagctaatgggacaagagagtttttagataataggaaattatttcatagagaagttaatgacttaggtccaatttacggatttcaatggaggcactttggtgctgaatatacagatatgcatgctgattataaagataaaggtgttgatcagttaaaaaatattataaatttaattaaaaacgatccgacatgtagacgaattattttatgtgcatggaatgtaaaagatttagatcaaatggcattacctccttgtcatattttatgtcaattttatgtttttgatggaaaattatcatgtattatgtatcaaagatcttgtgatttaggtcttggtgttccattcaatattgcttcctattctatatttacatatatgatagcacaagtatgtaatttacaaccagctgaatttatacatgtattgggaaatgctcatgtttataataatcatgttgaaagcttaaaagtccagttaaatagaacaccctatcctttccctactcttaaattaaatccggaaattaaaaatatcgaggattttacaatttcagattttactgtacaaaattatgtccatcacgataaaatcagtatggatatggcagcttaa

SEQ ID NO: 17599 - protein, 499 aa, Plasmodium chabaudi
MNTDGIPSVDKLQNIVVMGKASWESIPSKFKPLQNRINIILSRTLKKEDLAKEYNNVIIINSVDDLFPILKSIKYYKCFVIGGASVYKEFLDRNLIKKIYFTRINNAYTCDVLFPDINEDLFKITSISDVYSSNNTTLDFVIYSKTKEIPEEINPNDEIFNNAFLGVCDEKNTNFDDEDDYTYFSFNKHKDNIKKNSEHAHHFKIYNSIKYKHHPEYQYLNIIYDIIMHGNKQDDRTGVGVLSKFGYMMKFNLSEYFPLLTTKKLFVRGIIEELLWFIRGETNGNTLLEKNVRIWEANGTREFLDNRKLFHREVNDLGPIYGFQWRHFGAEYTDMHADYKDKGVDQLKNIINLIKNDPTCRRIILCAWNVKDLDQMALPPCHILCQFYVFDGKLSCIMYQRSCDLGLGVPFNIASYSIFTYMIAQVCNLQPAEFIHVLGNAHVYNNHVESLKVQLNRTPYPFPTLKLNPEIKNIEDFTISDFTVQNYVHHDKISMDMAA

SEQ ID NO: 17600 - DNA, 942 bp, Homo sapiens
  CDS (1)..(942)
atgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcgacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttag

SEQ ID NO: 17601 - protein, 313 aa, Homo sapiens
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFDIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 17602 - DNA, 1584 bp, Trypanosoma brucei
  CDS (1)..(1584)
atgctcagtcttacgcgtatcctccgcaagaaaattcctgttcatgagttggcggggaaaatttcccgccctcccctgcgacccttctctgttgttgtagcgtcggacgagaagggtgggattggggacggtggtacgatcccctgggaaatacctgaggatatgcaatacttcagaagggtaacgacaaaccttcgggggaaaaatgtaaagccatcgccaagtaaacggaatgctgttgtgatggggcggaaaacatgggacagtcttccaccaaagttccgtccactgtctaaccgccttaatgttgtgctgtcacgaagtgcgacaaaggaacagttgttggctggtatccctgatcccatcaaacgagcggaggctgcgaatgatgtggttgctgtgaacggtgggcttgaagacgcacttcggatgttggtaagtaaggagcacacatcttctatcgaaacggtgttttgcattggtggcgggactatatataaacaagccctttgtgccccatgcgttaatgtgttgcaagctatccaccggacggtggtccgaccagcctcaaattcgtgtagcgttttctttgacatcccagccgcagggacaaagaccctggaaggacttgagttggtgcgggaaagcataacggacgaacgggtatcaaccggagctggcggaaagaaatatcagtttgagaagcttgtcccccgaaacagcgaagaggagcagtatttaaatctcgttggccgcataattgatgagggatgtacgaaatgtgaccgcacgggtgttggtacccgctccctctttggggcccagatgcgtttctctctccgcaacaatcgcctgccattactaaccacgaagcgtgtcttttggcgtggagtatgtgaagagctgttgtggtttcttcggggagaaacaaatgcaaagttgctgagcgacaaggggattcacatatgggatgggaatggctcacgagcattccttgacagtcgtggcttgactgattatgatgagatggacctcggacctgtttatggcttccagtggaggcattttggtgccgactatatttcttgcaaggaggattccgaggggaaaggtgttgatcagattgcaaacattgtgaagtcattgatagagaacccggatgaccgtcgcatgatttgtacagcttggaatccggccgccttgccacgcatggcgctcccaccatgccacatgatggcgcaattctacgtgagcaatggggaactctcatgcatgttgtaccagcggtcatgtgatatgggtcttggcgtccccttcaatattgcttcgtatgcactgcttacattcctcatggcaaaagcttctggacttcggccgggcgaattggtgcacacccttggcgatgcacatgtttacagtaaccatgtggagccgtgtcggaagcaattgaaacgcgtgccccgcccgttccctttcatcgtgttcaaacaagacaaagagttcctggaagactttcaggaaagcgatatagaggtcatcgattattctccgtaccccgtaatttctatggagatggcggtgtag

SEQ ID NO: 17603 - protein, 527 aa, Trypanosoma brucei
MLSLTRILRKKIPVHELAGKISRPPLRPFSVVVASDEKGGIGDGGTIPWEIPEDMQYFRRVTTNLRGKNVKPSPSKRNAVVMGRKTWDSLPPKFRPLSNRLNVVLSRSATKEQLLAGIPDPIKRAEAANDVVAVNGGLEDALRMLVSKEHTSSIETVFCIGGGTIYKQALCAPCVNVLQAIHRTVVRPASNSCSVFFDIPAAGTKTLEGLELVRESITDERVSTGAGGKKYQFEKLVPRNSEEEQYLNLVGRIIDEGCTKCDRTGVGTRSLFGAQMRFSLRNNRLPLLTTKRVFWRGVCEELLWFLRGETNAKLLSDKGIHIWDGNGSRAFLDSRGLTDYDEMDLGPVYGFQWRHFGADYISCKEDSEGKGVDQIANIVKSLIENPDDRRMICTAWNPAALPRMALPPCHMMAQFYVSNGELSCMLYQRSCDMGLGVPFNIASYALLTFLMAKASGLRPGELVHTLGDAHVYSNHVEPCRKQLKRVPRPFPFIVFKQDKEFLEDFQESDIEVIDYSPYPVISMEMAV

SEQ ID NO: 17604 - DNA, 852 bp, Haemophilus parasuis
  CDS (1)..(852): transl_table=11
atgaaacaatatcttgatctctgccaacgtattgtcgaacaaggaaagtgggttgaaaatgaacgtacgggtaagcgttgtttaaccgtgattaacgctgatttaatctacgacgtggcaaagggggaatttccccttgtgactacacgcaaaagtttttggaaagctgcgattgcggaattactcggttatatccgtggttatgataatgccgcagatttccgtcagcttggcacaaaatcgtgggacgcaaatgccaatgaaaatgcagcttggctggcaaacccacatcgcaaaggcgaagatgatatggggctggtttatggtgcggtcggacgaaacttcccgaaagttggcggtggtagcgtcgatttattgcgtcaaattgtcgatgatctgaaacgtggcgtagataatcgtggtgagatttatacgttctatcaccctggggctttccatttaggttgcctacgtccgtgtttacacagccaccatttttcactgttagatggcacgctttatttgaacagtatccaacgctctgccgatgtgccacttggtttaaactggaatatgatccaatgttacacttttcttgcgttaatggcacaaattacaggacaccaagcaggacaagcattccataaaattgtgaatgcgcatatttatgaagatcagctggaattaatgcgagatgtacaactaaagcgcacgccatttaaagctccaacactcaaaatcaaccccgatattaaatccctagaagatttagaaatttgggtaaccttggcggattttgaagttgagggctacgaatatcatccgagtattcagtatccgttttctgtgtag

SEQ ID NO: 17605 - protein, 283 aa, Haemophilus parasuis
MKQYLDLCQRIVEQGKWVENERTGKRCLTVINADLIYDVAKGEFPLVTTRKSFWKAAIAELLGYIRGYDNAADFRQLGTKSWDANANENAAWLANPHRKGEDDMGLVYGAVGRNFPKVGGGSVDLLRQIVDDLKRGVDNRGEIYTFYHPGAFHLGCLRPCLHSHHFSLLDGTLYLNSIQRSADVPLGLNWNMIQCYTFLALMAQITGHQAGQAFHKIVNAHIYEDQLELMRDVQLKRTPFKAPTLKINPDIKSLEDLEIWVTLADFEVEGYEYHPSIQYPFSV

SEQ ID NO: 17606 - DNA, 948 bp, Caenorhabditis briggsae
  CDS (1)..(948)
atgaataaagaaaatattgttcctgaaaccatcgaacttcctagccaggaaaaatctggaaaggaaatcgcgcaacatgtgaatcaagacgaattcaaatacttgaagcaagttgagcaaattttgcaagaaggctctcgtcgagacgatcgtaccggaacgggaaccatctcgatttttggaatgcaatcgaagtatagtttgagaaatgacacaatcccactgctgacaacgaaacgagtctactggaaaggtgttcttgaagagcttctctggttcatttctgggtccaccgatggaaaattattgatggcgaaaaatgtcaagatttgggagaagaacggtgatcgtgcgttccttgacaatttgggattcacgtctcgcgaagaaggagatctcggaccggtttacggattccaatggagacatttcggagctaaatacgtggattgtcatacggattacactggacaaggtattgatcagctagctgaagtcattcgacaaatcaaggaagaaccggacagcagaagaatcattttgtcggcgtggaatccatcggaactcgggcagatggttctaccaccatgtcatacaatgtgccagttctacgtggataacggagagttgtcttgtcagctatatcagcgaagtggagacatgggcctcggagtgccgttcaaccttgccagctatggtcttctgacccatatgattgctaaggtgtgtggattgaaagctggaactcttgtgcacactctcggcgacgcccatgtctactcgaatcatgtggatgcattgaagactcaaatggaacgagaaccgtatgcattcccgaaaattcgattcacacgagacgtcagctcgatcgacgatttcacttctgacatgattgttctcgaggactacaagtgccacggaaagattgtcatggatatggctgtttaa

SEQ ID NO: 17607 - protein, 315 aa, Caenorhabditis briggsae
MNKENIVPETIELPSQEKSGKEIAQHVNQDEFKYLKQVEQILQEGSRRDDRTGTGTISIFGMQSKYSLRNDTIPLLTTKRVYWKGVLEELLWFISGSTDGKLLMAKNVKIWEKNGDRAFLDNLGFTSREEGDLGPVYGFQWRHFGAKYVDCHTDYTGQGIDQLAEVIRQIKEEPDSRRIILSAWNPSELGQMVLPPCHTMCQFYVDNGELSCQLYQRSGDMGLGVPFNLASYGLLTHMIAKVCGLKAGTLVHTLGDAHVYSNHVDALKTQMEREPYAFPKIRFTRDVSSIDDFTSDMIVLEDYKCHGKIVMDMAV

SEQ ID NO: 17608 - DNA, 957 bp, Brachydanio rerio
  CDS (1)..(957)
atgcccgacacggcagtggaagtgacaaatggacattgcgttaacggagaaagcaagaaagaaacaaacggagggaaaaaggagttttctctgttttgcgacgagcgcgggtatttgagtctggtggagtttattttgcagaatggagcaaagaaaggcgacaggacaggcacaggagtgatctctgtgttcgggacacaagccagatacagtctcagagatcagtttccgttgctgacgaccaaaagagttttctggaaaggcatattggaggagctgctgtggttcatcaagggttcaacaaacgccaaagatctgtcggagaagggtgtgaggatttgggatgctaacggctccagagagtttctggataagaacggattcaccgatcgggaggaaggagatctgggtccagtttatggatttcagtggaggcattttggagccgaatacaaagatatgcatactgattattctggagaaggagtcgatcagttacagaaagttattgacaccatcaagtcaaacccagaggaccgaaggatcatcatgtgtgcctggaatcctaaagatctccctctgatggcgctgccgccctgtcatgcgttgtgtcagttttacgtgtcgaacggtgagttgtcatgtcagctgtaccagcgatcgggagacatcggtctcggtgtcccattcaacatcgccagctacgccctgctgacctacatgatcgcccacatcactggactcaagcctggggatttcgttcatacattaggtgacgcccacatctacaccaatcacatcgagcctttaaaagagcagattcagcgagagccgcgtccgttccccaaactccggattaaacgcaaagttgaacaaattaatgatttctgtgctgaagattttgagatctatgattataacccacatcctacaatcaaaatgcaaatggctgtttag

SEQ ID NO: 17609 - protein, 318 aa, Brachydanio rerio
MPDTAVEVTNGHCVNGESKKETNGGKKEFSLFCDERGYLSLVEFILQNGAKKGDRTGTGVISVFGTQARYSLRDQFPLLTTKRVFWKGILEELLWFIKGSTNAKDLSEKGVRIWDANGSREFLDKNGFTDREEGDLGPVYGFQWRHFGAEYKDMHTDYSGEGVDQLQKVIDTIKSNPEDRRIIMCAWNPKDLPLMALPPCHALCQFYVSNGELSCQLYQRSGDIGLGVPFNIASYALLTYMIAHITGLKPGDFVHTLGDAHIYTNHIEPLKEQIQREPRPFPKLRIKRKVEQINDFCAEDFEIYDYNPHPTIKMQMAV

SEQ ID NO: 17610 - DNA, 861 bp, Bacteriophage T6
  CDS (1)..(861): transl_table=11
atgaaacaataccaagatttaattaaagacatttttgaaaatggctacgaaaccgatgaccgaacaggcacaggaacaattgctttgttcggtactaaattacgttgggatttaactaaaggttttcctgcggtaacaactaagaagctcgcctggaaagcttgcattgctgagctaatatggtttttatcaggaagcacaaatgtcaatgatttacgattaattcagcatgattcgttaatccaaggcaaaacagtctgggatgaaaattacgaaaatcaagcaaaagatttaggataccatagcggtgaacttggtccaatttatggaaaacaatggcgcgattttggcggtgtagaccaaattatagaagttgttgatcgtattaaaaaattgccaaatgataggcgtcaaattgtttctgcatggaatccagctgaacttaaatatatggcattaccgccttgtcatatgttctatcagtttaatgtgcgtaacggctatttggatttgcagtggtatcaacgatcagtagatgttttcttgggtctaccatttaatattgcatcatacgctgcgttagttcatattgcagctaagatgtgtaatcttattccaggagatttgatattttctggtggtaatactcatatctatatgaatcacgtagaacaatgtaaagaaattttacgtcgtgaacctatggatttatgcgaattacaattaaaatttccagatgaatttgatgaatggaacacagaatcgcaggtattttggttgagtcaattcgcaaagccgcataattttgttcttaacaactatgtatctcacccgccaattaaaggaaagatggcggtgtaa

SEQ ID NO: 17611 - protein, 286 aa, Bacteriophage T6
MKQYQDLIKDIFENGYETDDRTGTGTIALFGTKLRWDLTKGFPAVTTKKLAWKACIAELIWFLSGSTNVNDLRLIQHDSLIQGKTVWDENYENQAKDLGYHSGELGPIYGKQWRDFGGVDQIIEVVDRIKKLPNDRRQIVSAWNPAELKYMALPPCHMFYQFNVRNGYLDLQWYQRSVDVFLGLPFNIASYAALVHIAAKMCNLIPGDLIFSGGNTHIYMNHVEQCKEILRREPMDLCELQLKFPDEFDEWNTESQVFWLSQFAKPHNFVLNNYVSHPPIKGKMAV

SEQ ID NO: 17612 - DNA, 861 bp, Bacteriophage U5
  CDS (1)..(861): transl_table=11
atgaaacaataccaagatttaattaaagacatttttgaaaatggctacgaaaccgatgaccgaacaggcacaggaacaattgctttgttcggtactaaattgcgttgggatttaaccaaaggttttcctgcagtaacaactaaaaagctcgcctggaatgcatgcattgctgagcttctatggtttatttccggttctaccaatgttaatgatttacgtcttcgcactcatggtagtcttattcaaggtaaaactatttgggacgataactatgaaaaccaggctaaagacctaggatatcatagtggtgaacttggtcctatatacggtaaacaatggcgtgatttcggtggtgtggatcaattagttgaaactattgatcgtattaaaaaattaccaactgatcgacgtcaaatcgtttcagcatggaatccagctgaaatcaatcaaatggcattaccgccctgtcatatgttctatcagtttaatgtgcgtaatggttatcttgatttacaatggtatcaacgctcagtagatgttttcttgggtcttccattcaacattgcctcgtacgctgccttgacacatattgtggctaagatgtgtaatcttatcccaggagatttgatattttctggtggtaatactcacatctatatgaatcatactgcgcaatgtaaagaaattttacgtcgtgagcctaaagaactgtgtgaacttaaaattgattggcctatagagtttggaaattgtgacaccgaaacacagctttactggttaactgaatacatgaaaccgaaagattttatccttgaaaattatgaatcgcatccagcaattaaagggaaaatggcaatatga

SEQ ID NO: 17613 - protein, 286 aa, Bacteriophage U5
MKQYQDLIKDIFENGYETDDRTGTGTIALFGTKLRWDLTKGFPAVTTKKLAWNACIAELLWFISGSTNVNDLRLRTHGSLIQGKTIWDDNYENQAKDLGYHSGELGPIYGKQWRDFGGVDQLVETIDRIKKLPTDRRQIVSAWNPAEINQMALPPCHMFYQFNVRNGYLDLQWYQRSVDVFLGLPFNIASYAALTHIVAKMCNLIPGDLIFSGGNTHIYMNHTAQCKEILRREPKELCELKIDWPIEFGNCDTETQLYWLTEYMKPKDFILENYESHPAIKGKMAI

SEQ ID NO: 17614 - DNA, 861 bp, Bacteriophage RB3
  CDS (1)..(861): transl_table=11
atgaaacaataccaagatttaattaaagacatttttgaaaatggctatgaaaccgatgaccgaacgggcacaggaacaattgctttgttcggtactaaattacgctgggatttaagtaaaggttttcctgcagtaacaactaaaaagctcgcttggaaagcttgcattgctgagctactttggttcttatcaggaagtactaacgtaaatgatttacgattaattcagcatgattcgttaatccaaggcaaaacagtctgggatgaaaattacgaaaatcaagcaaaagatttaggataccatagcggtgaacttggtccaatttatggaaaacaatggcgtgattttggcggtgtagaccaaattgtagaagttattgatcgtattaaaaaactgccgaatgataggcgacaaattgtttctgcgtggaatccagctgaacttaaatatatggcattaccgccttgtcatatgttctatcagtttaatgtgcgtaatggctatttggatttgcagtggtatcaacgatcagtagatgttttcttgggtctaccatttaatattgcatcatatgctacgttagttcatattgtagctaagatgtgtaatcttattcctggagatttgatattttctggcggtaatactcatatctatatgaatcacgtagaacaatgtaaagaaattttgcgtcgtgaacctaaagagctttgtgaactggtaataggcggattgccttataaattccgctatctttctactaaagaacaattggaatacattcttaaactcaggcctaaagatttcgttctcaaagattatcagtcccacggtgtcttgaaaggaaaaatggcggtataa

SEQ ID NO: 17615 - protein, 286 aa, Bacteriophage RB3
MKQYQDLIKDIFENGYETDDRTGTGTIALFGTKLRWDLSKGFPAVTTKKLAWKACIAELLWFLSGSTNVNDLRLIQHDSLIQGKTVWDENYENQAKDLGYHSGELGPIYGKQWRDFGGVDQIVEVIDRIKKLPNDRRQIVSAWNPAELKYMALPPCHMFYQFNVRNGYLDLQWYQRSVDVFLGLPFNIASYATLVHIVAKMCNLIPGDLIFSGGNTHIYMNHVEQCKEILRREPKELCELVIGGLPYKFRYLSTKEQLEYILKLRPKDFVLKDYQSHGVLKGKMAV

SEQ ID NO: 17616 - DNA, 861 bp, Bacteriophage RB27
  CDS (1)..(861): transl_table=11
atgaaacaataccaagatttaattaaagacatttttgaaaatggctatgaaaccgatgaccgaacaggcacaggaacaattgctttgttcggtactaaattgcgctgggatttaactaaaggttttcctgcggtaacaactaagaagctcgcctggaaagcttgcattgctgagctgctttggtttttatcaggaagcacaaatgtcaatgatttacgattaattcaacatgattcattaattcaaggcaaaacagtctgggatgaaaattacgaaaatcaagcaaaagatttaggataccatagcggtgaacttggtccaatttatggaaaacagtggcgtgattttggcggtgtagaccaaattatagaagttgttgatcgtattaaaaaactgccaaatgataggcgtcaaattgtttctgcgtggaatccagctgaacttaaatatatggcattaccgccttgtcatgtgttctatcagtttaatgtgcgtaatggctatttagatttgcagtggtatcaacgatcagtagatgtttttctcggccttccatttaatattgcatcatatgctgcgttagttcatattgtagctaagatgtgtaatcttattcctggagatttgatattttctggcggtaatactcatatctatatgaatcacgtagaacaatgtaaagaaattttacgtcgtgaacctaaagagctttgtgaactggtaataggcggattgccttataaattccgctatctttctactaaagaacaattggaatacattcttaaactcaggcctaaagatttcgttctcaaagattatcagtcccacggtgtcttgaaaggaaaaatggcggtataa

SEQ ID NO: 17617 - protein, 286 aa, Bacteriophage RB27
MKQYQDLIKDIFENGYETDDRTGTGTIALFGTKLRWDLTKGFPAVTTKKLAWKACIAELLWFLSGSTNVNDLRLIQHDSLIQGKTVWDENYENQAKDLGYHSGELGPIYGKQWRDFGGVDQIIEVVDRIKKLPNDRRQIVSAWNPAELKYMALPPCHVFYQFNVRNGYLDLQWYQRSVDVFLGLPFNIASYAALVHIVAKMCNLIPGDLIFSGGNTHIYMNHVEQCKEILRREPKELCELVIGGLPYKFRYLSTKEQLEYILKLRPKDFVLKDYQSHGVLKGKMAV

SEQ ID NO: 17618 - DNA, 861 bp, Bacteriophage RB23
  CDS (1)..(861): transl_table=11
atgaaacaataccaatttttaattaaagatatcctggaaaatggctacgaaaccgatgaccgaacaggcacaggaacaattgctttgttcggtactaaattacgctgggatttaactaaaggttttcctgcagtaacaactaagaagctcgcctggaaagcttgcattgctgagctaatatggtttttatcgggaagcacaaatgtcaatgatttgcgattaattcaacatgattcgttaatccaaggcaaaacagtttgggatgaaaattacgaaaatcaagcaaaagatttaggataccatagcggtgaacttggtccaatttatggaaaacagtggcgtgattttggtggtgtagaccaaattatagaagttattgatcgtattaaaaaactgccaaatgataggcgtcaaattgtttcagcatggaatccagctgaactcaagcagatggcattaccaccttgtcatatgttctatcaatttaatgttcgtaatggataccttgaccttcagtggtatcaacgatcagtagatgttttcctcggtcttccatttaatattgcatcatatgctgcgttagttcatattgtagctaagatatgtaatcttattccgggagatttgatattttctggcggtaatactcatatctatatgaatcacgtagaacaatgtaaagaaattttgcgtcgtgaacctatggatttatgcgaattacaattaaaattcccagatgaatttgatgaatgggacacagaatcacaggtattttggttgagtcaattcgcaaagccgcataattttgttcttaacgactatgtatctcacccgccaattaaaggaaagatggcggtataa

SEQ ID NO: 17619 - protein, 286 aa, Bacteriophage RB23
MKQYQFLIKDILENGYETDDRTGTGTIALFGTKLRWDLTKGFPAVTTKKLAWKACIAELIWFLSGSTNVNDLRLIQHDSLIQGKTVWDENYENQAKDLGYHSGELGPIYGKQWRDFGGVDQIIEVIDRIKKLPNDRRQIVSAWNPAELKQMALPPCHMFYQFNVRNGYLDLQWYQRSVDVFLGLPFNIASYAALVHIVAKICNLIPGDLIFSGGNTHIYMNHVEQCKEILRREPMDLCELQLKFPDEFDEWDTESQVFWLSQFAKPHNFVLNDYVSHPPIKGKMAV

SEQ ID NO: 17620 - DNA, 861 bp, Bacteriophage RB61
  CDS (1)..(861): transl_table=11
atgaaacaataccaagatttaattaaagacatttttgaaaatggctatgaaaccgatgaccgaacgggcacaggaacaattgctttgttcggtactaaattgcgttgggatttaaccaaaggttttcctgcagtaacaactaaaaagctcgcctggaatgcatgcattgctgagctaatatggtttttatcaggaagcacaaatgtcaatgatttgcgattaattcaacatgattcattaattcaaggcaaaacagtctgggatgaaaattacgaaaatcaagcaaaagatttaggataccatagcggtgaacttggtccaatttatggaaaacagtggcgtgattttggcggtgtagatcaaattatagaagttattgatcgtattaaaaaactgccaaatgataggcgtcaaattgtttctgcgtggaatccagctgaacttaaatatatggcattaccgccttgtcatatgttctatcagtttaatgtgcgtaatggataccttgaccttcagtggtatcaacgttcggtagatgttttcctcggtcttccatttaatattgcatcatatgctacgttagttcatattgtagctaagatgtgtaatcttattccgggagatttgatattttctggtggtaatactcatatctatatgaatcacgtagaacaatgtaaagaaattttatgtcgtgaacctatggatttatgcgaattacaattaaaatttccagatgaatttgatgaatgggacacagaatcgcaggtattttggttgagtcaatttgcaaagcctcataattttgttcttaacaactatgaatcacatcctcctattaaaggaaagatggcggtgtaa

SEQ ID NO: 17621 - protein, 286 aa, Bacteriophage RB61
MKQYQDLIKDIFENGYETDDRTGTGTIALFGTKLRWDLTKGFPAVTTKKLAWNACIAELIWFLSGSTNVNDLRLIQHDSLIQGKTVWDENYENQAKDLGYHSGELGPIYGKQWRDFGGVDQIIEVIDRIKKLPNDRRQIVSAWNPAELKYMALPPCHMFYQFNVRNGYLDLQWYQRSVDVFLGLPFNIASYATLVHIVAKMCNLIPGDLIFSGGNTHIYMNHVEQCKEILCREPMDLCELQLKFPDEFDEWDTESQVFWLSQFAKPHNFVLNNYESHPPIKGKMAV

SEQ ID NO: 17622 - DNA, 861 bp, Bacteriophage LZ2
  CDS (1)..(861): transl_table=11
atgaaacaataccaagatttaattaaagacatttttgaaaatggctatgaaaccgatgaccgaacgggcacaggaacaattgctttgttcggtactaaattgcgttgggatttaaccaaaggttttcctgcagtaacaactaaaaagctcgcttggaaagcttgcattgctgagctactttggttcttatcaggaagtactaacgtaaatgatttacgattaattcagcatgattcgttaatccaaggcaaaacagtctgggatgaaaattacgaaaatcaagcaaaagatttaggataccatagcggtgaacttggtccaatttatggaaaacaatggcgtgattttggcggtgtagaccaaattatagaagttattgatcgtattaaaaaattgccaaatgataggcgtcaaattgtttctgcatggaatccagctgaacttaaatatatggcattaccgccttgtcatatgttttatcagtttaatgtgcgtaatggataccttgaccttcagtggtatcaacgatcagtagatgttttcttgggtctaccatttaatattgcatcatatgctgcgttagttcatattgtagctaagatgtgtaatcttattcctggagatttgatattttctggcggtaatactcacatctatatgaatcacgtagaacaatgtaaagaaattttacgtcgtgaacctaaagagctttgtgaactggtaataggcggattgccttataaattccgttatctttctactaaagaacaattggaatacattcttaaactcaggcctaaagatttcgttctcaaagattatcagtcccacggtgtcttgaaaggaaaaatggcggtataa

SEQ ID NO: 17623 - protein, 286 aa, Bacteriophage LZ2
MKQYQDLIKDIFENGYETDDRTGTGTIALFGTKLRWDLTKGFPAVTTKKLAWKACIAELLWFLSGSTNVNDLRLIQHDSLIQGKTVWDENYENQAKDLGYHSGELGPIYGKQWRDFGGVDQIIEVIDRIKKLPNDRRQIVSAWNPAELKYMALPPCHMFYQFNVRNGYLDLQWYQRSVDVFLGLPFNIASYAALVHIVAKMCNLIPGDLIFSGGNTHIYMNHVEQCKEILRREPKELCELVIGGLPYKFRYLSTKEQLEYILKLRPKDFVLKDYQSHGVLKGKMAV

SEQ ID NO: 17624 - DNA, 861 bp, Bacteriophage RB14
  CDS (1)..(861): transl_table=11
atgaaacaataccaagatttaattaaagacatttttgaaaatggctatgaaaccgatgaccgaacaggcacaggaacaattgctttgttcggtactaaattacgttgggatttaactaaaggttttcctgcagtaacaactaagaagctcgcctggaatgcatgcattgctgagcttctatggtttatttccggttctaccaatgttaatgatttacgtcttcgcacacatggtagtcttattcaaggtaaaactatttgggacgataactatgaaaaccaggctaaagacctaggatatcatagtggtgaacttggtcctatatacggtaaacaatggcgtgatttcggcggtgtggatcaattagttgaaactattgatcgtattaaaaaattaccaactgatcgacgtcaaatcgtttcagcatggaatccagctgaaatcaatcaaatggcattaccgccctgtcatatgttctatcagtttaatgtgcgtaatggttatcttgatttacaatggtaccaaagaagtgtagatgttttcttgggattgccattcaacattgcctcgtacgctgccttgacgcatattgtggctaagatgtgtaatcttatcccaggagatttgatattttctggtggtaatactcacatctatatgaatcatactgagcaatgtaaagaaattttacgtcgtgagcctaaagaactatgtgaacttaaaattgattggcctatagagtttggaaattgtgacaccgaaacacagctttactggttaactgaatacatgaaaccgaaagattttatccttgaaaattatgaatcgcatccagcaattaaagggaaaatggcaatatga

SEQ ID NO: 17625 - protein, 286 aa, Bacteriophage RB14
MKQYQDLIKDIFENGYETDDRTGTGTIALFGTKLRWDLTKGFPAVTTKKLAWNACIAELLWFISGSTNVNDLRLRTHGSLIQGKTIWDDNYENQAKDLGYHSGELGPIYGKQWRDFGGVDQLVETIDRIKKLPTDRRQIVSAWNPAEINQMALPPCHMFYQFNVRNGYLDLQWYQRSVDVFLGLPFNIASYAALTHIVAKMCNLIPGDLIFSGGNTHIYMNHTEQCKEILRREPKELCELKIDWPIEFGNCDTETQLYWLTEYMKPKDFILENYESHPAIKGKMAI

SEQ ID NO: 17626 - DNA, 861 bp, Bacteriophage RB32
  CDS (1)..(861): transl_table=11
atgaaacaataccaagatttaattaaagacatttttgaaaatggctacgaaactgatgaccgaacaggcacaggaacaattgctttgttcggtactaaattgcgttgggatttaaccaaaggttttcctgcagtaacaactaaaaagctcgcctggaaagcttgcattgctgagttaatatggtttttatcaggaagcacaaatgtcaatgatttacgattaattcagcatgattcattaattcaaggcaaaacagtctgggatgaaaattacgaaaatcaagcaaaagatttaggataccatagcggtgaacttggtccaatttatggaaaacaatggcgtgattttggcggtgtagaccaaattgtagaagttattgatcgtattaaaaaactgccgaatgataggcgacaaattgtttctgcgtggaatccagctgaacttaaatatatggcattaccgccttgtcatatgttctatcaatttaatgtgcgtaatggctatttggatttacagtggtatcaaagaagtgttgacgtgttcttgggcttgccattcaacattgcatcatatgctacgttagttcatattgtagctaagatgtgtaatcttattccgggagatttgatattttccggtggtaatactcatatctatatgaatcacgtagaacaatgtaaagaaattttacgtcgtgaacctatggatttatgcgaattgcaattaaaatttccagatgaatttgatgaatgggacacagaatcgcaggtattttggttgagtcaattcgtaaagccgcataattttgttcttaacaactatgaatcacacccttctattaaaggaaagatggcggtgtaa

SEQ ID NO: 17627 - protein, 286 aa, Bacteriophage RB32
MKQYQDLIKDIFENGYETDDRTGTGTIALFGTKLRWDLTKGFPAVTTKKLAWKACIAELIWFLSGSTNVNDLRLIQHDSLIQGKTVWDENYENQAKDLGYHSGELGPIYGKQWRDFGGVDQIVEVIDRIKKLPNDRRQIVSAWNPAELKYMALPPCHMFYQFNVRNGYLDLQWYQRSVDVFLGLPFNIASYATLVHIVAKMCNLIPGDLIFSGGNTHIYMNHVEQCKEILRREPMDLCELQLKFPDEFDEWDTESQVFWLSQFVKPHNFVLNNYESHPSIKGKMAV

SEQ ID NO: 17628 - DNA, 840 bp, Lactococcus lactis
  CDS (1)..(840): transl_table=11
atgacttacgcagatcaagtttttaaacaaaatatccaaaatatcctagataatggtgttttttcagaaaatgcaagaccaaagtataaggatggtcaaatggcgaatagcaaatatgtcactggttcattcgttacttatgatttgcaaaagggggagtttccaattaccactttgcgtccaattccaatcaaatctgctattaaagaattgatgtggatataccaagaccaaacaagtgaactttctgttctcgaagagaagtatggagtcaaatactggggagaatggggaattggtgatggtacgattgggcaacgttatggtgcaacagtcaaaaaatataatatcattggtaaattattagaaggcttggccaaaaatccatggaatcgtcgtaatatcatcaacctttggcagtatgaagattttgaggaaacagaaggtcttttaccatgtgctttccaaacgatgtttgatgtccgtcgagaaaaagatggtcagatttatttggatgccacactgattcaacgttcaaacgatatgcttgtagcccaccatatcaatgcgatgcaatatgttgctttgcaaatgatgattgcaaaacatttttcttggaaagttgggaaattcttttattttgtaaataatttacatatttatgataatcagtttgagcaggcaaatgaattaatgaagcgaacagcttctgaaaaagaacctcgtttggtccttaatgttcctgatggtacaaactttttcgatattaaacctgaagattttgaacttgtggactatgagccagtaaaacctcaattgaaatttgatttagcaatttaa

SEQ ID NO: 17629 - protein, 279 aa, Lactococcus lactis
MTYADQVFKQNIQNILDNGVFSENARPKYKDGQMANSKYVTGSFVTYDLQKGEFPITTLRPIPIKSAIKELMWIYQDQTSELSVLEEKYGVKYWGEWGIGDGTIGQRYGATVKKYNIIGKLLEGLAKNPWNRRNIINLWQYEDFEETEGLLPCAFQTMFDVRREKDGQIYLDATLIQRSNDMLVAHHINAMQYVALQMMIAKHFSWKVGKFFYFVNNLHIYDNQFEQANELMKRTASEKEPRLVLNVPDGTNFFDIKPEDFELVDYEPVKPQLKFDLAI

SEQ ID NO: 17630 - DNA, 1767 bp, Plasmodium yoelii yoelii
  CDS (1)..(1767)
atggaagatttatcggaaatattcgatatatatgcaatttgtgcatgttgtaaagttataaacaataatgaaaagagtggaagctttaacaataaaacatttaatggacttggaaatgcagggatgttgccttggaaatataatttagttgatatgaattattttagttctgtaacatcgtatgtaaatgaaaataactatataagattgcaatggaagagagataaatatatggggaaaaataatttaaaaaataatgcagaactgaataatggcgagctgaataataatctgcaaaatgttgtagtgatgggaaaaagaagttgggatagtatcccccccaaatttaaacccttacaaaatcgaataaacataattttgtctagaactttgaaaaaagaagatattgcaaatgaggataacaaaaataatgagaacggcaccgttatgataattaaaagcgtagacgatttgtttcctatcttaaaagctataaaatattacaaatgttttattataggggggtcatatgtttataaagaatttttagatcgtaatttaataaaaaaaatatattttacaagaataaataattcatataattgtgatgttttattcccagaaataaacgaaaatttatttaagatatcatcaataagtgatgtatataatagtaataacacaactttagattttataatttatagtaaaaagacagaaaaaataaattcaaataaggaaatatctaatgatatatttttaggtttatgtgatgaacaaaataaaaattttgatgatgaagatgattatacatacttcagtttcaataaaaataaagaaaatataaaaaaaaattctgaacatgttcataattttaaaatatataatagcataaaatataaaaatcatcctgaatatcaatatttaaatattatatatgatataataatgcatggaaataaacaagatgatagaacaggtgttggtgtgttaagtaaatttggatatatgatgaaatttaatttaaatcaatattttccattattaacaacaaaaaaattatttgtgcgaggtattattgaagaattattatggtttataagaggagaaacaaatggaaatacattgttagaaaaaaatgtaagaatatgggaagctaatggaacaagagaatttttagataatagaaaattatttcatagagaagttaatgatcttggtcctatttatggattccaatggagacattttggtgctgaatatacagatatgcatgataattataaagataaaggtgttgatcaactaaaaaatattataaatttaattaaaaatgatcctacatgtagacgaattattttatgtgcatggaatgtaaaagatttagataaaatggcattacctccatgtcatattttatgtcaattttatgtttttgatggaaaattatcatgtattatgtatcaaagatcttgtgatttaggactaggagttccatttaacattgcttcttattctatatttacatatatgatagcacaagtatgtaacttacaaccagctgaatttatacatgtattgggtaatgctcatgtttataataatcatattgaaagcttaaaaattcagttaaatagaactccttatcctttccctactcttaaattaaatcctgatattaaaaatatcgaagattttacaatttctgattttactgtgcaaaattatgttcatcatgataaaataagtatggatatggcagcttaa

SEQ ID NO: 17631 - protein, 588 aa, Plasmodium yoelii yoelii
MEDLSEIFDIYAICACCKVINNNEKSGSFNNKTFNGLGNAGMLPWKYNLVDMNYFSSVTSYVNENNYIRLQWKRDKYMGKNNLKNNAELNNGELNNNLQNVVVMGKRSWDSIPPKFKPLQNRINIILSRTLKKEDIANEDNKNNENGTVMIIKSVDDLFPILKAIKYYKCFIIGGSYVYKEFLDRNLIKKIYFTRINNSYNCDVLFPEINENLFKISSISDVYNSNNTTLDFIIYSKKTEKINSNKEISNDIFLGLCDEQNKNFDDEDDYTYFSFNKNKENIKKNSEHVHNFKIYNSIKYKNHPEYQYLNIIYDIIMHGNKQDDRTGVGVLSKFGYMMKFNLNQYFPLLTTKKLFVRGIIEELLWFIRGETNGNTLLEKNVRIWEANGTREFLDNRKLFHREVNDLGPIYGFQWRHFGAEYTDMHDNYKDKGVDQLKNIINLIKNDPTCRRIILCAWNVKDLDKMALPPCHILCQFYVFDGKLSCIMYQRSCDLGLGVPFNIASYSIFTYMIAQVCNLQPAEFIHVLGNAHVYNNHIESLKIQLNRTPYPFPTLKLNPDIKNIEDFTISDFTVQNYVHHDKISMDMAA

SEQ ID NO: 17632 - DNA, 861 bp, Bacteriophage T2
  CDS (1)..(861): transl_table=11
atgaaacaataccaagatttaattaaagacatttttgaaaatggctatgaaaccgatgatcgaacaggcacaggaacaattgctttgttcggtactaaattacgctgggatttaagtaaaggttttcctgcagtaacaactaaaaagctcgcctggaaagcttgcattgctgagctactttggtttttatcaggaagcacaaatgtcaatgatttacgattaattcagcatgattcattaattcaaggcaaaacagtctgggatgaaaattacgaaaatcaagcaaaagatttaggataccatagcggtgaacttggtccaatttatggaaaacagtggcgtgattttggcggtgtagaccaaattgtagaagttattgatcgtattaaaaaactgccgaatgataggcgacaaattgtttctgcgtggaatccagctgaacttaaatatatggcattaccgccttgtcatatgttctatcagtttaatgtgcgtaatggctatttggatttgcagtggtatcaacgatcagtagatgtttttcttggtcttccatttaatattgcatcatatgctgcgttagttcatattgtagctaagatgtgtaatcttattcctggagatttgatattttctggcggtaatactcatatctatatgaatcacgtagaacaatgtaaagaaattttgcgtcgtgaacctaaagagctttgtgagctggtaataagtggtctaccttataaattccgatatctttctactaaagaacaattaaaatatgttcttaaacttaggcctaaagatttcgttcttaacaactatgtatctcacccgccaattaaaggaaagatggcggtataa

SEQ ID NO: 17633 - protein, 286 aa, Bacteriophage T2
MKQYQDLIKDIFENGYETDDRTGTGTIALFGTKLRWDLSKGFPAVTTKKLAWKACIAELLWFLSGSTNVNDLRLIQHDSLIQGKTVWDENYENQAKDLGYHSGELGPIYGKQWRDFGGVDQIVEVIDRIKKLPNDRRQIVSAWNPAELKYMALPPCHMFYQFNVRNGYLDLQWYQRSVDVFLGLPFNIASYAALVHIVAKMCNLIPGDLIFSGGNTHIYMNHVEQCKEILRREPKELCELVISGLPYKFRYLSTKEQLKYVLKLRPKDFVLNNYVSHPPIKGKMAV

SEQ ID NO: 17634 - DNA, 1536 bp, Babesia bovis
  CDS (1)..(1536)
atgtctactgtctacgaagggtgtggtggtcttacgatttacgtagccattgccctgaatagggtgattggtcatcagaaccaaattccctggccgcatattattcatgattttcgttttttgcgcaatggcacaacttacattccacctgaggtcttatccaagaatcccaatatacagaatgttgtgattttcggtaggaagacttacgaaagtatccctaaagcttcgctccctcttaaaaaccgtataaacgtgatcatctctcgtactgtcaaggaagttcccggttgtttggtgtatgaggacctttctactgccattcgtgatttgcgtgcaaatgtccctcataacaagatttttatcttaggtggttcttatctttacaaggaggtgcttgacaatggtttgtgtgataagatatatttgactcgcattaacaaggagtaccctggtgacacatttttccctgacattccggatacttttgagataactgccattagtcctacgttttccactgactttgttagttatgattttgtgatttacgagcgtaaggattgcaagactgttttccccgatcctccttttgatcaattattgttgaagggtgttgacattattgttcccaaaccaaagtacgttgcttgtcctggtgtcaggatacgcaatcatgaagagttccaataccttgacatattggcagatgtgctaagtcacggtgtcttgaagcccaaccgtactggtactgatgcctattctaagtttggctatcagatgcgttttgatctttcgcgttcattcccgttactgactaccaagaaggtagcgttgcgctccataattgaggaactgctttggtttatcaagggtagcaccaacggcaacgacctactggctaagaatgtgcgcatttgggagcttaacggccgtcgtgaattccttgacaagaatggctttacagagcgtgaagagcatgatttaggtcctatatatggtttccaatggcgtcactttggtgctgagtacttggatatgcacgctgattacactggtaagggtattgaccagcttgctgagatcatcaaccgcattaaaacgaatccaaacgaccgtaggatgattgtctgttcttggaatgtttcagacctaaagaagatggctttgcctccttgtcattgtttcttccaattttatgtcagtgacaacaagctttcttgcatgatgcatcagcgttcttgtgaccttggtttgggtgtacctttcaacattgcttcttatagtattcttactgctatggtagctcaggtttgcggcttgggtttaggggagtttgtccacaatttggcggatgctcacatttatgttgaccatgtggacgctgttactactcagattgctcgcattccttatccatttcctcgtttgcgtttgaaccctgatattaagaacattgaggactttactattgacgacattgtagttgaggattacgtgtcgcatcctgccatacccatggccatgtccgcatga

SEQ ID NO: 17635 - protein, 511 aa, Babesia bovis
MSTVYEGCGGLTIYVAIALNRVIGHQNQIPWPHIIHDFRFLRNGTTYIPPEVLSKNPNIQNVVIFGRKTYESIPKASLPLKNRINVIISRTVKEVPGCLVYEDLSTAIRDLRANVPHNKIFILGGSYLYKEVLDNGLCDKIYLTRINKEYPGDTFFPDIPDTFEITAISPTFSTDFVSYDFVIYERKDCKTVFPDPPFDQLLLKGVDIIVPKPKYVACPGVRIRNHEEFQYLDILADVLSHGVLKPNRTGTDAYSKFGYQMRFDLSRSFPLLTTKKVALRSIIEELLWFIKGSTNGNDLLAKNVRIWELNGRREFLDKNGFTEREEHDLGPIYGFQWRHFGAEYLDMHADYTGKGIDQLAEIINRIKTNPNDRRMIVCSWNVSDLKKMALPPCHCFFQFYVSDNKLSCMMHQRSCDLGLGVPFNIASYSILTAMVAQVCGLGLGEFVHNLADAHIYVDHVDAVTTQIARIPYPFPRLRLNPDIKNIEDFTIDDIVVEDYVSHPAIPMAMSA

SEQ ID NO: 17636 - DNA, 960 bp, Brachydanio rerio
  CDS (1)..(960)
atgcccgacacggcagtggaagtgacaaatggacattgcgttaacggagaaagcaagaaagaagatacaaacggagggaaaaaggagttttctctgttttgcgacgagcgcgggtatttgagtctggtggagtttattttgcagaatggagcgaagaaaggcgacaggacaggcacaggagtgatctctgtgttcgggacacaagccagatacagtctcagagatcagtttccgttgctgacgaccaaaagagttttctggaaaggcatattggaggagctgctgtggttcatcaagggttcaacaaacgccaaagacctgtcggagaagggtgtgaggatttgggatgctaacggctccagagagtttctggataagaacggattcactgatcgggaggaaggagatctgggtccagtttatggatttcagtggaggcattttggagccgaatacaaagatatgcatactgattattctggagaaggagtcgatcagttacagaaagttattgacaccatcaagtcaaacccagaggaccgaaggatcatcatgtgtgcctggaatcccaaagatctccctctgatggcgctgccgccctgtcatgcgttgtgtcagttttacgtgtcgaacggtgagttgtcatgtcagctgtaccagcgatcgggagacatcggtctcggtgtcccattcaacatcgccagctacgccctgctgacctacatgatcgcccacatcactggactcaagcctggggatttcgttcatacattaggtgacgcccacatctacaccaatcacatcgagcctttaaaagagcagattcagcgagagccgcgtccgttccccaaactccggattaaacgcaaagttgaacaaattaatgatttctgtgctgaagattttgagatctatgattatgacccacatcctacaatcaaaatgcaaatggctgtttag

SEQ ID NO: 17637 - protein, 319 aa, Brachydanio rerio
MPDTAVEVTNGHCVNGESKKEDTNGGKKEFSLFCDERGYLSLVEFILQNGAKKGDRTGTGVISVFGTQARYSLRDQFPLLTTKRVFWKGILEELLWFIKGSTNAKDLSEKGVRIWDANGSREFLDKNGFTDREEGDLGPVYGFQWRHFGAEYKDMHTDYSGEGVDQLQKVIDTIKSNPEDRRIIMCAWNPKDLPLMALPPCHALCQFYVSNGELSCQLYQRSGDIGLGVPFNIASYALLTYMIAHITGLKPGDFVHTLGDAHIYTNHIEPLKEQIQREPRPFPKLRIKRKVEQINDFCAEDFEIYDYDPHPTIKMQMAV

SEQ ID NO: 17638 - DNA, 1593 bp, Pisum sativum
  CDS (1)..(1593)
atggctgctgattcctctgtaatgttcaatggaaatggaaatgggagcatcaacccaatgcctaacctacagagaacttaccaagtggttgtggcggccaccaaagatatgggcattggtaaggatggaaagttgccatggagattacctactgatctcaagtttttcaaggagttaactacgacgactttcgagactgggaagaagaatgccattgttatgggaagaaaaacatgggagagtatccctcttcagttcaggcctcttcccggtcgtcttaatgttgttttgactcgttcgggtagttttgatgctaaagcagcggagaatgttgtaatatgtggaagtatgtcttctgcattggaacttttagctgcttctccttattgtacatcgattgagaaaatatttgttattgggggtggtgagatatttagagatgctctcaatgtacccgaatgtgaagctatccacatcacagaaattcacacaagctttgaatgtgacacttttatgcctccaattgatttcactacatttcggccatggtactcatcctttcctaaggtggaaaacaacatccgatattctttcaccacttatgtgcgtgtaagaagttctgtagcagagtccttgaatcagagtactgtttcacctcttgataataaaccggcttctaaaaagtttgaggttcagaacttttcttttcttccgaaaatgatctttgagagacatgaggagtacatgtatcttaatctggttcaagaaatcatatctcaaggtacctccaagggtgataggacagggactgggaccttgtcaaaatttggttgccagatgaggttcaatctgcgtagaggctttcctcttctaacaactaagagagtattttggcgtggggttgttgaagagcttctttggtttatcagtggctcaacaaatgccaaggtgttacaggaaaaaggcattcatatatgggatgataatgcatccagggaattccttgatagcattggtttgtcagagagggaggagggtgacttaggacctgtttatgggtttcagtggagacactttggtgccaggtatactaacatgcataatgactatgccggccaaggagttgatcagcttttagatgttatcaacaaggtaaagcataatcctgatgatagacggatcattctctctgcatggaatccagcagatcttaaattgatggcacttccaccctgccacatgtctgcacagttctatgtagcaaatggggagttatcatgtcaaatgaatcagcgatctgctgacatgggcctgggcgtgccattcaacattgcatcttatgccctcctgacatgcatgattgctcatatttgtgaacttgttccaggtgattttatccatgttcttggggatgcacatgtttaccaaactcatgtgaggcctttgcaggagcagcttcataacctgccaaaaccttttccaactttgaaaatcaattcaaagaagaaagatatagattcttttgtggctactgatttcaagctcattgactatgatcctcaccaaaagattgagatgaagatggctgtttaa

SEQ ID NO: 17639 - protein, 530 aa, Pisum sativum
MAADSSVMFNGNGNGSINPMPNLQRTYQVVVAATKDMGIGKDGKLPWRLPTDLKFFKELTTTTFETGKKNAIVMGRKTWESIPLQFRPLPGRLNVVLTRSGSFDAKAAENVVICGSMSSALELLAASPYCTSIEKIFVIGGGEIFRDALNVPECEAIHITEIHTSFECDTFMPPIDFTTFRPWYSSFPKVENNIRYSFTTYVRVRSSVAESLNQSTVSPLDNKPASKKFEVQNFSFLPKMIFERHEEYMYLNLVQEIISQGTSKGDRTGTGTLSKFGCQMRFNLRRGFPLLTTKRVFWRGVVEELLWFISGSTNAKVLQEKGIHIWDDNASREFLDSIGLSEREEGDLGPVYGFQWRHFGARYTNMHNDYAGQGVDQLLDVINKVKHNPDDRRIILSAWNPADLKLMALPPCHMSAQFYVANGELSCQMNQRSADMGLGVPFNIASYALLTCMIAHICELVPGDFIHVLGDAHVYQTHVRPLQEQLHNLPKPFPTLKINSKKKDIDSFVATDFKLIDYDPHQKIEMKMAV

SEQ ID NO: 17640 - DNA, 1563 bp, Leishmania chagasi
  CDS (1)..(1563)
atgtccagggcagctcttaggcttaagattccgatgccggcgacgatggcggacttcgccttcccctctctgcgcgccttctccatcgttgtggccctcgataagcagcacggcatcggcgacggcgagtcgatcccgtggcgggtgccggaggacatggcgttcttcaaggaccagacgacgctgttgcgcaacaaaaagccgccgacggagaagaagcgcaacgctgtcgtgatgggccgcaagacgtgggagagcgtcccggtaaagttccgaccactcaagggacggctgaacattgtgttgtcctcgaaggccaccgtcgaggagcttctggcgccgctgccggagggaaagcgcgctgccgcggcgcaggatgtggtggtggtgaacggcggtctggccgaggcgctccgcctcctcgcacgcccgccgtactgcagctccatcgagacagcgtattgcgtcgggggtgcgcaggtttatgcggacgccatgctgtcgccgtgcgtcgagaagctgcaggaggtgtacctgacccgcatctacacgacggcgcctgcgtgtacgcgcttctttccgtttccgcccgagaacaccaccacggcgtgggacctggcgtcgtctcagggacgccgcaagagcgaggcggacggcctcgagttcgagatctgcaagtacgtgccgcgtaaccatgaggagcggcagtaccttgagctgattgaccgcatcatgaagacggggatcgtgaaggaggaccgcaccggcgtgggcaccatcagcctcttcggcgcacagatgcgcttctccctacgcgacaaccgcctgccgctgctgacgacgaagcgtgtcttctggcgcggcgtgtgcgaggagctgctgtggttcctgcgcggggagacgaacgcgcagctgctggcggacaaggacattcacatctgggacggcaacggctcgcgcgagtttctcgacagccgcggcttgacagagaataaggagatggacctcggccctgtctacggcttccagtggcgccacttcggggcagattacaaggggtttgaagcgaactacgacggcgaaggggtggaccagatcaggtccatcgtggagacgatcaaggcgaacccgaacgaccgccgccttctattcactgcctggaacccgtgcgcgctgcaaaagatggcgctgccgccgtgccacttgcttgctcagttctacgtgaacacggacacgagcgagctatcctgcatgctgtaccagcgctcgtgcgacatgggtctcggcgtccccttcaacatcgcctcctacgcgctgctcaccatcctcattgccaaggcgacgggcctgcggcctggtgagcttgtgcacacccttggtgacgcccacgtctaccgcaaccacgtcggtgccctcaagtcgcagctcgagcgagtcccgcacgcgttcccgaccctcgtcttcaaggaggagcgtcagttcctcgaggactacgagttaacggacatggaggtgatcgactacgttccacacccgccgatcaagatggagatggccgtatag

SEQ ID NO: 17641 - protein, 520 aa, Leishmania chagasi
MSRAALRLKIPMPATMADFAFPSLRAFSIVVALDKQHGIGDGESIPWRVPEDMAFFKDQTTLLRNKKPPTEKKRNAVVMGRKTWESVPVKFRPLKGRLNIVLSSKATVEELLAPLPEGKRAAAAQDVVVVNGGLAEALRLLARPPYCSSIETAYCVGGAQVYADAMLSPCVEKLQEVYLTRIYTTAPACTRFFPFPPENTTTAWDLASSQGRRKSEADGLEFEICKYVPRNHEERQYLELIDRIMKTGIVKEDRTGVGTISLFGAQMRFSLRDNRLPLLTTKRVFWRGVCEELLWFLRGETNAQLLADKDIHIWDGNGSREFLDSRGLTENKEMDLGPVYGFQWRHFGADYKGFEANYDGEGVDQIRSIVETIKANPNDRRLLFTAWNPCALQKMALPPCHLLAQFYVNTDTSELSCMLYQRSCDMGLGVPFNIASYALLTILIAKATGLRPGELVHTLGDAHVYRNHVGALKSQLERVPHAFPTLVFKEERQFLEDYELTDMEVIDYVPHPPIKMEMAV

SEQ ID NO: 17642 - DNA, 1563 bp, Leishmania infantum
  CDS (1)..(1563)
atgtccagggcagctgcgaggtttaagattccgatgccggcgacgaaggcggacttcgccttcccctctctgcgcgccttctccatcgttgtggccctcgataagcagcacggcatcggcgacggcgagtcgatcccgtggcgggtgccggaggacatggcgttcttcaaggaccagacgacgctgttgcgcaacaaaaagccgccgacggagaagaagcgcaacgctgtcgtgatgggccgcaagacgtgggagagcgtcccggtaaagttccgaccactcaagggacggctgaacattgtgttgtcctcgaaggccaccgtcgaggagcttctggcgccgctgccggagggaaagcgcgctgccgcggcgcaggatgtggtggtggtgaacggcggtctggccgaggcgctccgcctcctcgcacgcccgccgtactgcagctccatcgagacagcgtattgcgtcgggggtgcgcaggtttatgcggacgccatgctgtcgccgtgcgtcgagaagctgcaggaggtgtacctgacccgcatctacacgacggcgcctgcgtgtacgcgcttctttccgtttccgcccgagaacaccaccacggcgtgggacctggcgtcgtctcagggacgccgcaagagcgaggcggacggcctcgagttcgagatctgcaagtacgtgccgcgtaaccatgaggagcggcagtaccttgagctgattgaccgcatcatgaagacggggatcgtgaaggaggaccgcaccggcgtgggcaccatcagcctcttcggcgcacagatgcgcttctccctacgcgacaaccgcctgccgctgctgacgacgaagcgtgtcttctggcgcggcgtgtgcgaggagctgctgtggttcctgcgcggggagacgaacgcgcagctgctggcggacaaggacattcacatctgggacggcaacggctcgcgcgagtttctcgacagccgcggcttgacagagaataaggagatggacctcggccctgtctacggcttccagtggcgccacttcggggcagattacaaggggtttgaagcgaactacgacggcgaaggggtggaccagatcaggtccatcgtggagacgatcaaggcgaacccgaacgaccgccgccttctattcactgcctggaacccgtgcgcgctgcaaaagatggcgctgccgccgtgccacttgcttgctcagttctacgtgaacacggacacgagcgagctatcctgcatgctgtaccagcgctcgtgcgacatgggtctcggcgtccccttcaacatcgcctcctacgcgctgctcaccatcctcattgccaaggcgacgggcctgcggcctggtgagcttgtgcacacccttggtgacgcccacgtctaccgcaaccacgtcggtgccctcaagtcgcagctcgagcgagtcccgcacgcgttcccgaccctcgtcttcaaggaggagcgtcagttcctcgaggactacgagttaacggacatggaggtgatcgactacgttccacacccgccgatcaagatggagatggccgtatag

SEQ ID NO: 17643 - protein, 520 aa, Leishmania infantum
MSRAAARFKIPMPATKADFAFPSLRAFSIVVALDKQHGIGDGESIPWRVPEDMAFFKDQTTLLRNKKPPTEKKRNAVVMGRKTWESVPVKFRPLKGRLNIVLSSKATVEELLAPLPEGKRAAAAQDVVVVNGGLAEALRLLARPPYCSSIETAYCVGGAQVYADAMLSPCVEKLQEVYLTRIYTTAPACTRFFPFPPENTTTAWDLASSQGRRKSEADGLEFEICKYVPRNHEERQYLELIDRIMKTGIVKEDRTGVGTISLFGAQMRFSLRDNRLPLLTTKRVFWRGVCEELLWFLRGETNAQLLADKDIHIWDGNGSREFLDSRGLTENKEMDLGPVYGFQWRHFGADYKGFEANYDGEGVDQIRSIVETIKANPNDRRLLFTAWNPCALQKMALPPCHLLAQFYVNTDTSELSCMLYQRSCDMGLGVPFNIASYALLTILIAKATGLRPGELVHTLGDAHVYRNHVGALKSQLERVPHAFPTLVFKEERQFLEDYELTDMEVIDYVPHPPIKMEMAV

SEQ ID NO: 17644 - DNA, 1563 bp, Leishmania tropica
  CDS (1)..(1563): n means a or g or c or t/u, s means g or c
atgtccagggcagctgcgaggtttaagattctgatgccggagacgaaggcggacttcgctttcccctccctgcgcgccttctccatcgtcgtggccctcgataagcagcacggcatcggcgacggcgagtcgatcccgtggcgggtgccggaggacatggcgttcttcaaggaccagacgacgctgctgcgcaacaagaagccgccgacggagaagaagcgcaacgccgtcgtgatgggccgcaagacgtgggagagcgtcccggtcaagttccgaccactcaaggggcggctgaacattgtgttatcctcgaaggccaccgtcgaggagcttctggcgccgctgccggaggaaaagcgcgcggcggcggagcaggatgtggtggtggtgaacggcggtctggccgaggcgctccgcctcctcgcacgcccgccgtactgcagctccatcgagacagcgtattgcgtcggtggtgcgcaggtttacgcggacgccatgctgtcgccgtgcgtcgagaaactgcaggaggtgtacctgacccgcatctacacgacggcgcctgcgtgtacgcgcttctttccgtttccgcccgagaacgccgccacggcgtgggacctggcgtcgtctcagggacgccgcaagagcgaggcggagggcctcgagttcgagatctgcaagtacgtgccgcgcaaccacgaggagcggcagtaccttgagctgattgaccgcatcatgaagacggggatcgtgaaggaggaccgcaccggcgtgggcaccatcagcctcttcggcgcacagatgcgcttctccttacgcggcaaccgcctgccgctgctgacgacgaagcgtgtcttctggcgcggcgtgtgcgaggagctgctgtggttcctgcgcggggagaccaacgcgcrgctgctggcggacaaggacattcacatctgggacggcaacggctcgcgcgagtttctcgacagccgcggcttgacagagaataaggagatggacctcggccctgtctacggcttccagtggcgccacttcggggcagattacaaggggtttgaagcgaactacgacggcgaaggggtggaccaratccggttcatcgtggagacgatcaaggcgaacccgaacgaccgccgcctcctagtcactgcctggaacccgtgcgcgctgcaaaagatggcgctgccgccgtgccacttgcttgctcagttctacgtgaacacagacacgagcgagctatcctgcatgttgtaccagcgctcgtgcgacatgggtcttggcgtccccttcaacatcgcctcctacgcgctgctcaccatcctcattgccaaggcgacgggtctgcggcctggtgagcttgtgcacaccctcggcgacgcccacgtctaccgcaaccacgttgatgccctcaaggcgcagctcgagcgtgtcccgcacgcgttcccgaccctcatcttcaaggcggagcggcagttcctcgaggactacgagttgacggacatggaggtgatcgactacgttccgcacccgccgatcaagatggagatggccctatag

SEQ ID NO: 17645 - protein, 520 aa, Leishmania tropica
  Xaa in postion 304 is unknown
MSRAAARFKILMPETKADFAFPSLRAFSIVVALDKQHGIGDGESIPWRVPEDMAFFKDQTTLLRNKKPPTEKKRNAVVMGRKTWESVPVKFRPLKGRLNIVLSSKATVEELLAPLPEEKRAAAEQDVVVVNGGLAEALRLLARPPYCSSIETAYCVGGAQVYADAMLSPCVEKLQEVYLTRIYTTAPACTRFFPFPPENAATAWDLASSQGRRKSEAEGLEFEICKYVPRNHEERQYLELIDRIMKTGIVKEDRTGVGTISLFGAQMRFSLRGNRLPLLTTKRVFWRGVCEELLWFLRGETNAXLLADKDIHIWDGNGSREFLDSRGLTENKEMDLGPVYGFQWRHFGADYKGFEANYDGEGVDQIRFIVETIKANPNDRRLLVTAWNPCALQKMALPPCHLLAQFYVNTDTSELSCMLYQRSCDMGLGVPFNIASYALLTILIAKATGLRPGELVHTLGDAHVYRNHVDALKAQLERVPHAFPTLIFKAERQFLEDYELTDMEVIDYVPHPPIKMEMAL

SEQ ID NO: 17646 - DNA, 870 bp, White spot syndrome virus
  CDS (1)..(870)
atggagggagaacatcaatatttgaacctagtcagggagatcctagaaagaggagtgaagaaggacgatagaactggaacaggaactctatccatttttggaccccaaatgaggttctctcttcgagacgacactattccagttctcactaccaagaaaattttctggagaggagttgtggaagaactctcgtggttcatcaggggcaatacagacgccaaagaattggccaagaagaagatacacatctggaacgctaatgggtcgcgggaatttttggacagtagagggttatacgatagagcagagggagatttgggacccgtatacggattccaatggcgtcattttggtgctgaatatgatacctgttcttccgattatactggaaagggtattgatcaattggccaatatactaaagaccctgagagaaaatccagatgatagaaggatgattatgacggcatggaatcctatggatcttcaccttatggctcttcctccatgccacatgactgctcaattttatgtggctaatggagaattgtcgtgccagttgtatcagcgaagcggagatgtcgggttgggcgtgcccttcaatattgcatcatactctcttctgactcatctgatggccagtatggtgggtctaaaaccgggagagtttatcctcactcttggtgacgcacacatttataatacccacattgaggtgttaaagaagcagttgtgccgcgtccctagaccattccctaagttgaggattttaatggctccagaaaaaattgaggactttactatcgacatgttttatcttgaggggtatcaaccacacagtggaaacttgcagatgaaaatggctgtttga

SEQ ID NO: 17647 - protein, 289 aa, White spot syndrome virus
MEGEHQYLNLVREILERGVKKDDRTGTGTLSIFGPQMRFSLRDDTIPVLTTKKIFWRGVVEELSWFIRGNTDAKELAKKKIHIWNANGSREFLDSRGLYDRAEGDLGPVYGFQWRHFGAEYDTCSSDYTGKGIDQLANILKTLRENPDDRRMIMTAWNPMDLHLMALPPCHMTAQFYVANGELSCQLYQRSGDVGLGVPFNIASYSLLTHLMASMVGLKPGEFILTLGDAHIYNTHIEVLKKQLCRVPRPFPKLRILMAPEKIEDFTIDMFYLEGYQPHSGNLQMKMAV

SEQ ID NO: 17648 - DNA, 924 bp, Mus musculus
  CDS (1)..(924)
atgctggtggttggctccgagctgcagtccgatgctcagcagctgagcgcggaagccccgcagcatggagaactccagtacctgaggcaggtggaacacattttgcgctgcggcttcaagaaggaggaccgcacgggcacaggcaccctgtcggtgttcggcatgcaggcacgatacagcctgagagatgaatttcctctgctcacaaccaaacgagtgttctggaagggtgttttggaggagttgttgtggtttatcaagggatccacaaatgctaaagaattgtcctccaagggagtgagaatctgggatgccaatggatcccgagattttctggacagcttgggattttctgcccgacaggaaggggacctgggcccagtttatggtttccaatggaggcattttggagcagagtacaaagatatggattcagattactcgggacaaggagtagaccagctgcaaaaagtgattgacaccatcaaaaccaaccctgatgacagaagaatcatcatgtgtgcctggaacccaaaagatcttcccctgatggcactgcctccttgccatgccctctgtcagttctatgtggtgaatggggaactgtcttgccagctttaccagaggtcaggagatatgggtctgggcgtgcccttcaacattgccagctatgctctgctcacctacatgattgcacatatcacaggcctgcagccaggtgattttgtccacactttgggagatgcacatatttacctgaatcatatagagccgctgaaaattcagctacagcgagaaccaagacctttcccaaagctcaaaatccttcgaaaagttgagacaatcgatgatttcaaagttgaagactttcagattgaagggtataatccacatccaacgattaaaatggaaatggctgtttaa

SEQ ID NO: 17649 - protein, 307 aa, Mus musculus
MLVVGSELQSDAQQLSAEAPQHGELQYLRQVEHILRCGFKKEDRTGTGTLSVFGMQARYSLRDEFPLLTTKRVFWKGVLEELLWFIKGSTNAKELSSKGVRIWDANGSRDFLDSLGFSARQEGDLGPVYGFQWRHFGAEYKDMDSDYSGQGVDQLQKVIDTIKTNPDDRRIIMCAWNPKDLPLMALPPCHALCQFYVVNGELSCQLYQRSGDMGLGVPFNIASYALLTYMIAHITGLQPGDFVHTLGDAHIYLNHIEPLKIQLQREPRPFPKLKILRKVETIDDFKVEDFQIEGYNPHPTIKMEMAV

SEQ ID NO: 17650 - DNA, 840 bp, Homo sapiens
  CDS (1)..(840)
atgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttag

SEQ ID NO: 17651 - protein, 279 aa, Homo sapiens
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 17652 - DNA, 951 bp, Macropodid herpesvirus 1
  CDS (1)..(951)
atgtccaccaaaaatgcggaaggtcgacagagtgaagggtggggcggatttctccaaccgccccccgatgcgggcccccactctcaaccgcatggggagtggcagtatctgtatcaggtggcgcggatcctcagggagggctaccggaagggggaccggaccgggacggggaccctctccgtgttcggcacacaggcccgatacaaccttcggggcgaatttccgctgctgacgacgaaacgtgtgtactggaagggcgtggtcgaggagctgctgtggttcgtgaggggggccacgaacaccaaggagctctcgtcccggggggtgaagatctgggacgctcacgggtctcgagactttctggacaagcgggggttcccatctcgggaggagggcgacttgggcccggtctacgggttccagtggagacactttggggcggagtatcgggggagcgaagcggactattcgggacagggagcggaccagctgcagtacgtgatcgacaccttgaagcggaaccctgatgacagaaggatcgtgatgtgcgcgtggaacccgaaggatctccctctgatggcgctccccccgtgccacaccctctgccaattctacgtcgcgaatggggagctgtcctgccagctctatcaacgatcgggagacatggggttaggggtgccgttcaacattgctagttacgctctgctcacgtacatgatcgctcatgtcgtggggttggttcctggggagctggtgcatacgttgggggatgcgcatatctacctgaaccacatcgagcggctccggatccagctgcaacgagagccccgaccgttcccccagctcaaaattattcgagccgtcacctcaatcgattactttaggagcgaggacttcgtgttggaagggtaccggccgcactcggccctgaagatggagttggcggtgtag

SEQ ID NO: 17653 - protein, 316 aa, Macropodid herpesvirus 1
MSTKNAEGRQSEGWGGFLQPPPDAGPHSQPHGEWQYLYQVARILREGYRKGDRTGTGTLSVFGTQARYNLRGEFPLLTTKRVYWKGVVEELLWFVRGATNTKELSSRGVKIWDAHGSRDFLDKRGFPSREEGDLGPVYGFQWRHFGAEYRGSEADYSGQGADQLQYVIDTLKRNPDDRRIVMCAWNPKDLPLMALPPCHTLCQFYVANGELSCQLYQRSGDMGLGVPFNIASYALLTYMIAHVVGLVPGELVHTLGDAHIYLNHIERLRIQLQREPRPFPQLKIIRAVTSIDYFRSEDFVLEGYRPHSALKMELAV

SEQ ID NO: 17654 - DNA, 1770 bp, Plasmodium gallinaceum
  CDS (1)..(1770)
atgaatgaaatatctgatatttttgatatacacgctatatgcgcctgctgtaaggttgaaaacaaaaatgaaaagaaaaaaaatgaaatcttcagtaataacacatttagaggaattgggaataagggagttttgccatggaaaagtaacccattagacatgaaatattttactacagtaacaacatatgttaatgaatcaaaatataaaaaattaaaatataaaagagagaaatatttagaaaaaacaaaggatacaaagtgtttagagagtataattcaactatcaaataacttacaaaatgttgtagttatgggaagaactagctgggaaagtattccagaacgatttaggccgttagttaatagaataaatgttgtattatcaagatcattaaaaaaagaagacataaaaggagatgctattttaataaataatgtggatgatttacttctattactaagaaaaataaattattataaatgttttattattggtggttcagttgtatacaatgaatttttaaaaagaaatttaataaaaaaaatatactttacaagaataaatagtacgtatgagtgtgatgttttttttccagaaataaaggaaacggaatttgaaattatgtctctaagtgatgtgtatagcaataatggtgcaacattagactttgtaatttataagagaaaaaaagaaatattaaataatgaaaaccccattgaaaataataaagaagcagatatatgttctcaagattccccaaataactatttcactggagaggatgtttacaaaaacatggatgatgacgatgattatgtatattttaattttaataatacaaaggaaaagaaaaattctgaaataagtgatgattttaaaatatacaatagcttgaaatataaatatcatccggaatatcaatatttaaatattatatatgatgttattatgaatgggaataaacaaggtgatagaactggtgttggagtagtaagtaagtttggatatatgatgaaatttaatttaaatcaatattttcctttattaacaacaaaaaaattgttcataagaggaattattgaagaactgttatggtttataagaggggaaactaatggaaacactctgttgaataaaaatgtgagaatatgggaagccaacggaacaagggaattcttagataaaagaaaattatttgatagagaagttaatgatttgggacccatttatggttttcaatggagacattttggtgctgaatatactaatatgcatgacaattatgaaaataaaggagtagatcaattaaaaaatattatcaatttaataaaaaatgagcccactagtagaagaattattttatgtgcatggaatgtaaaggatttagataaaatggcattaccaccttgtcatattttatgtcaattttatgtctttgataataaattgtcatgcattatgtatcaaaggtcatgtgatttgggattaggagttccttttaatattgcatcatattcaatttttacttatatgattgcacaagtgtgtaatttgcaacctgcacagttcatacatattttaggaaatgcacacgtatataacaatcatatcgatagtttaaaaaagcaactaaacagaataccatatcctttcccaactctcaagttaaatccagatataaagaatatagaagactttaaagtttctgattttacaatagaaaattatgtacatcatgataaaatttctatggatatggctgcataa

SEQ ID NO: 17655 - protein, 589 aa, Plasmodium gallinaceum
MNEISDIFDIHAICACCKVENKNEKKKNEIFSNNTFRGIGNKGVLPWKSNPLDMKYFTTVTTYVNESKYKKLKYKREKYLEKTKDTKCLESIIQLSNNLQNVVVMGRTSWESIPERFRPLVNRINVVLSRSLKKEDIKGDAILINNVDDLLLLLRKINYYKCFIIGGSVVYNEFLKRNLIKKIYFTRINSTYECDVFFPEIKETEFEIMSLSDVYSNNGATLDFVIYKRKKEILNNENPIENNKEADICSQDSPNNYFTGEDVYKNMDDDDDYVYFNFNNTKEKKNSEISDDFKIYNSLKYKYHPEYQYLNIIYDVIMNGNKQGDRTGVGVVSKFGYMMKFNLNQYFPLLTTKKLFIRGIIEELLWFIRGETNGNTLLNKNVRIWEANGTREFLDKRKLFDREVNDLGPIYGFQWRHFGAEYTNMHDNYENKGVDQLKNIINLIKNEPTSRRIILCAWNVKDLDKMALPPCHILCQFYVFDNKLSCIMYQRSCDLGLGVPFNIASYSIFTYMIAQVCNLQPAQFIHILGNAHVYNNHIDSLKKQLNRIPYPFPTLKLNPDIKNIEDFKVSDFTIENYVHHDKISMDMAA

SEQ ID NO: 17656 - DNA, 1002 bp, Rhesus monkey rhadinovirus H26
  CDS (1)..(1002)
atgattgtcctggtgcatctcggtatttgctacgttaaaaaaattatacccgtttgcgtggctggaatcgcggccgcacgacgccgggtttcttccacacctgaaggtgccgcggccgtccgctgcgcgtgccgcggcgagcacggcgagctgcagtacctggcgcacctggatttaatcatcaaacacggcgtgcagagggaggacaggacgggcgtgggcaccaggtccgtgttcgggcttcaggcccgatataaccttagggacgagtttcccctgttaaccaccaaaagggtgttctggaggggcgtcgtggaggagttgctgtggtttatcaggggctccaccgactccaccgaactgtcgcgccgcggcgtaaagatttgggacgcgcacggatcccgcgcctttttggcggcgcagggcttcggggaccgccgcgagggcgatctggggccggtgtacgggttccagtggagacattttggggcggagtacaggggggccgacgccaactacgagggtcagggggtggaccagctgcgttacgtggtggatctaattaacaggcggccccacgatcggcgcatcgtcatgtgcgcgtggaaccccgcggacctcgcgcggatggccctccctccttgtcacgttttgtgtcagttttacgtggctcggggggagctgtcctgccagctgtaccagaggtccgccgacatgggccttggggtcccgtttaacatcgccagctacgccctcctgacgtatctgatcgctcacgtcacgggcctgaccccgggagactttgtgcacaccttgggtgacgcccacgtttacaacaaccacgttgatcccctgctgcttcagctgcggaggaccccgcgtccgtttccgcggctgaagattttgagaaaggtggcgcgtctggaggactttacgcgcgcggatctgagtctcgagggctacgacccccatccccacatagagatggagatggccgtttga

SEQ ID NO: 17657 - protein, 333 aa, Rhesus monkey rhadinovirus H26
MIVLVHLGICYVKKIIPVCVAGIAAARRRVSSTPEGAAAVRCACRGEHGELQYLAHLDLIIKHGVQREDRTGVGTRSVFGLQARYNLRDEFPLLTTKRVFWRGVVEELLWFIRGSTDSTELSRRGVKIWDAHGSRAFLAAQGFGDRREGDLGPVYGFQWRHFGAEYRGADANYEGQGVDQLRYVVDLINRRPHDRRIVMCAWNPADLARMALPPCHVLCQFYVARGELSCQLYQRSADMGLGVPFNIASYALLTYLIAHVTGLTPGDFVHTLGDAHVYNNHVDPLLLQLRRTPRPFPRLKILRKVARLEDFTRADLSLEGYDPHPHIEMEMAV

SEQ ID NO: 17658 - DNA, 939 bp, Caenorhabditis elegans
  CDS (1)..(939)
atgaacaaagaaaatatcatcgccgatgcgccttctgatgtcgtaaaaaccgttcaacagcaagttcacttgaatcaagatgaatataaatatttgaagcaagttgagcaaattttgagagaaggaacacgaagagatgatcgcactgggactggaactatttcgatttttggaatgcaatcgaaatactgtttgagaaatggcacaattccgttgcttaccacgaaacgtgtctattggaagggagttctcgaggaattactttggtttatttctggatcgaccgatggaaagcttttgatggagaaaaatgtgaagatttgggagaaaaacggcgatcgcgcgttccttgacaatctcggatttacgtctcgtgaagaaggagatcttggaccagtttatggatttcaatggagacactttggggcgaaatatgtggattgtcatacagattactctggacaaggtgttgatcagttggctgaagttatccgacagattaaggagcaaccggatagtcgaagaatcattatgtccgcgtggaatccgtcggatcttggacaaatggttctgccaccgtgtcacacaatgtgtcagttctatgtggacaatggagagctctcgtgtcagctttaccaacgaagtggagatatgggtctcggagttccattcaaccttgccagctacggccttctcacccacatgattgcaaaagtgtgtggattgaaaccaggaacccttgttcatactctcggagatgctcatgtctactcaaatcatgtggatgctctcaaaattcaactggaccgtgagccatacgctttccccaaaattcgattcacgcgagacgtggcctcaatcgatgatttcacttctgatatgattgccctggatgactacaagtgtcatccaaaaatcccaatggatatggctgtttga

SEQ ID NO: 17659 - protein, 312 aa, Caenorhabditis elegans
MNKENIIADAPSDVVKTVQQQVHLNQDEYKYLKQVEQILREGTRRDDRTGTGTISIFGMQSKYCLRNGTIPLLTTKRVYWKGVLEELLWFISGSTDGKLLMEKNVKIWEKNGDRAFLDNLGFTSREEGDLGPVYGFQWRHFGAKYVDCHTDYSGQGVDQLAEVIRQIKEQPDSRRIIMSAWNPSDLGQMVLPPCHTMCQFYVDNGELSCQLYQRSGDMGLGVPFNLASYGLLTHMIAKVCGLKPGTLVHTLGDAHVYSNHVDALKIQLDREPYAFPKIRFTRDVASIDDFTSDMIALDDYKCHPKIPMDMAV

SEQ ID NO: 17660 - DNA, 924 bp, Trichinella spiralis
  CDS (1)..(924)
atgacagaaactgttcacaaattagatactaattcaacatctcaggatgattacgtgaatcaggaggaactgaattatttgaatcaactgaaggacataattgatcacggtgttcgtaaaaacgatcgtactggaatcggaacattgtcaacttttggaacgcagtctcggtattgccttcgagatgatatttttccgcttcttacaacaaaacgcgtcttttggagaggagtggtcgaagaactgctttggttcatcagtggaagcaccaatgctaaacagctttcagagaagaatgtcaacatttgggatggaaattcttccagagaattcctagacagtagaggactgtacaattatgaagaaggtgatttggggcctgtttatggtttccaatggcgccactttggatgcccgtattcatcgatgacggccgattataaaggaaaaggctacgatcaattacaacagtgtattaaaatgattcgtgaagaaccggaaagtcgacgaatcatcatgaccgcatggaatccctgtgatttagagaaagtcgctttgccaccttgtcactgtttcgtccaattttacgttgctgatggggagctatcttgtcaaatgtatcaacgaagtgcagatatgggattgggagtgccgtttaacattgccagctattctttactgacacgtatgatagcccacattacttcactgaagccagggtttttcatacatacaatcggagatgcgcatgtctacttaacacatgttgacgctttgaaagttcaaatggaaagaaaaccaagaccgtttccgaagctgaaaattttaagaaatgtggaaaatattgatgattttcgggctgaagactttgaattaattaattataaaccatatccaaaaatatcaatgcctatggctgtgtga

SEQ ID NO: 17661 - protein, 307 aa, Trichinella spiralis
MTETVHKLDTNSTSQDDYVNQEELNYLNQLKDIIDHGVRKNDRTGIGTLSTFGTQSRYCLRDDIFPLLTTKRVFWRGVVEELLWFISGSTNAKQLSEKNVNIWDGNSSREFLDSRGLYNYEEGDLGPVYGFQWRHFGCPYSSMTADYKGKGYDQLQQCIKMIREEPESRRIIMTAWNPCDLEKVALPPCHCFVQFYVADGELSCQMYQRSADMGLGVPFNIASYSLLTRMIAHITSLKPGFFIHTIGDAHVYLTHVDALKVQMERKPRPFPKLKILRNVENIDDFRAEDFELINYKPYPKISMPMAV

SEQ ID NO: 17662 - DNA, 1029 bp, Halobacterium volcanii
  CDS (1)..(1029): transl_table=11
atgacgaccacacccaaccagggcacttctcatgcgccaatatttgacctcgtcacggacgtttttggaaccgggcggcacaaaccgaatcgaacgggcgtcgataccatctcgggcttctcgaagcactacaccgtcgacctccaagagggctttccgttgctcacgacgaaggacctctcgggcttccgctggaactccctcatccacgaactgctgtggtatttttccggcgaggaacacatccgcaccctccgcgaggagacgggcatttgggacgcgtgggccgacgaggagggccaccttgacacggcctacggccggttctggcggcgctacccggtccccgaggaggggcttgcgggcgaggcgtggcccgacgacggccaccgctggatgaacgacgaggggacgttcgaccagctcgcgtacgtcctcgacacgctcgacgagaacccgaactcgcgccggctggtcatcaacgcgtggcaccccgccaacgcggccgtctcgacgctcccgccgtgtcactacacgttcgtcttcaacgtgcagggcgacgaactcaacctccatctgacccagcgctccggcgatatcgcgctcggcgtcccgttcaacctcgcggcgtacgccatcctcgcgcaggttgtcgcccagcgcgccggcttcgaactcgggtcgttcgcccacaccatcgtcgacgcccacgtctactgcggggccggcgagcgcggcgcgtggtacggcgaccacctcgacgaactccagtcccgcctcgccgacgtgcagtcgcccgacgaatacctcgacgtgcgcgaatggctcctcgacgcggcccccgaggaggccgacggcgaggaggactacgaccacgtccccggactgctcttgcaggcctcgcgcgagccgcgcgagcgccccgcgctcgacgtggccgacgtgccgctcgaagacctctcgttcgaggacatcgtcctccgcgactacgacccggccgacgggattcgcttcgcggtggccgaatga

SEQ ID NO: 17663 - protein, 342 aa, Halobacterium volcanii
MTTTPNQGTSHAPIFDLVTDVFGTGRHKPNRTGVDTISGFSKHYTVDLQEGFPLLTTKDLSGFRWNSLIHELLWYFSGEEHIRTLREETGIWDAWADEEGHLDTAYGRFWRRYPVPEEGLAGEAWPDDGHRWMNDEGTFDQLAYVLDTLDENPNSRRLVINAWHPANAAVSTLPPCHYTFVFNVQGDELNLHLTQRSGDIALGVPFNLAAYAILAQVVAQRAGFELGSFAHTIVDAHVYCGAGERGAWYGDHLDELQSRLADVQSPDEYLDVREWLLDAAPEEADGEEDYDHVPGLLLQASREPRERPALDVADVPLEDLSFEDIVLRDYDPADGIRFAVAE

SEQ ID NO: 17664 - DNA, 969 bp, Oryza sativa
  CDS (1)..(969)
atgtcaaaaaatgaacagcaataccttgatttagcacaaaaaatattagctgaaggtaacctcaaaggcgaccgtaccggaacggggacgcactccctctttggtacgcaaatgcgctttgacttacaagaaggctttccccttctcacaaccaagaaagttttctttgggttaatcaaatccgaactactctggtttttgcgcggcgataacaacattcgtttcctactacaacataacaaccatatttgggacgaatgggcctttaaaaactgggtagaatcaaacgattacaccggccctgatatgaccaactttggtcatcgcgcagaaactgaccctgaatttgcagccgtctatcaaacgcaaaaagcgatttttgtcgacaagattttaaacgacgatgcgttcatggaaaaatttggttacgtaggtgacgtctatggcaagctctggcgtggttgggaaacgagcagtgtgacagctggtgccgagaccgttgagtcaagttgcggcttagttgaagagattaaaacaacgcctgactctcgtcgccttattttgacagcctggaatgctgatacaacgccgcaagcccccttgccttcatgccacgtcttaagtcaattctatgtcgctgatggcaaattaagccttcagttgtatcaacgttcgggtgatttcttcttgggtgtgccgttcaacattgcgtcatattcacttttgctgcatatgatggccgcacaaaccggttatgaagtgggcgactttgtgcatacaatcggtgacacgcacatttataacaaccacgtggctcaaatcacagaacaactctcacgcccgatgcatcccctaccaaaattatggttaaatccggacgttaaatcaatttttgattacacgatggctgacattaaggtgcttgattatgaaagtgaagctccaattaaggcaccggtcgctgtttaa

SEQ ID NO: 17665 - protein, 322 aa, Oryza sativa
MSKNEQQYLDLAQKILAEGNLKGDRTGTGTHSLFGTQMRFDLQEGFPLLTTKKVFFGLIKSELLWFLRGDNNIRFLLQHNNHIWDEWAFKNWVESNDYTGPDMTNFGHRAETDPEFAAVYQTQKAIFVDKILNDDAFMEKFGYVGDVYGKLWRGWETSSVTAGAETVESSCGLVEEIKTTPDSRRLILTAWNADTTPQAPLPSCHVLSQFYVADGKLSLQLYQRSGDFFLGVPFNIASYSLLLHMMAAQTGYEVGDFVHTIGDTHIYNNHVAQITEQLSRPMHPLPKLWLNPDVKSIFDYTMADIKVLDYESEAPIKAPVAV

SEQ ID NO: 17666 - DNA, 741 bp, Bacteriophage T4
  CDS (1)..(741): transl_table=11
atgattagtgactctatgacagttgaagaaatccgtcttcatttggggcttgcattaaaagaaaaagatttcgtagttgataaaacaggtgttaaaactattgaaattattggcgcatcatttgtagcagatgaaccgtttatttttggcgctcttaatgatgaatacattcagcgtgaacttgaatggtataaatctaaaagcttgttcgttaaagatattccgggtgaaacaccgaagatttggcaacaagtagcatcttctaaaggtgaaattaactcgaattatggttgggctatctggtcagaagataactatgctcagtatgacatgtgtttagctgaacttggtcaaaatcctgattctcgacgtggtatcatgatttatactcgtccatctatgcagtttgactataataaagatggtatgtcagatttcatgtgcacgaatacagtacaatacctgattcgtgacaagaaaatcaatgcggttgttaacatgcgctcaaatgacgtggtcttcggattccgtaatgattatgcatggcaaaaatacgtattagataaattagtatctgatttgaatgcaggtgattcaactcgccagtataaagcaggttccattatatggaatgttggaagcctacatgtgtattctcgtcatttttatttggttgatcattggtggaaaactggcgaaacacatatttcgaaaaaagattatgtaggaaaatacgcttaa

SEQ ID NO: 17667 - protein, 246 aa, Bacteriophage T4
MISDSMTVEEIRLHLGLALKEKDFVVDKTGVKTIEIIGASFVADEPFIFGALNDEYIQRELEWYKSKSLFVKDIPGETPKIWQQVASSKGEINSNYGWAIWSEDNYAQYDMCLAELGQNPDSRRGIMIYTRPSMQFDYNKDGMSDFMCTNTVQYLIRDKKINAVVNMRSNDVVFGFRNDYAWQKYVLDKLVSDLNAGDSTRQYKAGSIIWNVGSLHVYSRHFYLVDHWWKTGETHISKKDYVGKYA

SEQ ID NO: 17668 - DNA, 1560 bp, Arabidopsis thaliana
  CDS (1)..(1560)
atggcaacaactactctcaatgacagtgtcaccactacacttgcttcagagcctcaaaggacttaccaagttgttgttgctgcaactaaagaaatgggtattggtaaagatgggaaattgccatggaatttgccaacagatctcaagttctttaaagacattactttgaccacttcagattcctctaagaaaaatgctgttgtgatgggtagaaagacttgggagtctattcccattaagtataggccgctttcgggtcggcttaacgttgttctaactcgttctggtgggtttgatatagccaacactgagaatgttgtcacttgtagtagtgtagattctgctcttgatttgttagctgcgccgccgtattgtttatctattgagagggtttttgttataggaggtggtgacatattgagggaagcattgaataggcctagttgtgatgctatccatttaactgagattgatacaagtgttgactgtgatacgtttatacctgcgattgatacttctgtttatcagccttggtcttcatcgtttccagtaactgaaaatggacttcggttttgcttcacgacttttgtccgtgtaaagagttctgctgatgaatcttctgatgaaagcaatgggtcacagtctcttcaatttgatgggaagaagtttttgtttcttcctaagatggtttttgatcagcatgaggagtttctgtatttgaatatggttgaagatattatctctaatggcaatgtgaagaatgataggaccgggactggtacattatcaaaatttggttgccagatgaaattcaatttacgcagaagttttccacttctgacaacaaagcgagttttctggagaggtgttgttgaggaacttctatggttcataagcggttcaaccaatgcaaaagtccttcaggaaaaaggtatccatatatgggatgggaatgcgtcaagagagtatctcgatggtatcggcctgacagagagagaggaaggcgaccttggacctgtatacggatttcaatggcgacactttggtgctaagtacacagatatgcatgctgattatactggtcaaggatttgatcaacttgtagatgtaattgacaaaatcaagaacaatcctgatgatcggcgtattataatgtcagcttggaatccttctgatcttaagctgatggcacttcctccatgccatatgtttgcacaattttatgtggcagaaggggaactctcatgtcaaatgtatcagcgttcagcagatatgggccttggtgtgccgtttaacattgcttcttactctcttcttacttgcatgctggctcatgtgtgtgatcttgttcctggtgattttatccatgttcttggggatgctcatgtatacaaaactcacgtgaggcctctgcaagagcaacttctgaatcttccaaaaccctttcctgtaatgaagataaacccggagaagaaacaaatcgattcttttgtggcttctgactttgacctcacaggctatgatcctcacaagaagatagaaatgaaaatggcggtttag

SEQ ID NO: 17669 - protein, 519 aa, Arabidopsis thaliana
MATTTLNDSVTTTLASEPQRTYQVVVAATKEMGIGKDGKLPWNLPTDLKFFKDITLTTSDSSKKNAVVMGRKTWESIPIKYRPLSGRLNVVLTRSGGFDIANTENVVTCSSVDSALDLLAAPPYCLSIERVFVIGGGDILREALNRPSCDAIHLTEIDTSVDCDTFIPAIDTSVYQPWSSSFPVTENGLRFCFTTFVRVKSSADESSDESNGSQSLQFDGKKFLFLPKMVFDQHEEFLYLNMVEDIISNGNVKNDRTGTGTLSKFGCQMKFNLRRSFPLLTTKRVFWRGVVEELLWFISGSTNAKVLQEKGIHIWDGNASREYLDGIGLTEREEGDLGPVYGFQWRHFGAKYTDMHADYTGQGFDQLVDVIDKIKNNPDDRRIIMSAWNPSDLKLMALPPCHMFAQFYVAEGELSCQMYQRSADMGLGVPFNIASYSLLTCMLAHVCDLVPGDFIHVLGDAHVYKTHVRPLQEQLLNLPKPFPVMKINPEKKQIDSFVASDFDLTGYDPHKKIEMKMAV

SEQ ID NO: 17670 - DNA, 1557 bp, Arabidopsis thaliana
  CDS (1)..(1557)
atggcaaacactctcaatggaaatgtgatcatgacttcaaagcctcagagtacttaccaagttgtggtagctgcaaccaaggaaatgggtattggtaaagacggaaaacttccatggaatttgcctaccgatctcaagttcttcaaggatttaactttgtccacttcggattctgctaagaagaacgctgttgttatgggtaggaaaacgtgggagtctattcccaaaaagtataggccactctctggtcgcctgaatgttgtcttgtctcgttctagcggtttcgatatagccaacactgaaaatgttgtaacttgcagtagcatagattctgctctagacttattagctgcacctccgtttagtctgtccattgagaaagtgtttgtaataggaggtggcgacatattgagggaagctttgaataaaccgagctgtgaagccatccacataactgagattgatacaagtatcgactgtgatacatttattcccacggttgacacttctgcatatcagccttggtgttcgtcgtttccaatatgtgaaaatggtcttcgattttccttcacgactcatgttcgtgtaaagagttcttctgccggtgaagcctctgatgagagtgatgggtcaaaggttcttcaagttgattggaagaagttttcttctgttcttcctaaaatgatttttgaccggcatgaggaatatctctacttaaatctggtcaaagagataatctcaaatggaaacttaaaagacgataggacagggactggtacattatctaaatttggttgtcagatgaaattcaatttacgcaggaattttccacttctgacgacaaagagagttttctggagaggtgttgttgaggaacttctatggttcataagcggttcaaccaatgcaaaggtacttcaagaaaagggtatccgtatatgggatgggaatgcgtcgagagcatatcttgatggtattggactgactgagagagaggaaggtgaccttggacccgtttatggatttcagtggagacactttggtgctaagtacacagatatgcatgctgattatactggccaaggatttgatcagctcttagatgtaattaacaagatcaagaacaatcctgatgatcgacggattataatgtcagcttggaatccttctgatcttaagctgatggcacttcctccatgccacatgtttgcacagttttatgttgcaaatggagaactttcatgtcaaatgtatcagcgttcagccgatatgggtctcggcgtaccgtttaacattgcctcatactcccttcttacatgcattcttgctcacgtctgcgatcttgttcctggtgattttatccatgtgattggagatgctcatgtttacaaaaaccatgtcaggcctctgcaagagcaacttgagaacccaccaaaaccttttcctgttttgaagataaatccagagaagaaagatatagattcttttgttgcggatgactttgagctcattggctatgatcctcacaagaaaatagatatgaaaatggctgtttag

SEQ ID NO: 17671 - protein, 518 aa, Arabidopsis thaliana
MANTLNGNVIMTSKPQSTYQVVVAATKEMGIGKDGKLPWNLPTDLKFFKDLTLSTSDSAKKNAVVMGRKTWESIPKKYRPLSGRLNVVLSRSSGFDIANTENVVTCSSIDSALDLLAAPPFSLSIEKVFVIGGGDILREALNKPSCEAIHITEIDTSIDCDTFIPTVDTSAYQPWCSSFPICENGLRFSFTTHVRVKSSSAGEASDESDGSKVLQVDWKKFSSVLPKMIFDRHEEYLYLNLVKEIISNGNLKDDRTGTGTLSKFGCQMKFNLRRNFPLLTTKRVFWRGVVEELLWFISGSTNAKVLQEKGIRIWDGNASRAYLDGIGLTEREEGDLGPVYGFQWRHFGAKYTDMHADYTGQGFDQLLDVINKIKNNPDDRRIIMSAWNPSDLKLMALPPCHMFAQFYVANGELSCQMYQRSADMGLGVPFNIASYSLLTCILAHVCDLVPGDFIHVIGDAHVYKNHVRPLQEQLENPPKPFPVLKINPEKKDIDSFVADDFELIGYDPHKKIDMKMAV

SEQ ID NO: 17672 - DNA, 1548 bp, Crithidia fasciculata
  CDS (1)..(1548)
atgtcacgcgcagctgccaagttcaagatcccgatgccggtcaccaaggccgacttcgccttcccctccctccgcgccttcagcatcgtcgtcgcggccgatcagcagcacggtattggcgacggcgagacgattccgtggacggtgccggagacactggccttcttcaaggaccagacgacgctgctgcgcaacaagaagcccccgacggagaagaagcgcaacgctgtggtgatgggccgcaagacgtgggaagtgccgctcaagttccgtcctctcaagggtcgcctgaacgtggtgctctcctgcaggcgaccggtggacgaccttctggcgcagctgccagaggagaagcgcgctgccgccgctgccgatgtcgtgatcaacggtgggctgaaggaggccctgcacctgctggctcgtccgccgtactgcagttcgattgagacggcgtactgcatcggcggcgcgcgggtctacacagaggcgatgcagtccccgtgtgtggagaagttgaaggaggtgtacctgacccgcgtgcacacggcgccgacgtgcaaccgcttctacgagttcgtacggcggagaagagcgcgcgcagcagtggacctggagtccacctctggcgtgaaggtgagcgacgcagcggcacacctgtcgtatgagattatgaagtacgtgccacacaacgctgaggagcggcagtacctggagctcatcgaccgcatcatgaagaccgggctggtgaaggaggaccgcaccggcgtcggcaccatcagcctcttcggcgcgcagatgttctcgctgcgggacaaccagctgccgctgctgacgacgaagcgcgtcttctggcgtggcgtctgcgaagagctcatctggttcctccgtggcgagacaaacgcgcacgtgctggcagacaaggacattcacatctgggacggcaacggctcccgcgagttcctcgacagccgtgggctaacggagaacaaagagatggaccttgggccggtgtacggctttcagtggcgacacttcggggcagactacaaaggcttcgacgcgaattacgacgagggcgtggatcagatcaagacgattgttgagaccctcaagacgaacgaccgccgtctgctcgttacggcgtggaacccgtgcgcgctgcacaagatggccgtgcggccctgccacctcctcggccagttctatgtgaacacgcagacgaaggagctgtcctgcatgctgtaccagcgctgctgcgacatgggtctcggcgtgcccttcaacatcgcgtcgtacgccttgctgacgattctgattgccaaggcgaccgggctgcgtcctggagagctcgtgcacaccctcggtaccgcgcatgtgtacagcaaccacgtggaggcgctgaaggagcagctgcagcgggtgcccgtggccttccccgtgctcgtcttcaagaaggagcgcgagtttttggaggactacgagtcgacggacatggaggtggtcgactacgtgccctacccgcccatcaagatggagatggctgtctaa

SEQ ID NO: 17673 - protein, 515 aa, Crithidia fasciculata
MSRAAAKFKIPMPVTKADFAFPSLRAFSIVVAADQQHGIGDGETIPWTVPETLAFFKDQTTLLRNKKPPTEKKRNAVVMGRKTWEVPLKFRPLKGRLNVVLSCRRPVDDLLAQLPEEKRAAAAADVVINGGLKEALHLLARPPYCSSIETAYCIGGARVYTEAMQSPCVEKLKEVYLTRVHTAPTCNRFYEFVRRRRARAAVDLESTSGVKVSDAAAHLSYEIMKYVPHNAEERQYLELIDRIMKTGLVKEDRTGVGTISLFGAQMFSLRDNQLPLLTTKRVFWRGVCEELIWFLRGETNAHVLADKDIHIWDGNGSREFLDSRGLTENKEMDLGPVYGFQWRHFGADYKGFDANYDEGVDQIKTIVETLKTNDRRLLVTAWNPCALHKMAVRPCHLLGQFYVNTQTKELSCMLYQRCCDMGLGVPFNIASYALLTILIAKATGLRPGELVHTLGTAHVYSNHVEALKEQLQRVPVAFPVLVFKKEREFLEDYESTDMEVVDYVPYPPIKMEMAV

SEQ ID NO: 17674 - DNA, 1587 bp, Daucus carota
  CDS (1)..(1587)
atggctagcgaactgctcgcaaatcctactaatggaagtggcattacacgccctgatccacaaagaacttatcaggttgtggttgctgcaacccaaaatatgggtatcggtaaggatggtaaattgccctggaggttaccttctgacatgaaatttttcaaggatgtcaccatgactacatcagatcctttgaaaaggaatgcagtcataatgggtaggaaaacttgggaaagtattcccattcaacatcgccctctgccaggacgtcttaatgttgttttgactcgttctgggagttttgatattgcaactgtcgaaaatgtcgtaatatgtggtagcatgatttctgctttggaattattagcaggatctccttattgtgtttcagttgagaaggtttttgtcattgggggtggccagatatatagggaagctctcaatgctcctggatgtgatgcagtccacatcactgaaattgaagaacacatagaatgtgataccttcattcctcttctcgatgaatcagtttttcagccatggtactcatcattcccattggtggagaacaaaattcgttattgtttcacgacttatgttcgtgtgaggaattctgttgcggagctcacaagtcagaccaacggctgttcatctgatagtaaatcagattctggtaattttgaaattcagaatttctcttttcttcccaagacagtttttgagaaacatgaggagtatttgtatctgggattggttgagaatatcatttctaatggtgtgacaaagaatgataggacacgtactggtactgtctctatatttggttgccagatgcggtttaatttgcgcaaatcttttccactcctcacaactaagaaagtgttttggaggggagttgttgaggaactactgtggttcattagtggctcaactaatgctaagattctaaaagagaagggcgttaatatttgggaaggcaatggatcaagggagtatcttgacagtattggtttgacggatagagaagaaggtgacttggggcctatatatggttttcagtggagacactttggtgcaaggtatactgatatgcatgctgactactcaggccagggatttgatcagttgctagatgttatttcaaagataaaaaataatcctgatgataggaggatcattcaatcagcttggaatccatctgatctcaggctaatggcacttccaccctgtcacatgtttgcacagttctatgtagccaatggcgagttatcttgtcaaatgtatcagcgctctgctgatatgggtctcggtgttccattcaacattgcagcatatgcacttttgacatgcatgattgctcatgtttgtgacctggttcctggagactttgttcattctattggtgatgctcatgtctactcgaaccacctgtcagacctcttcgagaccagcttcagaatgttgcctaagacctttccggttttgaagatcaattctggagaaaaggacattgactcatttgaggctgctgatttcaaactcattggttatgatccgcaccagaaaatcgaaatgaaaatggcagtataa

SEQ ID NO: 17675 - protein, 528 aa, Daucus carota
MASELLANPTNGSGITRPDPQRTYQVVVAATQNMGIGKDGKLPWRLPSDMKFFKDVTMTTSDPLKRNAVIMGRKTWESIPIQHRPLPGRLNVVLTRSGSFDIATVENVVICGSMISALELLAGSPYCVSVEKVFVIGGGQIYREALNAPGCDAVHITEIEEHIECDTFIPLLDESVFQPWYSSFPLVENKIRYCFTTYVRVRNSVAELTSQTNGCSSDSKSDSGNFEIQNFSFLPKTVFEKHEEYLYLGLVENIISNGVTKNDRTRTGTVSIFGCQMRFNLRKSFPLLTTKKVFWRGVVEELLWFISGSTNAKILKEKGVNIWEGNGSREYLDSIGLTDREEGDLGPIYGFQWRHFGARYTDMHADYSGQGFDQLLDVISKIKNNPDDRRIIQSAWNPSDLRLMALPPCHMFAQFYVANGELSCQMYQRSADMGLGVPFNIAAYALLTCMIAHVCDLVPGDFVHSIGDAHVYSNHLSDLFETSFRMLPKTFPVLKINSGEKDIDSFEAADFKLIGYDPHQKIEMKMAV

SEQ ID NO: 17676 - DNA, 1563 bp, Leishmania amazonensis
  CDS (1)..(1563)
atgtccagggcggctgcgaagttcaagattccgatgccggtgacgaaggcggacttcgccttcccctccctgcgcgccttctccatcgtcgtggccctcgataagcagcacggcatcggcgacggcgagtcgatcccgtggcgggtgccggaggacatggcgttcttcaaggaccagacgacgctgctgcgcaacaagaagccgccgacggacaagaagcgcaacgccgtcgtgatggggcgcaagacgtgggagagcgttccggtaaagttccggccactcaagggccggctgaacgttgtgttgtcctcgaaggccaccgtcgaggagcttctggcgccactgccggaggaaaagcgcgcggcggcggcgcaggacattgtggtggtgaacggcggtctggccgcggccgtccgcctcctcgcacgtccgccgtactgcagctccatcgagacggcgtactgcgtcggcggtgcgcaggtgtatgcggacgccatgctgtcgccatgcgtcgagaagctgcaggaggtgtacctgacccgcatccacacgacggcgcctgcgtgcacgcgcttcttcccgtttcctcccgagaacgccgccacggcgtgggacctggcgtcgtctcagggacgccgcaagagcgcggtggacggcctcgagttcgagatttgcaagtacgtgccgcgcaaccacgaggagcggcagtaccttgagctgattgaccgcatcatgaagacggggatcgcgaaggaggaccgcaccggcgtgggcaccttgagcctcttcggcgcacagatgcggttctccctacgcgacaaccgcctgccactgctgacgacgaagcgcgtcttctggcgaggcgtgtgcgaggagttgctgtggttcctgcgcggggagacaaacgcgcagctgctcgcggacaaggacatacacatctgggacggcaacggctcgcgcgagtttctcgacagccgcggcttgacagagaatacggagatggacctcggccctgtctacggcttccagtggcgccacttcggggcagaataccgggggctcgaagcgaactacgacggcgagggggtggaccagatcaagttcatcgtggagacgatcaaggcgaacccgaacgaccgccgtctcctgttcactgcgtggaacccgtgcgcgctgcacaagatggcactgccgccgtgccacttgctcgctcaattctacgtgaacacggagaagagcgagctatcctgcatgctgtaccaacgttcgtgcgacatgggcctcggcgtccccttcaacatcgcctcctacgcgctgctcaccatcctcattgccaaggcgacgggtctgcggcctggtgagcttgtgcacaccctcggcgacgcccacgtctaccgcagccacatcgatgccctcaaggcgcagctcgagcgagtcccgcacgcgttcccgaccctcgtgttcaaggaggagcggcagttcctcgaggactacgagttgatggacatggaggtgatcgactacgtgccgcacccgccgatcaagatggagatggccgtatag

SEQ ID NO: 17677 - protein, 520 aa, Leishmania amazonensis
MSRAAAKFKIPMPVTKADFAFPSLRAFSIVVALDKQHGIGDGESIPWRVPEDMAFFKDQTTLLRNKKPPTDKKRNAVVMGRKTWESVPVKFRPLKGRLNVVLSSKATVEELLAPLPEEKRAAAAQDIVVVNGGLAAAVRLLARPPYCSSIETAYCVGGAQVYADAMLSPCVEKLQEVYLTRIHTTAPACTRFFPFPPENAATAWDLASSQGRRKSAVDGLEFEICKYVPRNHEERQYLELIDRIMKTGIAKEDRTGVGTLSLFGAQMRFSLRDNRLPLLTTKRVFWRGVCEELLWFLRGETNAQLLADKDIHIWDGNGSREFLDSRGLTENTEMDLGPVYGFQWRHFGAEYRGLEANYDGEGVDQIKFIVETIKANPNDRRLLFTAWNPCALHKMALPPCHLLAQFYVNTEKSELSCMLYQRSCDMGLGVPFNIASYALLTILIAKATGLRPGELVHTLGDAHVYRSHIDALKAQLERVPHAFPTLVFKEERQFLEDYELMDMEVIDYVPHPPIKMEMAV

SEQ ID NO: 17678 - DNA, 1563 bp, Leishmania major
  CDS (1)..(1563)
atgtccagggcagctgcgaggtttaagattccgatgccggagacgaaggcagactttgctttcccctccctgcgcgccttctccatcgtcgtggccctcgatatgcagcacggcatcggcgacggcgagtcgatcccgtggcgggtgccggaggacatgacgttcttcaagaaccagacgacgctgctgcgcaacaagaagccgccgacggagaagaagcgcaacgccgtcgtgatgggccgcaagacttgggagagcgtcccggtaaagttccgaccactcaagggacggctgaacatcgtgttatcctcgaaggccaccgtcgaggagcttctggcgccgctgccggagggacagcgcgcggcggcggcgcaggatgtggtggtggtgaacggcggtctggccgaggcgctccgcctcctcgcacgcccgctgtactgcagctccatcgagacagcgtattgcgtcggtggtgcgcaggtttacgcggacgccatgctgtcgccgtgcatcgagaaactgcaggaagtgtacctgacccgcatctacgcgacggcgcctgcgtgtacgcgcttctttccgtttccgcccgagaacgcggccacggcgtgggacctggcgtcgtctcagggacgccgcaagagcgaggcggagggcctcgagttcgagatctgcaagtacgtgccgcgcaaccacgaggagcggcagtaccttgagctgattgaccgcatcatgaagacggggatcgtgaaggaggaccgcaccggcgtgggcaccatcagcctcttcggcgcccagatgcgcttctccctacgcgacaaccgcctgccgctgctgacgacgaagcgtgtcttctggcgcggcgtgtgcgaggagctgctgtggttcctgcgcggggagacgagtgcgcagctgctggcagacaaggacattcacatctgggacggcaacggttcgcgcgagtttctcgacagccgcggcttgacagagaataaggagatggacctcggccctgtctacggcttccagtggcgccacttcggggcagattacaaggggtttgaagcgaactacgacggcgaaggggtggaccagatcaagctcatcgtggagaccatcaagacgaacccgaacgaccgccgcctcctagtcactgcctggaacccgtgcgcgctgcaaaagatggcgctgccgccgtgccacttgcttgctcagttctacgtgaacacagacacgagcgagctatcctgcatgttgtaccagcgctcgtgtgacatgggtcttggcgtccccttcaacattgcctcctacgcgctgctcaccatcctcattgccaaggcgacgggtctgcggcctggtgagcttgtgcacaccctcggcgacgcccacgtctaccgcaaccacgttgatgccctcaaggcgcagctcgagcgagtcccgcacgcgttcccgaccctcatcttcaaggaggagcggcagtacctcgaggactacgagttgacggacatggaggtgatcgactacgttccacacccggcgatcaagatggagatggccgtatag

SEQ ID NO: 17679 - protein, 520 aa, Leishmania major
MSRAAARFKIPMPETKADFAFPSLRAFSIVVALDMQHGIGDGESIPWRVPEDMTFFKNQTTLLRNKKPPTEKKRNAVVMGRKTWESVPVKFRPLKGRLNIVLSSKATVEELLAPLPEGQRAAAAQDVVVVNGGLAEALRLLARPLYCSSIETAYCVGGAQVYADAMLSPCIEKLQEVYLTRIYATAPACTRFFPFPPENAATAWDLASSQGRRKSEAEGLEFEICKYVPRNHEERQYLELIDRIMKTGIVKEDRTGVGTISLFGAQMRFSLRDNRLPLLTTKRVFWRGVCEELLWFLRGETSAQLLADKDIHIWDGNGSREFLDSRGLTENKEMDLGPVYGFQWRHFGADYKGFEANYDGEGVDQIKLIVETIKTNPNDRRLLVTAWNPCALQKMALPPCHLLAQFYVNTDTSELSCMLYQRSCDMGLGVPFNIASYALLTILIAKATGLRPGELVHTLGDAHVYRNHVDALKAQLERVPHAFPTLIFKEERQYLEDYELTDMEVIDYVPHPAIKMEMAV

SEQ ID NO: 17680 - DNA, 1566 bp, Zea mays
  CDS (1)..(1566)
atggccgcagttctagccaatggtgattcacagggtcgtcctcagaggaactatcaagttgttgttgctggcactcgtgacatgggcattgggaaggatggggtcttgccatggaagcttcctggtgatcttaaattctttaaagagcttacactaactacatctgatcctgtcaaaaagaatgcagttataatgggaaggaaaacatgggagagcattccggttaagtcaaggccattgcctggtcgtttgaatgtcatacttactcgatctggtagttttgattttgcaacagtagagaatgttgttatctgtggaagtatggagtctgccttagaactgctagcatcaactccatattgcttatcaattgagaaagtgtttgttataggaggcgggcaggtactgagagaatatcttaaaggacctgcatgtgaggctatccatctaactgacattcagtcaagcattgagtgtgacactttcatccctccggttgacttctcagtgttccagccatggtattcatctttcccggtgatagagagcaacattaggcattcgtttgtgtcttttgttcgtgttagaaagtcagtggcagaaactcatgagtcaaatggcaaggaatcaaccgaggttgataccaagaatgacaaatttgaaacagagaatttctcttttctccccaagatggtatatgaccgccatgaggagtaccaatatctcaatcttgttgaagatattataaggtctggtgctcagaaaaacgacaggacaggaactggaacattgtcaaaatttgggtgtcagatgcggttcaacttaaggaaaaattttcctctgctgacaacaaagagggtattttggcgtggtgttgtcgaagaactcctttggttcatcagtggctcaacaaatgcaaaggttttgcaagagaagggtattcatatctgggatggcaatgcttcaagagagtatctcaacagtgttggcttggcacacagggaggaaggtgatttaggtccaatttatggatttcagtggcgtcactttggtgctgaatacactgacatgcatgctgactatacgggaaaaggttttgatcagctaatggatgtgattgacaagatcaagaatgatcctgaggaccgtcgaataattttgtcggcgtggaatccttcagatctcaagaagatggctcttcctccttgccacatgtttgcacaattctatgtggaaaatggggagctatcttgccagatgtatcaacgctctgcagacatggggcttggtgttccattcaacatcgcatcatattctctcctgacatacatgattgctcaagtttgtgatctttctcctggagattttgtccatgttataggggatgcccatgtctatagaaaccatgttcgagcactggaggagcaaattcagaagatgcctaaaccatttccaattttgaagataaatccttcaaaaaaggatatagattcttttatggcatcagacttcaagctggttggctatgatccccaccagaagatagagatgaaaatggcagtgtaa

SEQ ID NO: 17681 - protein, 521 aa, Zea mays
MAAVLANGDSQGRPQRNYQVVVAGTRDMGIGKDGVLPWKLPGDLKFFKELTLTTSDPVKKNAVIMGRKTWESIPVKSRPLPGRLNVILTRSGSFDFATVENVVICGSMESALELLASTPYCLSIEKVFVIGGGQVLREYLKGPACEAIHLTDIQSSIECDTFIPPVDFSVFQPWYSSFPVIESNIRHSFVSFVRVRKSVAETHESNGKESTEVDTKNDKFETENFSFLPKMVYDRHEEYQYLNLVEDIIRSGAQKNDRTGTGTLSKFGCQMRFNLRKNFPLLTTKRVFWRGVVEELLWFISGSTNAKVLQEKGIHIWDGNASREYLNSVGLAHREEGDLGPIYGFQWRHFGAEYTDMHADYTGKGFDQLMDVIDKIKNDPEDRRIILSAWNPSDLKKMALPPCHMFAQFYVENGELSCQMYQRSADMGLGVPFNIASYSLLTYMIAQVCDLSPGDFVHVIGDAHVYRNHVRALEEQIQKMPKPFPILKINPSKKDIDSFMASDFKLVGYDPHQKIEMKMAV

SEQ ID NO: 17682 - DNA, 1389 bp, Paramecium tetraurelia
  CDS (1)..(1389): transl_table=6
atgactactaataaaacatttagtatggtattagcaatgactctcaatggaggcatagggtattagaatagattgccttggaaattaaaggaagatcttcagagattcaagaaaatcacaacaggcgggattgtgataatgggaagaaagacattcgaatcgatgaactctaaacctctaccaaacagagtgaatgtagtgatttcaaaaaatatgaaatcatctaatgaagttcaagtgtttcctagaatagaagatgcattacaattttacaatacatctcatcagaaattatatttaataggaggaaagagaatctttgaagaaggtttagcaactgataaatgttcagatgttcatttgactagaataggagtagaaactaagtgcgatgtgtatttgaacaaaaatattttctctacattttaagtgaataagacaagttaaactaaaagtgaaaatgggatcaattatgattatcaacatttaattaataagaattctcacgaacaatcatatatagatgaagaacattaagaaaatcaatatttagatatgataacaaaaataatgaaggagggagtctcaaaggatgacagaactggagtaggtaccatgtctatttttgggtaaactatgagatttaatttggcctaatcctttcctttattaacaacaaagaaagtattctttcgtggagttgttgaggaattgctatggtttttaagagggaatacaaatggtaaattacttttggataagggagttaagatatgggaaggaaatggcacccgagaatatttggataccattggtttataacatagataggaacatgacttaggaccagtctatggatttcaatggagacattttggagctaaatataaggattgttagactgattattccaattaaggagtggattaagtgaaggagattatacaattactgaaaaacaatccagatagtagaagaataatattatcagcttggaatccaattgatttaaaataaatggcattgccaccatgtcatgtgatgtcataattctttgtggcaaatggcaaattgagttgcatgatgtattagagatcatgtgactttggtttgggaattcccttcaatattgctagttatgcattgctcacttacatgttggcaaaggaatgcaatttgaatttgggagaatttgttcatgttttaggagatactcatatttatagtaatcatgtggaggctttaaagaaataaattgagagggttccttatcctttcccacttctgaaaatcaagggtaataagagtttgtttgattacacttatgaagattttgaattggttggatataatgctcatgataaaatagaaatgaaaatggctgtttga

SEQ ID NO: 17683 - protein, 462 aa, Paramecium tetraurelia
MTTNKTFSMVLAMTLNGGIGYQNRLPWKLKEDLQRFKKITTGGIVIMGRKTFESMNSKPLPNRVNVVISKNMKSSNEVQVFPRIEDALQFYNTSHQKLYLIGGKRIFEEGLATDKCSDVHLTRIGVETKCDVYLNKNIFSTFQVNKTSQTKSENGINYDYQHLINKNSHEQSYIDEEHQENQYLDMITKIMKEGVSKDDRTGVGTMSIFGQTMRFNLAQSFPLLTTKKVFFRGVVEELLWFLRGNTNGKLLLDKGVKIWEGNGTREYLDTIGLQHRQEHDLGPVYGFQWRHFGAKYKDCQTDYSNQGVDQVKEIIQLLKNNPDSRRIILSAWNPIDLKQMALPPCHVMSQFFVANGKLSCMMYQRSCDFGLGIPFNIASYALLTYMLAKECNLNLGEFVHVLGDTHIYSNHVEALKKQIERVPYPFPLLKIKGNKSLFDYTYEDFELVGYNAHDKIEMKMAV

SEQ ID NO: 17684 - DNA, 1752 bp, Plasmodium chabaudi
  CDS (1)..(1752)
atggaagatatctctgaaatattcgatatatatgcaatttgtgcatgttgtaaagttctgaacagtaatgaaaaggctggctgttttagtaataagacttttaagggacttgggaatgaaggggggttaccttggaaatgtaattcagtagatatgaaacattttagctctgtaacatcctatgttaatgaaactaactatatgagattaaaatggaaaagggatagatatatggaaaaaaataatgtaaaattaaatactgatggaataccctccgttgataagttacaaaatattgtagtaatgggaaaagcaagttgggaaagcatcccctcaaaatttaagccattacaaaatcgaataaatattatattgtctagaacattgaaaaaagaagatcttgcaaaagaatataataatgttattataattaatagtgtggatgatttatttcctattttaaaatgcataaaatattataaatgttttattataggaggtgcatctgtttataaagagtttttagatcgtaatttaataaaaaaaatatattttacaagaataaataatgcttatacttgtgatgttttatttccagatatcaatgaagatttatttaaaataacatcaattagtgatgtatatagtagtaataacacgactttagattttgtaatttatagtaagacaaaagaaatacatgaagaaattaatcccaacgatgaactatttaataacacatttttaggtgtgtgtgatgaaaaaaatacaaattttgatgatgaagatgattatacatatttcagttttaataaacataaagataatattaaaaaaaattcggagcatgctcatcattttaaaatatataatagtataaaatataaacatcatcctgaatatcaatatttaaatattatatatgatataataatgcatggaaataaacaagatgatagaacaggtgttggtgtattaagtaaatttggatatatgatgaaatttaatttaagtgaatattttccattattaacaacaaaaaaattatttgtaagaggtatcattgaagagttgttatggtttataaggggagaaacaaatggaaatacattattagaaaaaaatgtaagaatatgggaagctaatgggacaagagagtttttagataataggaaattatttcatagagaagttaatgacttaggtccaatttacggatttcaatggaggcactttggtgctgaatatacagatatgcatgctgattataaagataaaggtgttgatcaactaaaaaatattataaatttaattaaaaacgatccgacatgtagacgaattattttatgtgcatggaatgtaaaagatttagatcaaatggcattacctccttgtcatattttatgtcaattttatgtttttgatggaaaattatcatgtattatgtatcaaagatcttgtgatttaggtcttggtgttccattcaatattgcttcctattctatatttacatatatgatagcacaagtatgtaatttacaaccagctgaatttatacatgtattgggaaatgctcatgtttataataatcatgttgaaagcttaaaagttcagttaaatagaacaccctatcctttccctactcttaaattaaatccggaaattaaaaatatcgaggattttacaatttcagattttactgtacaaaattatgtccatcacgataaaatcagtatggatatggcagcttaa

SEQ ID NO: 17685 - protein, 583 aa, Plasmodium chabaudi
MEDISEIFDIYAICACCKVLNSNEKAGCFSNKTFKGLGNEGGLPWKCNSVDMKHFSSVTSYVNETNYMRLKWKRDRYMEKNNVKLNTDGIPSVDKLQNIVVMGKASWESIPSKFKPLQNRINIILSRTLKKEDLAKEYNNVIIINSVDDLFPILKCIKYYKCFIIGGASVYKEFLDRNLIKKIYFTRINNAYTCDVLFPDINEDLFKITSISDVYSSNNTTLDFVIYSKTKEIHEEINPNDELFNNTFLGVCDEKNTNFDDEDDYTYFSFNKHKDNIKKNSEHAHHFKIYNSIKYKHHPEYQYLNIIYDIIMHGNKQDDRTGVGVLSKFGYMMKFNLSEYFPLLTTKKLFVRGIIEELLWFIRGETNGNTLLEKNVRIWEANGTREFLDNRKLFHREVNDLGPIYGFQWRHFGAEYTDMHADYKDKGVDQLKNIINLIKNDPTCRRIILCAWNVKDLDQMALPPCHILCQFYVFDGKLSCIMYQRSCDLGLGVPFNIASYSIFTYMIAQVCNLQPAEFIHVLGNAHVYNNHVESLKVQLNRTPYPFPTLKLNPEIKNIEDFTISDFTVQNYVHHDKISMDMAA

SEQ ID NO: 17686 - DNA, 1827 bp, Plasmodium falciparum
  CDS (1)..(1827)
atgatggaacaagtctgcgacgttttcgatatttatgccatatgtgcatgttgtaaggttgaaagcaaaaatgaggggaaaaaaaatgaggtttttaataactacacatttagaggtctaggaaataaaggagtattaccatggaaatgtaattccctagatatgaaatattttcgtgcagttacaacatatgtgaatgaatcaaaatatgaaaaattgaaatataagagatgtaaatatttaaacaaagaaactgtggataatgtaaatgatatgcctaattctaaaaaattacaaaatgttgtagttatgggaagaacaaactgggaaagcattccaaaaaaatttaaacctttaagcaataggataaatgttatattgtctagaaccttaaaaaaagaagattttgatgaagatgtttatatcattaacaaagttgaagatctaatagttttacttgggaaattaaattactataaatgttttattataggaggttccgttgtttatcaagaatttttagaaaagaaattaataaaaaaaatatattttactagaataaatagtacatatgaatgtgatgtattttttccagaaataaatgaaaatgagtatcaaattatttctgttagcgatgtatatactagtaacaatacaacattggattttatcatttataagaaaacgaataataaaatgttaaatgaacaaaattgtataaaaggagaagaaaaaaataatgatatgcctttaaagaatgatgacaaagatacatgtcatatgaaaaaattaacagaattttacaaaaatgtagacaaatataaaattaattatgaaaatgatgatgatgatgaagaagaagatgattttgtttattttaattttaataaagaaaaagaagagaaaaataaaaattctatacatccaaatgattttcaaatatataatagcttgaaatataaatatcatcctgaataccaatatttaaatattatttatgatattatgatgaatggaaataaacaaagtgatcgaacgggagtaggtgttttaagtaaattcggatatattatgaaatttgatttaagtcaatatttcccattattaactacgaagaaattatttttaagaggaattattgaagaattgctttggtttattagaggagaaacaaatggtaatacgttgttaaataagaatgtaaggatatgggaagctaatggtactagggaatttttagataatagaaaattatttcatagagaagttaacgatttaggacctatttatggttttcaatggagacatttcggtgctgaatatacaaatatgtatgataattatgaaaataaaggagtggatcaattaaaaaatataataaatttaattaaaaatgatcctacaagtagaagaattcttttgtgtgcatggaatgtaaaagatcttgaccaaatggcattacctccttgtcatattttatgtcagttttatgttttcgatgggaaattatcatgtattatgtatcaaagatcatgtgatttagggctaggagtaccttttaatattgcttcttattctatttttactcatatgattgcacaagtctgtaatttgcaacctgcgcagttcatacacgttttaggaaatgcacatgtttataataatcacattgatagtttaaaaattcaacttaacagaataccctatccattcccaacacttaaattaaatccagatattaaaaatattgaagattttacaatttcggattttacaatacaaaattatgttcatcatgaaaaaatttcaatggatatggctgcttaa

SEQ ID NO: 17687 - protein, 608 aa, Plasmodium falciparum
MMEQVCDVFDIYAICACCKVESKNEGKKNEVFNNYTFRGLGNKGVLPWKCNSLDMKYFRAVTTYVNESKYEKLKYKRCKYLNKETVDNVNDMPNSKKLQNVVVMGRTNWESIPKKFKPLSNRINVILSRTLKKEDFDEDVYIINKVEDLIVLLGKLNYYKCFIIGGSVVYQEFLEKKLIKKIYFTRINSTYECDVFFPEINENEYQIISVSDVYTSNNTTLDFIIYKKTNNKMLNEQNCIKGEEKNNDMPLKNDDKDTCHMKKLTEFYKNVDKYKINYENDDDDEEEDDFVYFNFNKEKEEKNKNSIHPNDFQIYNSLKYKYHPEYQYLNIIYDIMMNGNKQSDRTGVGVLSKFGYIMKFDLSQYFPLLTTKKLFLRGIIEELLWFIRGETNGNTLLNKNVRIWEANGTREFLDNRKLFHREVNDLGPIYGFQWRHFGAEYTNMYDNYENKGVDQLKNIINLIKNDPTSRRILLCAWNVKDLDQMALPPCHILCQFYVFDGKLSCIMYQRSCDLGLGVPFNIASYSIFTHMIAQVCNLQPAQFIHVLGNAHVYNNHIDSLKIQLNRIPYPFPTLKLNPDIKNIEDFTISDFTIQNYVHHEKISMDMAA

SEQ ID NO: 17688 - DNA, 1872 bp, Plasmodium vivax
  CDS (1)..(1872)
atggaggacctttcagatgtatttgacatttacgccatctgcgcatgctgcaaggtcgcccccaccagtgaagggacaaagaatgaaccgttcagcccgcggacctttaggggtctgggcaataaggggactctcccatggaaatgcaactccgtcgatatgaagtacttcagctcggtgacgacctacgtggatgagtcaaagtatgagaagctaaagtggaagagggagaggtacctacgaatggaagcctcacagggggggggtgacaacacaagcggtggtgacaacacacacggtggtgacaacgccgacaagctgcaaaacgtcgtggtcatggggagaagcagctgggagagcatccccaagcagtacaagccgctcccaaacagaatcaacgtcgtgctttccaagacgctaacaaaggaagacgtgaaggaaaaggtcttcataattgacagcatagatgacctactgctgctcttaaagaagctgaagtactacaaatgcttcatcattgggggagcacaagtttatagggaatgcctaagtagaaacttaatcaagcagatctacttcacgaggatcaacggcgcctacccgtgtgacgtcttcttccccgagtttgacgaaagccagtttcgggtgacgtccgtcagtgaggtgtacaacagcaagggcaccactctggactttttggtttacagcaaggtgggggggggagttgacgggggcgcctccaacgggagcactgcgacagcgcttcggagaactgcaatgcgttcaactgcaatgcgccgaaatgtagcgccccgaactgccgctcccccaatgggaccgcacagcagggcgaatggggaaagggccccgccgcgtgcccgtgcgagaagaacaacgccgaggcagaggaagacgacctcgtgtacttcagctttaacaacaaagtgggggagaaaaacccggagcacctgcaagattttaaaatttacaacagcctcaagattaatgcagcacccagagtaccaatacctaggcatcatatacgacatcatcatgaatggaaacaaacaaggagacagaacaggtgtgggagtgatgagcaattttggctacatgatgaaatttaatttaagtgaatacttccccctattaacaacaaagaagttatttttgaggggaataattgaggaactgctttggttcattcgaggagaaacaaacggaaacactttgttaaataaaaacgtgaggatatgggaagcaaatggaacgagggagttcctcgacaacaggaaattattccacagagaagtgaatgacttggggcccatttatggcttccagtggagacacttcggtgctgaatacacaaatatgcatgacaattacgaagataaaggtgtagaccaattaaaaaatgttattcatttaataaaaaatgaaccaacaagtaggagaattattttgtgtgcatggaatgtaaaagatttggatcaaatggctttacctccttgtcatattttatgccaattttacgttttcgatgggaaactatcatgcattatgtaccagaggtcttgtgacttgggtcttggggtccccttcaacatcgcttcgtattccatattcacacacatgattgcgcaggtgtgcaatttgcagcctgcacagttcatacacattttgggcaacgcgcacgtctacaacaaccatgttgacagcttgaaagtgcagctgaacaggatcccctacccgttcccaacgcttaaactgaacccggaggtgaagaacattgaggattttaccatttcggatttcacaatagagaattacgtgcaccacgataaaataaccatggagatggccgcctaa

SEQ ID NO: 17689 - protein, 623 aa, Plasmodium vivax
MEDLSDVFDIYAICACCKVAPTSEGTKNEPFSPRTFRGLGNKGTLPWKCNSVDMKYFSSVTTYVDESKYEKLKWKRERYLRMEASQGGGDNTSGGDNTHGGDNADKLQNVVVMGRSSWESIPKQYKPLPNRINVVLSKTLTKEDVKEKVFIIDSIDDLLLLLKKLKYYKCFIIGGAQVYRECLSRNLIKQIYFTRINGAYPCDVFFPEFDESQFRVTSVSEVYNSKGTTLDFLVYSKVGGGVDGGASNGSTATALRRTAMRSTAMRRNVAPRTAAPPMGPHSRANGERAPPRARARRTTPRQRKTTSCTSALTTKWGRKTRSTCKILKFTTASRLMQHPEYQYLGIIYDIIMNGNKQGDRTGVGVMSNFGYMMKFNLSEYFPLLTTKKLFLRGIIEELLWFIRGETNGNTLLNKNVRIWEANGTREFLDNRKLFHREVNDLGPIYGFQWRHFGAEYTNMHDNYEDKGVDQLKNVIHLIKNEPTSRRIILCAWNVKDLDQMALPPCHILCQFYVFDGKLSCIMYQRSCDLGLGVPFNIASYSIFTHMIAQVCNLQPAQFIHILGNAHVYNNHVDSLKVQLNRIPYPFPTLKLNPEVKNIEDFTISDFTIENYVHHDKITMEMAA

SEQ ID NO: 17690 - DNA, 1593 bp, Glycine max
  CDS (1)..(1593)
atgcccagtgattcttctgtaatctccaatggacacagcaatggcagtgtcaatccactacctaacctgcaaaggacttaccaagtggtagtggctgccactcaagattggggcatcggtaaggatgggaaattaccctggagattgcctactgatctcaagttttttaaggagatcactatgaaaacatctgagcctgggaagaagaatgccattgtaatgggaaggaaaacatgggagagcatccctcttgagtacaggcctctttctggtcgccttaatgttgttcttactcgctcaggaagttttgatattgcaacagcagagaatgttgttatatgtggaagcatgtcttctgcattggaactgttagctgcttctccttactctctgtcaattgagaaagtttttgttatagggggtggtcagatatttagagaggctctcaatgtgcctggatgtgaagctatccacttaacggaaattcagtcaagcattgagtgtgacacttttatgcctccagttgatttcactatatttcggccatggtactcatcctttcctaaagtggaaaacaacatccgctattctttcaccacttatgtgcgtgtacggagttctgctgcagagtccgcgggtcagaacattgatccacttcttgataataattctgagtccatgaaatttgaggtcaaggatttttcttttcttcctaaaatgatttctgagagacatgaggagtatctgtatcttaagctggttcaggacatcattgctgaaggtacaactaagggtgataggacagggactggtaccttgtcaaaatttggttgccagatgaggttcaatctgcgtggaaactttcctcttctaacaactaagaaagtattttggcgaggggttgttgaagagcttctttggtttatcagtggctcaacaaatgccaaggtgctacaggaaaaaggcattcatatttgggatggcaatgcatccagagaataccttgatggtgttggtttgacagagcgggaggagggtgacttgggacctgtttatgggtttcaatggaggcactttggtgccagatatactgacatgcatcatgactactccggccaagggtttgatcaacttttagatgttattaacaagataaagcgtaatcctgatgatcggcgaatcattctctctgcatggaatccagtggatcttaaattaatggcacttccaccctgccacatgtttgcacagttttatgtagcacacggggagttatcatgtcaaatgtatcagcgatctgctgatatgggcctgggcattccatttaatattgcatcttatgcccttttgacatgcatgattgctcatgtttgtgatctcattcctggtgattttattcatgttattggggatgctcatatttaccgcaatcacgtgaggcctttgcaggagcagctccataaccagccaaagccttttccaactttgaagataaatccaaagaagaaagatatagattcttttgtggctgctgatttcaagctcataggctatgatcctcaccagaagattgatatgaagctgtctgtctaa

SEQ ID NO: 17691 - protein, 530 aa, Glycine max
MPSDSSVISNGHSNGSVNPLPNLQRTYQVVVAATQDWGIGKDGKLPWRLPTDLKFFKEITMKTSEPGKKNAIVMGRKTWESIPLEYRPLSGRLNVVLTRSGSFDIATAENVVICGSMSSALELLAASPYSLSIEKVFVIGGGQIFREALNVPGCEAIHLTEIQSSIECDTFMPPVDFTIFRPWYSSFPKVENNIRYSFTTYVRVRSSAAESAGQNIDPLLDNNSESMKFEVKDFSFLPKMISERHEEYLYLKLVQDIIAEGTTKGDRTGTGTLSKFGCQMRFNLRGNFPLLTTKKVFWRGVVEELLWFISGSTNAKVLQEKGIHIWDGNASREYLDGVGLTEREEGDLGPVYGFQWRHFGARYTDMHHDYSGQGFDQLLDVINKIKRNPDDRRIILSAWNPVDLKLMALPPCHMFAQFYVAHGELSCQMYQRSADMGLGIPFNIASYALLTCMIAHVCDLIPGDFIHVIGDAHIYRNHVRPLQEQLHNQPKPFPTLKINPKKKDIDSFVAADFKLIGYDPHQKIDMKLSV

SEQ ID NO: 17692 - DNA, 1833 bp, Toxoplasma gondii
  CDS (1)..(1833)
atgcagaaaccggtgtgtctggtcgtcgcgatgacccccaagaggggcatcggcatcaacaacggcctcccgtggccccacttgaccacagatttcaaacacttttctcgtgtgacaaaaacgacgcccgaagaagccagtcgcctgaacgggtggcttcccaggaaatttgcaaagacgggcgactctggacttccctctccatcagtcggcaagagattcaacgccgttgtcatgggacggaaaacctgggaaagcatgcctcgaaagtttagacccctcgtggacagattgaacatcgtcgtttcctcttccctcaaagaagaagacattgcggcggagaagcctcaagctgaaggccagcagcgcgtccgagtctgtgcttcactcccagcagctctcagccttctggaggaagagtacaaggattctgtcgaccagatttttgtcgtgggaggagcgggactgtacgaggcagcgctgtctctgggcgttgcctctcacctgtacatcacgcgtgtagcccgcgagtttccgtgcgacgttttcttccctgcgttccccggagatgacattctttcaaacaaatcaactgctgcgcaggctgcagctcctgccgagtctgtgttcgttcccttttgtccggagctcggaagagagaaggacaatgaagcgacgtatcgacccatcttcatttccaagaccttctcagacaacggggtaccctacgactttgtggttctcgagaagagaaggaagactgacgacgcagccactgcggaaccgagcaacgcaatgagctccttgacgtccacgagggagacaactcccgtgcacgggttgcaggctccttcttcggccgcagccattgccccggtgttggcgtggatggacgaagaagaccggaaaaaacgcgagcaaaaggaactgattcgggccgttccgcatgttcactttagaggccatgaagaattccagtaccttgatctcattgccgacattattaacaatggaaggacaatggatgaccgaacgggcgttggtgtcatctccaaattcggctgcactatgcgctactcgctggatcaggcctttccacttctcaccacaaagcgtgtgttctggaaaggggtcctcgaagagttgctgtggttcattcgcggcgacacgaacgcaaaccatctttctgagaagggcgtgaagatctgggacaagaatgtgacacgcgagttcctcgattcgcgcaatctcccccaccgagaggtcggagacatcggcccgggctacggcttccagtggagacacttcggcgcggcatacaaagacatgcacacagactacacagggcagggcgtcgaccagctgaagaatgtgatccagatgctgagaacgaatccaacagatcgtcgcatgctcatgactgcctggaatcctgcagcgctggacgaaatggcgctgccgccttgtcacttgttgtgccagttctacgtgaacgaccagaaggagctgtcgtgcatcatgtatcagcggtcgtgcgatgtcggcctcggcgtccccttcaacatcgcttcctattcgcttttgacgctcatggttgcacacgtctgcaacctaaaacctaaggagttcattcacttcatggggaacacgcatgtctacacgaaccatgtcgaggctttaaaagagcagctgcggagagaaccgagaccgttccccattgtgaacatcctcaacaaggaacgcatcaaggaaatcgacgatttcaccgccgaggattttgaggtcgtgggctacgtcccgcacggacgaatccagatggagatggctgtctag

SEQ ID NO: 17693 - protein, 610 aa, Toxoplasma gondii
MQKPVCLVVAMTPKRGIGINNGLPWPHLTTDFKHFSRVTKTTPEEASRLNGWLPRKFAKTGDSGLPSPSVGKRFNAVVMGRKTWESMPRKFRPLVDRLNIVVSSSLKEEDIAAEKPQAEGQQRVRVCASLPAALSLLEEEYKDSVDQIFVVGGAGLYEAALSLGVASHLYITRVAREFPCDVFFPAFPGDDILSNKSTAAQAAAPAESVFVPFCPELGREKDNEATYRPIFISKTFSDNGVPYDFVVLEKRRKTDDAATAEPSNAMSSLTSTRETTPVHGLQAPSSAAAIAPVLAWMDEEDRKKREQKELIRAVPHVHFRGHEEFQYLDLIADIINNGRTMDDRTGVGVISKFGCTMRYSLDQAFPLLTTKRVFWKGVLEELLWFIRGDTNANHLSEKGVKIWDKNVTREFLDSRNLPHREVGDIGPGYGFQWRHFGAAYKDMHTDYTGQGVDQLKNVIQMLRTNPTDRRMLMTAWNPAALDEMALPPCHLLCQFYVNDQKELSCIMYQRSCDVGLGVPFNIASYSLLTLMVAHVCNLKPKEFIHFMGNTHVYTNHVEALKEQLRREPRPFPIVNILNKERIKEIDDFTAEDFEVVGYVPHGRIQMEMAV

SEQ ID NO: 17694 - DNA, 1566 bp, Trypanosoma cruzi
  CDS (1)..(1566)
atgtcgctgtttaagatccgcatgccggagacggtggcggaggggacacgtctcgcactgcgtgccttttccctcgttgtagcggtcgacgagcacggcggcattggggacgggcggtcgatcccatggaatgtgcccgaggacatgaagtttttccgggatttgacaacaaaactgcgggggaagaacgtcaaaccatcgcctgcgaagcgcaacgccgttgtgatgggccgcaagacgtgggacagcattccgcccaaattccgcccgcttcccggtcgcctgaacgtcgttttgtcgtccaccctcacgacgcaacacctcttggacggcctgccagacgaagaaaaacggaatttgcatgccgacagcattgtggcggtaaatggtggactcgagcaggcattgcggttgctcgcgtcccccaattacacgccgagcattgagacggtctactgcattggtggcggctctgtgtatgcggaggcccttcgcccgccgtgcgttcatttgctgcaagccatttaccgcaccaccatccgcgccagcgagtcttcttgcagcgtgttttttcgcgttcccgagtcgggtacggaggcggcggcggggattgagtggcagcgggagacaatctccgaggagctcacgtcggcaaacggcaacgagacaaagtactactttgagaagctcatcccacgcaacagagaggaggagcagtatctaagccttgtggatcgcatcatacgcgaggggaatgtgaagcatgaccgcactggggtgggtacgctctccatctttggcgcacagatgcgtttctcgctccgcaacaatcgcctaccacttttgacaacgaagcgggttttttggcgcggtgtgtgcgaggaactgctgtggtttctacggggcgaaacatatgccaaaaagttaagtgacaagggagtccacatatgggacgacaacggctcgcgcgcgtttcttgacagtcgtggcctcacggagtacgaggagatggacctcggtcctgtctacggctttcagtggcgtcactttggtgccgcctacacacaccatgatgccaactatgacggacagggtgtggatcaaatcaaggcaatcgttgaaacgctaaagacaaatcctgacgatcgccggatgctattcacggcatggaatccgagcgctttgcccaggatggccctaccaccgtgccacctgctcgcacagttttacgtgagcaatggggaactgtcttgcatgctctaccagcgctcatgtgacatgggccttggcgtcccgttcaacattgcctcctacgccctcttgaccatcctcatcgcaaaggcgacggggctgcggccgggagagttggtgcacacccttggtgacgctcacgtgtacagcaatcacgtcgagccgtgcaatgagcaactgaaacgtgtgccacgtgcctttccgtatcttgtgtttcgccgcgagcgcgagttcctggaggactacgaggagggtgacatggaggtcattgactatgcgccataccctcccatctccatgaagatggcggtttag

SEQ ID NO: 17695 - protein, 521 aa, Trypanosoma cruzi
MSLFKIRMPETVAEGTRLALRAFSLVVAVDEHGGIGDGRSIPWNVPEDMKFFRDLTTKLRGKNVKPSPAKRNAVVMGRKTWDSIPPKFRPLPGRLNVVLSSTLTTQHLLDGLPDEEKRNLHADSIVAVNGGLEQALRLLASPNYTPSIETVYCIGGGSVYAEALRPPCVHLLQAIYRTTIRASESSCSVFFRVPESGTEAAAGIEWQRETISEELTSANGNETKYYFEKLIPRNREEEQYLSLVDRIIREGNVKHDRTGVGTLSIFGAQMRFSLRNNRLPLLTTKRVFWRGVCEELLWFLRGETYAKKLSDKGVHIWDDNGSRAFLDSRGLTEYEEMDLGPVYGFQWRHFGAAYTHHDANYDGQGVDQIKAIVETLKTNPDDRRMLFTAWNPSALPRMALPPCHLLAQFYVSNGELSCMLYQRSCDMGLGVPFNIASYALLTILIAKATGLRPGELVHTLGDAHVYSNHVEPCNEQLKRVPRAFPYLVFRREREFLEDYEEGDMEVIDYAPYPPISMKMAV

SEQ ID NO: 17696 - DNA, 885 bp, Encephalitozoon cuniculi
  CDS (1)..(885)
atgccccaggacccgcgccacccagagcaccagtatcttgacctggtgaagcacatactggaaaacggcgccagaaggatggacaggacaggcacgggaacgctgtccgtcttcggagcaacaatgaggttttccctcgaagacaacaccttcccgctgctgacgacaaggagggtcttctacagaggcgttgtcgaggagctcctgttcttcctgagaggcgagacagactcgaaggtccttgagaagaaaggagtccggatctgggaaaagaacggggccaagcagttcctgcagtccgtggggatagacagggaggagggcgacctcggcccgatatacggcttccagtggaggcacttcggcgcccggtacgagacatcggcctcgagctacgagggcaagggggtcgaccagatcgcgagcgccatcgcagcaatcagggccaaccccgccagcaggaggattgttgtgagtgcatggaaccccacagacctcgggagcatggcccttcccccgtgccacgtgctcttccagttcaacgtgacggacgggaagctcagctgtgcaatgtaccagaggtctggagacatgggcctgggcgttcccttcaacattgcctcgtactcgctgctcacaatactcgtggcgcatctgacaggcctgcagcccggggagtttgttcactttctgggcgacgcccacgtgtatctggaccacgtcgactctcttcggcagcagatccagagacccccgagagcatttccaaagctctttgtcagcccaaaggggccgagaacagagccggagcacttccagtacgaggacttcgagcttgtgggatacgacccgcaccctgcaatcaagatgaacatgagtgcttga

SEQ ID NO: 17697 - protein, 294 aa, Encephalitozoon cuniculi
MPQDPRHPEHQYLDLVKHILENGARRMDRTGTGTLSVFGATMRFSLEDNTFPLLTTRRVFYRGVVEELLFFLRGETDSKVLEKKGVRIWEKNGAKQFLQSVGIDREEGDLGPIYGFQWRHFGARYETSASSYEGKGVDQIASAIAAIRANPASRRIVVSAWNPTDLGSMALPPCHVLFQFNVTDGKLSCAMYQRSGDMGLGVPFNIASYSLLTILVAHLTGLQPGEFVHFLGDAHVYLDHVDSLRQQIQRPPRAFPKLFVSPKGPRTEPEHFQYEDFELVGYDPHPAIKMNMSA

SEQ ID NO: 17698 - DNA, 840 bp, Bacillus licheniformis
  CDS (1)..(840): transl_table=11
atgagccattatgaccagcaatacaatgcaatcatacaaaaaattattgaatcagggatctccgatgaagaatatcaggttcggacgaagtgggattcagacggaacgccggctcatacgctgagcatcatgagcgaaaaaatgcggtttgacaattcagaagtgccgattttgacgacgaagaaggtggcgtggaaaacggccattaaagagctgctttggatttggcagctgaaatccaatgatgttcaagttctgaatgatatgggggttcatatttgggatcaatggcgtcttgaagacggcacaatcggagcagcgtacggctatcaattagggaagaaaaacagaacggttaacggccagaaagtcgatcaagtggattatttgcttcatcagttaaagcataacccttcttcacgcaggcatttgaccatgctgtggaatcccgatgatttggatggcatggctttgacgccctgcgtctatgagacgcaatggtatgtgaaagaaggaaagctctctttagaagtaagagcgagaagcaacgacatggcgcttggcaacccgttcaatgtgtttcaatataatgtcttgcagcgcatgatcgcgcaagtcctcggttatgagctgggcgaatacatcttcaacatcggtgactgccacatctatacccgtcacatcgacaatttaaacattcagatgaaacgcgagcagtatgaagcgccaaagctatggatcaacccggatatcaaaaatttttatgactttacaatcgatgattttaaattaatcgactataagcacggcgacaagctgacatttgaagttgccgtatga

SEQ ID NO: 17699 - protein, 279 aa, Bacillus licheniformis
MSHYDQQYNAIIQKIIESGISDEEYQVRTKWDSDGTPAHTLSIMSEKMRFDNSEVPILTTKKVAWKTAIKELLWIWQLKSNDVQVLNDMGVHIWDQWRLEDGTIGAAYGYQLGKKNRTVNGQKVDQVDYLLHQLKHNPSSRRHLTMLWNPDDLDGMALTPCVYETQWYVKEGKLSLEVRARSNDMALGNPFNVFQYNVLQRMIAQVLGYELGEYIFNIGDCHIYTRHIDNLNIQMKREQYEAPKLWINPDIKNFYDFTIDDFKLIDYKHGDKLTFEVAV

SEQ ID NO: 17700 - DNA, 840 bp, Bacillus subtilis
  CDS (1)..(840): transl_table=11
atgacgcaattcgataaacaatacaattcaattataaaggatattatcaataatggaatctcagacgaagagtttgatgtaagaaccaagtgggactcagatggaacaccggcacatactctaagtgtaatcagtaagcaaatgagattcgacaactcagaggttccgattttaacgacaaaaaaggttgcctggaaaacagccattaaagagttgctctggatttggcagctgaaatctaatgatgttaatgatttaaacatgatgggcgtccatatttgggatcagtggaaacaagaagacggaaccatcggacatgcatatggatttcagctggggaagaaaaacagaagtctaaatggagaaaaagtggatcaggtagactatcttcttcatcaattgaagaacaatccatcttcacgcagacacattacaatgctgtggaatcctgatgaattagacgcaatggccttaacgccatgtgtatacgagacacaatggtacgttaaacatgggaaactccaccttgaggtaagagcacggagcaatgatatggcattgggaaatccattcaatgtattccagtataatgtgttgcagcgcatgattgctcaagtgactggttatgagcttggtgaatatatctttaacattggggattgccatgtgtacacacgtcatatagacaatttgaaaattcaaatggaaagagaacagtttgaagcacctgaactatggatcaatcctgaagtgaaagatttttatgactttaccattgatgatttcaagttaatcaactataaacatggggacaagcttttatttgaggtagcggtttaa

SEQ ID NO: 17701 - protein, 279 aa, Bacillus subtilis
MTQFDKQYNSIIKDIINNGISDEEFDVRTKWDSDGTPAHTLSVISKQMRFDNSEVPILTTKKVAWKTAIKELLWIWQLKSNDVNDLNMMGVHIWDQWKQEDGTIGHAYGFQLGKKNRSLNGEKVDQVDYLLHQLKNNPSSRRHITMLWNPDELDAMALTPCVYETQWYVKHGKLHLEVRARSNDMALGNPFNVFQYNVLQRMIAQVTGYELGEYIFNIGDCHVYTRHIDNLKIQMEREQFEAPELWINPEVKDFYDFTIDDFKLINYKHGDKLLFEVAV

SEQ ID NO: 17702 - DNA, 1243 bp, Bacillus amyloliquefaciens
  CDS (157)..(951)
gagctcggcagcatttactgggaccgcaatacgccgcctgactggatgagcgtataataccgtgaagaaataaaaaaatcatttctgagaaattttgcagaaatgattttttattgtgttacactactaaaagactactttaaaaggatgaaaaagatgaaacaatataaagatttgtgccgtcatgtgttagaaaacggagaaaaaaaaggagaccgtacgggaacgggtacgatcagcacgttcggctaccaaatgcggtttaaccttcagggaggtttcccgatgcttacgacgaaaaaactccattttaaatcaatcgcccatgagctgctttggtttttaaaaggtgacacgaatgtccgctaccttcaggaaaacggagtccgcatctggaacgaatgggcggatgaaaacggagaactcggaccggtttacggctctcaatggcgttcatggcgcggagcggacggcgagacgattgatcaaatctcccggctgattcacgacatcaagacaaatccgaattccagacgtttaatcgtcagcgcgtggaatgtcggcgaaattgatcgtatggcgcttcctccttgccactgtctgtttcagttctatgtcgcggacggaaagctgtcgtgccagctttatcagcgctcagcggatgtatttctcggcgtgccgtttaatattgcgtcttatgcgcttttaacaatgatgatcgcgcatgtgacggggcttgaaccgggtgagttcgttcatacgttcggagacgtccacatttaccaaaaccatgtggagcaggtgaatttgcagctgacaagggatgtccgtccgctgccgaaactgcggtttgcgcgaaacgtggattctatttttgattttgcgttcgaagactttatcattgaggattatgacccgcatccgcatataaaaggagctgtcagcgtatgatatcgttttatttttgcgatggatgaaaaccggctgatcggaaaagataacgatctgccttggcaccttccggatgatctcgcatatttcaaaaaagtgacgacgggacacaccattgtgatggggcggaaaacatttgaatcaatcgggcgtccgcttccgaaccggcgtaacatcgtagtaacctcgcgggatgcatccttattcccgggctgtactgtcgccggctcggctgaggaagtgctcaagctgatcccggctgatgaagaatgctttgtaatcggcggagctc

SEQ ID NO: 17703 - protein, 264 aa, Bacillus amyloliquefaciens
MKQYKDLCRHVLENGEKKGDRTGTGTISTFGYQMRFNLQGGFPMLTTKKLHFKSIAHELLWFLKGDTNVRYLQENGVRIWNEWADENGELGPVYGSQWRSWRGADGETIDQISRLIHDIKTNPNSRRLIVSAWNVGEIDRMALPPCHCLFQFYVADGKLSCQLYQRSADVFLGVPFNIASYALLTMMIAHVTGLEPGEFVHTFGDVHIYQNHVEQVNLQLTRDVRPLPKLRFARNVDSIFDFAFEDFIIEDYDPHPHIKGAVSV

SEQ ID NO: 17704 - DNA, 795 bp, Bacillus subtilis
  CDS (1)..(795): transl_table=11
atgaaacagtataaggatttctgcagacatgttttagagcatggtgagaaaaagggagaccggactgggaccggaacaatcagcactttcggatatcaaatgagatttaatttacgggaaggctttccgatgctcaccactaaaaaactccactttaaatcaattgcgcatgaactgctgtggttcttaaaaggagatacgaatgtacgctatctgcaggaaaacggagtgcgaatctggaatgagtgggctgatgaaaacggtgaacttggacctgtatatggctcccaatggcgttcttggcggggagctgatggagaaaccattgatcaaatttcccgtcttattgaagatattaaaacaaatccgaactccagacgcttaatcgtcagcgcctggaatgttggtgaaattgataaaatggcgttgccgccgtgccattgcctgttccaattctatgtgtctgacggcaagctgtcctgtcagctgtatcagcgctctgccgatgttttcttaggtgtgccgtttaatattgcatcttatgccctcctaaccatgatcattgctcatgtgactgggcttgaaccgggcgagttcatccatacgtttggtgatgttcatatttaccaaaatcatattgaacaagtcaatttgcagctggaaagagatgttagaccgcttccgcagcttcgtttcgccagaaaggttgattctatttttaactttgcatttgaggactttatcatcgaggattatgatccgcatcctcatataaaaggggcggtcagcgtatga

SEQ ID NO: 17705 - protein, 264 aa, Bacillus subtilis
MKQYKDFCRHVLEHGEKKGDRTGTGTISTFGYQMRFNLREGFPMLTTKKLHFKSIAHELLWFLKGDTNVRYLQENGVRIWNEWADENGELGPVYGSQWRSWRGADGETIDQISRLIEDIKTNPNSRRLIVSAWNVGEIDKMALPPCHCLFQFYVSDGKLSCQLYQRSADVFLGVPFNIASYALLTMIIAHVTGLEPGEFIHTFGDVHIYQNHIEQVNLQLERDVRPLPQLRFARKVDSIFNFAFEDFIIEDYDPHPHIKGAVSV

SEQ ID NO: 17706 - DNA, 843 bp, Acinetobacter sp
  CDS (1)..(843): transl_table=11
atgcgcacctatttagaccttttacaacatatcctcgacaacggcggcgacaaaggtgaccgtacaggcacagggacacgttctgtatttggtcatcaaatgcgttttgacctatctcaagggtttcctttacttaccaccaagaaagtacatttccgctcaattgtgattgagctgctgtggtttctcaaaggcgataccaacgttcaatatttaaaagaccataaagtcagcatttgggatgagtgggcaacggcagagcaaactgcacgttttggccgtccagaaggcgagcttggcccagtttatggacaccaatggcgtaatttcggtgctactcaaaattcagatgggagctacaaaaacgacggttttgatcaaatcaaatggctcattaatgaaatcaagaccaatccgaattcacgtcgcttgattgtatcaggctggaatccaaatgaagccggacaagtggctttaccaccttgtcataccctgtttcagttttttgttcaggatggcaaactctcttgtcagctctatcaacgtagtgccgatgtgtttttaggtgtgccatttaacattgccagttatgcccttctcacccatatgattgcgcaggtgtgtggcctaggtgtaggcgattttgtctggacgggcggtgacacccatttatacgccaatcattttgagcaagcacaacttcaactgacacgtgaaccgttaccactttgtcagcttaaattaaaccctgaaattaccgatctgtttgattttaaatttgaagatattgaaattgtggattatcaatcccaccctgcaatcaaagcccctgttgccgtataa

SEQ ID NO: 17707 - protein, 280 aa, Acinetobacter sp
MRTYLDLLQHILDNGGDKGDRTGTGTRSVFGHQMRFDLSQGFPLLTTKKVHFRSIVIELLWFLKGDTNVQYLKDHKVSIWDEWATAEQTARFGRPEGELGPVYGHQWRNFGATQNSDGSYKNDGFDQIKWLINEIKTNPNSRRLIVSGWNPNEAGQVALPPCHTLFQFFVQDGKLSCQLYQRSADVFLGVPFNIASYALLTHMIAQVCGLGVGDFVWTGGDTHLYANHFEQAQLQLTREPLPLCQLKLNPEITDLFDFKFEDIEIVDYQSHPAIKAPVAV

SEQ ID NO: 17708 - DNA, 891 bp, Agaricus bisporus
  CDS (1)..(891)
atgcacgatgaagaccagtatctacacctcatcagacgcgttctcgacacgggtgaccttcgccccgatcgaacggggacagggaccatctcgctctttgcgccgccaaatctacgcttctcgcttcgtgaatccaccgtgccactcctgacaaccaagcgcacttttttacgtggcatcgtggaagagctgctgtggttcacgaacggattgacagattcaaaaatcctgtctgacaagggcgtcaaaatatgggatgggaatgggtcgaaagcgttccttgagagccgggggttgggtcatcgtagagaaggtgatctcggtccggtgtatggattccagtggcggcatttcggggcggaatacgaggattgcgatgcggattatgctggcaagggtgtcgaccagctgcgagaatgcatccgaaaaatcaaagaaaatccgacggacagacggataattcttagtgcatggaacccaaaagatattccctcgatggcattgcctccctgccacatgttgtgccaattctacgtgcatctcccagccgacactgccaaaccggaactgtcgtgtctgatgttccagcggtctgcagatcttgggctggggattcccttcaatatcgcatcctacgcgctccttacacatatgatcgcgcacgttacagggacgacggcacgggagctgattatccagcttggagatgctcatgtctatcgcgatcacgtcgaggccctcgaggtgcaactccaacgcgagccgcgtccttttcccaagcttcgatgggcgagggacggtatcacggacattgaagactttgagtattctgactttgtaatcgagggctacaaccctcatccctctattgcgatgaagatgagtgtctga

SEQ ID NO: 17709 - protein, 296 aa, Agaricus bisporus
MHDEDQYLHLIRRVLDTGDLRPDRTGTGTISLFAPPNLRFSLRESTVPLLTTKRTFLRGIVEELLWFTNGLTDSKILSDKGVKIWDGNGSKAFLESRGLGHRREGDLGPVYGFQWRHFGAEYEDCDADYAGKGVDQLRECIRKIKENPTDRRIILSAWNPKDIPSMALPPCHMLCQFYVHLPADTAKPELSCLMFQRSADLGLGIPFNIASYALLTHMIAHVTGTTARELIIQLGDAHVYRDHVEALEVQLQREPRPFPKLRWARDGITDIEDFEYSDFVIEGYNPHPSIAMKMSV

SEQ ID NO: 17710 - DNA, 795 bp, Agrobacterium tumefaciens
  CDS (1)..(795): transl_table=11
atgaaacaatatctcgatcttctccggcatgtgatggaaaccggctccgaccgcggagaccgcaccggcaccggcacgcgttcggtattcggttaccagatgcgtttcgacctttccgaaggttttccggttctcaccacaaagaaactgcatctgcgctccatcatccatgagctgctgtggttcctaaacggcgataccaatattgcctatctcaaggaaaatggtgtttccatctgggatgaatgggccgatgagaacggcgatctcggtccggtctatggcgcgcaatggcggtcctggccagcgcctgatggccgccatatcgaccagatcgcgcttctgatcgaggcgcttaaaaccaatcccaattcccgccgccacatcgtttcggcctggaacccggcgctggtggacgaaatggcgctgccgccctgccattgcctgttccagttctatgtgtccgatggaaagctgtcctgccagctttaccagcgctcggccgatattttcctcggcgtgcccttcaatatcgcatcctacgcgctgctgacgctgatggtggcgcaggtcgtgggcctcaagcccggcgatttcgttcatacccttggtgatgcgcatatctacgccaaccatttcgaacaggcgcagctgcagatgacgcgtacgccgaaggccttgccgaccatgcgcctcaaccctgatgtgaagaaccttttcggctttaagttcgaggactttacgctggagaattacgaggccgattcaagcatcaaggcaccgatcgcggtatga

SEQ ID NO: 17711 - protein, 264 aa, Agrobacterium tumefaciens
MKQYLDLLRHVMETGSDRGDRTGTGTRSVFGYQMRFDLSEGFPVLTTKKLHLRSIIHELLWFLNGDTNIAYLKENGVSIWDEWADENGDLGPVYGAQWRSWPAPDGRHIDQIALLIEALKTNPNSRRHIVSAWNPALVDEMALPPCHCLFQFYVSDGKLSCQLYQRSADIFLGVPFNIASYALLTLMVAQVVGLKPGDFVHTLGDAHIYANHFEQAQLQMTRTPKALPTMRLNPDVKNLFGFKFEDFTLENYEADSSIKAPIAV

SEQ ID NO: 17712 - DNA, 885 bp, Ascaris suum
  CDS (1)..(885)
atggagggagcaaatgtgaacgaagatgagaggaagtatctacggcaaatcaagcacatcattgatgagggtgataaggtcattgatcgtaccggtgttggtacgctttccttgttcggactgcactctacctattcattgcgcaacggtgtgattccgttactaacgacgaaacgtgtctactggaagggtgtcgtcgaagaattgctgtggttcatcaaaggtgacacagatgcaaaacgtctgtcagcaaaaggtgtgaagatttgggatgcgaatggatctcgtgagttcctggatagtcaaggtttcaaggatcgccccgaaggcgatttgggtccgatttacggattccaatggcgtcattttggtgccgaataccatggtacagatgccgattataaaggccaaggtgtcgaccaactcgccgatgtcattgagcaaatcaaaaataatccgaatagtaggcggatcatcctcaacgcttggaatgttaaagatcttcaccagatggcattgccaccatgtcacacccttgctcagttcgctgtaaagaatggagagctttcatgtcagctctatcagcgctcaggtgatatgggattgggagtgccattcaatctggctagctatggtctcttgacacatatgatcgcccatgtttgtgctctgaaaacggggttcctgcaccatgttttgggtgatgcgcacgtctacctcaaccatatcgatgccctcaaggaacagttgtcgcgcgatccgcgtccattcccaacagttcatttcgaaggcagaatcgattcaatcgacgatttcacagccgaatctatcatcctgaatgggtacaatccgatggctccaataaaaatgcccatggccgtgtga

SEQ ID NO: 17713 - protein, 294 aa, Ascaris suum
MEGANVNEDERKYLRQIKHIIDEGDKVIDRTGVGTLSLFGLHSTYSLRNGVIPLLTTKRVYWKGVVEELLWFIKGDTDAKRLSAKGVKIWDANGSREFLDSQGFKDRPEGDLGPIYGFQWRHFGAEYHGTDADYKGQGVDQLADVIEQIKNNPNSRRIILNAWNVKDLHQMALPPCHTLAQFAVKNGELSCQLYQRSGDMGLGVPFNLASYGLLTHMIAHVCALKTGFLHHVLGDAHVYLNHIDALKEQLSRDPRPFPTVHFEGRIDSIDDFTAESIILNGYNPMAPIKMPMAV

SEQ ID NO: 17714 - DNA, 795 bp, Azoarcus sp
  CDS (1)..(795): transl_table=11
atgaaacagtatctcgacctgatgcgccatgtcctcgatcatggcgaccggaaatccgaccggaccggcaccggcacactttcgatcttcggttggcagatgcggtttaatctcgacgacggctttcctctgctcacgacgaagaaactgcacacccgttcgataattcacgaattgctgtggtttctgcgcggcgataccaatatccgctacctcaacgagaatggcgtgtcgatctgggacgactgggccgacgagaatggcgatctcgggccggtgtacggcaagcaatggcgccgctgggagacggcaaacggcgccactatcgaccagatcgcacaactgatcgacggactgaagcacaatcctgattcgcgccgccatctggtttcagcgtggaatccgggagaagtggccggaatggcgcttcccccgtgtcacgcactgttccagttctatgttgcgggtgaccgactgtcctgccagttgtaccaacgcagtgccgacatcttcctcggagtaccgttcaacattgcgtcctacgcgctactgacactgatggtggctcaggtctgcgggctgcgggccggggatttcgtatggacagggggggattgccacctgtacctcaaccatctcgatcaggcacgtctgcagctctcccggcaaccacgcgctttgccgcggatgatcgtgaatcccggcgtcaccgacatctttggattccgcttcgaagattttcgtctcgaaggctatgacccccacccccatatcaaagcggaagtggccgtatga

SEQ ID NO: 17715 - protein, 264 aa, Azoarcus sp
MKQYLDLMRHVLDHGDRKSDRTGTGTLSIFGWQMRFNLDDGFPLLTTKKLHTRSIIHELLWFLRGDTNIRYLNENGVSIWDDWADENGDLGPVYGKQWRRWETANGATIDQIAQLIDGLKHNPDSRRHLVSAWNPGEVAGMALPPCHALFQFYVAGDRLSCQLYQRSADIFLGVPFNIASYALLTLMVAQVCGLRAGDFVWTGGDCHLYLNHLDQARLQLSRQPRALPRMIVNPGVTDIFGFRFEDFRLEGYDPHPHIKAEVAV

SEQ ID NO: 17716 - DNA, 957 bp, Bacillus cereus
  CDS (1)..(957): transl_table=11
atgaaacatgctgaaaatgaatacttaaatttatgccgccatgtaatggaacatggtacgaagaaagaagatcgtacagggacaggaactgtatctgtatttggatatcaaatgcgttttgatttaagtaaaggttttcctttattaacgacaaagagagtaccgtttcgccttgtagcaagtgaattgctatggtttatgaaaggtgatacaaatattcgctatttattgcagcataataataacatttggaatgaatgggcatttaagagctgggtagaaagcgacgagtatactggtcctgacatgactgatttcggtcttcgttcacaacaagatgaggaatttaaagtgcagtacgataagcaaatggaattatttaaaaagaacgttttagaagatgatgatttctcaaataaatatggttatttaggagacgtatacggtaagcagtggcgtgcttggaaaacgacagctggtgagacacttgatcaattaaaggatgtaattgaaatgattaagaagacgccagattcgcgtcgcctaattgtttctgcttggaatccggaagatgtaccaagtatggcattaccgccttgtcatacactattccaattttatgtagcagatggcaaactttcttgtcagctatatcaaagaagtggtgacatattccttggaattccatttaacattgcaagttactcactactgacacatttaattgcacatgaatgcggacttgaagtgggagaatttgttcatacaattggagatgcacacatttatacaaaccattttgagcaagtagaaaagcaattggcacgtgaaccacgtccattcccgaaacttacactaaatccagatgtgaaatctgtgtttgattttgaaatggaagatttaacaattgaaggatatgatccgcatccagcaattaaagcaccagttgcagtgtaa

SEQ ID NO: 17717 - protein, 318 aa, Bacillus cereus
MKHAENEYLNLCRHVMEHGTKKEDRTGTGTVSVFGYQMRFDLSKGFPLLTTKRVPFRLVASELLWFMKGDTNIRYLLQHNNNIWNEWAFKSWVESDEYTGPDMTDFGLRSQQDEEFKVQYDKQMELFKKNVLEDDDFSNKYGYLGDVYGKQWRAWKTTAGETLDQLKDVIEMIKKTPDSRRLIVSAWNPEDVPSMALPPCHTLFQFYVADGKLSCQLYQRSGDIFLGIPFNIASYSLLTHLIAHECGLEVGEFVHTIGDAHIYTNHFEQVEKQLAREPRPFPKLTLNPDVKSVFDFEMEDLTIEGYDPHPAIKAPVAV

SEQ ID NO: 17718 - DNA, 795 bp, Bacteroides fragilis
  CDS (1)..(795): transl_table=11
atgaaacaatatttagacctgctcgaccgagtgttgacggagggaatagaaaaaggtgaccgcaccggaacgggaaccatcagtgtcttcggacaccagatgcgtttcaacctggacgagggattcccttgcctgactaccaagaaacttcatctgaaatcaatcatttacgaactactgtggttcctcaaaggagacacgaatgtgaaatatctgcaggaccacggcgtacgcatctggaacgaatgggcggacgaaacaggagatctgggacatatatatggataccagtggcgttcgtggccaacctacgacggaggatttatcgaccagatcagcgaagctgtagatgccatcaagcacaatcccgattcacgccgcatcattgtcagtgcatggaatgtaggagacctggatcacatgaacctccctccttgccacgcattcttccagttttacgtagcaaacggacggctgagcctgcaactctatcaacgcagcgccgatatcttcctgggggtacctttcaatatagcatcttatgcattgctgctacagatgatggcgcaagtcaccggtctgcaggcaggagactttatccacacactgggcgacgcacatatctacctgaaccacttggaacaggtgaaactccagctcagccgggaaccgcgcccactaccacaaatgaagatcaatccggacgtgaaaaacatcttcgacttccaattcaaggactttgaattagtaaattatgatccgcacccgcacatcgctggaaaagttgcggtataa

SEQ ID NO: 17719 - protein, 264 aa, Bacteroides fragilis
MKQYLDLLDRVLTEGIEKGDRTGTGTISVFGHQMRFNLDEGFPCLTTKKLHLKSIIYELLWFLKGDTNVKYLQDHGVRIWNEWADETGDLGHIYGYQWRSWPTYDGGFIDQISEAVDAIKHNPDSRRIIVSAWNVGDLDHMNLPPCHAFFQFYVANGRLSLQLYQRSADIFLGVPFNIASYALLLQMMAQVTGLQAGDFIHTLGDAHIYLNHLEQVKLQLSREPRPLPQMKINPDVKNIFDFQFKDFELVNYDPHPHIAGKVAV

SEQ ID NO: 17720 - DNA, 795 bp, Bacillus halodurans
  CDS (1)..(795): transl_table=11
atggaacaatatttagagctttgccgccacgttctcgagcatggaaccgagcgatcagaccggacaggaacagggacgatcagcgtttttggctatcagatgagatttgatctccaagaaggatttcccgttgttacgacgaaaaaactgcacctgcggtcgatcatccatgaactgctttggtttttaaaaggagagactaacatcgcctacttgcaagagaatggtgtgcgaatttggaacgagtgggccgatgaaaatggggaacttggtcctgtatatggtaagcagtggcgctcatgggaaggagcgaatgggaaaacggtcgaccaaatttctcaagtcgtagaagcgattaaacatcaaccggattcaagacgattgatcgtaagtgcttggaatgcagcggagattgaagatatggccttggctccatgtcattgtctattccaattttatgtgcaagatggaaagctatcgtgtcagctctatcagcgaagtgcagacattttcctaggcgtacctttcaacatcgcttcatacgccttgttaacaaaaatgatcgcccaagtatgcgatttagaagaaggagagtttgttcacacgttcggtgacgctcacatttacttaaatcatatcgaacaagtaaaattacagttaacgagagagccaagaccattaccggagatgcgtttgaacccagaggttcgttcattgttcgacttcacgttcgatgattttgaacttgtcggatatgatccgcaccctcatataaaaggagaagtgtctgtatga

SEQ ID NO: 17721 - protein, 264 aa, Bacillus halodurans
MEQYLELCRHVLEHGTERSDRTGTGTISVFGYQMRFDLQEGFPVVTTKKLHLRSIIHELLWFLKGETNIAYLQENGVRIWNEWADENGELGPVYGKQWRSWEGANGKTVDQISQVVEAIKHQPDSRRLIVSAWNAAEIEDMALAPCHCLFQFYVQDGKLSCQLYQRSADIFLGVPFNIASYALLTKMIAQVCDLEEGEFVHTFGDAHIYLNHIEQVKLQLTREPRPLPEMRLNPEVRSLFDFTFDDFELVGYDPHPHIKGEVSV

SEQ ID NO: 17722 - DNA, 840 bp, Bacillus mojavensis
  CDS (1)..(840): transl_table=11
atgactcaatttgataaacaatacaattcaattataaaggaaattataaagaatggaatctcagacgaagaatttgatgtgagaaccaagtgggaatcagatggaacaccggctcacacactaagcatcatcaccaagcaaatgagattcgacaactcagaggttccgattttaacaacaaaaaaagttgcctggaaaacagcgattaaagagctgctctggatctggcaactgaaatctaacgatgttacggaattaaacaaaatgggcgtacatatctgggatcaatggaaacaagaagatggcagcatcggacatgcatatggattccagctggccaagaaaaacagaaatctaaatggagaaaaggtagatcaggttgattatcttctgcatcaattgaagaacaacccatcttcacggagacacattactatgctttggaatcctgatgaattagactcaatggccttaacgccatgtgtatacgagacacaatggtacgttaaacaagggaaactccaccttgaggtaagagcccgtagtaatgacatggccttgggaaatcccttcaatgtattccagtacaatgttttgcagcgcatgattgctcaagtaactggttatgagcttggtgaatatatctttaacattggtgattgccatgtttacacacgtcatatagacaatttgaaaattcaaatggaaagagaacagtttgaagcacctaaattatggatcaatcctgaagtcaaagatttttatgactttaccattgatgatttcaagttaatcaactataaacatggggacaggctttcatttgaggtagcagtttaa

SEQ ID NO: 17723 - protein, 279 aa, Bacillus mojavensis
MTQFDKQYNSIIKEIIKNGISDEEFDVRTKWESDGTPAHTLSIITKQMRFDNSEVPILTTKKVAWKTAIKELLWIWQLKSNDVTELNKMGVHIWDQWKQEDGSIGHAYGFQLAKKNRNLNGEKVDQVDYLLHQLKNNPSSRRHITMLWNPDELDSMALTPCVYETQWYVKQGKLHLEVRARSNDMALGNPFNVFQYNVLQRMIAQVTGYELGEYIFNIGDCHVYTRHIDNLKIQMEREQFEAPKLWINPEVKDFYDFTIDDFKLINYKHGDRLSFEVAV

SEQ ID NO: 17724 - DNA, 840 bp, Bacillus subtilis var
  CDS (1)..(840): transl_table=11
atgacgcaattcgataaacaatacaattcaattataaaggatattatcaataatggaatctcagacgaagagtttgatgtaagaaccaagtgggactcagatggaacaccggcacatactctaagtgtaatgagtaagcaaatgagattcgacaactcagaggttccgattttaacgacaaaaaaggttgcctggaaaacagccattaaagagttgctctggatttggcagctgaaatctaatgatgttaatgatttaaacaagatgggcgtacatatttgggatcagtggaaacaagaagacggcaccatcggacatgcatatggatttcagctggggaagaaaaacagaagtctaaacggagaaaaagtggatcaggtagactatcttcttcatcaattgaagaacaacccgtcttcacgcagacatattacaatgctgtggaatcctgatgatttagacgcaatgtccttaacgccatgtgtatacgagacacaatggtacgttaaacatgggaaactccaccttgaggtaagagcacggagcaatgatatggcattaggaaatcccttcaatgtattccagtacaatgtgttgcagcgcatgattgctcaagtgactggttatgagcttggtgaatatatctttaacattggggattgccatgtgtacacacgtcatatagacaatttgaaaattcaaatggaaagagaacagtttgaagcacctgaactatggatcaatcctgaagtgaaagatttttataactttaccattgatgatttcaagttaatcaactataaacatggggacaagcttttatttgaggtagcggtttaa

SEQ ID NO: 17725 - protein, 279 aa, Bacillus subtilis var
MTQFDKQYNSIIKDIINNGISDEEFDVRTKWDSDGTPAHTLSVMSKQMRFDNSEVPILTTKKVAWKTAIKELLWIWQLKSNDVNDLNKMGVHIWDQWKQEDGTIGHAYGFQLGKKNRSLNGEKVDQVDYLLHQLKNNPSSRRHITMLWNPDDLDAMSLTPCVYETQWYVKHGKLHLEVRARSNDMALGNPFNVFQYNVLQRMIAQVTGYELGEYIFNIGDCHVYTRHIDNLKIQMEREQFEAPELWINPEVKDFYNFTIDDFKLINYKHGDKLLFEVAV

SEQ ID NO: 17726 - DNA, 795 bp, Bacillus clausii
  CDS (1)..(795): transl_table=11
atggaacaatacttgcagttatgcgagcacgttttgcaaaacggctcgccaaaatcagatcggacaggcactggcaccattagtgtatttggttaccaaatgcgctttgatttagaaaagggttttccaattgtcacaacgaaaaaattgcatatgcgttcgatcatccatgaattgctttggtttctaaaaggcgacacgaacatccgttatttgcaagaaaatggcgttcgtatttggaacgaatgggcggatgaaaacggcgaccttgggcctgtttacggaaaacaatggcgctcctgggaaggggcaaacggcaaaacagtcgaccaaattactgaagtggttgagcaaataaaaacgaatccgaattctcgccgcttaattgtcaatgcgtggaatgtcgcggagattgaagaaatggcgcttgcgccatgccattgcttgtttcagttttacgtaaacgacggaaaactttcttgccaattgtaccagcgcagtgccgatatttttcttggcgttccttttaatatatcgtcttatgccctgttaacgatgatgatggcccaagtgtgcggattaaagcctggcgaatttatccatacgtttggcgatgcccatttgtacaacaaccatattgaacagacgaagcttcaattaacgcgtaaaccaaaacagctacctacgatgcatatcaatccagaggtaacagacctgtttgcgtttacttacgatgattttgaactgaaacattatgatccttatccgcatattaaagcagaggtgtccgtatga

SEQ ID NO: 17727 - protein, 264 aa, Bacillus clausii
MEQYLQLCEHVLQNGSPKSDRTGTGTISVFGYQMRFDLEKGFPIVTTKKLHMRSIIHELLWFLKGDTNIRYLQENGVRIWNEWADENGDLGPVYGKQWRSWEGANGKTVDQITEVVEQIKTNPNSRRLIVNAWNVAEIEEMALAPCHCLFQFYVNDGKLSCQLYQRSADIFLGVPFNISSYALLTMMMAQVCGLKPGEFIHTFGDAHLYNNHIEQTKLQLTRKPKQLPTMHINPEVTDLFAFTYDDFELKHYDPYPHIKAEVSV

SEQ ID NO: 17728 - DNA, 795 bp, Bacteroides thetaiotaomicron
  CDS (1)..(795): transl_table=11
atgaaacaatatttagatttactcaatcgcgtattaactgaaggaactgagaaaagtgaccgtacaggaaccggaacgatcagtgtgttcggacatcagatgcgtttcaacctcgacgagggtttcccgtgtctgaccaccaaaaaactgcatctgaaatcaatcatctacgagttactctggtttctgcaaggtgatacgaacgcgaaatatctgcaagaacacggtgtacgcatctggaacgaatgggcggacgagaacggtgatttagggcatatctatggctatcagtggcgttcgtggcccgactacgacggcggattcatcgaccagatcagcgaagcggtagagacgatcaagcacaatcccgactcccgccgtatcattgtcagcgcctggaatgtagccgatttaaagaatatgaacctgcctccctgtcatgccttcttccagttttacgtggcagacggtcggctgagcctgcaactttaccagcgcagcgcggatatatttctcggagtcccgttcaatatcgcatcatatgcactgctgctacaaatgatggcgcaggtgacaggactgaaagcgggtgaatttatccatacacttggcgatgcccatatctatctgaaccacttggatcaggtcaaattgcagcttagccgcgaaccacgcgcattgcctcaaatgaaaattaatccggatgtgaagagtatctatgacttccagttcgaagacttcgaactggtgaactacgacccgcatccacatattgccggaatagtagcggtataa

SEQ ID NO: 17729 - protein, 264 aa, Bacteroides thetaiotaomicron
MKQYLDLLNRVLTEGTEKSDRTGTGTISVFGHQMRFNLDEGFPCLTTKKLHLKSIIYELLWFLQGDTNAKYLQEHGVRIWNEWADENGDLGHIYGYQWRSWPDYDGGFIDQISEAVETIKHNPDSRRIIVSAWNVADLKNMNLPPCHAFFQFYVADGRLSLQLYQRSADIFLGVPFNIASYALLLQMMAQVTGLKAGEFIHTLGDAHIYLNHLDQVKLQLSREPRALPQMKINPDVKSIYDFQFEDFELVNYDPHPHIAGIVAV

SEQ ID NO: 17730 - DNA, 795 bp, Bartonella henselae
  CDS (1)..(795): transl_table=11
atgaaaacctatcttgatcttttatctcatgttttaaataaaggcattgatcgtactgacagaactggtgtaggaacacgatcggtttttggctatcagatgcggtttgatttacaggctggatttccattgttaacaacgaagaaattgcatttacgctcgatcatttatgagcttttgtggtttcttagaggtgataccaatattgcctggttgaaagaacatggtgtgtcaatttgggatgagtgggctgatgaaaaaggcaatcttggtcctatttatggttatcagtggcgttcttggccagctcctgatggacgtcatattgatcagatcagtaatcttttgatgatgattaaaaaaacgcctgattctcgtcgtttaattgtctctgcgtggaatcctgcctcgataaaggaaatggctcttccaccatgccattgtttttttcaattttatgttgcagatggtaaattgtcttgccaactttatcaacgttctgcagatatttttttaggtattccgttcaatattgcttcctatgcgttattaacaatgatgattgcacaagtaagtggtcttaaagtcggcgattttattcatactcttggtgatgcgcatctttattctaatcattttgaacaggctcaacatcaattgtctcgtataccaaatgctttgccgtttatgcgtataaatccagcggtaacagatcttttttcttttaaatttgaggattttgaattgcttaattatgatgcacaaccacatatcaaggcgccaatagcagtatga

SEQ ID NO: 17731 - protein, 264 aa, Bartonella henselae
MKTYLDLLSHVLNKGIDRTDRTGVGTRSVFGYQMRFDLQAGFPLLTTKKLHLRSIIYELLWFLRGDTNIAWLKEHGVSIWDEWADEKGNLGPIYGYQWRSWPAPDGRHIDQISNLLMMIKKTPDSRRLIVSAWNPASIKEMALPPCHCFFQFYVADGKLSCQLYQRSADIFLGIPFNIASYALLTMMIAQVSGLKVGDFIHTLGDAHLYSNHFEQAQHQLSRIPNALPFMRINPAVTDLFSFKFEDFELLNYDAQPHIKAPIAV

SEQ ID NO: 17732 - DNA, 795 bp, Bartonella quintana
  CDS (1)..(795): transl_table=11
atgaaaacttacctcgatcttttatctcatgttttaaataagggcattgatcgtacagaccgaactggtgttgggacgcgatcggtttttggctatcagatgcggtttgatttacagatcggatttccattgttaacaacgaagaaattgcatttacgctcgatcatttatgaacttttgtggtttcttagaggtgatacaaatgtcgcatggttaaaagaacatggtgtatcaatttgggatgagtgggctgatgaaaaaggcaatcttggtcctatttatggttatcaatggcgttcttggccagcttctgatggacgctatattgatcaaatcagtcgtcttttaacgatgattaaaaaaacacctgattctcgtcgcttgattgtctctgcgtggaatcctgcattgatagaagaaatggctttgccaccttgtcattgcttttttcaattttatgttgccgacgataagttgtcttgccagctttatcagcgttcggcggatatttttttaggtgttccgttcaatattgcttcttatgcgttgttaacgatgatgattgcgcaagtgagtggccttaaagccggtgatttcattcatactctcggcgatgcccatctttattctaatcattttgaacaggctcgataccaattatctcgtataccaaatgctttgccatcgatgcttataaatccatcggtaacagatcttttttcgtttaaattcgaggattttgaattgcttaattatgaagcgcaaccacatataaaggcaccggtagcagtatga

SEQ ID NO: 17733 - protein, 264 aa, Bartonella quintana
MKTYLDLLSHVLNKGIDRTDRTGVGTRSVFGYQMRFDLQIGFPLLTTKKLHLRSIIYELLWFLRGDTNVAWLKEHGVSIWDEWADEKGNLGPIYGYQWRSWPASDGRYIDQISRLLTMIKKTPDSRRLIVSAWNPALIEEMALPPCHCFFQFYVADDKLSCQLYQRSADIFLGVPFNIASYALLTMMIAQVSGLKAGDFIHTLGDAHLYSNHFEQARYQLSRIPNALPSMLINPSVTDLFSFKFEDFELLNYEAQPHIKAPVAV

SEQ ID NO: 17734 - DNA, 795 bp, Bdellovibrio bacteriovorus
  CDS (1)..(795): transl_table=11
atgaagcagtatcacgatctcatcaaaacagttctagaacatggcgtgaaaaaagaggaccgcacaggcaccggcactatttccatgttcggttatcagatgcgctacaatctgcaagagggcttccctctgctgaccaccaaaaaactgcacacgcgctcgatctttcatgaactgctgtggttcctgaagggtgaaaccaacatcaagtatcttcacgacaacaaagtgacgatctgggatgaatgggctgatgaaaacggcaacctgggcccggtgtacggaaaacaatggcgctcctgggaaacggccgacggccgcaccatcgatcagatcaccaacgtcgtagagcaaatcaaaaagaatccgaactcccgccgcatgctggtggtggcgttcaatccgggcgacgttgacaagatggctttgccgccatgtcacgccttcttccagttctatgtggcgaacggaaagctttcctgccagctgtatcagcgcagtgctgatatcttcctgggcgtgccgttcaatatcgccagctacgctttgctgacccatatgatcgcgcaagtttgtgatcttgaagtgggtgactttgttcacaccctgggtgatgcgcatctttacctgaatcaccttgaacaggcgaacctgcaactgacccgtgaattccgtccactgcctcagttgaaactgaacccggcaaagaaggatcttttcgacttcacttacgaagacatcgaaatcatcggttacgatccgcacccggccatcaaggctgaggtggcagtatga

SEQ ID NO: 17735 - protein, 264 aa, Bdellovibrio bacteriovorus
MKQYHDLIKTVLEHGVKKEDRTGTGTISMFGYQMRYNLQEGFPLLTTKKLHTRSIFHELLWFLKGETNIKYLHDNKVTIWDEWADENGNLGPVYGKQWRSWETADGRTIDQITNVVEQIKKNPNSRRMLVVAFNPGDVDKMALPPCHAFFQFYVANGKLSCQLYQRSADIFLGVPFNIASYALLTHMIAQVCDLEVGDFVHTLGDAHLYLNHLEQANLQLTREFRPLPQLKLNPAKKDLFDFTYEDIEIIGYDPHPAIKAEVAV

SEQ ID NO: 17736 - DNA, 801 bp, Bifidobacterium longum
  CDS (1)..(801): transl_table=11
atgccctatgaggacctggtgcgcaagatcctgaccgaaggcacgctgaagtccgatcgcaccggcaccggcacgatttccctgttcggccagcagatgcgctttgacctgtcgaagtacttcccgttgctgaccaccaagaccgtgttcttcaaaggcctggcctatgagctgctgtggtttttgaagggttcctccaacatcaactggctgctggagcacaacgtgcatatttgggatgagtgggcggacgagaacggcgatctgggcccggtctatggcgtgcagtggcgttcctggcccgcgccgacccccgaggacccgaatcgcaccatcgaccagatctccaatgtgctcgacctcatcaagcatcatccggattcgcgccgcatgatcgtctccgcgtggaatccggccgaggtggagaagatggcgttgccgccctgccacgcgctcttccagttctacgtggccgacgacaagctaagctgccagctgtaccagcgttcctgcgacatgttcctcggcgtgccgttcaatatcgcctcctactcgctgctcaccatgatgatggcgcagcaggccgggctcaagccgggcgaattcgtctggaccggcggcgactgccatgtttacgacaaccacgtcgaccagttccttgagcagctgggccgcaagccctacccgtacccgaccatcgagatccgtaaggccgattccctgttcgactaccagtatgaggacttcaaggtcgtcggctaccagcatcaccccactattaaggcacctgttgcggtctga

SEQ ID NO: 17737 - protein, 266 aa, Bifidobacterium longum
MPYEDLVRKILTEGTLKSDRTGTGTISLFGQQMRFDLSKYFPLLTTKTVFFKGLAYELLWFLKGSSNINWLLEHNVHIWDEWADENGDLGPVYGVQWRSWPAPTPEDPNRTIDQISNVLDLIKHHPDSRRMIVSAWNPAEVEKMALPPCHALFQFYVADDKLSCQLYQRSCDMFLGVPFNIASYSLLTMMMAQQAGLKPGEFVWTGGDCHVYDNHVDQFLEQLGRKPYPYPTIEIRKADSLFDYQYEDFKVVGYQHHPTIKAPVAV

SEQ ID NO: 17738 - DNA, 972 bp, Bordetella pertussis
  CDS (1)..(972): transl_table=11
atgaaacaatatctagacctcgtccaatccattctcgaccagggcgcctggcaggaaaaccgcaccggcgtgcgcacgctctcgctgcccggcgcggcgctgcgcttcgacctgcagcaggggtttcccgccgtcaccaccaagaagctggcgttcaagtccgccatcggcgaaatggtgggcttcctgcgcgccacgcgcagcgccgcgcagttccgcgcgctgggttgcaaggtctgggaccagaacgccaacgagaacgagcaatggctggccaacccgtaccgcgagggtcccgacgacctcggcccggtctacggcgtccaatggcgccattggccggcctacaagctgctgccgagcagcgccggcggccaggtggccgacgcgctggcgcgcggctaccgacaagtggccgaggtcgacgaaaacggcgcgccgcacgtgctgctgtacaaggcggtggaccagttgcgccagtgcctggacaccatccgccaatcgccgggcgaccgccgcatcctgttccatggctggaactgggcgcagatcgaggaaatggccctgccgccctgccatctgctctaccagttcctgcccaacgccggcacgcgcgaaatctcgctgtgcctgtacatccgctccaacgacgtcggcctgggcacgcccttcaacctgaccgagggcgcggcgctgctgcacctggtcggccgcctgaccggctacaagccgcgctggttcagctatttcatcggcgatgcgcacgtctacgaaaaccacctgccgatgctgcgcgagcaactggcgcgcgagccctatccggccccgcagctggtgctgtcggaccgcattcccgatttcgccgtgaccggcaagtacgagccgcaatggctggagcaggtcgagccgggcgatttcacgctgagcggctaccagcaccacgcgccgctgaccgcccccatggcggtctga

SEQ ID NO: 17739 - protein, 323 aa, Bordetella pertussis
MKQYLDLVQSILDQGAWQENRTGVRTLSLPGAALRFDLQQGFPAVTTKKLAFKSAIGEMVGFLRATRSAAQFRALGCKVWDQNANENEQWLANPYREGPDDLGPVYGVQWRHWPAYKLLPSSAGGQVADALARGYRQVAEVDENGAPHVLLYKAVDQLRQCLDTIRQSPGDRRILFHGWNWAQIEEMALPPCHLLYQFLPNAGTREISLCLYIRSNDVGLGTPFNLTEGAALLHLVGRLTGYKPRWFSYFIGDAHVYENHLPMLREQLAREPYPAPQLVLSDRIPDFAVTGKYEPQWLEQVEPGDFTLSGYQHHAPLTAPMAV

SEQ ID NO: 17740 - DNA, 840 bp, Bacteriophage phi
  CDS (1)..(840): transl_table=11
atgactcaattcgataaacaatacaattcaattataaaggatattatcaataatggaatctcagacgaagagtttgatgtaagaaccaagtgggactcagatggaacgccggcacatactctaagtgtaatgagtaagcaaatgagattcgacaactcagaggttccgattttaacgacaaaaaaggttgcctggaaaacagccattaaagagttactctggatttggcagctgaaatcgaacgatgttactgaattgaacaaaatgggcgtacatatttgggatcagtggaaacaagaagacggcaccatcggacatgcatatggatttcagctggggaagaaaaacagaagtctaaatggagaaaaagtggatcaggtagactatcttcttcatcaattgaagaacaacccgtcttcacgcagacacattacaatgctgtggaatcctgatgatttagacgcaatggccttaacgccatgtgtatacgagacacaatggtatgttaagcaaggtaagctccaccttgaggtaagagcacggagcaatgacatggcgttggggaatccattcaatgtattccagtacaatgtgttgcagcgcatgattgctcaagtgactggttatgagcttggtgaatatatctttaacattggggattgccatgtgtacacacgtcatatagacaatttgaaaatccagatggaaagagaacagtttgaagcacctgaactatggatcaatcctgaagtgaaagatttttataactttaccgttgatgatttcaaattaatcaactataaacatggggacaagcttttatttgaggtagcggtttaa

SEQ ID NO: 17741 - protein, 279 aa, Bacteriophage phi
MTQFDKQYNSIIKDIINNGISDEEFDVRTKWDSDGTPAHTLSVMSKQMRFDNSEVPILTTKKVAWKTAIKELLWIWQLKSNDVTELNKMGVHIWDQWKQEDGTIGHAYGFQLGKKNRSLNGEKVDQVDYLLHQLKNNPSSRRHITMLWNPDDLDAMALTPCVYETQWYVKQGKLHLEVRARSNDMALGNPFNVFQYNVLQRMIAQVTGYELGEYIFNIGDCHVYTRHIDNLKIQMEREQFEAPELWINPEVKDFYNFTVDDFKLINYKHGDKLLFEVAV

SEQ ID NO: 17742 - DNA, 861 bp, Bacteriophage T4
  CDS (1)..(861): transl_table=11
atgaaacaataccaagatttaattaaagacatttttgaaaatggttatgaaaccgatgatcgtacaggcacaggaacaattgctctgttcggatctaaattacgctgggatttaactaaaggttttcctgcggtaacaactaagaagctcgcctggaaagcttgcattgctgagctaatatggtttttatcaggaagcacaaatgtcaatgatttacgattaattcaacacgattcgttaatccaaggcaaaacagtctgggatgaaaattacgaaaatcaagcaaaagatttaggataccatagcggtgaacttggtccaatttatggaaaacagtggcgtgattttggtggtgtagaccaaattatagaagttattgatcgtattaaaaaactgccaaatgataggcgtcaaattgtttctgcatggaatccagctgaacttaaatatatggcattaccgccttgtcatatgttctatcagtttaatgtgcgtaatggctatttggatttgcagtggtatcaacgctcagtagatgttttcttgggtctaccgtttaatattgcgtcatatgctacgttagttcatattgtagctaagatgtgtaatcttattccaggggatttgatattttctggtggtaatactcatatctatatgaatcacgtagaacaatgtaaagaaattttgaggcgtgaacctaaagagctttgtgagctggtaataagtggtctaccttataaattccgatatctttctactaaagaacaattaaaatatgttcttaaacttaggcctaaagatttcgttcttaacaactatgtatcacaccctcctattaaaggaaagatggcggtgtaa

SEQ ID NO: 17743 - protein, 286 aa, Bacteriophage T4
MKQYQDLIKDIFENGYETDDRTGTGTIALFGSKLRWDLTKGFPAVTTKKLAWKACIAELIWFLSGSTNVNDLRLIQHDSLIQGKTVWDENYENQAKDLGYHSGELGPIYGKQWRDFGGVDQIIEVIDRIKKLPNDRRQIVSAWNPAELKYMALPPCHMFYQFNVRNGYLDLQWYQRSVDVFLGLPFNIASYATLVHIVAKMCNLIPGDLIFSGGNTHIYMNHVEQCKEILRREPKELCELVISGLPYKFRYLSTKEQLKYVLKLRPKDFVLNNYVSHPPIKGKMAV

SEQ ID NO: 17744 - DNA, 795 bp, Bradyrhizobium japonicum
  CDS (1)..(795): transl_table=11
atgcaccagtatcaggacctgctcgagcggattctttcagacggcgccgagaagaccgaccggaccggcaccggcacgctctcggtgttcggccatcagatgcgctttaatctgtcggccggcttcccgatgctgaccaccaagcggctgccgctgaaggcgatcgtgcacgagctgttgtggttcctgaagggcgacaccaacatcaaatatctgcgcgacaacggcgtcaccatctgggacgagtgggcggacgccaatggcgatctcggcccggtctacggtcatcagtggcgttcctggcccgcgccggacggacgcagcatcgaccagatcgccaacgtcgtcgacatgatcaagcgcaatccggactcgcgccgcctgatcgtctcggcctggaatccggccgaggtcgacaagatggcgttgccgccgtgccattgcctgttccagttctatgtcgccaacggcaagctgtcgtgccagctctatcagcgctcggccgacgtattcctcggcgtgcccttcaacatcgcctcctatgcgctgctcaccatgatggtggcgcaggtcacgggcctcaagcccggcgacttcgtgcattcgttcggcgacacccatctctattccaaccatctggagcaggcgaagctccagctcacgcgcgcgccgcgtgcgctgccggtgatgcggatcaatcctgacgtgaaggacatcttctccttccgcttcgaggatttcgagctcgtcggctacgatccgcacccgcacatcaaggcggaagtcgcggtctga

SEQ ID NO: 17745 - protein, 264 aa, Bradyrhizobium japonicum
MHQYQDLLERILSDGAEKTDRTGTGTLSVFGHQMRFNLSAGFPMLTTKRLPLKAIVHELLWFLKGDTNIKYLRDNGVTIWDEWADANGDLGPVYGHQWRSWPAPDGRSIDQIANVVDMIKRNPDSRRLIVSAWNPAEVDKMALPPCHCLFQFYVANGKLSCQLYQRSADVFLGVPFNIASYALLTMMVAQVTGLKPGDFVHSFGDTHLYSNHLEQAKLQLTRAPRALPVMRINPDVKDIFSFRFEDFELVGYDPHPHIKAEVAV

SEQ ID NO: 17746 - DNA, 795 bp, Brucella melitensis
  CDS (1)..(795): transl_table=11
atgcgcacctatcttgatcttctccagcatgtgctcgaccacggcgttgaccgtgacgaccgcacgggaacgggcacacgctcggtcttcggctatcagatgcggttcgacctggaggaggggtttccggttctcacgaccaagaaactccatttgcgttcgatcattcatgaactcttgtggttcctgaaaggcgatacgaacattgcctatctgaaagaaaacggcgttacgatctgggatgaatgggccgatgaaaacggcgatctggggccggtttatggctatcagtggcgttcatggcctgcgccggacggacggcatatcgaccagatcgcgaatcttttgaagatgttgcacacaaatcctcagtcgcggcgtctgattgtttcggcgtggaacccggcgctggtggatgaaatggctctgccgccctgccactgcctgttccagttctatgtcgccaatggcaggctttcctgccagctttaccagcgttccgcggatattttcctcggcgtgccgttcaatatcgcctcctatgccctgttgacgatgatgatcgcgcaggtgacggggctgaaaccgggcgagttcatccatacgctgggcgatgcccatatttattccaaccatttcgagcaggcacgactacaactgacccgcacgccgaagaagctgccggtgatgcatatcaacccggacgtgaaggatctctttgcctttcgtttcgaggatttccggctggatggctatgaagccgaccccacgatcaaagcgcctatcgcggtatag

SEQ ID NO: 17747 - protein, 264 aa, Brucella melitensis
MRTYLDLLQHVLDHGVDRDDRTGTGTRSVFGYQMRFDLEEGFPVLTTKKLHLRSIIHELLWFLKGDTNIAYLKENGVTIWDEWADENGDLGPVYGYQWRSWPAPDGRHIDQIANLLKMLHTNPQSRRLIVSAWNPALVDEMALPPCHCLFQFYVANGRLSCQLYQRSADIFLGVPFNIASYALLTMMIAQVTGLKPGEFIHTLGDAHIYSNHFEQARLQLTRTPKKLPVMHINPDVKDLFAFRFEDFRLDGYEADPTIKAPIAV

SEQ ID NO: 17748 - DNA, 795 bp, Buchnera aphidicola
  CDS (1)..(795): transl_table=11
atgaaacaatacatcaaattaattaaaaaaatcatcagggttggaaaccaaaaaaaagatcgcacaggaacaggaactttatctatttttggttataatatgaaatttgatttaaaaaaaggttttccacttcttactacaaaaaaatgtcatattgcatctatcatctacgagcttttatggtttttaaaaggagacacaaacatttcttatctaaatgaaaataaaatatcaatttggaataattgggcaaatgaatccggagatgttggtccaatatacggaaaacaatggcgtaattggagtacaccagaaggacacgaaattgatcaaataaaaaatgtattaatacaattaaaaaaaaatcccgattcccgtagaatgttagtttctagttggaatgttggagatatagataaaatgagattacctccttgccatgttctatttcaattttatgtatttaacaatacattaagttgtcaattgtaccagcgttcttgtgatgtgtttctaggactaccttttaatatagctagttactcaatacttatacacatgatagcacaacaatgtgatttaaaagttggagattttttgtggacaggaggcgatgttcacttatataataatcatatagaattagcaaaaaaacaaatactcagaatacctcgaacgcttcccaaactaaccatcctcaaaaaacctcagtcattatttcaatattgtttcgaagactttaaaattattggatatcatccttatcctgctatcaaaggagaaatatctatataa

SEQ ID NO: 17749 - protein, 264 aa, Buchnera aphidicola
MKQYIKLIKKIIRVGNQKKDRTGTGTLSIFGYNMKFDLKKGFPLLTTKKCHIASIIYELLWFLKGDTNISYLNENKISIWNNWANESGDVGPIYGKQWRNWSTPEGHEIDQIKNVLIQLKKNPDSRRMLVSSWNVGDIDKMRLPPCHVLFQFYVFNNTLSCQLYQRSCDVFLGLPFNIASYSILIHMIAQQCDLKVGDFLWTGGDVHLYNNHIELAKKQILRIPRTLPKLTILKKPQSLFQYCFEDFKIIGYHPYPAIKGEISI

SEQ ID NO: 17750 - DNA, 795 bp, Buchnera aphidicola
  CDS (1)..(795): transl_table=11
atgaaacaatatttagatttaataaaaaaaataattaaaaatggaaattcaaaaaaagatcgaaccggtacaggaactttatctatttttggacatcatatgaaatttgatttaaaaaaaggttttcctcttatcacaacaaaaaaatgtcatataccatcaattattcatgaacttttatggtttcttaggggagaaacaaatattaaatatcttaacgaaaataaaatatcaatttgggataactgggcagataaatttggtgatctaggtccaatttatggaaaacaatggagaagttgggatacatctaacggaaaaaaaatcgatcaaataaaaaacgtactaaaacaaataaaagaagatcctgattcacgtagaattttagtatctagttggaacgttggagaaattgataaaatgtctttagctccatgtcatatattatttcaattttacgtattaaaaaaaaaattaagttgtcaactttaccaacgttcttgcgatgtatttcttggtttgccttttaatatagctagctatgcaatactgatacatatgatagctcaacaatgtaatctacaagttggagaatttttatggacaggaggtgacgttcatttatataaaaatcatgttgaattggcgaaaaaacaaatattgagaatacctaaaaaattaccagagttaataattttaaaaaaacctcaatcattatttcaatattcttttgaagattttaaaattgttgggtataaaccatattccttaattaagggaaaaatatctgtataa

SEQ ID NO: 17751 - protein, 264 aa, Buchnera aphidicola
MKQYLDLIKKIIKNGNSKKDRTGTGTLSIFGHHMKFDLKKGFPLITTKKCHIPSIIHELLWFLRGETNIKYLNENKISIWDNWADKFGDLGPIYGKQWRSWDTSNGKKIDQIKNVLKQIKEDPDSRRILVSSWNVGEIDKMSLAPCHILFQFYVLKKKLSCQLYQRSCDVFLGLPFNIASYAILIHMIAQQCNLQVGEFLWTGGDVHLYKNHVELAKKQILRIPKKLPELIILKKPQSLFQYSFEDFKIVGYKPYSLIKGKISV

SEQ ID NO: 17752 - DNA, 795 bp, Buchnera aphidicola
  CDS (1)..(795): transl_table=11
atgaagagttatttggttttgttaaaaaaaatattaaaagaaggaagtaataggaaagatcgaacaggaataggaacattatcagtttttggatatcatatggaatttaatttgaaattgggatttccgttaattacgactaaaaaatgtcattttcctgctatagttcatgaacttttgtggtttttaaagggagatacaaatataaagtatttaaatgatcataatatatctatttggaatccatgggctgatgaacgtggatatttaggtccaatttatggagaacaatggagatcatggaaaacaaaagatggacgtgtaattgatcaaatagataatgtaatacatttaataaaaaacaatccaaattctcgaagaatagttgtatctagttggaatgttggtgatttacataaaatggcattattaccatgtcatgtattatttcagtttcacgttgttgatcacgttttgcattgtcaattatatcagcgatcttgtgatgtttttcttggtttgccttttaatatagctagttattctttattaacacatatgatagcacaacagtgtaatctaaaagtaggtaattttatatggactggcggtgatgtgcatttatataaaaatcatatcaaacaagctaaaaaacaaattttaagacgtccttatttacttccaaaattagttattaacagaaaacctactcaaatatttaattatcttttacaagattttaatttattgaattataaatatcatccttctattcatgctaaaatagcaatataa

SEQ ID NO: 17753 - protein, 264 aa, Buchnera aphidicola
MKSYLVLLKKILKEGSNRKDRTGIGTLSVFGYHMEFNLKLGFPLITTKKCHFPAIVHELLWFLKGDTNIKYLNDHNISIWNPWADERGYLGPIYGEQWRSWKTKDGRVIDQIDNVIHLIKNNPNSRRIVVSSWNVGDLHKMALLPCHVLFQFHVVDHVLHCQLYQRSCDVFLGLPFNIASYSLLTHMIAQQCNLKVGNFIWTGGDVHLYKNHIKQAKKQILRRPYLLPKLVINRKPTQIFNYLLQDFNLLNYKYHPSIHAKIAI

SEQ ID NO: 17754 - DNA, 840 bp, Caulobacter crescentus
  CDS (1)..(840): transl_table=11
atgagcaccgccgtcctcgacgcccccaaagccgcgaccgaccatcccgagcggcagtacctgaccctgctggccgacatcctggagaatggcgtccagcgcggcgaccgcacgggcacggggacactgggcgtattcggccgccagatccgctttgacctggccaagggcttcccggtcctgaccaccaagaagctgcacctgcgctcgatcatcatcgagctgctgtggttcctgaagggcgacaccaacatcgcctatctcaaggacaacggcgtgcgcatctgggacgagtgggccgacgagaacggcgacctgggtcccgtctatggcaagcagtggcgctcctgggccacgcctgacggccgggtgatcgaccagatctcggccctggtcgagaacctgaaggccaaccccaacagccgccgccacatcgtcacggcctggaacccggccgatgtcgacgacatggccctgccgccttgccactgcctgttccagttcttcgtggcggatggaaaactgagctgccagctctaccagcgcagcgccgacgtgttcttaggggtgccgttcaacatcgccagctacgccctgctcaccctgatggtcgccaaggtcgtgggcctggagcccggcgagttcgtccacaccttcggcgacgcccacctctatctgaaccacctggatcaggcccgcgagcaactgacccgcgagcccttcgactttcccacgatgaagatcgccgacaagcgcgacctcttcgggttcgagtacgaggacttcacgctggagggctatcaggcccacccgcacatcaaggccgaggtttcggtctag

SEQ ID NO: 17755 - protein, 279 aa, Caulobacter crescentus
MSTAVLDAPKAATDHPERQYLTLLADILENGVQRGDRTGTGTLGVFGRQIRFDLAKGFPVLTTKKLHLRSIIIELLWFLKGDTNIAYLKDNGVRIWDEWADENGDLGPVYGKQWRSWATPDGRVIDQISALVENLKANPNSRRHIVTAWNPADVDDMALPPCHCLFQFFVADGKLSCQLYQRSADVFLGVPFNIASYALLTLMVAKVVGLEPGEFVHTFGDAHLYLNHLDQAREQLTREPFDFPTMKIADKRDLFGFEYEDFTLEGYQAHPHIKAEVSV

SEQ ID NO: 17756 - DNA, 795 bp, Chromobacterium violaceum
  CDS (1)..(795): transl_table=11
atgcaacagtacctcgacctgatgcgccatgtgctggaacatggacacgacaaggcagaccgcaccggaaccggcacccgctcggtgttcggctaccagatgcgcttcgatttggcggccggcttcccgctggtcaccaccaagaaatgccatctgcgctccatcattcatgaactgctgtggttcctgtcgggcgacaccaatatccgctacctgaaggaaaacggcgtgtcgatctgggacgagtgggccgacgagaacggcgacctggggccggtctacggctaccagtggcgcagctggccggcgccggacggccgccacatcgaccagatcagccagctcttggacatgatcaagaagaatccggactcgcgccggctgatcgtgtcggcgtggaatccggcgctggtggaccagatggcgctgccgccgtgccacagcctgtttcagttctacgtcgccaatgggcgcctgtcctgccagctgtaccagcgttcggccgacatcttcctcggcgtgccgttcaacatcgccagctacgcgttgctgaccatgatggtggcccaggtgtgcggcctgcagcccggcgatttcgtccacacgctgggcgacgcccacctgtacagcaaccacctggagcaggcccggctgcaactgacgcgcgatccccgcccgctgccgacgatgaagctgaacccggaggtgaaggatctgttcgcgttcaccttcgacgacttcgcgctggaaggctacgatccgcatccgcacatcaaggcgcaggtggcggtatga

SEQ ID NO: 17757 - protein, 264 aa, Chromobacterium violaceum
MQQYLDLMRHVLEHGHDKADRTGTGTRSVFGYQMRFDLAAGFPLVTTKKCHLRSIIHELLWFLSGDTNIRYLKENGVSIWDEWADENGDLGPVYGYQWRSWPAPDGRHIDQISQLLDMIKKNPDSRRLIVSAWNPALVDQMALPPCHSLFQFYVANGRLSCQLYQRSADIFLGVPFNIASYALLTMMVAQVCGLQPGDFVHTLGDAHLYSNHLEQARLQLTRDPRPLPTMKLNPEVKDLFAFTFDDFALEGYDPHPHIKAQVAV

SEQ ID NO: 17758 - DNA, 792 bp, Clostridium acetobutylicum
  CDS (1)..(792): transl_table=11
atgagcaaagctgatgaaaaatatttagatataatagaaaacattttagaaaatggttattatgataacaatagaacaggaattgaaacctataagcttcctcatcaaattatgcagtttgacttgtccaaagagtttccaatactcacaacaaaatttgttgcttttaaaacttctgtaaaggagcttttgtggatatataaagatcaatcaaacgatgtgagaaaacttcaaaatgagaatgttaccatatgggatgaatggatgctcgaagacggcactataggaaaagcttacggttatcaagtagctaaatttaaacaaattgacaatctaatagacaccttaaaaacggaccctcaaagtagacgaatgcttatatccttatggaatatagccgacttaaaggatatgtctcttacaccttgctgctatgaaacactgtgggatgtacaaaatggcaaactaaattgtatgctagttcaaagaagtggtgacatgcctttaggtgtaccttttaatatgtgccaatatgcagttttagtacatttaatagcccaggttactggccttaaaccaggtctctttactcatgtgataaataatgctcatatatataaaaatcaaattgaaggtatgaaaattcaacttaaaagaagagataaggcatacgaagcaccaaagctgtggataaatcctaacattaaaaatttttatgattttacagctgatgacattaaattaatagattacaaacatcacgataaaataaaaatggaggtggccgtgtaa

SEQ ID NO: 17759 - protein, 263 aa, Clostridium acetobutylicum
MSKADEKYLDIIENILENGYYDNNRTGIETYKLPHQIMQFDLSKEFPILTTKFVAFKTSVKELLWIYKDQSNDVRKLQNENVTIWDEWMLEDGTIGKAYGYQVAKFKQIDNLIDTLKTDPQSRRMLISLWNIADLKDMSLTPCCYETLWDVQNGKLNCMLVQRSGDMPLGVPFNMCQYAVLVHLIAQVTGLKPGLFTHVINNAHIYKNQIEGMKIQLKRRDKAYEAPKLWINPNIKNFYDFTADDIKLIDYKHHDKIKMEVAV

SEQ ID NO: 17760 - DNA, 813 bp, Corynebacterium diphtheriae
  CDS (1)..(813): transl_table=11
atgagcaccaacaacaccataaaaaccccgtatgaagaccttcttcgcacaatccttgaacagggctcccacaaagacgaccgtaccggcaccggtacaaccagcctttttggccaacagatgcgtttcgatctcaccgaggccttcccactcatcaccaccaagaaggtgtattggaaaggtgtaatcggagaactcctctggttcctgcaaggctcctccaatgttcgctggctccaaaagcgcaacattcacatctgggatgaatgggcttccgaagaaggcgaactgggacctgtttatggtgttcaatggcgcagctggcctacccctgatgggcagcatgtggaccagatcgcccaagcactagatatactcaaaaacaatccggactctaggcgcaacatcgtctcagcgtggaacgtggccgatctcaacaatatggcgcttccaccgtgccacttgttgttccagctttatgttgccgatggaaagttgagctgccagctctaccagcgcagcgcagacatgttcttaggtgttccgtttaatatcgcctcctactccgctctcacacatatgctcgcacaacaagcaggccttaaggtcggcgagttcatttggactggcggcgactgccacatctacgacaatcatcgcgagcaggttctcacccagctctcacgtgaacctcgcccctaccctcagttgacattgcggaaagcctcctcgatcttcgactacgacttcgacgatttcactatcgagggctacgatcctcacccagcgattcgtggcgaggtagcagtgtaa

SEQ ID NO: 17761 - protein, 270 aa, Corynebacterium diphtheriae
MSTNNTIKTPYEDLLRTILEQGSHKDDRTGTGTTSLFGQQMRFDLTEAFPLITTKKVYWKGVIGELLWFLQGSSNVRWLQKRNIHIWDEWASEEGELGPVYGVQWRSWPTPDGQHVDQIAQALDILKNNPDSRRNIVSAWNVADLNNMALPPCHLLFQLYVADGKLSCQLYQRSADMFLGVPFNIASYSALTHMLAQQAGLKVGEFIWTGGDCHIYDNHREQVLTQLSREPRPYPQLTLRKASSIFDYDFDDFTIEGYDPHPAIRGEVAV

SEQ ID NO: 17762 - DNA, 804 bp, Corynebacterium efficiens
  CDS (1)..(804): transl_table=11
atgactgccattcccaccccatatgaggacctcctccgcaccatcagagacgaaggcgcccataaggacgatcgcaccggcaccggcaccacctccctgttcggccagcagatccgttacaacctgcaggagggtttccccctcctgaccaccaagaaggttcatttccactccgtggtcggtgaactgctgtggttcctgcgcggtgactccaacgtccgttggctccaggacaacaacatccgcatctggaacgagtgggccgatgaggacggcgagctcggtcccgtctacggcgtgcagtggcgcagctggcccaccccggacggtcgccacatcgaccagatctcgcgtgcactggagatgctgaagaacaatccggattcccgccgtaacatcgtctccgcatggaacgtctccgaactggagaacatggcgcttcccccctgtcatctgctgttccagctgtatgtcgccgatgggaaactgtcctgccagctctaccagcgcagcgccgacatgttcctcggtgtgcccttcaacatcgcctcctacgccctgctgacgcacatgttcgcccagcaggcagacctggaggtgggtgagttcatctggaccggcggtgactgccacatctatgacaatcacaccgaacaggtcgatgaacagctgagccgcgcggcgcgcccctaccccaccctggaactgaacaaggctgcgtccctgttcgactacaccttcgaggacattgccgtgagcaactacgatccgcacccgctcatccgcggcaaggtcgcggtatga

SEQ ID NO: 17763 - protein, 267 aa, Corynebacterium efficiens
MTAIPTPYEDLLRTIRDEGAHKDDRTGTGTTSLFGQQIRYNLQEGFPLLTTKKVHFHSVVGELLWFLRGDSNVRWLQDNNIRIWNEWADEDGELGPVYGVQWRSWPTPDGRHIDQISRALEMLKNNPDSRRNIVSAWNVSELENMALPPCHLLFQLYVADGKLSCQLYQRSADMFLGVPFNIASYALLTHMFAQQADLEVGEFIWTGGDCHIYDNHTEQVDEQLSRAARPYPTLELNKAASLFDYTFEDIAVSNYDPHPLIRGKVAV

SEQ ID NO: 17764 - DNA, 801 bp, Corynebacterium glutamicum
  CDS (1)..(801): transl_table=11
atgactgttccaacgccttatgaagaccttcttcggaagattgctgaagaagggtcccacaaggacgaccgcaccggcaccggcactacttctttattcggacaacaaatccgctttgatctcaatgaaggttttccccttctgaccaccaagaaggtccatttccactctgttgtgggtgagcttttgtggttccttcagggggattccaacgtcaaatggctgcaggataacaacatccgcatttggaatgaatgggcagatgaggacggcgagctgggccctgtttatggtgtccagtggcgttcttggccaacccctgatggtcgtcacattgaccagatctcaggtgctttagaaactctgcgaaacaaccctgattcacgtcgcaatattgtctcggcgtggaatgtttccgagcttgaaaacatggctcttcccccttgtcacttgcttttccagctctatgtcgccgatggcaaactgtcttgccagctctaccagcgttctgcggacatgttcctgggtgtgcctttcaacatcgcatcttatgcactgctcacccacatgtttgcccagcaggcaggcttggaagtcggcgagttcatttggactggcggcgactgccacatttatgacaaccacaaggaacaggtcgcggagcagctgagccgcgaagctcgcccctaccccaccttggagctcaacaaggcagcgtccatgtttgagtacagcttcgatgacatcaccgtgtccggctacgatccacacccattgatccgcggcaaggtcgccgtatga

SEQ ID NO: 17765 - protein, 266 aa, Corynebacterium glutamicum
MTVPTPYEDLLRKIAEEGSHKDDRTGTGTTSLFGQQIRFDLNEGFPLLTTKKVHFHSVVGELLWFLQGDSNVKWLQDNNIRIWNEWADEDGELGPVYGVQWRSWPTPDGRHIDQISGALETLRNNPDSRRNIVSAWNVSELENMALPPCHLLFQLYVADGKLSCQLYQRSADMFLGVPFNIASYALLTHMFAQQAGLEVGEFIWTGGDCHIYDNHKEQVAEQLSREARPYPTLELNKAASMFEYSFDDITVSGYDPHPLIRGKVAV

SEQ ID NO: 17766 - DNA, 795 bp, Coxiella burnetii
  CDS (1)..(795)
atgaaagaatatcttaattttttgcaatttatccttgatcacggagtcgctaaaacggaccggaccggaataggaacgaaaagtgtttttggctacgaaatgcgctttaatctgcgggaaggttttccgttagttaccactaagaaaatccatttgaaaagtgttatttatgaattgttatggtttttacggggtgacacgaatattcagtttttaaacgacaatggtgtaaccatttgggatgaatgggccgatgaaaacggcgatttaggtccgatttatggcaaacaatggcgtcgctggcactgcccggatggtcgcaccgtcgatcaaatgcaacgattaattcgcgaaataaaaactaaccccgattcacggcgtttaattgtcagcgcctggaatgtcggtgaacttgatcaaatggcattgccaccctgtcatttactttttcaattttatgtggcggatggttttctttcttgtaaattaacgcaacgttcagccgacgcttttttaggcgtgccgtttaatattgcttcttattcacttttaactcacctgatcgcgcgacaatgcaatttaaaagcgggtgaatttatttggtctggcggagattgtcatatttataatacccatcaagaccaagtaagcacccaattgtcgcgcgagccacgtgctttacctcaattaatcatcaaccgtgatccttcatccttatacgattataattttaacgatttttccatcgtgaattatcacccacatcccgctattaaagcaccggtcgcggtgtag

SEQ ID NO: 17767 - protein, 264 aa, Coxiella burnetii
MKEYLNFLQFILDHGVAKTDRTGIGTKSVFGYEMRFNLREGFPLVTTKKIHLKSVIYELLWFLRGDTNIQFLNDNGVTIWDEWADENGDLGPIYGKQWRRWHCPDGRTVDQMQRLIREIKTNPDSRRLIVSAWNVGELDQMALPPCHLLFQFYVADGFLSCKLTQRSADAFLGVPFNIASYSLLTHLIARQCNLKAGEFIWSGGDCHIYNTHQDQVSTQLSREPRALPQLIINRDPSSLYDYNFNDFSIVNYHPHPAIKAPVAV

SEQ ID NO: 17768 - DNA, 954 bp, Cryptococcus neoformans
  CDS (1)..(954)
atgacagcaacaatcgacgaccaggaaaagaaccaacgatctaacccggaccacgaggaatatcagtacctcgatctcattaggcgaatcattaacgtaggagaggttcggccagaccgtaccggtacaggaactgttgctctctttgctcctccttctttccgcttttccctcgccgacaacacccttcctcttctgacgacgaaacgcgtcttccttcgcggtgtcattgccgagcttttgtggttcgtttctggctgtaccgacgccaaaatgctctctagccagggtgtagggatctgggatggtaatggaagcaaagaattcctggagaaggtcggacttggccacagaagggaaggtgatctgggacctgtatacgggttccagtggagacattttggtgccgagtacactgatgccgacggagactacaagggcaaaggagtcgaccaattgcaaagggtaatcgacactatcaagaacaacccaactgacagacggattatcttatcggcttggaacccaaaggatcttcccctgatggctcttccgccctgccacatgttctgccaattcttcgtctcacttcctcctgctgattcaccgggttccaagccaaaactttcttgcttgatgtatcagaggtcttgtgacttaggccttggtgtcccattcaacattgcgtcttacgcactgctaacccatatgattgccctcattaccgacaccgaaccgcatgagtttattttacaaatgggagatgcgcatgtgtacagggatcatgttgagccattgaagacgcaactggaaagggagcctagagatttccccaagttaaaatgggctaggagcaaggaagaaattggagacatcgatggtttcaaggttgaggactttgtggttgagggatacaagccatgggggaaaatcgacatgaagatgtctgcttaa

SEQ ID NO: 17769 - protein, 317 aa, Cryptococcus neoformans
MTATIDDQEKNQRSNPDHEEYQYLDLIRRIINVGEVRPDRTGTGTVALFAPPSFRFSLADNTLPLLTTKRVFLRGVIAELLWFVSGCTDAKMLSSQGVGIWDGNGSKEFLEKVGLGHRREGDLGPVYGFQWRHFGAEYTDADGDYKGKGVDQLQRVIDTIKNNPTDRRIILSAWNPKDLPLMALPPCHMFCQFFVSLPPADSPGSKPKLSCLMYQRSCDLGLGVPFNIASYALLTHMIALITDTEPHEFILQMGDAHVYRDHVEPLKTQLEREPRDFPKLKWARSKEEIGDIDGFKVEDFVVEGYKPWGKIDMKMSA

SEQ ID NO: 17770 - DNA, 966 bp, Drosophila melanogaster
  CDS (1)..(966)
atggttttaacaccaacgaaagatgggcccgaccaggagagcatgccgttgccggccgacaatggggagtcaccaagtaaacagcaggcccctgtcaatcgggatgagatgcactacttggatcttctgaggcacatcatcgcaaatggagagcagcggatggaccgcacggaggtgggcactctgtccgtgttcggcagtcagatgcgcttcgacatgcggaactcctttcctttgctgaccacgaagcgcgtcttcttccgcgcggtggccgaggagctgctgtggttcgtggcgggcaagacggacgccaagctgctgcaggcgaagaatgtgcacatctgggatgggaacagctccagagaatttctggacaagatggggttcacggggcgagccgttggggatctggggccggtgtacggcttccaatggaggcatttcggggcgcagtacggcacctgcgacgacgactacagcggcaaggggatcgaccagctgcgccaggtgatcgacaccatcaggaataacccctcagaccgtcgcatcatcatgtcggcttggaatccactggacatcccaaagatggccctgccgccgtgccactgcttggcgcagttttacgtctccgagaagcgcggtgagctttcgtgccagctataccagagaagcgcagacatgggcctgggcgtacccttcaacatcgcctcctatgccctgctcacccacatgattgcccatgtgacgggtctgaagccgggcgactttgttcacaccatgggcgacacacacgtctacctgaaccacgtagagccgctgaaggagcaactggagcgcacaccgcgaccctttcccaagctgatcattaaacgtcaggtgcaggacatcgaggacttccgcttcgaggactttcagatagtcgactacaatccacatccaaaaatccaaatggacatggccgtgtag

SEQ ID NO: 17771 - protein, 321 aa, Drosophila melanogaster
MVLTPTKDGPDQESMPLPADNGESPSKQQAPVNRDEMHYLDLLRHIIANGEQRMDRTEVGTLSVFGSQMRFDMRNSFPLLTTKRVFFRAVAEELLWFVAGKTDAKLLQAKNVHIWDGNSSREFLDKMGFTGRAVGDLGPVYGFQWRHFGAQYGTCDDDYSGKGIDQLRQVIDTIRNNPSDRRIIMSAWNPLDIPKMALPPCHCLAQFYVSEKRGELSCQLYQRSADMGLGVPFNIASYALLTHMIAHVTGLKPGDFVHTMGDTHVYLNHVEPLKEQLERTPRPFPKLIIKRQVQDIEDFRFEDFQIVDYNPHPKIQMDMAV

SEQ ID NO: 17772 - DNA, 870 bp, Equine herpesvirus 2
  CDS (1)..(870)
atggtcacccactgcgagcaccagtacctcaacaccgtcagggagatcctggcgaacggggtgcgcaggggggacaggacgggcgtgggcaccctgtccgtcttcggggaccaggccaagtactccctgcggggccagttccccctgctgaccaccaagagggtcttctggaggggggtcctcgaagagctgctctggttcatcagggggtccacggactccaatgagctctccgcgaggggcgtcaagatctgggacgccaacgggtcccgggacttcctcgcccgggccgggctggggcacagggagcccggggacctggggcccgtctacgggttccagtggaggcacttcggggccgcgtacgtggactccaagacagattaccgggggcagggcgtggaccagctcagggacctgataggggagatcaagaggaaccccgagagcaggaggctcgtcctcaccgcctggaacccggcggacctgcccgccatggccctgccgccctgccacctcctgtgccagttctacgtggcgggcggggagctctcctgccagctgtaccagcgctcgggggacatggggctgggggtgcccttcaacatagccagctactccctgctgacctacatggtcgcccacctcacgggcctcgagcccggggacttcatccacgtcctgggggacgcgcacgtctacctcaaccacgtggagcccctgaagctccagctgaccaggagcccccggccctttcccaggctcaggatcctgaggcgggtggaggacatagatgacttcagggcggaggactttgcgctggagggctaccacccccacgcggccatccccatggagatggcggtctaa

SEQ ID NO: 17773 - protein, 289 aa, Equine herpesvirus 2
MVTHCEHQYLNTVREILANGVRRGDRTGVGTLSVFGDQAKYSLRGQFPLLTTKRVFWRGVLEELLWFIRGSTDSNELSARGVKIWDANGSRDFLARAGLGHREPGDLGPVYGFQWRHFGAAYVDSKTDYRGQGVDQLRDLIGEIKRNPESRRLVLTAWNPADLPAMALPPCHLLCQFYVAGGELSCQLYQRSGDMGLGVPFNIASYSLLTYMVAHLTGLEPGDFIHVLGDAHVYLNHVEPLKLQLTRSPRPFPRLRILRRVEDIDDFRAEDFALEGYHPHAAIPMEMAV

SEQ ID NO: 17774 - DNA, 948 bp, Enterococcus faecalis
  CDS (1)..(948): transl_table=11
atggaagaagcatacttagcgctaggaaaaaagattttagaagaaggtcattttaaagaagaccgtacaggaactgggacgtatagtttatttggctatcaaatgcgttttgatttggccaaaggatttcccttactaacaaccaaacgagtaccgtttggcttgattaaaagtgagttattgtggtttttaaaaggcgacacgaatattcgctatttgttagagcgaaataatcatatttgggatgaatgggcgttcgaacgttacgtaaaaagcgcagattatcaaggaccagacatgacggattttgggcatcgtgtcttacaagatccagcgtttgcagaacaatacaaagaagaacatcaaaaattctgtgatgccattttaaatgatgcagagtttgcagaaaaatatggtgaattagggaatatttatggtgcacaatggcgtcactgggaaaccaaagatggtagctttatcgatcaattagctaatgtgattgaaatgattaaaaccaatcctgattctcgccgtttaattgtttccgcttggaatccagaagatgtgccttcaatggcgttgccgccttgtcacactatgtttcaattttatgtaaatgaaggaaaattaagctgtcaactttatcagcgcagtgccgatgtttttttaggtgttccttttaacattgcaagctatgctttattgacacatctgattgcgcatgaaacaggtttagaagtgggggagtttgtacacacgctaggagatgcccacttatatcaaaatcatgtggaacaaatgcaagaacaattatcacgagaagttcgttctttcccaacgctcgttttgaatccagacaaggcttctgtttttgattttgatatggaagatattaaagtagaaggctatgacccacatccaacgattaaagcgccgattgccgtataa

SEQ ID NO: 17775 - protein, 315 aa, Enterococcus faecalis
MEEAYLALGKKILEEGHFKEDRTGTGTYSLFGYQMRFDLAKGFPLLTTKRVPFGLIKSELLWFLKGDTNIRYLLERNNHIWDEWAFERYVKSADYQGPDMTDFGHRVLQDPAFAEQYKEEHQKFCDAILNDAEFAEKYGELGNIYGAQWRHWETKDGSFIDQLANVIEMIKTNPDSRRLIVSAWNPEDVPSMALPPCHTMFQFYVNEGKLSCQLYQRSADVFLGVPFNIASYALLTHLIAHETGLEVGEFVHTLGDAHLYQNHVEQMQEQLSREVRSFPTLVLNPDKASVFDFDMEDIKVEGYDPHPTIKAPIAV

SEQ ID NO: 17776 - DNA, 795 bp, Erwinia carotovora
  CDS (1)..(795): transl_table=11
atgaaacagtatctggatctgatgaaaaaagtgcttgaagaaggcacgccgaaggccgaccgtaccggtacgggcacgcgttccattttcggccatcagatgcgtttcaacttgcaggacgggtttccgctggttaccaccaaaaaatgccacctgcgttcgattatccatgaactactttggtttctgaacggcgataccaatgttgcttatctgaatgaaaacaaagtcagtatttgggacgaatgggcagatgagaacggtgatttggggccagtttacggtaaacagtggcgttcgtggggagccgcagacggtcgtcagatcgaccagttgaagaatgtcctgacccagttgagacaggatccagattctcgccgtattatcgtgtctgcctggaacgtgggcgagttggacaaaatggcgctggcaccgtgccacgcgtttttccagttctacgtggcagatggcaaactctcttgccagctttatcagcgctcgtgcgatatcttcctcggcctgccgttcaacatcgccagctatgcgcttctggtgcatatggtggcgcagcagtgcgatctggacgtcggtgatttcgtctggacaggtggtgacacgcatctgtacaacaaccatatggaacagacgcacttacagttgagccgtgaaccgcgcgcattgcctaagctggtgattaaacgccgcccagatacgctgttcgactatcgtttcgaagattttgaaatcgagggatacgatccgcatcctgccatcaaagcaccggtggcaatctaa

SEQ ID NO: 17777 - protein, 264 aa, Erwinia carotovora
MKQYLDLMKKVLEEGTPKADRTGTGTRSIFGHQMRFNLQDGFPLVTTKKCHLRSIIHELLWFLNGDTNVAYLNENKVSIWDEWADENGDLGPVYGKQWRSWGAADGRQIDQLKNVLTQLRQDPDSRRIIVSAWNVGELDKMALAPCHAFFQFYVADGKLSCQLYQRSCDIFLGLPFNIASYALLVHMVAQQCDLDVGDFVWTGGDTHLYNNHMEQTHLQLSREPRALPKLVIKRRPDTLFDYRFEDFEIEGYDPHPAIKAPVAI

SEQ ID NO: 17778 - DNA, 825 bp, Francisella tularensis
  CDS (1)..(825): transl_table=11
atgcaagaatatctaaatttccttaagtatatcaaagaaaatggcgttttaaagggtgatagaaccggtactggaacaagaagtatctttggctatcaaatgcgttttgatcttcaaaaaggcttcccattagtaactacaaaaaaaattcatattcctagtgttgttcatgaattattatggtttttaagtggtagtacaaatatcaaatatcttaatgataacaatgttagaatttggaatgagtgggcaactgtagatggcgaacttggtcctatttatggcaagcagtggcgtgattttaatggtcaaggtatagatcaaattgccgatgtaattcagatgctaaaaacaaacccaaactcacgtaggattctagtttcagcgtggaatccatgtgttgttccatcagaaaaaatctctccacaagaaaatgttgtaaaaggtaattcagccctaccaccatgccatgcaatgtttcagttctatgtagcaaataataaactatcatgcatgcttacgcaaagaagtgctgatgcttttcttggagtgccatttaacattgcaagttattcactactgacaaatatggttgcacaacaatgtaatcttgatgttggtgagttcatctggtcaggtggtgattgtcatatttacaataatcatattgagcaagtcaatgaacagcttagtcgtgagcctttagctttaccaacactaaagattttaagaaaaccaaactccatctttgattataaatacgaagattttgaatttgagaactataaccatcaccctgccatcaaagcaaaaatatctgtataa

SEQ ID NO: 17779 - protein, 274 aa, Francisella tularensis
MQEYLNFLKYIKENGVLKGDRTGTGTRSIFGYQMRFDLQKGFPLVTTKKIHIPSVVHELLWFLSGSTNIKYLNDNNVRIWNEWATVDGELGPIYGKQWRDFNGQGIDQIADVIQMLKTNPNSRRILVSAWNPCVVPSEKISPQENVVKGNSALPPCHAMFQFYVANNKLSCMLTQRSADAFLGVPFNIASYSLLTNMVAQQCNLDVGEFIWSGGDCHIYNNHIEQVNEQLSREPLALPTLKILRKPNSIFDYKYEDFEFENYNHHPAIKAKISV

SEQ ID NO: 17780 - DNA, 828 bp, Fusobacterium nucleatum
  CDS (1)..(828): transl_table=11
atgaaagctagatttgataaaatatataaagatatagttgacacaatagcagaaaaaggaatttggagtgaggggaatgttagaacaaaatatgcagatggaacagctgcacattataaaagctatataggctaccaatttagacttgataactcagatgatgaagcacatttaataacttcaagatttgcaccaagtaaagcaccaataagagaactatattggatatggatattacaatcaaataatgttgatgttttaaatgagttaggttgtaagttttgggatgaatggaaaatgcaagatgggactattggaaaggcctatggttatcaaatagctcaagaaacttttgggcaaaaatctcaacttcattatgtaataaatgaattgaaaaaaaatcctaatagcagaagaattatgacagaaatttggatacctaatgaactttcagaaatggcattaacaccttgtgtacatttaactcaatggtcagtaattgggaataaattgtatttagaagttagacaaagaagttgtgatgtagcattgggcttagttgctaatgtatttcaatattcagttttacataaattagtagcacttgaatgtggacttgagccagcagaaataatttggaatatacataatatgcatatttatgatagacattatgataagttaatagaacaagttaatagagaaacatttgaacctgcaaaaataaaaataaataattttaaatcaatatttgattttaaacctgatgatatagaaataattgattataagtatggagaaaaagttagctatgaggtggctatttaa

SEQ ID NO: 17781 - protein, 275 aa, Fusobacterium nucleatum
MKARFDKIYKDIVDTIAEKGIWSEGNVRTKYADGTAAHYKSYIGYQFRLDNSDDEAHLITSRFAPSKAPIRELYWIWILQSNNVDVLNELGCKFWDEWKMQDGTIGKAYGYQIAQETFGQKSQLHYVINELKKNPNSRRIMTEIWIPNELSEMALTPCVHLTQWSVIGNKLYLEVRQRSCDVALGLVANVFQYSVLHKLVALECGLEPAEIIWNIHNMHIYDRHYDKLIEQVNRETFEPAKIKINNFKSIFDFKPDDIEIIDYKYGEKVSYEVAI

SEQ ID NO: 17782 - DNA, 795 bp, Geobacillus kaustophilus
  CDS (1)..(795): transl_table=11
ttgcggcaatatttgcagcttttggaggatattttggaaaacggcgtcgaaaaagaagaccgcacgggcgtcggcacgctgtcggtgttcggccgccagctccgcttcaacttgcaagatggatttccgctcgtgacaacgaaaaaattgcatatccgctccatcatttatgaactgctttggtttttaaaaggcgatacgaacgtccgctatttgcaggagaatggcgtgacgatttgggacgagtgggcggacgaaaacggcgatctcggcccgatttacggcgcgcaatggcgctcatggaaaggggcggacgggaaaacaatcgaccagatcgcgtgggtcgtcgaggagatcaaacgaaatccgaattcacgccggttgcttgtgagcgcttggaacgtagcggaattagacgagatgaagctgccgccgtgccattatgcctttcagttttatgtcgcgaacggtcggttgtcgtgcatgtggcagcagcgctccgttgatacgtttttagggctgccgtttaacattgccagctacgcgctgttgacgcatatgatcgcccagcaatgcgatctcgatgtcggcgaactcattttcaccggcggtgatgtccatttgtacaaaaaccatctcgaacaggcgaaactgcagctgacgcgcgagccgcgcccgctgccgaagctcgtgatcaaacggaagccgccgtccattttcgattacgaatacgacgattttgaaattgtcggctacaacccgcatccgacgattaaagcaccggtggctgtgtaa

SEQ ID NO: 17783 - protein, 264 aa, Geobacillus kaustophilus
MRQYLQLLEDILENGVEKEDRTGVGTLSVFGRQLRFNLQDGFPLVTTKKLHIRSIIYELLWFLKGDTNVRYLQENGVTIWDEWADENGDLGPIYGAQWRSWKGADGKTIDQIAWVVEEIKRNPNSRRLLVSAWNVAELDEMKLPPCHYAFQFYVANGRLSCMWQQRSVDTFLGLPFNIASYALLTHMIAQQCDLDVGELIFTGGDVHLYKNHLEQAKLQLTREPRPLPKLVIKRKPPSIFDYEYDDFEIVGYNPHPTIKAPVAV

SEQ ID NO: 17784 - DNA, 852 bp, Haemophilus ducreyi
  CDS (1)..(852): transl_table=11
atgaaacaatatttagatctatgccatcgtatcctaaatgaagggaaatgggtaaaaaacaagcgaactgataaactatgcttaaccgttattaatgccgacctaacttatgatgtcgcaaaaggtgaattcccgcttattactactcgtaaaagtttttggaaagccgccattgctgagctactaggctatatacgtggctatgacaacgcggcagattttcgccaattaggaacaaaatcttgggatgcaaatgccaatcaaaacgctgattggttagccaatccatatcgcaaaggagtcgatgatatgggattagtgtatggcgcaatcggtagaaaatttcctaaagcagatcatggttcgcttgatttacttaaacaaattgttgatgatttaagcaatggcattgataatcgtggcgaaatttatactttctatcatccgggtgcttttcatatggggtgcttacgcccttgtttatatagccaccatttttcattattagacggtacattatatctaaatagcacgcaacgttctgcagatgtgccattaggtttaaattggaatatggttcaatgctatacatttttagcattaatggcacaaattactaatcataaagcaggacaagtttttcataaaatcgttaatgcacatatttatgaagatcaactcgctttaatgcgtgatgtacagctaaaacgtgaaccatttgcgactcccacgcttaccatcaatccagcgattaagtcattagaagatttagaaatttgggttacgctcgatgactttaaagtggaaaactacttttaccatccaagtattcaataccccttttctatttaa

SEQ ID NO: 17785 - protein, 283 aa, Haemophilus ducreyi
MKQYLDLCHRILNEGKWVKNKRTDKLCLTVINADLTYDVAKGEFPLITTRKSFWKAAIAELLGYIRGYDNAADFRQLGTKSWDANANQNADWLANPYRKGVDDMGLVYGAIGRKFPKADHGSLDLLKQIVDDLSNGIDNRGEIYTFYHPGAFHMGCLRPCLYSHHFSLLDGTLYLNSTQRSADVPLGLNWNMVQCYTFLALMAQITNHKAGQVFHKIVNAHIYEDQLALMRDVQLKREPFATPTLTINPAIKSLEDLEIWVTLDDFKVENYFYHPSIQYPFSI

SEQ ID NO: 17786 - DNA, 852 bp, Haemophilus influenzae
  CDS (1)..(852): transl_table=11
atgaagcaatatcttgagctttgtcgccgcattgttagtgaaggggaatgggttgctaatgaacgtacaggtaagcattgcctcacggtcattaatgcagatttagaatatgatgtggcgaataatcaatttccgctgattactacccgtaaaagttattggaaagcggcgattgctgaatttttaggttatattcgtggatatgacaatgccgctgatttccgcgcacttggcacgaaaacttgggatgctaatgcgaatgaaaatgcagcttggcttgcaaatccgcatcgtagaggcgttgatgatatggggcgcgtatatggtgtgcaaggcagagcatggcgtaagcctaatggagaaactatcgatcagctacgtaaaattgttaataacttaacgaaaggtattgatgatagaggagagattttaactttttttaaccctggggaatttgatcttggttgtcttcgtccttgtatgcatacgcatactttttctcttgtgggcgatactttacatcttactagctatcagcgttcctgtgatgttccgcttggattgaatttcaatcaaattcaggtgtttaccttcttagcacttatggctcagatcacgggcaaaaaagccggcaaggcatatcataaaattgtgaatgcgcatatttatgaagatcagcttgagttaatgcgtgacgtacaacttaaacgcgagcctttcccattaccaaaattagaaattaatccagatataaaaacgcttgaagatttggaaacttgggtcacgatggatgattttaaagtcgttggctatcaatcccacgaaccaattaaatatcctttttccgtctaa

SEQ ID NO: 17787 - protein, 283 aa, Haemophilus influenzae
MKQYLELCRRIVSEGEWVANERTGKHCLTVINADLEYDVANNQFPLITTRKSYWKAAIAEFLGYIRGYDNAADFRALGTKTWDANANENAAWLANPHRRGVDDMGRVYGVQGRAWRKPNGETIDQLRKIVNNLTKGIDDRGEILTFFNPGEFDLGCLRPCMHTHTFSLVGDTLHLTSYQRSCDVPLGLNFNQIQVFTFLALMAQITGKKAGKAYHKIVNAHIYEDQLELMRDVQLKREPFPLPKLEINPDIKTLEDLETWVTMDDFKVVGYQSHEPIKYPFSV

SEQ ID NO: 17788 - DNA, 1014 bp, Human herpesvirus 8
  CDS (1)..(1014)
atgtttccgtttgtacctttaagcttgtatgtcgccaaaaagttattccgtgccagggggtttcgcttctgtcaaaagcctggcgtcttggctttggcccccgaggttgacccttgttcgattcagcatgaggtaactggggctgagacgccccacgaggaacttcagtatctcaggcagttgagggaaattttgtgccgtggcagcgatcgactcgaccgcaccggcataggcaccctctctctatttggcatgcaggccaggtatagtctgcgggaccactttcccttactaaccacaaagcgggtgttttggcgaggcgtagtgcaagagctgctttggtttctgaaggggagtactgactccagggagctttcaagaacaggagtcaagatatgggacaaaaatggctccagggagttcctggccgggcgcggcctggcgcacagaagggagggggatttgggacctgtttacggtttccagtggaggcactttggggcggcgtacgtggacgcggatgctgactatacaggccaggggtttgaccaattgtcgtacattgtggatttaataaaaaataatccgcacgatagaagaatcattatgtgtgcgtggaacccggcggacttgtcgttgatggcgcttccgccctgtcacttgttatgtcaattttatgtagctgacggtgagctttcctgtcagctgtatcagaggtcgggagacatgggtttgggagttccttttaacattgccagctattccctcttaacttatatgcttgctcatgttactggtcttagacccggggagtttattcacacgttgggagatgcccacatctacaaaacgcatatagagccactacggctgcagctgacgcgcactccacgtccctttccgcgcctggagatactccggtctgtttcttccatggaagagtttacacctgatgattttagactggtggactactgcccgcatcctaccattcgtatggaaatggcagtatag

SEQ ID NO: 17789 - protein, 337 aa, Human herpesvirus 8
MFPFVPLSLYVAKKLFRARGFRFCQKPGVLALAPEVDPCSIQHEVTGAETPHEELQYLRQLREILCRGSDRLDRTGIGTLSLFGMQARYSLRDHFPLLTTKRVFWRGVVQELLWFLKGSTDSRELSRTGVKIWDKNGSREFLAGRGLAHRREGDLGPVYGFQWRHFGAAYVDADADYTGQGFDQLSYIVDLIKNNPHDRRIIMCAWNPADLSLMALPPCHLLCQFYVADGELSCQLYQRSGDMGLGVPFNIASYSLLTYMLAHVTGLRPGEFIHTLGDAHIYKTHIEPLRLQLTRTPRPFPRLEILRSVSSMEEFTPDDFRLVDYCPHPTIRMEMAV

SEQ ID NO: 17790 - DNA, 852 bp, Idiomarina loihiensis
  CDS (1)..(852): transl_table=11
atgaaacaatatttacaactgtgccaacgcattgtcgacgaaggggtctgggttaaaaatgaacgtacaggcattaactgcctgacggttataaacgccgacttagagtatgatgttgcgaacaatcaatttcctttaattactactcggaaaagctattacaagtcggctattgctgagcttctaggatacttgcgaggctacaatagtgccgctcaattccgcgatattggctgcaaaacctgggacgccaatgccaacgaaaaccaggcctggctgaataatccgaatcgcaaaggcgaagacgacatgggccgtgtatacggtgtgcaggggcgctcatggcaaaagccggatggcagccacttagaccagctgaaaaaggtcattaataacctgtcgaaaggcattgatgaccgtggggaaattgttactttctataaccctggcgaatttgaactgggttgtttgcgtccgtgcatgcatacccacaacttttcgctgttaggcgacacgctttacctaacctcttaccaacgcagctgtgacgtgcccctgggactcaactttaaccaaattcagtgctttgctcttttagctttggtggcacaaattactggtcacaagccgggcaaggcctaccacaagatagtgaacgctcacatttatgagaaccagttggaactcatgcgtgatgtacagctgaagcgagagccttttccatcgccacagctgcatattaacccagagataaagtctttagaagacattgaaacctgggtcagcaaagacgatttcatcgtcagcggctaccagtgtcacgaccccattaaatacccattcgcagtgtag

SEQ ID NO: 17791 - protein, 283 aa, Idiomarina loihiensis
MKQYLQLCQRIVDEGVWVKNERTGINCLTVINADLEYDVANNQFPLITTRKSYYKSAIAELLGYLRGYNSAAQFRDIGCKTWDANANENQAWLNNPNRKGEDDMGRVYGVQGRSWQKPDGSHLDQLKKVINNLSKGIDDRGEIVTFYNPGEFELGCLRPCMHTHNFSLLGDTLYLTSYQRSCDVPLGLNFNQIQCFALLALVAQITGHKPGKAYHKIVNAHIYENQLELMRDVQLKREPFPSPQLHINPEIKSLEDIETWVSKDDFIVSGYQCHDPIKYPFAV

SEQ ID NO: 17792 - DNA, 957 bp, Lactobacillus acidophilus
  CDS (1)..(957): transl_table=11
atggcaattcttgaacaaccatatttagatttgattaataaaattatgattgaaggtcatgataaaaatgatcgtacaggaactggaactaggagttattttggtgctcaaatgcgctttgacttatcaaaagggtttccaattttaaccactaaaaaggttccattcggtttaattaaaagtgaactcctatggttcttacgaggggacactaatattcgttttttattagaacataaaaatcatatttgggatgagtgggcatttaaaaattgggttaacagtgatgaatatactggtcctgatatgactgattttggtttacgaagtcaaagtgatccggaatttaataaaatttatcaagctgaattaaaaaaatttgatcgacgtatccttgatgatgagaacttcgccaaaaaatatggtaatttaggcgacgtttatggtgcacaatggcgccattggcaaaagcgagatggtagctttattgatcaaattgaaaatgtaattgaacaaattaaaaataatccagattcacgcaggatgattgtaacagcctggaatccagaagatgtaccaactagtgctcttcctccgtgtcatgttatgttccaattttatgtggtagatggaaaaattagcgttcagctttatcagcgtagtggagatatgtttttaggcgtgccatttaatattgcatcatatgcacttttattaaatatgattgccagagaaactggtctgcaagtgggtgaatttattcatacattgggggatgctcatatttatagtaaccactttagtcaagtgaaggaaatgcttagtcgcaagccatatgaatctccacagttatggcttaatcctgaaaaaaaacatattgaagattttgatatgcaagatattaagttagtggattataagcatcatggcacaattaaggcgccagttgctgtttaa

SEQ ID NO: 17793 - protein, 318 aa, Lactobacillus acidophilus
MAILEQPYLDLINKIMIEGHDKNDRTGTGTRSYFGAQMRFDLSKGFPILTTKKVPFGLIKSELLWFLRGDTNIRFLLEHKNHIWDEWAFKNWVNSDEYTGPDMTDFGLRSQSDPEFNKIYQAELKKFDRRILDDENFAKKYGNLGDVYGAQWRHWQKRDGSFIDQIENVIEQIKNNPDSRRMIVTAWNPEDVPTSALPPCHVMFQFYVVDGKISVQLYQRSGDMFLGVPFNIASYALLLNMIARETGLQVGEFIHTLGDAHIYSNHFSQVKEMLSRKPYESPQLWLNPEKKHIEDFDMQDIKLVDYKHHGTIKAPVAV

SEQ ID NO: 17794 - DNA, 971 bp, Lactobacillus casei
  CDS (20)..(970)
aattcaggaggtaataattatgctggaacagccgtacctggatctcgcgaaaaaagttctagatgaaggccacttcaaaccggatcgtacgcacactggtacttacagcatcttcggccaccagatgcgcttcgacttaagcaaaggcttcccgctgctgaccaccaaaaaggtaccattcggcctgatcaaaagcgagctgctgtggttcctgcacggtgataccaatattcgcttcctgctgcagcaccgcaaccacatctgggatgagtgggctttcgaaaaatgggttaaaagcgatgaataccacgggcccgacatgactgacttcggtcaccgcagccagaaggatccagagttcgcggccgtttaccacgaagaaatggccaaattcgacgaccgtgttctgcacgacgacgcgttcgctgctaaatacggtgacctgggactagtttacggttcccagtggcgcgcttggcacactagcaaaggtgacactatcgatcagctgggtgacgttatcgaacagatcaaaactcacccgtactcccgtcgactgatcgtttccgcttggaaccctgaggatgttccgaccatggctctgccgccgtgtcacactctgtaccagttttacgtaaacgatggcaagctgagcttgcagctgtaccagagatctgctgacatcttcctaggcgttccgtttaacatcgctagctatgcattgctgacccacctggttgctcacgaatgtggcctcgaggttggcgagttcatccacacctttggcgatgcgcacctttacgttaaccacctggaccagatcaaagaacagctgtcccgcaccccgcggcctgcaccgactttgcagctgaatccggataaacacgatattttcgacttcgacatgaaagatatcaaactgctgaactacgatccttacccggccatcaaggccccggttgctgtttaaa

SEQ ID NO: 17795 - protein, 316 aa, Lactobacillus casei
MLEQPYLDLAKKVLDEGHFKPDRTHTGTYSIFGHQMRFDLSKGFPLLTTKKVPFGLIKSELLWFLHGDTNIRFLLQHRNHIWDEWAFEKWVKSDEYHGPDMTDFGHRSQKDPEFAAVYHEEMAKFDDRVLHDDAFAAKYGDLGLVYGSQWRAWHTSKGDTIDQLGDVIEQIKTHPYSRRLIVSAWNPEDVPTMALPPCHTLYQFYVNDGKLSLQLYQRSADIFLGVPFNIASYALLTHLVAHECGLEVGEFIHTFGDAHLYVNHLDQIKEQLSRTPRPAPTLQLNPDKHDIFDFDMKDIKLLNYDPYPAIKAPVAV

SEQ ID NO: 17796 - DNA, 957 bp, Lactobacillus johnsonii
  CDS (1)..(957): transl_table=11
atggcaactttagagcaaccatatttagatttactaagtaaaataatgagtgaagggcatgacaaggaagataggactggtacaggtactagaagcttgtttggagcccaaatgagatttgatttaaatgatggctttcctattttaactactaaaaaaataccttttggacttattaagagcgaattgttatggtttttacgaggagacactaatatccgttttttgctagaacataataatcatatttgggatgaatgggcctttaaaaattgggtagagagcaatgaatatcaggggccagatatgactaattttggtctaagaagtcaacaagacccagaatttaaaagaatatatcaagaagaaatgaaaaaatttgatcaaaaagtcttggaagatcaaactttcgcagaaaaatatggaaatttaggagacgtttatggtgctcaatggagacattggcagaagcgtgaaggtggctttattgatcaaattcaaaatgtaattgatcaaattaagaaaacaccttattctcgtcgcttaattgttagcgcatggaatcccgaagatgtaccaacgtctgctttaccgccatgtcatgtcttgtttcagttttatgttaatgacgggtgtttaagtttacaactgtatcaaagatcaggcgacatgtttttaggtgtaccgtttaatattgcgagttatgctttactagtaaatttagtcgcgcgtgaaacgggactaaagccgggtgaatttattcataccttaggggatgctcatatttataaaaatcactttaaccaagttaaagaattattgaatcgatctgcatatgacgctcctatgctttggctaaatccggataaaaaattagtacaggattttgaaatgaaagatatcaagttaattaattaccggcatcatggcactattaaggcgccggtagccgtttaa

SEQ ID NO: 17797 - protein, 318 aa, Lactobacillus johnsonii
MATLEQPYLDLLSKIMSEGHDKEDRTGTGTRSLFGAQMRFDLNDGFPILTTKKIPFGLIKSELLWFLRGDTNIRFLLEHNNHIWDEWAFKNWVESNEYQGPDMTNFGLRSQQDPEFKRIYQEEMKKFDQKVLEDQTFAEKYGNLGDVYGAQWRHWQKREGGFIDQIQNVIDQIKKTPYSRRLIVSAWNPEDVPTSALPPCHVLFQFYVNDGCLSLQLYQRSGDMFLGVPFNIASYALLVNLVARETGLKPGEFIHTLGDAHIYKNHFNQVKELLNRSAYDAPMLWLNPDKKLVQDFEMKDIKLINYRHHGTIKAPVAV

SEQ ID NO: 17798 - DNA, 840 bp, Lactococcus lactis
  CDS (1)..(840): transl_table=11
atgacttacgcagacaagatttttaaacaaaatatccaaaatatccttgataacggtgttttttcagaaaatgcacgtcccaagtataaggatggtcaaaccgcaaatagtaagtatgtaacaggctctttcgttacttatgatttgcaaaaaggtgagtttccaattaccactttgcgtccaattccaattaaatcggcaattaaagaattgatgtggatttatcaagatcaaacaagtgaacttgctattcttgaagaaaaatatggagtcaaatactggggcgaatggggaattggcgacggtacgattggacaacgctatggggcaacagtcaaaaaatataatattattggaaaattattggatggtttagcaaaaaatccttggaatcgccgtaatatcattaatctttggcaatatgaagattttgaggaaactgaaggacttttgccttgtgctttccaaacaatgtttgatgttcgccgtgaacaagatggtcagatttacttggatgcgactcttattcaacgttcaaatgatatgcttgttgcgcatcatatcaatgccatgcaatatgttgctttacaaatgatgattgcaaaacatttttcttggaaagttggaaaatttttctatttcgtaaataatttgcatatttatgataatcagtttgaacaggcaaatgagttagttaagcgaacagcttctgacaaggagccccgtttggtgcttaatgttcctgacggaacaaactttttcgatattaaaccagaagattttgagcttgtggactatgaaccggtaaaacctcaattaaaatttgatttggcaatttag

SEQ ID NO: 17799 - protein, 279 aa, Lactococcus lactis
MTYADKIFKQNIQNILDNGVFSENARPKYKDGQTANSKYVTGSFVTYDLQKGEFPITTLRPIPIKSAIKELMWIYQDQTSELAILEEKYGVKYWGEWGIGDGTIGQRYGATVKKYNIIGKLLDGLAKNPWNRRNIINLWQYEDFEETEGLLPCAFQTMFDVRREQDGQIYLDATLIQRSNDMLVAHHINAMQYVALQMMIAKHFSWKVGKFFYFVNNLHIYDNQFEQANELVKRTASDKEPRLVLNVPDGTNFFDIKPEDFELVDYEPVKPQLKFDLAI

SEQ ID NO: 17800 - DNA, 951 bp, Lactobacillus plantarum
  CDS (1)..(951): transl_table=11
atgttagaagatagttatttacaactcgcgcgcaccattttagaacacggcacgtataaggatgaccgtaccggcacgggaacatacagtgtgtttggttaccagatgcgctttgacctgagtcaaggcttcccgttattgacgaccaaaaaagttccctttggactgatcaagagcgaattactatggtttttgcatggtgatacgaatattcagtatttattgcaacaccacaaccatatctgggacgaatgggcgttcaaaaattgggttacgagtgccgattatgacggccctgatatgacgaattttgaacaccgccggctagatgatcctgactttgcgccgatttatcaagctcagatgcagacctttgatgaccagatcttgacagacgacgcgtttgcggccaagtatggtaatttgggtgacgtttacggtgcgcaatggcgtcactggcaaacgcgtcagggaaagacgatcgatcaaattgccaatgtgattgaaatgatcaagacgcatccggattcgcggcggttaatcgtttccgcttggaatccagaagatgtgccgaacatggcgttaccaccgtgtcatactctgtttcaattctatgtcgcggatggtaagctctcttgccaactctaccaacgttcaggcgatgtcttcctaggtgtgccattcaatattgcgagttatgcgttactaacacatctgattgctaaggagacgggcctagcagtgggcgagttcgtgcatacgttgggtgacgcgcacatttatactaaccatgtggaacaagttaaaacgcagttgacccggcaacctcggccggcaccccagctgactttaagtggggctcatgacagtatttttgattaccaaatgagtgacattaagctcagtggctatgatcccgcaccggcaatcaaagcgccggtcgcgatttag

SEQ ID NO: 17801 - protein, 316 aa, Lactobacillus plantarum
MLEDSYLQLARTILEHGTYKDDRTGTGTYSVFGYQMRFDLSQGFPLLTTKKVPFGLIKSELLWFLHGDTNIQYLLQHHNHIWDEWAFKNWVTSADYDGPDMTNFEHRRLDDPDFAPIYQAQMQTFDDQILTDDAFAAKYGNLGDVYGAQWRHWQTRQGKTIDQIANVIEMIKTHPDSRRLIVSAWNPEDVPNMALPPCHTLFQFYVADGKLSCQLYQRSGDVFLGVPFNIASYALLTHLIAKETGLAVGEFVHTLGDAHIYTNHVEQVKTQLTRQPRPAPQLTLSGAHDSIFDYQMSDIKLSGYDPAPAIKAPVAI

SEQ ID NO: 17802 - DNA, 795 bp, Legionella pneumophila
  CDS (1)..(795): transl_table=11
atgaaaacatatttgcaattgttggagcatattttacaacaaggagtagaaaaatcggatagaacgggcactggaacattatctgtatttgggtatcaaatgcgttttgatttgaccaagggattcccgcttgtcactactaaaaaactacacacgagaagtattgttcatgaattactatggtttttgcgtggtgataccaatatttcttatcttaaggaaaacggggtaactatttgggatgaatgggcagataataatggtgatttggggcctgtctatggaaagcaatggagaagttggccaactgctgatggacacactattgatcaattaagtgatgtagtgcaacaaataaagagtaaccctgactctcgtcgcttgattgtaagcgcctggaatgtgggtgaattggataaaatggctttaatgccttgtcatgccttgtttcagttttatgttgcaaacaacaagttatcctgtcaattgtatcaacgctcagccgatgtatttttaggagttcctttcaatatcgcttcttattcgttgcttactcatatggtcgcccaacaatgtaatttggatgtggctgagttcatatggaccgggggagattgtcatttgtatcttaatcatttggagcaagcgcaaatccaattaacaagagaacctttgccattgccctccttaactattaagagaaaaccagcttctttatttgactatgcttatgaggattttgaatttttgaattatcaatcacatcccgcaattaaagcacctattgccgtttaa

SEQ ID NO: 17803 - protein, 264 aa, Legionella pneumophila
MKTYLQLLEHILQQGVEKSDRTGTGTLSVFGYQMRFDLTKGFPLVTTKKLHTRSIVHELLWFLRGDTNISYLKENGVTIWDEWADNNGDLGPVYGKQWRSWPTADGHTIDQLSDVVQQIKSNPDSRRLIVSAWNVGELDKMALMPCHALFQFYVANNKLSCQLYQRSADVFLGVPFNIASYSLLTHMVAQQCNLDVAEFIWTGGDCHLYLNHLEQAQIQLTREPLPLPSLTIKRKPASLFDYAYEDFEFLNYQSHPAIKAPIAV

SEQ ID NO: 17804 - DNA, 795 bp, Legionella pneumophila subsp
  CDS (1)..(795): transl_table=11
atgaaaacatatttgcaattgttggagcatattttacaacatggggtagaaaaatccgatagaacgggcactggaacattatctgtatttgggtatcaaatgcgttttgatttggcccagggattcccgcttgttaccactaaaaaactgcatacgagaagtattgttcatgaattactgtggttcttgcgtggtgataccaatatttcttatcttaaggaaaacggggtaactatttgggatgaatgggcagataataatggtgatttagggcctgtctatgggaagcaatggagaagttggccaactgctgatggacgcaccattgatcaattaagtgaagtagtgcaacaaataaagagcaaccctgactctcgtcgcttgattgtaagcgcctggaatgtgggtgaattggataaaatggctttaatgccttgtcatgccttgtttcagttttatgttgcaaacaacaagctatcctgtcaattatatcaacgctcagccgatgtatttttaggagttcctttcaatatcgcttcttattcgttgcttactcatatggttgctcagcaatgtaatttggatgtggctgaatttatatggaccgggggagattgtcatttgtatcttaatcatttggagcaagcgcaaatccaattaacaagagaacctttgccattgccctccttagctattaagagaaaaccggcttctttatttgactatgcttatgaggattttgaatttttgaattatcaatcacatcccgcaattaaagcgcctatcgccgtttaa

SEQ ID NO: 17805 - protein, 264 aa, Legionella pneumophila subsp
MKTYLQLLEHILQHGVEKSDRTGTGTLSVFGYQMRFDLAQGFPLVTTKKLHTRSIVHELLWFLRGDTNISYLKENGVTIWDEWADNNGDLGPVYGKQWRSWPTADGRTIDQLSEVVQQIKSNPDSRRLIVSAWNVGELDKMALMPCHALFQFYVANNKLSCQLYQRSADVFLGVPFNIASYSLLTHMVAQQCNLDVAEFIWTGGDCHLYLNHLEQAQIQLTREPLPLPSLAIKRKPASLFDYAYEDFEFLNYQSHPAIKAPIAV

SEQ ID NO: 17806 - DNA, 810 bp, Leifsonia xyli
  CDS (1)..(810): transl_table=11
atgaccacgccgatcccgaccccgtacgaagacctgctgcgcgacgtcctcgcgaacggcagccacaaatccgaccgcaccgggacgggcacgcgcagcgtcttcggacgccagctccggttcgacctcgcggacggcttcccgctgatcacgaccaagcgggtccacttcaagtcgatcgcgtacgaactgctctggttcctccgcggcgacagcaatgtcggctggctgcgcgagaatggcgtgagcatctgggacgagtgggccgacgagcggggcgaactcggccctgtctacggggttcagtggcgctcctggccgtccccggacggcacgcacatcgaccaaatccagcaggtcgtcgacacgctccgccgcgacccggactcgcgccgcatcatcgtctccgcctggaacgtcgcggacatcccggatatggcgctcgcgccctgccacgccttcttccagttctatgtcgccgacggcaagctctcctgccagctgtaccagcgcagcgccgacatgttcctcggcgttccgttcaacattgcgagctacgcgctcctcacgctcatggtcgcccagcaggtgggactcgaaccgggcgagttcgtctggacgggcggggacgtccacatctacgacaaccacatcgagcaggtgaacgagcagctgagccgtaacccgttcccagctcctgcgcttcgcttcgcgcgcagaccggaaagcgtcttcgactaccgctacgaggacttcgtgctcgagggctaccggcaccacccggccatccgcgccgccgtcgcggtatga

SEQ ID NO: 17807 - protein, 269 aa, Leifsonia xyli
MTTPIPTPYEDLLRDVLANGSHKSDRTGTGTRSVFGRQLRFDLADGFPLITTKRVHFKSIAYELLWFLRGDSNVGWLRENGVSIWDEWADERGELGPVYGVQWRSWPSPDGTHIDQIQQVVDTLRRDPDSRRIIVSAWNVADIPDMALAPCHAFFQFYVADGKLSCQLYQRSADMFLGVPFNIASYALLTLMVAQQVGLEPGEFVWTGGDVHIYDNHIEQVNEQLSRNPFPAPALRFARRPESVFDYRYEDFVLEGYRHHPAIRAAVAV

SEQ ID NO: 17808 - DNA, 945 bp, Listeria monocytogenes
  CDS (1)..(945): transl_table=11
atgaaacaatatttggatttagaaaagtacgttttagagaatggaacacaaaaaggagatcgcactggaactggaacaatcagcacatttggttatcaaatgcgttttgatttacaagagggctttccgattatgacaacaaaacgggtaccatttaaacttgtagtaagtgaactgctatggtttttacatggagatacgaatattcgctaccttttacagcataataataatatttggaatgaatgggcttttgagcgttttgtgaaaagcgatgattataaaggcgaagatatgactgactttggactgcgtgctgagcgtgattcagctttcaaagaagtgtatcaagcggagatggagaagtttaaagctcggattttagaagacgaagcgttcgcgaataaatacggtgagctaggtaatatttacggtaaacaatggcgcgaatggaagacttcacaaggagaaacaattgatcagttagcggatttgattgaaatgattaaaacgaatccgaactcgcgtcgtttgattgtgtctgcttggaaccctgaagatattccgaatatggctttaccgccatgtcattcgctattccaattttatgtagcggacggaaaattatcatgtcagctgtatcaacgtagtgccgatattttccttggtgtaccgtttaatattgcaagctatgcacttctaacacacctgattgcacgtgaagtagggctggaagttggcgagtttatccatactatgggtgatgcgcatctttataacaatcatattgagcaagtgaaagaacagctgtctagaacaccgcacaaacttccaaaattagtgctttcagataaaccagcaacgatttttgattttgatgtagcggatatttcactggatggttataatccagatccagcaattaaagcaccaatttcagtataa

SEQ ID NO: 17809 - protein, 314 aa, Listeria monocytogenes
MKQYLDLEKYVLENGTQKGDRTGTGTISTFGYQMRFDLQEGFPIMTTKRVPFKLVVSELLWFLHGDTNIRYLLQHNNNIWNEWAFERFVKSDDYKGEDMTDFGLRAERDSAFKEVYQAEMEKFKARILEDEAFANKYGELGNIYGKQWREWKTSQGETIDQLADLIEMIKTNPNSRRLIVSAWNPEDIPNMALPPCHSLFQFYVADGKLSCQLYQRSADIFLGVPFNIASYALLTHLIAREVGLEVGEFIHTMGDAHLYNNHIEQVKEQLSRTPHKLPKLVLSDKPATIFDFDVADISLDGYNPDPAIKAPISV

SEQ ID NO: 17810 - DNA, 852 bp, Mannheimia succiniciproducens
  CDS (1)..(852): transl_table=11
atgcgtcaatatttagatttatgccaacgtatcgtaaatgaaggctgctggattgaaaacaagcgtaccggaaaacgctgcttaaccgttatcaatgcggatttgacttatgatgtggcaaacaaccgatttccgattattactacacgtaaaagttattggaaagcggcgattgcggagtttctgggttatatccgcggctacgataatgcggcggatttccgtaaattaggagcaaaaacctgggatgccaacgctaatgaaaatcaggtatggctgaacaaccctcatcgcaaaggcaccgacgatatggggcgcgtttacggcgtacaaggcagagcctggcgtaagcctaacggcgaaaccgttgatcaattacgcaaaatagtcaacaatttaagtcgcggcattgatgatcgcggcgaaattctgacctttttaaacccgggtgaattcgatctcggttgtctgcgcccttgtatgtacaatcacacgttttctttgctgggcgatacgctttatttaaccagttatcaacgctcctgtgacgtacctttaggcttgaatttcaatcaaattcaagtatttacgttcttagctttaatggcgcagattaccggtaaaaaagccggtcaggcataccacaaaatcgtcaatgcgcatatttacgaagaccagctggaactaatgcgcgacgtgcagttaaaacgcgaaccgttcccgtcgccaaaactggaaattaatccggacattaaaacccttgaagatttagaaacctgggtaaccatggatgatttcaacgtcgttggttaccaatgccacgaaccgataaaatatccgttctcggtataa

SEQ ID NO: 17811 - protein, 283 aa, Mannheimia succiniciproducens
MRQYLDLCQRIVNEGCWIENKRTGKRCLTVINADLTYDVANNRFPIITTRKSYWKAAIAEFLGYIRGYDNAADFRKLGAKTWDANANENQVWLNNPHRKGTDDMGRVYGVQGRAWRKPNGETVDQLRKIVNNLSRGIDDRGEILTFLNPGEFDLGCLRPCMYNHTFSLLGDTLYLTSYQRSCDVPLGLNFNQIQVFTFLALMAQITGKKAGQAYHKIVNAHIYEDQLELMRDVQLKREPFPSPKLEINPDIKTLEDLETWVTMDDFNVVGYQCHEPIKYPFSV

SEQ ID NO: 17812 - DNA, 867 bp, Mesoplasma florum
  CDS (1)..(867): transl_table=4
atgaaacaatatttagaattagttaatgaaattttaaaagatggagaaaaaagagaagatcgtacaaacacaggaacaatatctaagtttggtgtacaaaaaagatatgatttacgtgaaggttttccattactaacaactaaaaaagttttttataaagcaatctttcatgagatgttatggtttataaaaggtgataccaatattaaatacttggttgagaataatgtaaaaatttgaaatgaatgaccatatgaaaattttaaaaaatcatctgagttcaataatgagactttacaagagtttgttgaaagattaaagaatgataatgagttctgtaataaatgaggagatttaggacctgtttatggaaaacaatgaagagactttggtggaattgatcaatttgcaaaactaattaatgatattaagaaaaatccattttcaagaagacatattgtttcagcatgaaatccagctgaagttgataacatgttgttaccaccatgtcattctttttgacaagtttatgtttcaaaagacggttgattagatttacaactataccaaagaagtggtgatgtgtttttaggagtgccatttaatatagcatcgtatgcgttactaatggaattaatcgcaaaagaatgtaacttaaaagcaagatactttgttcatacaattggggatgctcatatttatttaaaccatctagaacaaattaatgagcaattaaaaagaaaaccattgccactatgcaaaattaagattaattctgaaaaatcaatttttgatattgcatttgaggacattgaaattgaaggttatgaaagtcatgctaaaataacaggagaagttgcagtttag

SEQ ID NO: 17813 - protein, 288 aa, Mesoplasma florum
MKQYLELVNEILKDGEKREDRTNTGTISKFGVQKRYDLREGFPLLTTKKVFYKAIFHEMLWFIKGDTNIKYLVENNVKIWNEWPYENFKKSSEFNNETLQEFVERLKNDNEFCNKWGDLGPVYGKQWRDFGGIDQFAKLINDIKKNPFSRRHIVSAWNPAEVDNMLLPPCHSFWQVYVSKDGWLDLQLYQRSGDVFLGVPFNIASYALLMELIAKECNLKARYFVHTIGDAHIYLNHLEQINEQLKRKPLPLCKIKINSEKSIFDIAFEDIEIEGYESHAKITGEVAV

SEQ ID NO: 17814 - DNA, 783 bp, Methylococcus capsulatus
  CDS (1)..(783): transl_table=11
atgcgcccttatctcgacctgctgcgcgacatcctcgatcacggctgccccaaaggggaccggaccggcaccgggaccctgagcgtgttcggccgcatgatgcggttcgacctgtcgcgggggcttcccctcgtcaccaccaagaaactgcatctgccctcgatcatccatgaactgctctggttcgtctccggcagcaccaacgtgcgtgatctgcaacggcacggcgtcacgatctgggacgagtgggcggatgacaatggtgagttaggccccgtgtatggacgccaatggcggaattggaacggcgccatcgatcagcttgccggactggtcgagcaactgcgccggaatccgggctcccgccgcctgctggtgagcgcatggaacccctccgatctggatgccatggcgctgccgccctgccactacgcctttcagtgccatgtggcggatggaaggctgtcgctcatgttccagatgcgttcggcggacgtgttcctgggactgccgttcaatatcgccggctatgccctgctcacccatatgcttgcgcaacagaccggatacgaaccgggggagttgatatggtgcggcggtgacgtgcatctgtacctcaaccacctggagcaggcgcgcctgcaactcacgcgcgaaccctatccgccgcccacgctgaaactcgcccgcaagcccgggagcctgttcgattaccgctacgaggatttcgtggtcgaggactaccaggcgcatccacacatcaaagcggcggtggcggtgtga

SEQ ID NO: 17815 - protein, 260 aa, Methylococcus capsulatus
MRPYLDLLRDILDHGCPKGDRTGTGTLSVFGRMMRFDLSRGLPLVTTKKLHLPSIIHELLWFVSGSTNVRDLQRHGVTIWDEWADDNGELGPVYGRQWRNWNGAIDQLAGLVEQLRRNPGSRRLLVSAWNPSDLDAMALPPCHYAFQCHVADGRLSLMFQMRSADVFLGLPFNIAGYALLTHMLAQQTGYEPGELIWCGGDVHLYLNHLEQARLQLTREPYPPPTLKLARKPGSLFDYRYEDFVVEDYQAHPHIKAAVAV

SEQ ID NO: 17816 - DNA, 795 bp, Methylobacillus flagellatum
  CDS (1)..(795): transl_table=11
atgaaggtctatcacgacttgatgcgccacgtactggagcagggccacaagaaggaagaccgcaccggcaccggtacgctgtccgtattcggctaccagatgcgcttcgacctgtccgagggctttccgctgctgaccaccaagaaggttcacctgaatgccattattcatgagctgctctggtttttgcagggcagtaccaacattgcctacctcaaggaaaacggcgtgaccatctgggacgagtgggcggatgccgagggcaacctggggccagtgtacggctaccagtggcgcaattggcccaaaccggatggaggccatatcgatcagatcagcgaagtgatagcggccatcaagagtaatccggactctcgccgtctgattgtgtccgcatggaatgtcgccgatgttgacaagatggaattgccgccttgccatgcgttgttccagttctatgtggcggagggaaaactttcgtgccagttgtaccaacgtagtgcggatatctttctcggcgtaccgttcaatatcgcctcctatgccttgctcaccatgatggtggcgcgggtatgtgatctcgagcttggcgattttgtacatacactgggtgatgcgcatatctatctcaatcatctcgagcaggtgaaggagcaattgtcgcgtgagccttatcctctgcctgtaatgcggatcaatcccgaggtcaaggatatctttgctttccgtttcgaggatttcacactggagaattaccagtcgcatcccgctatcaaggcccccgttgcagtgtag

SEQ ID NO: 17817 - protein, 264 aa, Methylobacillus flagellatum
MKVYHDLMRHVLEQGHKKEDRTGTGTLSVFGYQMRFDLSEGFPLLTTKKVHLNAIIHELLWFLQGSTNIAYLKENGVTIWDEWADAEGNLGPVYGYQWRNWPKPDGGHIDQISEVIAAIKSNPDSRRLIVSAWNVADVDKMELPPCHALFQFYVAEGKLSCQLYQRSADIFLGVPFNIASYALLTMMVARVCDLELGDFVHTLGDAHIYLNHLEQVKEQLSREPYPLPVMRINPEVKDIFAFRFEDFTLENYQSHPAIKAPVAV

SEQ ID NO: 17818 - DNA, 924 bp, Mus musculus
  CDS (1)..(924)
atgctggtggttggctccgagctgcagtccgatgctcagcagctgagcgcggaagccccacggcatggagaactccagtacctgaggcaggtggagcacattttgcgctgcggcttcaagaaggaggaccgcacgggcactggcaccctgtcggtgttcggcatgcaggcacgatacagcctgagagatgaatttcctctgctcacaaccaaacgagtgttctggaagggtgttttggaggagttgttgtggtttatcaagggatccacaaatgctaaagaattgtcctcaaagggagtgagaatctgggatgccaatggatcccgagattttctggacagcttgggattttctgcccgacaggaaggggacctgggcccagtttatggtttccaatggaggcattttggagcagagtacaaagatatggattcagattactcgggacaaggagtagaccagctgcaaaaagtgattgacaccatcaaaaccaaccctgatgacagaagaatcatcatgtgtgcctggaacccaaaagatcttcccctgatggcactgcctccttgccatgccctctgtcagttctatgtggtgaatggggaactgtcttgccagctttaccagaggtcaggagatatgggtctgggcgtgcccttcaacattgccagctatgctctgctcacctacatgattgcacatatcacaggcctgcagccaggtgattttgtccacactttgggagatgcacatatttacctgaatcatatagagccgctgaaaattcagctacagcgagaaccaagacctttcccaaagctcaaaatccttcgaaaagttgagacaatcgatgatttcaaagttgaagactttcagattgaagggtataatccacatccaacgattaaaatggaaatggctgtttag

SEQ ID NO: 17819 - protein, 307 aa, Mus musculus
MLVVGSELQSDAQQLSAEAPRHGELQYLRQVEHILRCGFKKEDRTGTGTLSVFGMQARYSLRDEFPLLTTKRVFWKGVLEELLWFIKGSTNAKELSSKGVRIWDANGSRDFLDSLGFSARQEGDLGPVYGFQWRHFGAEYKDMDSDYSGQGVDQLQKVIDTIKTNPDDRRIIMCAWNPKDLPLMALPPCHALCQFYVVNGELSCQLYQRSGDMGLGVPFNIASYALLTYMIAHITGLQPGDFVHTLGDAHIYLNHIEPLKIQLQREPRPFPKLKILRKVETIDDFKVEDFQIEGYNPHPTIKMEMAV

SEQ ID NO: 17820 - DNA, 792 bp, Mycobacterium bovis
  CDS (1)..(792): transl_table=11
gtgacgccatacgaggacctgctgcgcttcgtgctcgaaacgggtacgcccaaatccgaccgcaccggcaccggaacccgcagcctgttcggccagcagatgcgctatgatttgtcggccggtttcccgctgctcactaccaagaaagtccatttcaaatcggtagcctacgagctgctgtggtttttgcgcggcgattccaatatcggttggctgcacgagcacggagtcaccatctgggacgaatgggcaagtgatacaggcgaactcgggccgatctacggtgtacaatggcgatcgtggccggctccatccggtgagcacatcgaccagatcagcgcggcgctggatttgctgcgcaccgatcccgattcccggcgcatcatcgtgtcggcctggaacgtcggcgaaatcgagcggatggcgctgccgccctgtcatgcgttcttccagttctacgtcgccgatggccggctgagctgtcagctctaccaacgcagcgccgacctgtttctgggtgtgccgttcaacatcgccagctatgcgttgctcacccacatgatggccgcccaggccggcttgtcggtcggcgagttcatctggaccggtggcgactgccacatctacgacaatcacgtcgagcaagtacggctgcagctcagccgcgagccgcggccatatccgaaactacttctagccgaccgggattcaatcttcgagtacacctatgaagacatcgttgtgaagaactacgatccgcatccggcgatcaaagctccagtcgcggtatga

SEQ ID NO: 17821 - protein, 263 aa, Mycobacterium bovis
MTPYEDLLRFVLETGTPKSDRTGTGTRSLFGQQMRYDLSAGFPLLTTKKVHFKSVAYELLWFLRGDSNIGWLHEHGVTIWDEWASDTGELGPIYGVQWRSWPAPSGEHIDQISAALDLLRTDPDSRRIIVSAWNVGEIERMALPPCHAFFQFYVADGRLSCQLYQRSADLFLGVPFNIASYALLTHMMAAQAGLSVGEFIWTGGDCHIYDNHVEQVRLQLSREPRPYPKLLLADRDSIFEYTYEDIVVKNYDPHPAIKAPVAV

SEQ ID NO: 17822 - DNA, 870 bp, Mycoplasma gallisepticum
  CDS (1)..(870): transl_table=4
atgaaaacatatttagatttgttagaaaaagttatgaccaaaggtgaggttaaaaaagatcgaactaacacaggtacgatctcttattttggcactcaaagtcgatatgatttacgtgaaggatttccattattaacaactaagaaaatggcttgaaaagcaatttgccatgaattattatgatttcttaaaggtgatacgaatatcaagtacttggttgatcataatgtgaacatttggaacgaatgaccttatgaagcttttaagaaatcaaatgactttaaaggagagagcttacaagacttcgttgagaaaattaaaactgataaccaatttgctcaacaatacggaaaactaggccctgtgtatggaaaacaatgacgtgactttaatggcgttgatcaaattgagtgagttatcaacgaaattaaaactaacccgttttcacgtcgtttaatagtaagtgcgtgaaatcctggtgaaataaaagagatggccctaccaccttgtcatagttttttccagttctttgttaatgaaaaatatgaaatttcactgcaactataccaaagaagtggggacctattcttaggcgtgccttttaatattgcttcttatagtttgttacttttaatggttgctcaagtaactgggttaaaacctgctgaatttatccatacaattggggatacccacatctattcaaaccaccttgaacaagtaaaaattcaactacaaagagaacctaaaaaacttcctaaagtaaccctaaaccctgatattaaaaatatctttgattttagattcgaagatatcagtttagaaaactatgaacaccatgacccaatcaaaggaaaggtagctgtttaa

SEQ ID NO: 17823 - protein, 289 aa, Mycoplasma gallisepticum
MKTYLDLLEKVMTKGEVKKDRTNTGTISYFGTQSRYDLREGFPLLTTKKMAWKAICHELLWFLKGDTNIKYLVDHNVNIWNEWPYEAFKKSNDFKGESLQDFVEKIKTDNQFAQQYGKLGPVYGKQWRDFNGVDQIEWVINEIKTNPFSRRLIVSAWNPGEIKEMALPPCHSFFQFFVNEKYEISLQLYQRSGDLFLGVPFNIASYSLLLLMVAQVTGLKPAEFIHTIGDTHIYSNHLEQVKIQLQREPKKLPKVTLNPDIKNIFDFRFEDISLENYEHHDPIKGKVAV

SEQ ID NO: 17824 - DNA, 864 bp, Mycoplasma genitalium
  CDS (1)..(864): transl_table=4
atgaaacagtatttagatttagctagttatgttttagcaaatggtaaaaaaagaaaaaaccgtacagatacagatactttaagtgtctttggttaccagatgaaatttgaccttactaatagttttcctttattgacaactaaaaaggttaattggaaggcaattgtccatgaattgttgtgatttattaagggtgataccaacattaagtacttagttgataatggggtgaacatctgaaatgaatgaccatatgaaaactttaaaaaatcaccaagttttcaaaacgaaacactccaagaatttatcttaaaggttaaaactgataatgagtttgctaaacaatttgctgatttgggtcctgtttatggcaagcaatgacgtaattttaatggtgttgatcaactcaaaaaagtcatccaagagattaaagaaaatcccaactcaagaaggctaattgtctcaagctgaaaccctagtgaattggaaaaaatggcattggctccttgtcattcactctttcagttctatgttgaagaagataaactaagcttacagctttaccagcgcagcggtgatatctttcttggtgtcccatttaacattgcatcttacgccttacttgtgtatttagttgctcatgaaactaagttaaaacctggttattttatccatacactaggagatgcacatatctatgaaaaccacattgaacaaattaaattacaactaacaagaacaaccctagacccccctcaagtggttttgaaaagtgataaatcaatctttgcttatagttttgatgatattgagttagttggttataattaccatccatttatctatgggagggttgcagtttaa

SEQ ID NO: 17825 - protein, 287 aa, Mycoplasma genitalium
MKQYLDLASYVLANGKKRKNRTDTDTLSVFGYQMKFDLTNSFPLLTTKKVNWKAIVHELLWFIKGDTNIKYLVDNGVNIWNEWPYENFKKSPSFQNETLQEFILKVKTDNEFAKQFADLGPVYGKQWRNFNGVDQLKKVIQEIKENPNSRRLIVSSWNPSELEKMALAPCHSLFQFYVEEDKLSLQLYQRSGDIFLGVPFNIASYALLVYLVAHETKLKPGYFIHTLGDAHIYENHIEQIKLQLTRTTLDPPQVVLKSDKSIFAYSFDDIELVGYNYHPFIYGRVAV

SEQ ID NO: 17826 - DNA, 801 bp, Mycobacterium leprae
  CDS (1)..(801): transl_table=11
gtgctgatagcgacgccatacgaggatttgctgcgtctcgtgcttgactgcggcgtagccaaaatggaccgcaccggcaccgggactcgcagtctgtttggtcagcagttgcgttacgacctgtcggttgggttcccgctagttacgacgaaaaaggtgcacttcaaatcggttgtctacgagttgttgtggttcttgcgcggcgactccaacgtcgcctggttgcatgagcatggagttaatatctgggatgagtgggctagcagcacaggcgacctcgggccgatttatggtgtgcagtggcgatcttggccgacctcttcgggtgattacatcgaccaaatcagcaccgcactggatttgctgcgtaccgaaccggattctcggcgcatcattgtgtcggcttggaatgtcggtgaaatcccgcagatggcgctgccaccatgtcacgcgtttttccaattctacgtcgctcaaggccggctgagttgccagctgtaccagcgcagcgccgacatgttccttggtgtgccgttcaacatcgccagttacgcgcttctgacccacatgatggccgcccagtccggtcttttggttggtgagttcgtctggacgggcggtgattgccacatctacgacaaccatgtcgagcaggtacagctgcagctcagccgcgaaccccgagcatatccagaactctttttagcgcagcgtgattctatcttcgactatgtctacgaggacgtcgtcgtcacgaattatgatccgcacccggcgatcaaagccccagtcgcgatatga

SEQ ID NO: 17827 - protein, 266 aa, Mycobacterium leprae
MLIATPYEDLLRLVLDCGVAKMDRTGTGTRSLFGQQLRYDLSVGFPLVTTKKVHFKSVVYELLWFLRGDSNVAWLHEHGVNIWDEWASSTGDLGPIYGVQWRSWPTSSGDYIDQISTALDLLRTEPDSRRIIVSAWNVGEIPQMALPPCHAFFQFYVAQGRLSCQLYQRSADMFLGVPFNIASYALLTHMMAAQSGLLVGEFVWTGGDCHIYDNHVEQVQLQLSREPRAYPELFLAQRDSIFDYVYEDVVVTNYDPHPAIKAPVAI

SEQ ID NO: 17828 - DNA, 867 bp, Mycoplasma mobile
  CDS (1)..(867): transl_table=4
atggaacaatatttatctttacttaaagaaattttagaaaaaggacaaaaaaaagaagatcgtactaatacaggcacaatttcttattttggaactcaaagaagatatgatctatctaaaggatttcctttagtaacaactaaaaaagttcatcttaaatcaattatttttgaactattatgatttattaaaggcgatacaaatattaagtatctagttgataatggagtaaatatttgaaatgaatggccttatgaaacttttaaaaaatcaaaagattttaatggtgaatctttagctgattttgttttaaaaatcaaaagtgatactctttttgctaaaaaatatggtgaattaggtcctgtttatggaaaacagtgaagaaattttaatggcacagaccaactttttgatgcaattgagacaattaaaaaaaatcctgattcaaggagaattattgtttcggcttgagctgcaaatgaaatttccaaaatggctcttcctccttgccatgctttttttcaattttatgtaaataataataaattatcattacagttatatcaaagatcaggagatacatttttaggtgtcccttttaatattgcttcttattcaattcttcttgcaatggttgctcaaataacaaattatgaagtaggtgaatttattcacacaataggtgatactcacatttatctaaatcatttagaacaagtagaagagcaattatcaagaaaacctttaaaattaccaaaattagttttgaacaaaaaaattaaaaatattgatgattttaaatatgaagatattgaaattattgattatgaatctcatcctgcaattaaagcaaaggtggctgtataa

SEQ ID NO: 17829 - protein, 288 aa, Mycoplasma mobile
MEQYLSLLKEILEKGQKKEDRTNTGTISYFGTQRRYDLSKGFPLVTTKKVHLKSIIFELLWFIKGDTNIKYLVDNGVNIWNEWPYETFKKSKDFNGESLADFVLKIKSDTLFAKKYGELGPVYGKQWRNFNGTDQLFDAIETIKKNPDSRRIIVSAWAANEISKMALPPCHAFFQFYVNNNKLSLQLYQRSGDTFLGVPFNIASYSILLAMVAQITNYEVGEFIHTIGDTHIYLNHLEQVEEQLSRKPLKLPKLVLNKKIKNIDDFKYEDIEIIDYESHPAIKAKVAV

SEQ ID NO: 17830 - DNA, 801 bp, Mycobacterium paratuberculosis
  CDS (1)..(801): transl_table=11
gtgcccatcccgacgccctacgaggaccttctgcgtctggtgctcgatcggggaacggccaaatccgaccgaaccggcaccgggacgcgcagcctgttcggccagcagctgcgctatgacctgtcggccggcttcccgctgatcaccaccaagaaggtgcatctgaaatcggtggtctatgagttgctgtggttcttgcgcggcgactccaacgtcgactggctgcaccggcacggcgtcaccatttgggacgaatgggcaagcgacacaggcgatctcggaccgatctacggcgtgcagtggcggtcctggccgacgccgtcgggtgagcacatcgaccagatcagcgccgcgctggatctgttgcgcaccgaccccgactcgcggcgcatcatcgtgtcggcgtggaacgtcggcgagatcccgcggatggcgctgccgccgtgtcacgcgttcttccagttctacgtggccgacgggcggctgagctgccagctctaccagcgcagcgccgacctgtttctgggcgtgccgttcaacatcgccagctacgccctgctcacccacatgatggccgcccaggccgggctgtcggtcggcgaattcgtgtggaccggtggcgactgccacatctacgacaaccacgtcgagcaggtccggctgcagctgagccgcgagccccggccctacccggaactcattctggcgcatagggattcgatcttcgactacacctacgacgacgtcgtggtgcacaactacgatccgcacccggccatcaaggcccccgtcgcggtatga

SEQ ID NO: 17831 - protein, 266 aa, Mycobacterium paratuberculosis
MPIPTPYEDLLRLVLDRGTAKSDRTGTGTRSLFGQQLRYDLSAGFPLITTKKVHLKSVVYELLWFLRGDSNVDWLHRHGVTIWDEWASDTGDLGPIYGVQWRSWPTPSGEHIDQISAALDLLRTDPDSRRIIVSAWNVGEIPRMALPPCHAFFQFYVADGRLSCQLYQRSADLFLGVPFNIASYALLTHMMAAQAGLSVGEFVWTGGDCHIYDNHVEQVRLQLSREPRPYPELILAHRDSIFDYTYDDVVVHNYDPHPAIKAPVAV

SEQ ID NO: 17832 - DNA, 870 bp, Mycoplasma penetrans
  CDS (1)..(870): transl_table=4
atgaaagaatataaagacttattaaaactggttttagataatgggataatgcaagagaacagaactgatactgatgctattgcatattttggaacacaatctagatatgatctaactaaaggttttccattattaacaactaagaaaatggcttataaagcaattttccatgaattattatgatttttaaaaggtgaaactaatattaaataccttgtggataataatgtaaaaatctgaaatgaatgaccttatgaaaactataaaaaatctccatatttcaaaaatgaatctattgatgaattcattttaaaaattaaagaagatgattcatttgctaaacaatttggtgaacttggaccagtatatggaagacaatgaagaaattttaatggggtagatcaaattactaatctaatagaagagatcaagaaaaataagtattctagaagattaattgtaagtgtttgaaatcctagtgaaattaaaaatatgttattaccaccttgtcattgtttatttcaattttttgttaattcaaaaaatgaattatcttgtcagttatatcaaagaagtgcagatctatttttaggagttccttttaatattgcttcatatagtttattaacttatatgattgctcaagttacaaatactactgcaaaagaatttgttcacactattggagtagctcatatttataacaatcatattgatcaagttaaagaacaactaactagagaaccattgcaattaccaacattagtattaaataaaaatattaaaaatatctttgattttaaaatagaagatattgaaattaaagattataattctcatccagctattaaagggaaggtagcagtataa

SEQ ID NO: 17833 - protein, 289 aa, Mycoplasma penetrans
MKEYKDLLKLVLDNGIMQENRTDTDAIAYFGTQSRYDLTKGFPLLTTKKMAYKAIFHELLWFLKGETNIKYLVDNNVKIWNEWPYENYKKSPYFKNESIDEFILKIKEDDSFAKQFGELGPVYGRQWRNFNGVDQITNLIEEIKKNKYSRRLIVSVWNPSEIKNMLLPPCHCLFQFFVNSKNELSCQLYQRSADLFLGVPFNIASYSLLTYMIAQVTNTTAKEFVHTIGVAHIYNNHIDQVKEQLTREPLQLPTLVLNKNIKNIFDFKIEDIEIKDYNSHPAIKGKVAV

SEQ ID NO: 17834 - DNA, 864 bp, Mycoplasma pneumoniae
  CDS (1)..(864): transl_table=4
atgcagcagtatctagatttagcccgttatgttttagagcacggaaaataccgtccaaatcgcactgatactgctggcattggtgtctttggttaccagatgcactttgatatttcaaaacactttccgctcttgactacgaagaaggtgcactgaaagtcgattgtgcacgaacttttgtggttcattaagggtgacaccaatattaagtacctagtcgacaataaggtcaacatttggaatgaatgaccttacgaaagctttaaaaagtcacctcactttaacggtgagagtcaaaaggagttcattgaacggattcgacaagacgcgaagtttgcccaacagtttggtaacctcggacccgtttatggaaagcaatggcgtgactttaacggagtcgatcaattgaaaaaggtaattgcgcaaattaaggtaaatccgttttcgcggcgcttaattgtgtctagttgaaatcccaatgaggtggatcaaatgttgctcccgccttgtcattcactgtaccagttttacgtacaggacgggcagttgagctgccagttgtaccagcgcagtggtgatatttttctaggtatccccttcaacattgcgtcctactctcttctggtgtacttagttgctaaggaaactaacctaaaaccagggagctttgtccacaccattggcgatgcccacatttacgaaaatcacttggaacaaattaagttgcaattaacacgtcaacccaaaccattgcccaaggtagttttaaagagtgataaatcaatttttgattatcaattcgatgatattgaactggtggattacgaccaccaccctacaattaaaggagaggtagcagtttaa

SEQ ID NO: 17835 - protein, 287 aa, Mycoplasma pneumoniae
MQQYLDLARYVLEHGKYRPNRTDTAGIGVFGYQMHFDISKHFPLLTTKKVHWKSIVHELLWFIKGDTNIKYLVDNKVNIWNEWPYESFKKSPHFNGESQKEFIERIRQDAKFAQQFGNLGPVYGKQWRDFNGVDQLKKVIAQIKVNPFSRRLIVSSWNPNEVDQMLLPPCHSLYQFYVQDGQLSCQLYQRSGDIFLGIPFNIASYSLLVYLVAKETNLKPGSFVHTIGDAHIYENHLEQIKLQLTRQPKPLPKVVLKSDKSIFDYQFDDIELVDYDHHPTIKGEVAV

SEQ ID NO: 17836 - DNA, 861 bp, Mycoplasma pulmonis
  CDS (1)..(861): transl_table=4
atgaaacaatatttagactttttaaaatgagtattagaaaagggaaaacataaggaaaatagaactagtgttgacacaattagtgcctttggttatcaaatgcgttttgatctatctaagggctttcctttggttacaacaaagaaaactaattttagtgctatagctcatgaattactgtgatttataaaaggtgatactaacattaaatatctagttgataacaaagttaacatttgaaatcaatgaccttatgagagttataaaaaaagtcaagattttcaaagcgagagcttaaaagagtttattcaaaaaatcaaagatgataatgaatttgctcaaaaacatggtaatttaggtccagtttatggaaagcaatgaagagactttttgggaatagatcaattaaaaaaagttattgaacaaataaaaaataatccaaactctagaagactaatagtttcttcatgaaatccaagtgaaatagatactatgcttttacctccttgtcatactttgtttcaattttatgtaaatgataataagctttcatgtcatctatatcaacgaagtgctgatgcttttttgggtattccttttaacatagcctcttatgcacttttgacttttttattagctcaagaaactaatttagaagttggtgattttgttcattcaattggagatgctcacatttatgtaaatcatcttgagcaagtaaaaactcaactaaaaagaaatccaaaagaactgccaaaattaataatcaaaaacaaaaatatttttgaaattaattttgaagatattgaattagttgactatgaatttgatccaattattaaaggggaagtggcggtttaa

SEQ ID NO: 17837 - protein, 286 aa, Mycoplasma pulmonis
MKQYLDFLKWVLEKGKHKENRTSVDTISAFGYQMRFDLSKGFPLVTTKKTNFSAIAHELLWFIKGDTNIKYLVDNKVNIWNQWPYESYKKSQDFQSESLKEFIQKIKDDNEFAQKHGNLGPVYGKQWRDFLGIDQLKKVIEQIKNNPNSRRLIVSSWNPSEIDTMLLPPCHTLFQFYVNDNKLSCHLYQRSADAFLGIPFNIASYALLTFLLAQETNLEVGDFVHSIGDAHIYVNHLEQVKTQLKRNPKELPKLIIKNKNIFEINFEDIELVDYEFDPIIKGEVAV

SEQ ID NO: 17838 - DNA, 1422 bp, Neisseria gonorrhoeae
  CDS (446)..(1243)
acagggtgttcaggtcagtcattcggatactccttttggttgatattgtactaatgggaaaacaaatttgtagttggcaatataaacctatttttttctgatgccaagcctaattttgcacaaattgttgacattatttttcccatattttcgatatatgatgtttattgccgataatcaaccaataatcataaattaatttctcaaataaaaaatattattggaattttattctaagtagttaaactagattttttgattccaatcaagataattttgttttcacgcctgcttttgctgtgaaaaagggctgaaattgccaacaatcctgcctgccttcatccgcgttttgagcgtccggcggggcggcctgcgcgtttgtccggactcgggtgttggccggaaatgttacaatatgtgccgtttaatttgatgaaagatgatgatgaaggcctatttggacttgatgcgccacgtcctcgacaacggtacggacaaatcagaccgcaccggtacgggtacgctgtccgtattcggttatcagatgcgttttgacttgggcaaaggttttccgctgctgacgaccaaaaagctgcatttgcgctcgataatccacgagctgctttggttcctcaaaggcgataccaatatcaaatacctcaaggataacaatgtttccatttgggacgacgagtgggcggacgaaaacggcgacttgggcccggtttacggctaccaatggcgcagctggcccgcgcccgacggcaggcatatcgaccaaatcgccaatgtggtggaacaaattaagaaaaaccccgactcgcgccgcctgattgtgtcggcgtggaatccggctttggtcgatgagatggccttaccgccctgccacgcgctgtttcagttttacgttgccgacggaaacctgtcctgccagctttaccagcgtagtgcagatattttccttggtgtgccgtttaatattgccagctacgcgctgttgacgatgatgatggcgcaagtgtgcgggctggaggcgggcgagtttgtccatacgtttggcgacgcgcatttgtaccgtaaccatttcgaacaggccgcattgcagttggaacgcgaaccgcgcgccttgcctgtgatgaaaatcaatcctgaagtcaaggatttgtttgccttcaagtttgaagatttcgagttggaaggctacgatccgcatccgcacatcaaggcggtagtgtcggtttaggaggcggtatgggcaggcatttcgggcgcagacgttttctgacggctgccgcgttgctgtggccggtgcggcggtttcttttttgccgaatccttttgccgccgcgcgaaaaacgcaacatggataaaaaacgcgatgaaaatgtgtttttctggaaaggtgtcgcgctgggttccggc

SEQ ID NO: 17839 - protein, 265 aa, Neisseria gonorrhoeae
MKAYLDLMRHVLDNGTDKSDRTGTGTLSVFGYQMRFDLGKGFPLLTTKKLHLRSIIHELLWFLKGDTNIKYLKDNNVSIWDDEWADENGDLGPVYGYQWRSWPAPDGRHIDQIANVVEQIKKNPDSRRLIVSAWNPALVDEMALPPCHALFQFYVADGNLSCQLYQRSADIFLGVPFNIASYALLTMMMAQVCGLEAGEFVHTFGDAHLYRNHFEQAALQLEREPRALPVMKINPEVKDLFAFKFEDFELEGYDPHPHIKAVVSV

SEQ ID NO: 17840 - DNA, 795 bp, Neisseria meningitidis
  CDS (1)..(795): transl_table=11
atgaaagcctatttggacttgatgcgccacgtcctcgacaacggtacggacaaatcagaccgcaccggtacgggtacgcgctccgtattcggttatcagatgcgttttgacttgggcaaaggttttccgctgctgacgaccaaaaagctgcatctgcgttcgattatccacgagctgctttggtttctcaaaggcgataccaatatcaaatacctaaaggacaacaatgtttccatttgggacgagtgggcggacgaaaacggcgacttaggcccggtttacggctaccagtggcgtaactggcccgcgcccgacggcaggcatatcgaccaaatcgccaatgtgctggaacaaatcaagaagaatcccgactcgcgccgcctgattgtatcggcgtggaatccggctttggtcgatgaaatggccttgccgccctgccacgcgctgtttcagttttacgttgccgacggcaaactgtcctgccagctttaccagcgtagtgcagatattttccttggtgtgccgtttaatattgccagctacgcattgttgaccatgatgatggcgcaagtgtgcggattggaggcgggcgagtttgtccatacgtttggcgacgcgcatttgtaccgcaaccatttcgagcaggccgcattgcagttggaacgcgaaccgcgcgccttgccagtgatgaaaatcaatcctgaagtcaaagatttgttttccttcaagtttgaagatttcgagttggaaggttacgaccctcatccgcatatcaaggcggcagtgtcggtttag

SEQ ID NO: 17841 - protein, 264 aa, Neisseria meningitidis
MKAYLDLMRHVLDNGTDKSDRTGTGTRSVFGYQMRFDLGKGFPLLTTKKLHLRSIIHELLWFLKGDTNIKYLKDNNVSIWDEWADENGDLGPVYGYQWRNWPAPDGRHIDQIANVLEQIKKNPDSRRLIVSAWNPALVDEMALPPCHALFQFYVADGKLSCQLYQRSADIFLGVPFNIASYALLTMMMAQVCGLEAGEFVHTFGDAHLYRNHFEQAALQLEREPRALPVMKINPEVKDLFSFKFEDFELEGYDPHPHIKAAVSV

SEQ ID NO: 17842 - DNA, 795 bp, Nitrosomonas europaea
  CDS (1)..(795): transl_table=11
atgtatcagtacctcgacctgatgcgacatgtgttgcaatacggccataaaaagagtgatcgcaccggcaccggcacactctccgtttttggctatcagatgcgctttgatctgcaaacgggttttccgctggtgacaaccaagaaatgtcatgtcaaatcgatcattcatgaactgctatggtttctgcgcggcgaaaccaacatcgattacctgaaaagaaacggggtttccatctgggatgaatgggcagatgaaaacggtgatctgggcccgatctacggccatcagtggcgatcctgggcagcttccgacggcactgtcattgaccagatatcgcaagtgatccagcaaatcaaagaaacaccggactcacgccggatgatcgtctccgcatggaatgtaggtgatctcgacaaaatgaagctcgccccctgtcacgtactgttccagttttacgtggcggatggcagactctcctgccagctttaccagcgcagtgccgatatctttctgggcgttcccttcaacattgcctcttattcactgctgacactgatgatcgcacaatgttgcgacctgcagcccggcgaattcgtccatacctttggtgatgcgcatctgtatctgaaccaccttgaacaggcgcggttgcaactggaacgcgaacccagagcactcccagccatgcaactgaattcaacagtcagaaatatctttgatttcggatacgaggattttaccttgcacgattatgatccttacccgcctatcaaggcaccggtggctgtatga

SEQ ID NO: 17843 - protein, 264 aa, Nitrosomonas europaea
MYQYLDLMRHVLQYGHKKSDRTGTGTLSVFGYQMRFDLQTGFPLVTTKKCHVKSIIHELLWFLRGETNIDYLKRNGVSIWDEWADENGDLGPIYGHQWRSWAASDGTVIDQISQVIQQIKETPDSRRMIVSAWNVGDLDKMKLAPCHVLFQFYVADGRLSCQLYQRSADIFLGVPFNIASYSLLTLMIAQCCDLQPGEFVHTFGDAHLYLNHLEQARLQLEREPRALPAMQLNSTVRNIFDFGYEDFTLHDYDPYPPIKAPVAV

SEQ ID NO: 17844 - DNA, 801 bp, Nocardia farcinica
  CDS (1)..(801): transl_table=11
gtggcgacggacaggcaatacgaggacctcctgcggctcgtgctcgacaccggcacggccaagggcgaccgcaccggcaccggaacccgcagcatcttcgggcaccagctgcgctacgacctgtccgcgggattcccgctgatcaccaccaagaaagtgcacctgaagtcgatcgtctacgagctgctgtggttcctgcgcggcgactccaacgtgggctggctgcgcgagcacggggtgaccatctgggacgaatgggccgacccgcagggcgagttgggcccggtgtacggcgtgcagtggcggtcgtggcccaccccggacggcacccacatcgaccagatctcccaggtgttgcagaccctgcgcaccgacccggactcgcggcggatgatcgtctcggcgtggaatgtggccgaactcgaccggatggcgctggcgccctgccacgcgttcttccagttctacgtggccgacggcaagctgtcctgccagctctaccagcgcagcgcggacctgttcctgggggtgccgttcaacatcgccagttacgcgctgctcacccacatggtggcccagcagaccgagctcgagcccggtgagttcatctggaccggcggtgactgccacatctacgacaaccacgtcgagcaggtcaccgagcagctcggccgcgagccctatccgttcccgcggctcgaattgcgcccggcgcccagcttgttcgactaccgcttcgaggacgtcacggtgaccgactaccggcatcacccggcgatcaaagctccggtggcggtgtga

SEQ ID NO: 17845 - protein, 266 aa, Nocardia farcinica
MATDRQYEDLLRLVLDTGTAKGDRTGTGTRSIFGHQLRYDLSAGFPLITTKKVHLKSIVYELLWFLRGDSNVGWLREHGVTIWDEWADPQGELGPVYGVQWRSWPTPDGTHIDQISQVLQTLRTDPDSRRMIVSAWNVAELDRMALAPCHAFFQFYVADGKLSCQLYQRSADLFLGVPFNIASYALLTHMVAQQTELEPGEFIWTGGDCHIYDNHVEQVTEQLGREPYPFPRLELRPAPSLFDYRFEDVTVTDYRHHPAIKAPVAV

SEQ ID NO: 17846 - DNA, 954 bp, Oceanobacillus iheyensis
  CDS (1)..(954): transl_table=11
atgttaggggaacaagcctacttagatttgtgtaaacaaatatttaaaactggagaacaacgtggagatcgaaccaatacaggaacacattctatattcggacatcaaattcgttttgatttaaataaaggatttcctcttctaacgacaaaacgtgttccattccgactagttgcgagtgaactactttggtttattaaaggggataccaatattcggtatttattaaaacataataataatatttggaatgaatgggcatttgaaaaatgggtaaatagcgctgattatcaaggtccagatatggcgaatttcggattacgcagtcaaaaagatgagaattttaataaacaatatcaagaacaaatggagctctttaaaacgcgaattcttgaagatgattcttttgctgacaaatacggggacttaggatctgtatacgggaaacaatggagaaattggaagactactcagaatgaaacaattgatcaattaaaagatgtgattcattccattaaaacgaatccaaattcaagaagacatattgtatctgcgtggaatccagaagatattccaacaatggctttacctccttgtcatacattattccaattttatgtttcaaatggaaagctttcttgtcagctataccaaagaagtgcagacgtattcctaggggtaccattcaatatagccagttatgccctactcacgcatttaattgcccatgagtgtggattagaagttggtgatttcgtacatacttttggagacgcacatatttactctaatcatgttgaacaagtcgaaacacaactggaaagggagatccgcgattttccacaactaataataaacaaagataaaaattctatttttgaaatggacttagatgatttagtgattgaaaattataatcctcatccaagtattaaagcaccgattgctgtatag

SEQ ID NO: 17847 - protein, 317 aa, Oceanobacillus iheyensis
MLGEQAYLDLCKQIFKTGEQRGDRTNTGTHSIFGHQIRFDLNKGFPLLTTKRVPFRLVASELLWFIKGDTNIRYLLKHNNNIWNEWAFEKWVNSADYQGPDMANFGLRSQKDENFNKQYQEQMELFKTRILEDDSFADKYGDLGSVYGKQWRNWKTTQNETIDQLKDVIHSIKTNPNSRRHIVSAWNPEDIPTMALPPCHTLFQFYVSNGKLSCQLYQRSADVFLGVPFNIASYALLTHLIAHECGLEVGDFVHTFGDAHIYSNHVEQVETQLEREIRDFPQLIINKDKNSIFEMDLDDLVIENYNPHPSIKAPIAV

SEQ ID NO: 17848 - DNA, 867 bp, Onion yellows phytoplasma
  CDS (1)..(867): transl_table=11
atgaatacttatttagatttatgtcgttttattttgcaaaaaggcagttttagaaacgaccgcactaatacaggtaccaaaagtgtttttggctaccaaatgcgctttaatcttgaagaaggttttcctttgttaactactaaaaaaatgaatcttagatcaattatccacgaacttttatggtttttaaaaggggatactaatatttgttatttggtacaaaacaatgttaatatttggaatgaatggccttatcaaaaatatcaacaatcagctttttttcaaaatgaaacattgaaagaatttttagaaaaaatcaaaaatgatcctctttttgccataaagcacggtaatttaggtcctgtttatggtaaacaatggcgcgattttaatggcgttgatcaaatcaaatttttaatttctgaaatcaaaaccaatcccaattccagacgtttgattcttaattcttggaatccgcccttattaaaccaaatggcattgccaccttgtcatgtcttaattcaattctacgttcatcaaggcaaactctccttgcaactatatcaacgtagtggagatgtttttttgggaataccttttaatatcgcttcttattctttattacttatgatggtcgcacaagtaactaacttacaaccttacgaatttatccatactttaggagatgcccacatttattccaatcaccttgcacaagttcagacccaaattcaaagaactcctaaaaaattacctcaaatgattttaaatcctgacatcaaaaatattgatgattttaaatttagtgattttactttgcaaaattatcaatgtgatggcattttgaaaggcgatattgctgtatga

SEQ ID NO: 17849 - protein, 288 aa, Onion yellows phytoplasma
MNTYLDLCRFILQKGSFRNDRTNTGTKSVFGYQMRFNLEEGFPLLTTKKMNLRSIIHELLWFLKGDTNICYLVQNNVNIWNEWPYQKYQQSAFFQNETLKEFLEKIKNDPLFAIKHGNLGPVYGKQWRDFNGVDQIKFLISEIKTNPNSRRLILNSWNPPLLNQMALPPCHVLIQFYVHQGKLSLQLYQRSGDVFLGIPFNIASYSLLLMMVAQVTNLQPYEFIHTLGDAHIYSNHLAQVQTQIQRTPKKLPQMILNPDIKNIDDFKFSDFTLQNYQCDGILKGDIAV

SEQ ID NO: 17850 - DNA, 852 bp, Pasteurella multocida
  CDS (1)..(852): transl_table=11
atgaaacactatttagaactttgccaacgtatcgttgatgaaggtgtttgggttgaaaatgcacggactggcaaacgttgtctgaccgtgattgatgcggatctcacctacgatgttgccaataaccaatttccgttgatcaccacacgcaaaagctattggaaagcggcaattgcagaatttttaggttatatccgtggctatgacaatgcggcagatttccgcaaactcggcaccaaaacctgggatgccaatgctaatgaaaacagtgcatggctcaataatccgcaccgcaaaggcaccgatgatatgggacgtgtttatggcgtacaagggcgtgcatggcgcaaaccgaacggtgaaaccgtcgatcaattgcgcaaaatcgtcaataatctgcgcaacggcattgatgaccgtggtgaaatcatgaccttcttcaaccccggtgaatttgaactgggttgcctacgtccttgcatgcacacccacaccttctcattactcggtgataccctctatctcaccagttatcagcgttcttgtgatgtgccgcttggcttgaatttcaaccaaattcaagtgttcacctttcttgccttgatggcacaaattacgggcaaaaaagcgggtaaggcgtaccacaaaatcatcaatgcacacatttatgaagatcaacttgatctcatgaaaaatgtgcaattaaaacgtgaccccttcccgttgccacaattacacattaaccccgagattaaaactctcgaagatttagaaacttgggtgactatggatgattttaaggtcacgggctatcaatgccacgatgccattaaatatcctttctctgtgtaa

SEQ ID NO: 17851 - protein, 283 aa, Pasteurella multocida
MKHYLELCQRIVDEGVWVENARTGKRCLTVIDADLTYDVANNQFPLITTRKSYWKAAIAEFLGYIRGYDNAADFRKLGTKTWDANANENSAWLNNPHRKGTDDMGRVYGVQGRAWRKPNGETVDQLRKIVNNLRNGIDDRGEIMTFFNPGEFELGCLRPCMHTHTFSLLGDTLYLTSYQRSCDVPLGLNFNQIQVFTFLALMAQITGKKAGKAYHKIINAHIYEDQLDLMKNVQLKRDPFPLPQLHINPEIKTLEDLETWVTMDDFKVTGYQCHDAIKYPFSV

SEQ ID NO: 17852 - DNA, 795 bp, Photorhabdus luminescens
  CDS (1)..(795): transl_table=11
atgaaacagtatctggacttaatgacaagagtgcttgcagagggcactccgaaagcagaccgcaccgggacggggacactctcgattttcgggcatcagatgcgtttcaatttacaggatggttttccactggtcacaactaaacgttgccatatccgctcaattattcatgaacttctctggttcttgaatggtgataccaatattaaatatctgcatgaaaatggggtgactatttgggatgaatgggcggatgaaaacggtgatttagggccggtatatggtaagcaatggcgcgcatggggtaccgcagatggccgccagattgaccaattgaaaactgtactggaacagcttaaaagcgatccagattcacgtagaattattgtttcggcttggaacgttggtgaattggataagatggcattagcgccatgccacgctttcttccagttttatgttgcggatggcaaactttcctgtcagctttaccagcgctcctgtgacgtattccttggcttaccgttcaatattgccagctatgcattgctagttcacatgatggcgcaacagtgtgatttggaagtaggcgattttgtctggaccggtggtgatacgcacctttatagcaaccatatggagcagacaaaattacaactcagccgtgaaccgcgttcactaccaaaactggtgataaagcgtaaaccggcatcactttttgattataaatttgatgactttgaaatagttgattatgacccacatccaggaataaaggccccggttgctatttag

SEQ ID NO: 17853 - protein, 264 aa, Photorhabdus luminescens
MKQYLDLMTRVLAEGTPKADRTGTGTLSIFGHQMRFNLQDGFPLVTTKRCHIRSIIHELLWFLNGDTNIKYLHENGVTIWDEWADENGDLGPVYGKQWRAWGTADGRQIDQLKTVLEQLKSDPDSRRIIVSAWNVGELDKMALAPCHAFFQFYVADGKLSCQLYQRSCDVFLGLPFNIASYALLVHMMAQQCDLEVGDFVWTGGDTHLYSNHMEQTKLQLSREPRSLPKLVIKRKPASLFDYKFDDFEIVDYDPHPGIKAPVAI

SEQ ID NO: 17854 - DNA, 852 bp, Photobacterium profundum
  CDS (1)..(852): transl_table=11
atgaaacagtatttagaactctgtcagcgtattgttgacgacggcgtttggattgaaaataaacgaaccaataaacggtgccttaccgttgttaatgccgatttaacgtttgatgtggctaataatcagtttccgcttataaccactcgtaaaagcttctggaaatctgctattgctgagttacttggttacatccgtggttatgataatgccgctgattttcgtgccttgggaacaaaaacgtgggacatgaatgcgaatgataatttagcatggttgaataacccgcaccgcaaaggtgaagatgacatggggcgagtgtacggtgttcaaggccgtagctggcagaaaccagatggtagtactatcgatcagttgcgaaaaattgtcgataacctgtctgaaggtattgatgaccgtggtgaaattctgacgttttataatccaggtgagtttgatctggggtgtttacgtccttgtatgcacacacatacgttttcattgcttggtgatacattgcatctaacaagttaccagcgttcatgtgatgtgccgctagggctaaattttaaccaagttcaggtctatacactgttggcactagtggcacagattactggcaagaagccaggactggcttaccataagatcattaatgcacatatttatgaagatcagctgtctttgctacgtgatgtgcaattaacgcgtaccccttttgctgcacctaaactcatcatcaacccaaagattaaatgccttgaagacttggaaacgtgggtaacaatggatgattttgacgtgattggctacgagcatcatgaagcgataaaatacccattttcggtgtaa

SEQ ID NO: 17855 - protein, 283 aa, Photobacterium profundum
MKQYLELCQRIVDDGVWIENKRTNKRCLTVVNADLTFDVANNQFPLITTRKSFWKSAIAELLGYIRGYDNAADFRALGTKTWDMNANDNLAWLNNPHRKGEDDMGRVYGVQGRSWQKPDGSTIDQLRKIVDNLSEGIDDRGEILTFYNPGEFDLGCLRPCMHTHTFSLLGDTLHLTSYQRSCDVPLGLNFNQVQVYTLLALVAQITGKKPGLAYHKIINAHIYEDQLSLLRDVQLTRTPFAAPKLIINPKIKCLEDLETWVTMDDFDVIGYEHHEAIKYPFSV

SEQ ID NO: 17856 - DNA, 795 bp, Porphyromonas gingivalis
  CDS (1)..(795)
atgaaacagtatttggatctgcttcgccgcatcctcgacgagggagtacgaaaagaagaccgcacgggtacgggtacgatcagcgtattcggccatcagatgtgctttgaccttgaagagggatttcccttgcttacgaccaagcgattgcacttgaagtccattatatacgaactgctttggttcctcagaggtgacacgaacgtgcattacctgcaggaacatggcgtacgcatttggaacgaatgggctgatgagaacggcgatttgggacctatatatggctaccagtggcgcagttggccggactatcggggagggcatatagaccaaatgcaggaggtgctgcgccagctgcgcgaagaaccggacagccggcgcattatcgtatgctcgtggaatgtaggccagcttgccgatatgcatctgcctccatgccactgtttcatgcagttctatgtcgctgacggccggctgagcctgcaactctatcagcgcagtgccgattcttttctgggcataccgttcaacatagcttcgtatgcactcctgctacaaatgatcgctcatgtcacagggctgaaacccgggcgattcgtacatacactgggcgacgcccatatctatcttaaccacctcgaacaggtacagctacaactgagtcgtgagccgagagcgttgccccgaatggtactgaatccggaggtgtccgatctcttcgacttccgatacgaagacttccgactcgaagggtatgatccgcatccgcacattgcgggcgttgtagcagtctga

SEQ ID NO: 17857 - protein, 264 aa, Porphyromonas gingivalis
MKQYLDLLRRILDEGVRKEDRTGTGTISVFGHQMCFDLEEGFPLLTTKRLHLKSIIYELLWFLRGDTNVHYLQEHGVRIWNEWADENGDLGPIYGYQWRSWPDYRGGHIDQMQEVLRQLREEPDSRRIIVCSWNVGQLADMHLPPCHCFMQFYVADGRLSLQLYQRSADSFLGIPFNIASYALLLQMIAHVTGLKPGRFVHTLGDAHIYLNHLEQVQLQLSREPRALPRMVLNPEVSDLFDFRYEDFRLEGYDPHPHIAGVVAV

SEQ ID NO: 17858 - DNA, 810 bp, Propionibacterium acnes
  CDS (1)..(810): transl_table=11
atgcagatctacctcgacttgttgcggcggatccttgacgagggcgtgcgccgcgaggaccgtaccggaacggggacggtcagcgtcttcggtcaccagatggtctttgatctgcgcgagggattcccgctggtaacgacgaagaagatttacacccgcagcgtgttcggggagttgctgtggtttctgcgcggggatacgaatgtcggctggctgcatgataataacatccacatttgggacgagtgggccgacgagaacggtgatttagggccggtctacgggcatcagtggcgttcttggcccgacgacgatggcacaattgatcagatcgccaacgtggttgagcagattcgcaccaatccgtggtcgcgtcgtcacatcgtctcggcatggaatgtggccgagatcaaggagatggccctgccgccgtgccacactttgttccagttttacgtcacgccggatgatcggggaaccccgacgtggttgagctgccagctgtaccagcgctccggtgacaccttcctcggagtgccgttcaatatcgcgtcatatgccctgctcacccatctggtggcctcggtgaccgggctcaagccgttgcggttcgtccacaccttgggtgatgcccatgtgtacctcaatcacctcgaccaggttcatgagcagttgaaacgtaagccgcggcaccggccaacgctcaccgtcaacccgggtatccgtgacattgacgggtttgagctgtccgatatcaccctgactggttatgacccgtatccggcgctgcctgctccgattgcggtctga

SEQ ID NO: 17859 - protein, 269 aa, Propionibacterium acnes
MQIYLDLLRRILDEGVRREDRTGTGTVSVFGHQMVFDLREGFPLVTTKKIYTRSVFGELLWFLRGDTNVGWLHDNNIHIWDEWADENGDLGPVYGHQWRSWPDDDGTIDQIANVVEQIRTNPWSRRHIVSAWNVAEIKEMALPPCHTLFQFYVTPDDRGTPTWLSCQLYQRSGDTFLGVPFNIASYALLTHLVASVTGLKPLRFVHTLGDAHVYLNHLDQVHEQLKRKPRHRPTLTVNPGIRDIDGFELSDITLTGYDPYPALPAPIAV

SEQ ID NO: 17860 - DNA, 795 bp, Pseudomonas aeruginosa
  CDS (1)..(795): transl_table=11
atgaaacagtacctcgacctgatgcgccacgtgcgcgagcacggcaccttcaagagcgaccgcaccggcaccggcacctatagcgtgttcggccaccagatgcgcttcgacctggccgcgggcttccccctggtgaccaccaagaagtgccacctcaagtcgatcgtccacgagctgctgtggttcctcaagggctccaccaatatcgcctacctcaaggagcacggcgtctcgatctgggacgaatgggccgacgagaacggcgacctcggcccggtgtatggctaccagtggcgctcctggccggcgccggacggccgccacatcgaccagatcgccaacctgatggcgatgctgaagaagaatccggactcgcgccggctgatcgtctccgcctggaacccggcgctgatcgacgagatggccctgccgccctgccacgcgctgttccagttctacgtcgccgacggcaagctcagctgccagctctaccaacgttcggcggacatcttcctcggcgtacccttcaatatcgccagctatgccctgctgaccctgatggtggcgcaggtcgccggcctgcagccgggcgagttcatctggaccggcggcgattgccacctgtacgccaaccacctggagcaggccgacctgcagctgacccgcgagccgctgccgttgccgagcatgaagctgaatcccgaggtgaaggatctgttcgactttcgcttcgaggacttcgagctggtcggctacgaggcccatccgcacatcaaggcaccggtcgcggtctga

SEQ ID NO: 17861 - protein, 264 aa, Pseudomonas aeruginosa
MKQYLDLMRHVREHGTFKSDRTGTGTYSVFGHQMRFDLAAGFPLVTTKKCHLKSIVHELLWFLKGSTNIAYLKEHGVSIWDEWADENGDLGPVYGYQWRSWPAPDGRHIDQIANLMAMLKKNPDSRRLIVSAWNPALIDEMALPPCHALFQFYVADGKLSCQLYQRSADIFLGVPFNIASYALLTLMVAQVAGLQPGEFIWTGGDCHLYANHLEQADLQLTREPLPLPSMKLNPEVKDLFDFRFEDFELVGYEAHPHIKAPVAV

SEQ ID NO: 17862 - DNA, 972 bp, Pseudomonas syringae
  CDS (1)..(972): transl_table=11
atgaagcaatatctggaactggtcgcccacgtgatcaagcacggcaccttgcaagccaaccgtaccggcgtgaacaccatcagctttccgggtgccatgctgcgttacgacttgcaggaaggttttccggcgatcaccacacggcgcatggcgttcaaatcggctattggcgagatggtcggtttcttgcgtggcgtgagcaatgccgccgaattccgcgaactgggctgcaaggtctgggaccagaacgccaacgaaaacgcccagtggctgaacaatccgttccgcaagggcgaagacgatctgggcgagatctacggcgtgcaatggcgcaaatggccagcgtacaagcgcatcgacacgggcaacgtcgccgccatcgaactggcactcggtcagggttatcgccagattgccgaatcggaagaagacggccagtcgttcgtggtgctgtacaaggccatcgaccagattcgccagtgcatcgacaccatcatcaatgacccaggcagccgccgcatcctgttccacggctggaactgcgcccagctcgatgaaatggccctgccgccatgccatctgctgtaccagctgcaccccaacccgcagacccgcgaaatctccctgaccctgtacatccgctccaacgacctgggcctcggcacgccgttcaacctgaccgaaggcgccgcgctgctgagcctcatcggccgcctgaccggctacacgccgcgctggttcacctacttcatcggcgatgcccatgtgtacgagaaccacctggacatgctcaacgagcaaatgacccgcgagccgtacccgatgccaaaactggtgatctccgaccgcgtgccggagtttgccaagaccggcgtttatcagcctgaatggctggagctgatcgagccgtcggacttttcgctggaaggctatcagcatcacccggcgatgactgcgccgatggcggtctga

SEQ ID NO: 17863 - protein, 323 aa, Pseudomonas syringae
MKQYLELVAHVIKHGTLQANRTGVNTISFPGAMLRYDLQEGFPAITTRRMAFKSAIGEMVGFLRGVSNAAEFRELGCKVWDQNANENAQWLNNPFRKGEDDLGEIYGVQWRKWPAYKRIDTGNVAAIELALGQGYRQIAESEEDGQSFVVLYKAIDQIRQCIDTIINDPGSRRILFHGWNCAQLDEMALPPCHLLYQLHPNPQTREISLTLYIRSNDLGLGTPFNLTEGAALLSLIGRLTGYTPRWFTYFIGDAHVYENHLDMLNEQMTREPYPMPKLVISDRVPEFAKTGVYQPEWLELIEPSDFSLEGYQHHPAMTAPMAV

SEQ ID NO: 17864 - DNA, 795 bp, Ralstonia solanacearum
  CDS (1)..(795): transl_table=11
atgcagccctatctcgacctgatgcgccatgtccacgagcatggcaccgacaaagccgaccgcaccggcactggcacgcgctccgtgttcggccatcagatgcgcttcgacctgcagcagggctttccgctggtgaccaccaagaaggtccacatcaagtccatcgtctatgagctgctgtggttcctgcagggcgcgaccaacgtgcgctggctgcgggagaacggcgtcaccatctgggacgaatgggccgatgcggaaggtgaactgggcccgatctacggctaccagtggcgctcgtggccgacgccgtccggcgagcacatcgaccagatcgccgaactgatcgcgcagatcaagcgcaatccggactcgcgccggctgatcgtctcggcctggaacgtggccgacattccgcgcatgaagctgccgccctgccacgcgttcttccagttctatgtggccgacggcaagctgtcgtgccagctctaccagcgcagcgcggacatcttcctcggcgtgccgttcaacatcgccagctacgcgctgctcacgcacatgatcgcgcagcagaccggcctggacgtgggcgacttcgtctggaccggcggcgactgccatctctacaacaaccacttcgaacaggtcgagacgcaactcgcgcgcacgccgctgccgctgccgaagctgcacatcaagcgcaagccggacagcatcttcgattaccggtacgaagacttcgagatcgtcggctacgaaagccatcccgcgatcaaggcgcccgtggccgtatga

SEQ ID NO: 17865 - protein, 264 aa, Ralstonia solanacearum
MQPYLDLMRHVHEHGTDKADRTGTGTRSVFGHQMRFDLQQGFPLVTTKKVHIKSIVYELLWFLQGATNVRWLRENGVTIWDEWADAEGELGPIYGYQWRSWPTPSGEHIDQIAELIAQIKRNPDSRRLIVSAWNVADIPRMKLPPCHAFFQFYVADGKLSCQLYQRSADIFLGVPFNIASYALLTHMIAQQTGLDVGDFVWTGGDCHLYNNHFEQVETQLARTPLPLPKLHIKRKPDSIFDYRYEDFEIVGYESHPAIKAPVAV

SEQ ID NO: 17866 - DNA, 924 bp, Rattus norvegicus
  CDS (1)..(924)
atgctggttgaaggctctgagctgcagtccggtgctcaacagccacgcacggaagccccgcagcatggagaactccagtacctgaggcaggtggagcacattatgcgctgcggcttcaagaaggaggaccgcacgggcactggcaccctgtcggtgttcggcatgcaggcacggtacagcctgagagatgaatttcctctgctcacaaccaaacgagtattctggaagggtgttttggaggagttgttgtggtttattaagggctccacaaatgctaaagaactgtcctccaagggagtgagaatttgggatgccaatgggtcccgagactttttggacagcttgggattctctgcccgacaggaaggagacctgggcccagtttatggattccagtggagacattttggagcagactacaaagatatggattcagattactcgggtcaaggagtagaccagctgcaaaaagtgattgacaccatcaaaaccaaccccgatgacagaagaatcatcatgtgtgcctggaacccaaaagatcttcccctgatggcactgcctccttgccatgccctctgtcaattttatgtggtgaatggggagctgtcttgccagctttaccagcggtcaggagatatgggtctgggtgtgcccttcaacattgccagctatgctctgctgacctacatgattgcacatatcacgggcctgcagccgggtgattttgtccatactttgggagatgcacacatttatctgaatcatattgagccactgaaaattcagctacagcgagaaccaagacctttcccaaagctcagaatcctccgaaaagttgagacaatcgatgatttcaaagttgaagactttcagattgaagggtataatccacatccaacgattaaaatggaaatggctgtttag

SEQ ID NO: 17867 - protein, 307 aa, Rattus norvegicus
MLVEGSELQSGAQQPRTEAPQHGELQYLRQVEHIMRCGFKKEDRTGTGTLSVFGMQARYSLRDEFPLLTTKRVFWKGVLEELLWFIKGSTNAKELSSKGVRIWDANGSRDFLDSLGFSARQEGDLGPVYGFQWRHFGADYKDMDSDYSGQGVDQLQKVIDTIKTNPDDRRIIMCAWNPKDLPLMALPPCHALCQFYVVNGELSCQLYQRSGDMGLGVPFNIASYALLTYMIAHITGLQPGDFVHTLGDAHIYLNHIEPLKIQLQREPRPFPKLRILRKVETIDDFKVEDFQIEGYNPHPTIKMEMAV

SEQ ID NO: 17868 - DNA, 795 bp, Rhizobium loti
  CDS (1)..(795): transl_table=11
atgcgccaatatctcgacctcttgcagcatgtgctggacaacggtgccgaccgtagcgaccgcaccggcaccggcacgcgctccgtctttggctaccagatgcgtttcgacctggcgcgcggttttccggtcactacgaccaagaagctgcacctgaagtcgatcatccatgaactcctgtggttcctggccggcgacaccaacatcaaatacctgactgaccatggcgtcacgatctgggacgaatgggccgacgagaatggcgaccttggtcccgtctacggcaggcagtggcgctcctggccggacggtcatggcggctcgatcgaccagatcgcgggccttctcaaggagatacgccgcaatcctcaatcgcggcggctgatcgtttcggcgtggaacccggccgaggtggaggcgatggcgctgccgccctgccactgcctgttccagttctacgtgtccgagggccggctgtcctgccagctctaccagcggtcggccgatattttcctcggcgtgcccttcaacatcgcgtcctacgcgctgctgacgctgatggtggcgcaggtgaccgggctgaagccgggcgatttcgtccacacgctgggcgacgcgcatctctattcgaaccatttcgaacaggcgcgcgagcagttgcagcgcacgccaagggcattgccgacgatgtggatcaatccggaggtgaaggacctgttcgccttccgcttcgaggatttccggctggaaaactacgtcgccgacgcatcgatccaggcgccgatcgccgtttga

SEQ ID NO: 17869 - protein, 264 aa, Rhizobium loti
MRQYLDLLQHVLDNGADRSDRTGTGTRSVFGYQMRFDLARGFPVTTTKKLHLKSIIHELLWFLAGDTNIKYLTDHGVTIWDEWADENGDLGPVYGRQWRSWPDGHGGSIDQIAGLLKEIRRNPQSRRLIVSAWNPAEVEAMALPPCHCLFQFYVSEGRLSCQLYQRSADIFLGVPFNIASYALLTLMVAQVTGLKPGDFVHTLGDAHLYSNHFEQAREQLQRTPRALPTMWINPEVKDLFAFRFEDFRLENYVADASIQAPIAV

SEQ ID NO: 17870 - DNA, 795 bp, Rhizobium meliloti
  CDS (1)..(795): transl_table=11
atgcgacaatatctcgatctcctcgaacatgtgatcacaacgggtaccgaccggggcgaccgtacgggtacgggcacgcgctcggtgttcggctaccagatgcgcttcgacctgtcgcagggtttcccggtgctgaccaccaagaagctgcatctgcgttcgatcattcacgagcttctgtggttcctcaggggcgacacgaacgtcgcctatctcaaggacaacggggtgagcatctgggacgaatgggcggacgaaaacggcgagctcggaccggtctacggctaccaatggcgctcctggccgacgcccgatggccgacatatcgaccagatcgcggcgctggtcgaaggcctgaagaccaatccgaattcccgccgccacatcgtttcggcctggaacccggcgcttgtggacgaaatggcgctgccgccatgccactgtctgttccagttctacgtggcggacgggaagctctcctgccagctctaccagcgctcggccgatatctttctcggcgtacccttcaatatcgcttcctacgctctgctgacgatgatggtggcgcaggtgactgggctcgaagccggcgatttcgttcatacgcttggtgacgcgcatatctaccgcaaccacttcgagcaggcgcagctgcagctgacgagaacgccgaagccgctgcccaaaatggaaataaatccggcggtgaaggatatattttcgtttagattcgaagactttgagctcgtcggctacgaagccgattcacatatcaaggcgccggtcgcggtctag

SEQ ID NO: 17871 - protein, 264 aa, Rhizobium meliloti
MRQYLDLLEHVITTGTDRGDRTGTGTRSVFGYQMRFDLSQGFPVLTTKKLHLRSIIHELLWFLRGDTNVAYLKDNGVSIWDEWADENGELGPVYGYQWRSWPTPDGRHIDQIAALVEGLKTNPNSRRHIVSAWNPALVDEMALPPCHCLFQFYVADGKLSCQLYQRSADIFLGVPFNIASYALLTMMVAQVTGLEAGDFVHTLGDAHIYRNHFEQAQLQLTRTPKPLPKMEINPAVKDIFSFRFEDFELVGYEADSHIKAPVAV

SEQ ID NO: 17872 - DNA, 795 bp, Rhodopirellula baltica
  CDS (1)..(795): transl_table=11
atgcaaggctatttgcaactattagacgaagtcctgcatgacgggattgatcgagacgaccggacgggcgtcggcactcgcagtctgtttggacgccaaatgcggtttgatttggcggagggttttcctctgttgacgactaagaagctgcatatccggtcgattttgcacgaattgctgtggttccttcgcggggacaccaacatcggttacctaaaagagaacaaggtttcgatttgggacgagtgggccgatgaggccggcgatctgggcccggtctacggtcaccaatggcgaagctgggaaggtgccaacggcgacacggtcgaccaaatcgcttgggtcgaaaacgaaattcgcaccaacccgagatcacgccgtttggtcgtttcggcttggaacgtggccgatgtgccgaagatggctttgccgccgtgtcatttgctgtttcagttttatgtttctggcggacggctgtcttgtcagttgtatcaacgcagcgcggatttgtttttgggagtgccgttcaatatcgccagctacgcgatgttgacgtcgatgatggcccatgtcacgggtctgaagccgggcgaatttgttcacacgcttggcgacgttcatctctatagcaaccacttcgaccaagctcgcgaacaactcagccgaacgcctcggccgttgccgacgtttcatatcaagcgagacgtcgcatcggtcacggatttccagttcgatgatttcgagctgacaaactacgacccccatccccacatcaaggctccggtggcagtttaa

SEQ ID NO: 17873 - protein, 264 aa, Rhodopirellula baltica
MQGYLQLLDEVLHDGIDRDDRTGVGTRSLFGRQMRFDLAEGFPLLTTKKLHIRSILHELLWFLRGDTNIGYLKENKVSIWDEWADEAGDLGPVYGHQWRSWEGANGDTVDQIAWVENEIRTNPRSRRLVVSAWNVADVPKMALPPCHLLFQFYVSGGRLSCQLYQRSADLFLGVPFNIASYAMLTSMMAHVTGLKPGEFVHTLGDVHLYSNHFDQAREQLSRTPRPLPTFHIKRDVASVTDFQFDDFELTNYDPHPHIKAPVAV

SEQ ID NO: 17874 - DNA, 795 bp, Rhodopseudomonas palustris
  CDS (1)..(795): transl_table=11
atgatccaatatcaggacctgctcgaacgcatcttgagcgacggggccgaaaagcacgaccgcactggcaccggcacgctgtcggtattcgggcatcagatgcggttcgacctcgccgccggctttccgatgctgaccaccaagcggctgccgctgaaggcgattgtgcacgagctgctatggttcctgcagggcgataccaacatcaaatacctgcacgatcacggcgtcacgatctgggacgagtgggcggacgccaacggcgatctcggcccagtgtacggcgcacagtggcgctcgtggccgaccgcggatggtggctcgatcgatcagatcgccaatgtggtcgagatgatcaagcgtaatccggattcgcggcggctgatggtgacggcgtggaatccggccgacgtcgagaagatggcgctgccgccgtgccactgcctgttccagttctatgtcgcgaacggcaagctgtcgtgtcagctgtatcagcgctcggccgacgtgtttctcggcgtgccgttcaacatcgcatcgtacgcgctgctgacgctgatggtggcgcaagtcactggtctaaagcccggcgagttcgtccacactcttggcgacgcgcacctgtattccaatcacctggagcaggcgcggctgcaactgacccgtgccccgcgcgcgctgccggtgatgacgatcaatccggcggtgaaggacatcttcggcttccgctacgaggatttcaccctgaccggctacgatccgcaccctcacatcaaggccgaggtggcggtgtga

SEQ ID NO: 17875 - protein, 264 aa, Rhodopseudomonas palustris
MIQYQDLLERILSDGAEKHDRTGTGTLSVFGHQMRFDLAAGFPMLTTKRLPLKAIVHELLWFLQGDTNIKYLHDHGVTIWDEWADANGDLGPVYGAQWRSWPTADGGSIDQIANVVEMIKRNPDSRRLMVTAWNPADVEKMALPPCHCLFQFYVANGKLSCQLYQRSADVFLGVPFNIASYALLTLMVAQVTGLKPGEFVHTLGDAHLYSNHLEQARLQLTRAPRALPVMTINPAVKDIFGFRYEDFTLTGYDPHPHIKAEVAV

SEQ ID NO: 17876 - DNA, 795 bp, Salmonella paratyphi
  CDS (1)..(795): transl_table=11
atgaaacagtatttagaactgatgcaaaaagtgctggatgaaggcacacagaaaaacgaccgtaccggcaccggcacgctttccatttttggccatcagatgcgttttaacctgcaggaaggctttcctctggtgacgacgaaacgctgccatttacgttcaattattcacgaactgctatggtttttgcagggcgataccaacatcgcttacctgcacgaaaataatgtcaccatctgggacgaatgggccgatgagaacggcgatttaggcccggtttatggtaagcagtggcgtgcatggccaacaccggatggccgccatatcgatcagatcgccacggtcttaagccagcttaaaaacgacccggactctcgccgtattatcgtttctgcgtggaacgtcggcgagctggataagatggcgctggcgccgtgtcacgcctttttccagttttatgtcgcagatggaaaactctcctgtcagctttatcagcgctcctgcgatgtgttcctcggtctgccgttcaacattgccagctacgcgttactggtgcatatgatggcgcaacagtgcgacctggacgttggcgattttgtctggaccggcggcgacacgcacctgtacagcaaccatatggagcagacgcacctgcaattaagccgtgaaccgcgcgcgctgccgaaattggtcattaagcgtaaacccgattcgctttttgactaccggttcgatgatttcgaaattgaaggctatgatccgcaccccggtattaaagcgccggtcgctatctaa

SEQ ID NO: 17877 - protein, 264 aa, Salmonella paratyphi
MKQYLELMQKVLDEGTQKNDRTGTGTLSIFGHQMRFNLQEGFPLVTTKRCHLRSIIHELLWFLQGDTNIAYLHENNVTIWDEWADENGDLGPVYGKQWRAWPTPDGRHIDQIATVLSQLKNDPDSRRIIVSAWNVGELDKMALAPCHAFFQFYVADGKLSCQLYQRSCDVFLGLPFNIASYALLVHMMAQQCDLDVGDFVWTGGDTHLYSNHMEQTHLQLSREPRALPKLVIKRKPDSLFDYRFDDFEIEGYDPHPGIKAPVAI

SEQ ID NO: 17878 - DNA, 795 bp, Salmonella typhi
  CDS (1)..(795): transl_table=11
atgaaacagtatttagaactgatacaaaaagtgctggatgaaggcacacagaaaaacgaccgtaccggcaccggcacgctttccatttttggccatcagatgcgttttaacctgctggaaggctttcctctggtgacgacgaaacgctgccatttacgttcaattattcacgaactgctatggtttttgcagggcgataccaacatcgcttacctacacgaaaataatgtcaccatctgggacgaatgggccgatgagaacggcgatttaggcccggtttatggtaagcagtggcgtgcatggccaacaccggatggccgccatatcgatcagatcgccacggtcttgagccagcttaaaaacgacccggactctcgtcgtattatcgtttctgcgtggaacgtcggcgagctggataagatggcgctggcgccgtgtcacgcctttttccagttttatgtcgcagatggaaaactctcctgtcagctttatcagcgctcctgcgatgtgttcctcggtctgccgttcaacattgccagctacgcgttactggtgcatatgatggcgcaacagtgcgacctggacgtcggcgattttgtctggaccggcggcgacacgcacctgtacagcaaccatatggagcagacgcacctgcaattaagccgtgaaccgcgcgcgctgccgaaattggtcattaagcgtaaacccgattcgctttttgactaccggttcgatgatttcgaaattgaaggctatgatccgcaccccggtattaaagcgccggtcgctatctaa

SEQ ID NO: 17879 - protein, 264 aa, Salmonella typhi
MKQYLELIQKVLDEGTQKNDRTGTGTLSIFGHQMRFNLLEGFPLVTTKRCHLRSIIHELLWFLQGDTNIAYLHENNVTIWDEWADENGDLGPVYGKQWRAWPTPDGRHIDQIATVLSQLKNDPDSRRIIVSAWNVGELDKMALAPCHAFFQFYVADGKLSCQLYQRSCDVFLGLPFNIASYALLVHMMAQQCDLDVGDFVWTGGDTHLYSNHMEQTHLQLSREPRALPKLVIKRKPDSLFDYRFDDFEIEGYDPHPGIKAPVAI

SEQ ID NO: 17880 - DNA, 795 bp, Shewanella oneidensis
  CDS (1)..(795): transl_table=11
atgcaacagtatttagacttaatgaaacacatcttagccgaaggtgtggataaatcagaccgaacaggtacgggtactcgctcggtttttggttatcaaatgcgtttcgatttgagtaagggttttcctttagtcaccacgaaaaagtgccatatgcgctccatcattcatgagctgttgtggttcctaaagggcgataccaatattgcttatctgcgtgacaataaagtcagtatttgggatgaatgggccgatgaaaacggcgatttgggccctgtgtatggtgcgcaatggcgcagctggccgacccaaagtggtgaggctatcgatcaaatttcgcaggttattgcgcaaattaaatcgcaacctgactcgcgtcgtttgatcgtatcggcttggaacgttggtgagttggataaaatggctctggctccttgccatgcgtttttccaattctatgttgctgatggcaaattatcctgtcagctgtaccagcgtagttgtgatgtgtttttagggttgccctttaatatcgccagctatgcactattgaccatgatggtggcgcaacaatgcgacttagctttaggtgactttgtttggacggggggggatacccacttgtattccaaccacatggagcaaacagcgttgcagttgagccgcgagcctagacccttaccgacgatgaccattctgcgtaaacctgcctcgatttttgattatcaattcgacgattttgcattgagcaactacgatcctcacccacatatcaaagcgcctgtcgccgtttaa

SEQ ID NO: 17881 - protein, 264 aa, Shewanella oneidensis
MQQYLDLMKHILAEGVDKSDRTGTGTRSVFGYQMRFDLSKGFPLVTTKKCHMRSIIHELLWFLKGDTNIAYLRDNKVSIWDEWADENGDLGPVYGAQWRSWPTQSGEAIDQISQVIAQIKSQPDSRRLIVSAWNVGELDKMALAPCHAFFQFYVADGKLSCQLYQRSCDVFLGLPFNIASYALLTMMVAQQCDLALGDFVWTGGDTHLYSNHMEQTALQLSREPRPLPTMTILRKPASIFDYQFDDFALSNYDPHPHIKAPVAV

SEQ ID NO: 17882 - DNA, 885 bp, Saimiriine herpesvirus 2
  CDS (1)..(885)
atgtcaacacacacagaagaacagcatggagaacaccagtacctctcacaggtacagcacattttaaattatgggtcatttaaaaatgacagaacagggactggaacactgagtatttttggaacacagtctaggtttagtttagaaaatgaatttccacttttaactactaagagagtattttggagaggtgttgttgaagaactgttgtggtttatcagaggatctactgacagcaaagagctatcagcagctggcgtgcacatttgggatgcgaatggatctagatcatttttagataaacttggtttttatgacagagatgaaggagatcttggacctgtgtatggatttcagtggaggcatttcggagcagaatataaaggtgttgggcgcgattataaaggagaaggagttgaccaattaaaacagttgattgatactataaaaacaaaccctacagatagaaggatgttaatgtgtgcttggaatgtttcagacattcctaaaatggtgttgccgccttgtcatgtattaagtcaattttatgtctgtgatggaaagctttcctgtcaactgtatcaaagatcagctgatatggggttaggagtgccatttaacattgctagctattctcttttaacttgcatgattgctcatgtcactaatctagtgcctggagagtttatccatactataggagatgctcacatctatgtagatcacattgatgctcttaaaatgcagttgacgcgaactcctagaccgtttccaacacttagatttgctagaaatgtttcatgcattgatgactttaaagcagatgacattatattagaaaactataacccacaccctataattaaaatgcatatggctgtttaa

SEQ ID NO: 17883 - protein, 294 aa, Saimiriine herpesvirus 2
MSTHTEEQHGEHQYLSQVQHILNYGSFKNDRTGTGTLSIFGTQSRFSLENEFPLLTTKRVFWRGVVEELLWFIRGSTDSKELSAAGVHIWDANGSRSFLDKLGFYDRDEGDLGPVYGFQWRHFGAEYKGVGRDYKGEGVDQLKQLIDTIKTNPTDRRMLMCAWNVSDIPKMVLPPCHVLSQFYVCDGKLSCQLYQRSADMGLGVPFNIASYSLLTCMIAHVTNLVPGEFIHTIGDAHIYVDHIDALKMQLTRTPRPFPTLRFARNVSCIDDFKADDIILENYNPHPIIKMHMAV

SEQ ID NO: 17884 - DNA, 957 bp, Staphylococcus aureus
  CDS (1)..(957): transl_table=11
atgttgaattcatttgatgcagcatatcacagtctttgtgaagaggttttagaaataggaaatacacgaaatgatcgcacaaatacaggtacgatttcgaaatttggtcatcaacttcgctttgacttatctaaaggatttccactattaacgacaaagaaagtttcttttaaattagtagcaaccgaattattatggttcattaaaggagatacaaacatccaatacttattaaaatataataataatatttggaacgaatgggcttttgaaaattatataaaatcagacgagtataacggtccagatatgacagatttcgggcatcgtgcattgagtgatcctgaatttaacgaacaatataaagaacaaatgaaacaatttaagcaacgtattcttgaagatgatacttttgcgaagcaattcggtgatttaggaaatgtttatggtaaacaatggcgagattgggttgataaagatggtaatcattttgatcaacttaaaacagtaattgaacaaattaagcataatccagattcaagacgacacatcgtatctgcatggaatccaacagaaattgatacaatggcacttccgccttgtcataccatgttccagttttatgtccaagatggtaagttaagttgccagttataccaacgtagcgcagatatctttttaggtgtgccatttaatatcgcaagctacgctttattgacacaccttattgccaaagaatgtggacttgaagtaggagaatttgtgcatacatttggagatgcacatatttattcaaatcatattgatgcgattcaaacacaattagcacgtgaaagcttcaatcctccaacattaaaaattaacagtgacaagtctattttcgacataaattatgaagatttggaaattgttgactatgaatcacatccagcaataaaagctccaatagcagtgtag

SEQ ID NO: 17885 - protein, 318 aa, Staphylococcus aureus
MLNSFDAAYHSLCEEVLEIGNTRNDRTNTGTISKFGHQLRFDLSKGFPLLTTKKVSFKLVATELLWFIKGDTNIQYLLKYNNNIWNEWAFENYIKSDEYNGPDMTDFGHRALSDPEFNEQYKEQMKQFKQRILEDDTFAKQFGDLGNVYGKQWRDWVDKDGNHFDQLKTVIEQIKHNPDSRRHIVSAWNPTEIDTMALPPCHTMFQFYVQDGKLSCQLYQRSADIFLGVPFNIASYALLTHLIAKECGLEVGEFVHTFGDAHIYSNHIDAIQTQLARESFNPPTLKINSDKSIFDINYEDLEIVDYESHPAIKAPIAV

SEQ ID NO: 17886 - DNA, 840 bp, Streptococcus agalactiae
  CDS (1)..(840): transl_table=11
atgacaaaagccgatttattatttaaagacaatatcacgaaaattatgtctgaaggtgtatttagcgagcaagccagacctagatataaaaatggggaaatggctaattctaagtatattacaggtgcctttgcagagtatgatttatcaaagggtgaatttcctattacaactctacgtccaattccaataaaatctgctattaaagaaattttctggatttatcaagatcagacaaatgatttagtagttttgaatgataaatatggtgtgacatactggaatgattgggaagttggccatactggcacgataggtcagcgctacggtgcagttgttaaaaaacataatattatatcaaaactcttaaaacagcttgaagataacccttggaatcgtcgtaatgttatttcattatgggactatgaagcatttgaagaaacagaaggcctactaccttgtgcttttcaaacgatgtttgatgtgagacgcgttaatggtgagctttatttggatgccacattaacacaacgttctaatgacatgttagttgcacatcatattaatgctatgcagtatgtagcacttcagatgatgattgcaaagcattttggttggagagttgggaagtttttctattttatcaataatcttcatatttatgataaccagtttgaacaagctcaggaactcttaaaacgccaaccgtctgagtgtaaccccaaactagtattgaatgttccagatggaacagacttttttgatattaaaccagatgattttgcgttagttgattatgacccaattaaacctcaattacgttttgatttagcaatctaa

SEQ ID NO: 17887 - protein, 279 aa, Streptococcus agalactiae
MTKADLLFKDNITKIMSEGVFSEQARPRYKNGEMANSKYITGAFAEYDLSKGEFPITTLRPIPIKSAIKEIFWIYQDQTNDLVVLNDKYGVTYWNDWEVGHTGTIGQRYGAVVKKHNIISKLLKQLEDNPWNRRNVISLWDYEAFEETEGLLPCAFQTMFDVRRVNGELYLDATLTQRSNDMLVAHHINAMQYVALQMMIAKHFGWRVGKFFYFINNLHIYDNQFEQAQELLKRQPSECNPKLVLNVPDGTDFFDIKPDDFALVDYDPIKPQLRFDLAI

SEQ ID NO: 17888 - DNA, 840 bp, Streptococcus agalactiae
  CDS (1)..(840): transl_table=11
atgacaaaagccgatttattatttaaagacaatatcacgaaaattatgtctgaaggtgtatttagcgagcaagccagacctagatataaaaatggggaaatggctaattctaagtatattacaggtgcctttgcagagtatgatttatcaaagggtgaatttcctattacaactctacgtccaattccaataaaatctgctattaaagaaattttctggatttatcaagatcagacaaatgatttagcagttttgaatgataaatatggtgtgacatactggaatgattgggaagttggccatactggcacgataggtcagcgctacggtgcagttgttaaaaaacataatattatatcaaaactcttaaaacagcttgaagataacccttggaatcgtcgtaatgttatttcattatgggactatgaagcatttgaagaaacagaaggcctactaccttgtgcttttcaaacgatgtttgatgtgagacgcgttaatggtgagctttatttggatgccacattaacacaacgttctaatgacatgttagttgcacatcatattaatgctatgcagtatgtagcacttcagatgatgattgcaaagcattttggttggagagttgggaagtttttctattttatcaataatcttcatatttatgataaccagtttgaacaagctcaggaactcttaaaacgccaaccgtctgagtgtaaccccaaactagtattgaatgttccagatggaacagacttttttgatattaaaccagatgattttgcgttagttgattatgacccaattaaacctcaattacgttttgatttagcaatctaa

SEQ ID NO: 17889 - protein, 279 aa, Streptococcus agalactiae
MTKADLLFKDNITKIMSEGVFSEQARPRYKNGEMANSKYITGAFAEYDLSKGEFPITTLRPIPIKSAIKEIFWIYQDQTNDLAVLNDKYGVTYWNDWEVGHTGTIGQRYGAVVKKHNIISKLLKQLEDNPWNRRNVISLWDYEAFEETEGLLPCAFQTMFDVRRVNGELYLDATLTQRSNDMLVAHHINAMQYVALQMMIAKHFGWRVGKFFYFINNLHIYDNQFEQAQELLKRQPSECNPKLVLNVPDGTDFFDIKPDDFALVDYDPIKPQLRFDLAI

SEQ ID NO: 17890 - DNA, 840 bp, Streptococcus mutans
  CDS (1)..(840): transl_table=11
atgtctaaggcagattttattttcaaaaaaaatataaaaaaaatcttaactgatggtgtctggagcgaacaggctcgtcctaaatataaaaatggcaagacagccaattctaaatatattacaggcgcttttgcagaatatgaccttgcaaaaggagaatttcctatcacaacccttcgtccgattgctatcaagtcagctatcaaggaagtattctggatctatcaggatcagaccaacgaattagccatcttaaatgataagtacggtgttaggtattggaatgattgggaagtcaagcaaacaggaaccatcggagaacgttatggtgccattgttaagaaacatgatattatgaataaaattctcaaacaattggaagaaaatccttggaatcgacgcaatgtcatctctctttgggattatgaagcctttgaaaaaacagaaggtctcctaccttgtgcctttcaaatcatgttcgatgttcgtcgtgtgaaaggcgaaatttatttagatgctaccttaacacagcgctccaacgatatgctggttgctcaccatatcaacgccatgcaatatgtcgctttgcagatgatgatcgccaaacactttggttggaaggttggtaaattcttctattttgtcaataatctccatatttatgataatcaatttgaacaagcagaggaattattgcggagagagccagtggtttgtcaaccgcatttggtattgaatgtcccaaataaaactaatttctttgatattaaacctgaagattttgaattattggattatgaaccggttaaaccacaattaaaatttgatttagctatttaa

SEQ ID NO: 17891 - protein, 279 aa, Streptococcus mutans
MSKADFIFKKNIKKILTDGVWSEQARPKYKNGKTANSKYITGAFAEYDLAKGEFPITTLRPIAIKSAIKEVFWIYQDQTNELAILNDKYGVRYWNDWEVKQTGTIGERYGAIVKKHDIMNKILKQLEENPWNRRNVISLWDYEAFEKTEGLLPCAFQIMFDVRRVKGEIYLDATLTQRSNDMLVAHHINAMQYVALQMMIAKHFGWKVGKFFYFVNNLHIYDNQFEQAEELLRREPVVCQPHLVLNVPNKTNFFDIKPEDFELLDYEPVKPQLKFDLAI

SEQ ID NO: 17892 - DNA, 840 bp, Streptococcus pyogenes
  CDS (1)..(840): transl_table=11
atgacaaaagctgaccagatttttaaagctaatattcaaaaaattataaacgaaggatcattgagtgagcaagcacgtcctaaatataaagatggtcgaacagctcattctaagtatattactggggcgtttgctgaatatgatttagctaaaggagagtttcccatcacaactttacgacccattccaattaaatctgctataaaggaattattttggatatatcaagatcagtctaacagtttagatgtgctagaagctaaatataatgttcattattggaatgaatgggaagttgaccagacacgtactattgggcaacgttatggtgctgtagtcaaaaaacatgatatcatctcaaaaatactaaagcaattagcagaaaatccttggaatcgtcgtaatgtcatttctctctgggactatgaagcatttgaggagacaaaagggttgttgccatgtgcctttcaaatcatgtttgatgttagacgtgtaggggaagatctttatttagatgctagtttgacgcaacgttctaatgacatattagttgctcatcacatcaatgccatgcaatacgttgccttgcagatgatgattgctaaacattttggatggaaaataggtaagttcttttattttgttaacaatttacatatttatgacaaccaatttgatcaggctcaagaattgctaaaacgacagccagttgctagtcagcctaagcttgttttaaatgttccagataggactaatttctttgatattaaaccagatgattttgaattacaaaattatgatccagtgaagcctcagttgcactttgaccttgctatttaa

SEQ ID NO: 17893 - protein, 279 aa, Streptococcus pyogenes
MTKADQIFKANIQKIINEGSLSEQARPKYKDGRTAHSKYITGAFAEYDLAKGEFPITTLRPIPIKSAIKELFWIYQDQSNSLDVLEAKYNVHYWNEWEVDQTRTIGQRYGAVVKKHDIISKILKQLAENPWNRRNVISLWDYEAFEETKGLLPCAFQIMFDVRRVGEDLYLDASLTQRSNDILVAHHINAMQYVALQMMIAKHFGWKIGKFFYFVNNLHIYDNQFDQAQELLKRQPVASQPKLVLNVPDRTNFFDIKPDDFELQNYDPVKPQLHFDLAI

SEQ ID NO: 17894 - DNA, 840 bp, Streptococcus pyogenes
  CDS (1)..(840)
atgacaaaagctgaccagatttttaaagctaatattcaaaaaattataaatgaaggatcattgagtgagcaagcacgtcctaaatataaagatggtcgaacagctcattctaagtatattactggggcgtttgctgaatatgatttagctaaaggagagtttcccatcacaactttacgacctattccaattaaatctgctataaaggaattattttggatatatcaagatcagtctaacagtttagatgtgctagaagctaaatataatgttcattattggaatgaatgggaagttgaccagacacgtactattgggcaacgttatggtgctgtagtcaaaaaacatgatatcatttcaaaaatactaaagcaattagcagaaaatccttggaatcgtcgtaatgtcatttctctctgggactatgaagcatttgaggagacaaaagggttgttgccatgtgcctttcaaatcatgtttgatgttagacgtgtaggggaagatctttatttagatgctagtttgacgcaacgttctaatgacatattagttgctcatcacatcaatgccatgcaatacgttgccttgcagatgatgattgctaaacattttggatggaaaataggtaagttcttttattttgttaacaatttacatatttatgacaaccaatttgatcaggctcaagaattactaaaacgacagccagttgctagtcagcctaagcttgttttaaatgttccagatgggactaatttctttgatattaaaccagatgattttgaattacaaaattatgatccagtgaagcctcagttgcactttgaccttgctatttaa

SEQ ID NO: 17895 - protein, 279 aa, Streptococcus pyogenes
MTKADQIFKANIQKIINEGSLSEQARPKYKDGRTAHSKYITGAFAEYDLAKGEFPITTLRPIPIKSAIKELFWIYQDQSNSLDVLEAKYNVHYWNEWEVDQTRTIGQRYGAVVKKHDIISKILKQLAENPWNRRNVISLWDYEAFEETKGLLPCAFQIMFDVRRVGEDLYLDASLTQRSNDILVAHHINAMQYVALQMMIAKHFGWKIGKFFYFVNNLHIYDNQFDQAQELLKRQPVASQPKLVLNVPDGTNFFDIKPDDFELQNYDPVKPQLHFDLAI

SEQ ID NO: 17896 - DNA, 840 bp, Streptococcus pneumoniae
  CDS (1)..(840): transl_table=11
atgacaaaagcagatacgatttttaaagagaatattgaacgcattctaaaggaaggtgttttctcagagcaggctcgtcctaagtacaaggatgggactgttgctaattccaagtatgtaactggtgccttttccgagtacgacttatctaaaggagaatttcctatcacaaccttgcgtcccattgcaatcaaatccgccatcaaagaagttctctggatttaccaagaccagtcaaatagcttagaagtgcttaatgacaagtacaatgttcactactggaatgactgggaagttggagacacgggaaccattggtgagcgctatggtgccgttgttaagaaacacgacattatcaataagcttctcaaacagttggaaaccaatccttggaaccgccgcaatattatttcgctctgggattaccaagctttcgaagaaacagatgggctgctcccgtgcgcctttcagaccatgtttgatgttcggcgtgttgatggggaaatctatctggatgcgaccttgacccagcgctccaatgatatgctggtggcccaccacatcaacgctatgcagtatgtggctttgcagatgatgattgccaaacattttggctggaaggttgggaagttcttctacttcatcaacaacctccatatctatgataatcaatttgaacaagctcaggaattgctccgtcgggagccgtcaaactgccaaccacgcttggttttaaatgttcctgatgggactaatttctttgatatcaaagcagaagattttgagttggtggattatgaccctgttaagccacagttgaagtttgacctagctatttaa

SEQ ID NO: 17897 - protein, 279 aa, Streptococcus pneumoniae
MTKADTIFKENIERILKEGVFSEQARPKYKDGTVANSKYVTGAFSEYDLSKGEFPITTLRPIAIKSAIKEVLWIYQDQSNSLEVLNDKYNVHYWNDWEVGDTGTIGERYGAVVKKHDIINKLLKQLETNPWNRRNIISLWDYQAFEETDGLLPCAFQTMFDVRRVDGEIYLDATLTQRSNDMLVAHHINAMQYVALQMMIAKHFGWKVGKFFYFINNLHIYDNQFEQAQELLRREPSNCQPRLVLNVPDGTNFFDIKAEDFELVDYDPVKPQLKFDLAI

SEQ ID NO: 17898 - DNA, 861 bp, Streptococcus thermophilus
  CDS (1)..(861): transl_table=11
atgacgaaagcagacactatttttaaagaaaatatcactaaaatcatggaagagggagtttggtcagagcaagcacgtcctaaatacaaggatggcacaacagccaattccaaatacatcacagggtcttttgcagaatatgatttgagcaagggagagtttccaattacgactctgcgtcccattgctatcaaatctgccatcaaagaagtgttctggatctatcaagaccagacaaatagcctagatgtgcttgaagataagtataatgttcattattggaatgactgggaagttgaaggcgtccctgctaataatggggacaagcgttcaatcggtcagcgttatggggcagtcgttaagaagcacgatattattaatcgtttgttagcacagttagaagccaatccttggaatcgccgtaatgtcatttccctttgggattacgaggccttcgaggagacagctggacttcagccttgcgccttccagaccatgtttgatgttcgtcgtgtgggtgaggacgtttatttggatgccactttgacgcagcgctcaaacgatatgttggtggcccatcacattaatgctatgcagtatgtggcacttcagatgatgattgccaagcattttggttggaaaattggtaaattcttttatttcatcaacaacctccatatctatgacaatcaatttgaacaagctgaggaactcctcaagcgtcagccgtctgattgtcaaccacgcttggtcctcaatgttcctgatgaaactaatttctttgatatcaaaccagaagattttgaattggtggactatgatcctgttaaacctcaactcaaatttgacttagcaatttaa

SEQ ID NO: 17899 - protein, 286 aa, Streptococcus thermophilus
MTKADTIFKENITKIMEEGVWSEQARPKYKDGTTANSKYITGSFAEYDLSKGEFPITTLRPIAIKSAIKEVFWIYQDQTNSLDVLEDKYNVHYWNDWEVEGVPANNGDKRSIGQRYGAVVKKHDIINRLLAQLEANPWNRRNVISLWDYEAFEETAGLQPCAFQTMFDVRRVGEDVYLDATLTQRSNDMLVAHHINAMQYVALQMMIAKHFGWKIGKFFYFINNLHIYDNQFEQAEELLKRQPSDCQPRLVLNVPDETNFFDIKPEDFELVDYDPVKPQLKFDLAI

SEQ ID NO: 17900 - DNA, 861 bp, Streptococcus thermophilus
  CDS (1)..(861): transl_table=11
atgacgaaagcagacactatttttaaagaaaatatcactaaaatcatggaagagggagtttggtcagagcaagcacgtcctaaatacaaggatggcacaacagccaattccaaatacatcacagggtcttttgcagaatatgatttgagcaagggagagtttccaattacgactctgcgtcccattgctatcaaatctgccatcaaagaagtgttctggatctatcaagaccagacaaatagcctagatgtgcttgaagataagtataatgttcattattggaatgactgggaagttgaaggcgtccctgctaataatggggacaagcgttcaatcggtcagcgttatggggcagtcgttaagaagcacgatattattaatcgtttgttagcacagttagaagccaatccttggaatcgccgtaatgtcatttccctttgggattacgaggccttcgaggagacagctggacttcagccttgcgccttccagaccatgtttgatgttcgtcgtgtgggtgaggacgtttatttggatggcactttgacgcagcgctcaaacgatatgttggtggcccatcacattaatgctatgcagtatgtggcacttcagatgatgattgccaagcattttggttggaaagttggtaaattcttttatttcatcaacaacctccatatctatgacaatcaatttgaacaagctgaggaactcctcaagcgtcagccgtctgattgtcaaccacgcttggtcctcaatgttcctgatgaaactaatttctttgatatcaaaccagaagattttgaattggtggactatgatcctgttaaacctcaactcaaatttgacttagcaatttaa

SEQ ID NO: 17901 - protein, 286 aa, Streptococcus thermophilus
MTKADTIFKENITKIMEEGVWSEQARPKYKDGTTANSKYITGSFAEYDLSKGEFPITTLRPIAIKSAIKEVFWIYQDQTNSLDVLEDKYNVHYWNDWEVEGVPANNGDKRSIGQRYGAVVKKHDIINRLLAQLEANPWNRRNVISLWDYEAFEETAGLQPCAFQTMFDVRRVGEDVYLDGTLTQRSNDMLVAHHINAMQYVALQMMIAKHFGWKVGKFFYFINNLHIYDNQFEQAEELLKRQPSDCQPRLVLNVPDETNFFDIKPEDFELVDYDPVKPQLKFDLAI

SEQ ID NO: 17902 - DNA, 852 bp, Symbiobacterium thermophilum
  CDS (1)..(852): transl_table=11
ttgaacatcgagatccagtacctggaactctgccgggagatcctggcggagaacgagcaggagatcgccgagggccgctggacgcccaaccggaccggcatggggacggtgggcgtcttcggccgcatgctgaagcacgacttcaaggaagggtttcccgccctgaccaccaagaagctgttcttcaactccgtgaaggccgagttgctctggttcctcgcgggccggaccgacctggagttcctgcacgagcggggatgccacatctgggacaaggacgcggcccgcaacggcgggaagctcgggccgatctacggcaagcagtggcgggcgtgggagggcgcggacggcaggacctacgaccagatcgcctgggtcatccagcagatccgggagatcgccgccgacccggagcggccccatcccaactccaggcggctggtcgtcagcccctggaacgtcgccgacctggaggagatggccctgccgccctgccacgggccgttccagttccacgtgaaggacggcaggctgcacctggccgtgtggcagcgcagcgccgacctgttcctgggagtgcccttcaacatcgccagctactcgctgctgctgcacatggtggcgcaggtgaccgggctggcggtgggcacgtacacgcattacctgaacgacgtgcacatctaccgcaacctcctggaccaggtacggctgcagctcacgcgggagccgtacccgctgcccaggctctggctgaaccccgaggtcagggagatcgaccagttcacgatggacgacatccagctggtggactacaagcaccacccgccgatccgcggggagctgtcgacatga

SEQ ID NO: 17903 - protein, 283 aa, Symbiobacterium thermophilum
MNIEIQYLELCREILAENEQEIAEGRWTPNRTGMGTVGVFGRMLKHDFKEGFPALTTKKLFFNSVKAELLWFLAGRTDLEFLHERGCHIWDKDAARNGGKLGPIYGKQWRAWEGADGRTYDQIAWVIQQIREIAADPERPHPNSRRLVVSPWNVADLEEMALPPCHGPFQFHVKDGRLHLAVWQRSADLFLGVPFNIASYSLLLHMVAQVTGLAVGTYTHYLNDVHIYRNLLDQVRLQLTREPYPLPRLWLNPEVREIDQFTMDDIQLVDYKHHPPIRGELST

SEQ ID NO: 17904 - DNA, 852 bp, Vibrio cholerae
  CDS (1)..(852): transl_table=11
gtgagacagtatttagatctttgtcagcgcatcgtcgatcaaggtgtttgggttgaaaatgaacgaacgggcaagcgttgtttgactgtgattaatgccgatttgacctacgatgtgggcaacaatcagtttcctctagtcactacacgcaagagtttttggaaagccgccgtggccgagttgctcggctatattcgtggttacgataatgcggcggattttcgccaattaggtaccaaaacctgggatgctaatgccaatttaaaccaagcatggctcaacaatccttaccgtaaaggtgaggatgacatgggacgcgtgtatggagttcagggtagagcttgggctaagcctgatggtggtcatattgaccagttgaaaaagattgttgatgatttgagccgtggcgttgatgaccgaggtgaaattcttaacttctacaatccgggtgaatttcacatggggtgtttgcgcccttgcatgtacagccatcatttttcattgctgggtgataccttgtatctcaacagtactcagcgttcatgtgatgtgcccttggggttgaatttcaacatggtgcaggtttatgtgttccttgcgctgatggcacagatcacagggaaaaagccgggcttggcgtatcacaagatcgtcaatgcgcacatttaccaagatcaactcgaattgatgcgcgatgtgcagctaaaacgtgagccattcccagcgcctcagttccatatcaatccaaagattaaaacactgcaggatttggaaacttgggtcactttggatgattttgacgtcaccggatatcagttccacgatcctattcaatacccgttttcagtctaa

SEQ ID NO: 17905 - protein, 283 aa, Vibrio cholerae
MRQYLDLCQRIVDQGVWVENERTGKRCLTVINADLTYDVGNNQFPLVTTRKSFWKAAVAELLGYIRGYDNAADFRQLGTKTWDANANLNQAWLNNPYRKGEDDMGRVYGVQGRAWAKPDGGHIDQLKKIVDDLSRGVDDRGEILNFYNPGEFHMGCLRPCMYSHHFSLLGDTLYLNSTQRSCDVPLGLNFNMVQVYVFLALMAQITGKKPGLAYHKIVNAHIYQDQLELMRDVQLKREPFPAPQFHINPKIKTLQDLETWVTLDDFDVTGYQFHDPIQYPFSV

SEQ ID NO: 17906 - DNA, 852 bp, Vibrio fischeri
  CDS (1)..(852)
atgaagcagtatttagatttatgccaacgcattgtagatgaaggaacttggatcgaaaacgagcgcacaggaaagcgttgtttaacggtgattaatgcggatttaacttatgatgtagaaaatggtgttttccctcttgtgacaacgcgtaaaagcttttggaaagcggcagtagctgaaatgattggttatattcgtggttacgatagcgcagaagacttccgtaaaattggaacaaaaacatgggatgcgaatgctaaccttaacgatgcatggctaaacaaccctcatcgtaaaggtgatgatgacatgggccgagtatatggtgtgcaaggtcgttcatgggcaaaaccaaatggtgagtttgtcgatcaactgaaaaaaatcattgatgatttaagtcagggaattgatgatcgtggtgagattttaaatttttataacccaggtgagtttgatatgggatgtttgcgtccgtgtatgtactcacaccatttttcattacttggtgatacgttatatttaaacagtacgcaacgttcatgtgatgttccgctagggcttaatttcaatatggttcaagtgtatttcttattagcgatagtggcacaaattacagggcataaagcaggtaaggcgtaccataagattgtaaatgcacatatttatgaagaccaacttgaactaatgcaaagtgtgcagctaaagcgtgaaccgttacaagccccaatctttaaaataaaccctgaaattaagtcactagaagatttagaaacatgggtaactatggatgactttgaagtgattggctatgaaagccacgaagcaattaagtatcctttttctgtttaa

SEQ ID NO: 17907 - protein, 283 aa, Vibrio fischeri
MKQYLDLCQRIVDEGTWIENERTGKRCLTVINADLTYDVENGVFPLVTTRKSFWKAAVAEMIGYIRGYDSAEDFRKIGTKTWDANANLNDAWLNNPHRKGDDDMGRVYGVQGRSWAKPNGEFVDQLKKIIDDLSQGIDDRGEILNFYNPGEFDMGCLRPCMYSHHFSLLGDTLYLNSTQRSCDVPLGLNFNMVQVYFLLAIVAQITGHKAGKAYHKIVNAHIYEDQLELMQSVQLKREPLQAPIFKINPEIKSLEDLETWVTMDDFEVIGYESHEAIKYPFSV

SEQ ID NO: 17908 - DNA, 852 bp, Vibrio parahaemolyticus
  CDS (1)..(852): transl_table=11
gtgaaacagtatttagatttgtgtcaacgcatcgttgatcaaggtgtttgggttgaaaatgaacgtacaggtaagcgttgcctgacggtaatcaacgcggatttaacctacgatgttgcgaacaatcaattcccattggtaacgacgcgtaaaagtttttggaaagcagcagtggctgagctacttggctacattcgtggttatgataatgctgaagatttccgtaaattaggcaccaaaacgtgggatgcgaacgccaacctaaacgacgcttggttgaataacccataccgtaagggtgaagacgacatgggccgtgtgtacggcgttcaaggtcgtgcatgggcaaagcctgatggtggtcatatcgaccagctacgcaagattgtggatgatttgactcgcggtgttgatgaccgtggtgaaatcttgaacttctacaaccctggtgagttccatatggggtgcttgcgaccttgtatgtacagtcatcatttctcactactggatgacactttgtatctcaacagtacacagcgttcgtgcgatgtgccgcttggattgaacttcaacatggttcaagtttatgtgttcttagcgatcatggcgcaaattacgggcaagaagccaggccaggcattccataaaatcgttaacgcgcacatttatgaagatcagcttgagttgatgcgtgatgttcagttgaagcgtgaaccgttacaagccccaacattccatatcaatccggagattaaatctctagaagatttggaaacttgggtgacactggatgacttttgggtagaagggtacgaacaccacgatccaattcgttatccattctcagtgtaa

SEQ ID NO: 17909 - protein, 283 aa, Vibrio parahaemolyticus
MKQYLDLCQRIVDQGVWVENERTGKRCLTVINADLTYDVANNQFPLVTTRKSFWKAAVAELLGYIRGYDNAEDFRKLGTKTWDANANLNDAWLNNPYRKGEDDMGRVYGVQGRAWAKPDGGHIDQLRKIVDDLTRGVDDRGEILNFYNPGEFHMGCLRPCMYSHHFSLLDDTLYLNSTQRSCDVPLGLNFNMVQVYVFLAIMAQITGKKPGQAFHKIVNAHIYEDQLELMRDVQLKREPLQAPTFHINPEIKSLEDLETWVTLDDFWVEGYEHHDPIRYPFSV

SEQ ID NO: 17910 - DNA, 852 bp, Vibrio vulnificus
  CDS (1)..(852): transl_table=11
gtgaaacaatatttagaattgtgccgtcgcatcgttgatgaagggcactgggttgaaaatgaacgtaccggtaagcgctgccttactgtgatcaacgcggatttaacctacgatgttgccaacaatcagtttcctttggttaccacgcgtaagagtttctggaaggcggcggttgcagagttgcttggctacattcgaggttatgacaatgcggaagattttcgcaagttaggtacgaaaacctgggatgcgaacgccaatctcaatgatgcttggttgaataacccatatcgcaaaggcgaagatgacatgggccgtgtctacggcgtacaaggtcgagcttgggcgaagcctgatggtggtcatatcgaccaattgcgtaaaattgtcgatgacctgacgcgcggagtagacgatcgcggggagatcctcaatttctacaacccaggtgaatttcatatgggttgtttgcgcccttgtatgtacagtcatcacttctcattgctgggtgatacgttatacctcaatagcacacaacgttcgtgtgacgtgccactggggctgaatttcaacatggtccaggtgtatgtgttcttggcgatcatggcacagattacgggcaagaaaccgggccaagcattccataagattgttaatgcacatatctatgaagatcagttagcactgatgcgtgatgtgcaactcaagcgagaaccgttacaagcgccaacgttccacatcaaccctgagatcaaatctttggaagatctggaaacttgggtcactttggatgatttctgggtagaagggtatgaacatcatgacccaatccagtacccattctcggtataa

SEQ ID NO: 17911 - protein, 283 aa, Vibrio vulnificus
MKQYLELCRRIVDEGHWVENERTGKRCLTVINADLTYDVANNQFPLVTTRKSFWKAAVAELLGYIRGYDNAEDFRKLGTKTWDANANLNDAWLNNPYRKGEDDMGRVYGVQGRAWAKPDGGHIDQLRKIVDDLTRGVDDRGEILNFYNPGEFHMGCLRPCMYSHHFSLLGDTLYLNSTQRSCDVPLGLNFNMVQVYVFLAIMAQITGKKPGQAFHKIVNAHIYEDQLALMRDVQLKREPLQAPTFHINPEIKSLEDLETWVTLDDFWVEGYEHHDPIQYPFSV

SEQ ID NO: 17912 - DNA, 852 bp, Vibrio vulnificus
  CDS (1)..(852): transl_table=11
gtgaaacaatatttagaattgtgccgtcgcatcgttgatgaagggcactgggttgaaaatgaacgtaccggtaagcgctgccttactgtgatcaacgcggatttaacctacgatgttgccaacaatcagtttcctttggttaccacgcgtaagagtttctggaaggcggcggttgcagagttgcttggctacattcgaggctatgacaatgcggaagattttcgcaagttaggtacgaaaacctgggatgcgaacgccaatctcaatgatgcttggttgaataacccatatcgcaaaggcgatgatgacatgggccgtgtctacggcgtacaaggtcgagcttgggcgaagcctgatggtggtcatatcgaccaattgcgtaaaattgtcgatgacctgacgcgcggagtagacgatcgcggggagatcctcaatttctacaacccaggtgaatttcatatgggctgtttacgcccttgtatgtacagtcatcacttctcattgctgggtgatacgttatacctcaatagcacacaacgttcgtgtgacgtaccgctggggctgaatttcaacatggtccaggtgtatgtgttcttggcgatcatggcacagattacgggcaagaaaccgggccaagcattccataagattgttaatgcacatatctatgaagatcagttagcactgatgcgtgatgtgcaactcaagcgagaaccgttacaagcgccaacgttccacatcaaccctgagatcaaatctttggaagatctggaaacttgggtcactttggatgatttctgggtagaagggtatgaacatcatgacccaatccagtacccattctcggtataa

SEQ ID NO: 17913 - protein, 283 aa, Vibrio vulnificus
MKQYLELCRRIVDEGHWVENERTGKRCLTVINADLTYDVANNQFPLVTTRKSFWKAAVAELLGYIRGYDNAEDFRKLGTKTWDANANLNDAWLNNPYRKGDDDMGRVYGVQGRAWAKPDGGHIDQLRKIVDDLTRGVDDRGEILNFYNPGEFHMGCLRPCMYSHHFSLLGDTLYLNSTQRSCDVPLGLNFNMVQVYVFLAIMAQITGKKPGQAFHKIVNAHIYEDQLALMRDVQLKREPLQAPTFHINPEIKSLEDLETWVTLDDFWVEGYEHHDPIQYPFSV

SEQ ID NO: 17914 - DNA, 906 bp, Varicella
  CDS (1)..(906)
atgggagacttgtcatgttggacaaaggtgccgggttttacgttaaccggcgaacttcagtacttaaaacaagtggatgatattttaaggtatggagttcggaaacgcgatcgaacaggaatcggaacgttatctttatttggaatgcaagctcgatacaatttgcgaaatgaatttcctcttttaactacaaagcgtgttttttggagggccgtcgtggaagagttgttatggtttatccgcgggtcaaccgattccaaagaactcgccgctaaagatatacacatatgggatatatacggatcgagcaaatttctaaataggaatggcttccataaaagacacacgggggaccttggccccatttacggcttccagtggagacattttggagcggaatataaagactgtcaatcaaactatttacagcaaggaatcgatcagctgcaaactgttatagatacaattaaaacaaacccagaaagccgacgaatgattatatcgtcttggaatccaaaggatatccccttaatggtactacctccatgtcacacgttatgtcagttttacgttgcaaacggtgaattatcctgccaagtataccagagatcgggggatatgggccttggggtaccgttcaacattgctggatatgcacttcttacctacatagtagcgcatgttacaggacttaaaaccggagatttaattcatacaatgggggatgcacatatttacttgaatcatatagatgctttaaaagtgcagctagctcgatccccaaaaccttttccttgccttaaaattattcgaaatgtaacagatataaacgactttaaatgggacgattttcagcttgatggatataatccacacccccccctaaaaatggaaatggctctttaa

SEQ ID NO: 17915 - protein, 301 aa, Varicella
MGDLSCWTKVPGFTLTGELQYLKQVDDILRYGVRKRDRTGIGTLSLFGMQARYNLRNEFPLLTTKRVFWRAVVEELLWFIRGSTDSKELAAKDIHIWDIYGSSKFLNRNGFHKRHTGDLGPIYGFQWRHFGAEYKDCQSNYLQQGIDQLQTVIDTIKTNPESRRMIISSWNPKDIPLMVLPPCHTLCQFYVANGELSCQVYQRSGDMGLGVPFNIAGYALLTYIVAHVTGLKTGDLIHTMGDAHIYLNHIDALKVQLARSPKPFPCLKIIRNVTDINDFKWDDFQLDGYNPHPPLKMEMAL

SEQ ID NO: 17916 - DNA, 795 bp, Wigglesworthia glossinidia brevipalpis
  CDS (1)..(795): transl_table=11
atgaaagaatatttagatttgttaaatttgattttaaaaaatggatatccaaaaatagatagaacaaaaactggaactttatctatgtttggatatcaaataagaattaatttaaatgaaggatttccgttattaacaacaaaatattgtcattttaaatcaatagtatatgaattgctttggtttttaagaggggacacaaatatatcatttttaaaaaaaaataatatttctatttggaataaatgggcagataaaaatggaaacctaggtccaatatatggaaaacaatggcgtgcttgggaagataaaaaaaataacactattgatcaaattgaaatagctttaaataaattaaaaaaagaaccttcttctagaagaatactagtttcttcatggaatgttggagagttagatttgatgtccatacctccatgtcacgttttatttcaactatatgtaataaataataaattgtcttgtcaagtatatcaaagatcttgcgatatttttttaggattaccttttaacataggaagttatgctttgttgactcatatttttgctaatcaatgcgatttgctagttgaagatttaatatggacaggaggagacattcatttatacaaaaatcatttaaatcaagcaaaattacaattaacaagatcccctttaccattaccaaaaatttttattaaaaaaaaacctaaaaatttatttaattatgcatttaatgattttttacttattgattataatcatcatccaaaaataaaagctccaatatcaatttaa

SEQ ID NO: 17917 - protein, 264 aa, Wigglesworthia glossinidia brevipalpis
MKEYLDLLNLILKNGYPKIDRTKTGTLSMFGYQIRINLNEGFPLLTTKYCHFKSIVYELLWFLRGDTNISFLKKNNISIWNKWADKNGNLGPIYGKQWRAWEDKKNNTIDQIEIALNKLKKEPSSRRILVSSWNVGELDLMSIPPCHVLFQLYVINNKLSCQVYQRSCDIFLGLPFNIGSYALLTHIFANQCDLLVEDLIWTGGDIHLYKNHLNQAKLQLTRSPLPLPKIFIKKKPKNLFNYAFNDFLLIDYNHHPKIKAPISI

SEQ ID NO: 17918 - DNA, 795 bp, Xanthomonas axonopodis
  CDS (1)..(795): transl_table=11
gtgaagccgtacctggagttgttgcagcacgtgctggaccacggcgcagagaagtccgaccgcaccggtaccggcacgcgcagcgtgttcggctggcagatgcgcttcgatctcaacgacggctttccgttggtgaccaccaagaagctgcacctgcgctcgatcatccatgagttgctgtggttcctgaagggcgacaccaatatcggctacctcagcgaccaccaggtgcgcatctgggacgaatgggccgacgacaacggcgatctcggtccggtgtacggcaagcagtggcggcgctggaccggcccggacggtgtcgagatcgaccagatgcagtggctggtggatgagatcaagcgcaatccggattcgcgtcgtctggtgatcagcgcctggaatgtcggcgagctgccgcagatggcgctgatgccttgccacagcctgttccagttctacgtggtgaacggcaagctcagttgccagctctatcagcgcagcggcgatatctttctgggcgtgccgttcaatatcgccagctatgcgctgctgacgcacatggtggcccaggccaccggcctgggcgttggcgatttcgtgcacacgctgggcgatgcgcacctgtattccaatcacttcgagcaggcacgcgagcagctgacgcgcacaccgcgtgcgctgcccagcttgcgtctgaatcccgaggtcaccgacctgttcgcgttccgcttcgaagacatcgccatcgaaggctacgacccgcatccggcaatcaaggccccggtggcggtgtga

SEQ ID NO: 17919 - protein, 264 aa, Xanthomonas axonopodis
MKPYLELLQHVLDHGAEKSDRTGTGTRSVFGWQMRFDLNDGFPLVTTKKLHLRSIIHELLWFLKGDTNIGYLSDHQVRIWDEWADDNGDLGPVYGKQWRRWTGPDGVEIDQMQWLVDEIKRNPDSRRLVISAWNVGELPQMALMPCHSLFQFYVVNGKLSCQLYQRSGDIFLGVPFNIASYALLTHMVAQATGLGVGDFVHTLGDAHLYSNHFEQAREQLTRTPRALPSLRLNPEVTDLFAFRFEDIAIEGYDPHPAIKAPVAV

SEQ ID NO: 17920 - DNA, 795 bp, Xanthomonas campestris
  CDS (1)..(795): transl_table=11
gtgaagccgtacctggagttgctgcagcacgtgctcgagtacggcgccgagaagtccgatcgcaccggcaccggcacgcgcagcgtgttcggctggcagatgcgcttcgacctcaatgccgggtttccgctggtcaccaccaagaagctgcacctgcgctcgatcatccatgagctgctgtggttcctgcagggcgataccaacatcgcgtacctgaaagacaaccaggtccgcatctgggacgagtgggccgatgccaacggcgacctcggcccggtctacggcaagcagtggcgacgctggaccggtccggacggcgtcgagatcgatcagatgcagtggctggtggacgagatcaagcgcaacccggactcgcgccggctggtgatcagtgcctggaatgtcggcgagttgccgcaaatggccttgatgccctgccatagcctgttccagttctacgtggtggacggcaagctcagctgccagctctaccagcgcagcggcgacatcttcctgggggtgccgttcaacatcgccagctatgcgttgctgacccacatggtggcgcaggccaccggcctgggcgtgggcgacttcgtacacacactgggcgatgcgcacctgtattcaaaccatttcgaacaagcccgcgagcagctcacgcgcacgccgcgtccgctgccaaccttgcgcctgaacccggatgtcaccgacctgttcgcgttccgtttcgaggacatcgcgatcgacggctacgacccgcatccggcgatcaaggcgccggtggcggtgtga

SEQ ID NO: 17921 - protein, 264 aa, Xanthomonas campestris
MKPYLELLQHVLEYGAEKSDRTGTGTRSVFGWQMRFDLNAGFPLVTTKKLHLRSIIHELLWFLQGDTNIAYLKDNQVRIWDEWADANGDLGPVYGKQWRRWTGPDGVEIDQMQWLVDEIKRNPDSRRLVISAWNVGELPQMALMPCHSLFQFYVVDGKLSCQLYQRSGDIFLGVPFNIASYALLTHMVAQATGLGVGDFVHTLGDAHLYSNHFEQAREQLTRTPRPLPTLRLNPDVTDLFAFRFEDIAIDGYDPHPAIKAPVAV

SEQ ID NO: 17922 - DNA, 795 bp, Xanthomonas oryzae
  CDS (1)..(795): transl_table=11
gtgaagccgtatcttgatctgctgcagcatgtgctggaacacggtgcggagaagtccgaccgtaccggcaccggcacgcgcagcgtgttcggctggcagatgcgcttcgatctcaacgacggctttccgttggtgactaccaagaagctgcatctgcgctcgatcatccacgagttgctgtggttcctgcagggcgacaccaatatcggctatctgagcgacaaccaggtgcgcatctgggacgagtgggccgacgacaacggcgatctcggtccggtctatggcaagcagtggcggcgctggaccggcccggatggtgtcgagatcgaccagatgcaatggctggtggacgagatcaagcgcaacccggattcgcgccggctggtgatcagcgcctggaatgtcggcgagctgccgcagatggcgctgatgccgtgccacagcctgttccagttctacgtggtgaacggcaagctcagttgccagctctaccagcgcagcggcgacatctttctgggcgtgccgttcaatatcgccagctacgcgttgctcacgcacatggtggcgcaggccaccggcctgggcgtgggcgatttcgtgcatacgttgggcgatgcgcacctgtattcgaatcacttcgatcaagcgcgtaagcaactgacgcgtacaccgcgcgcgctgcccaccctgcgcttgaatcccgaggtcaccgacctgttcgcgttccgcttcgaagacatcgccatcgaaggttacgatccgcatccggcgatcaaggcgccggtggcggtctga

SEQ ID NO: 17923 - protein, 264 aa, Xanthomonas oryzae
MKPYLDLLQHVLEHGAEKSDRTGTGTRSVFGWQMRFDLNDGFPLVTTKKLHLRSIIHELLWFLQGDTNIGYLSDNQVRIWDEWADDNGDLGPVYGKQWRRWTGPDGVEIDQMQWLVDEIKRNPDSRRLVISAWNVGELPQMALMPCHSLFQFYVVNGKLSCQLYQRSGDIFLGVPFNIASYALLTHMVAQATGLGVGDFVHTLGDAHLYSNHFDQARKQLTRTPRALPTLRLNPEVTDLFAFRFEDIAIEGYDPHPAIKAPVAV

SEQ ID NO: 17924 - DNA, 795 bp, Xenorhabdus nematophilus
  CDS (1)..(795): transl_table=11
atgaaacagtatctcgatttaatgaaaaaagtgctggaagaaggcacggcaaaagatgaccgtacgggaacgggaacacgctctatttttggtcatcagatgcgtttcaatttgcaggaaggttttccattagtcacaaccaagcgttgtcatcttcgctccatcatccatgaactgctttggttcctgaatggtgataccaatatcaagtacttgcatgataatggcgtgagcatctgggatgagtgggctgatgaaaacggggatttgggaccggtttatggtaagcaatggcgcgcctggggttcagcggatggtcgtcacatcgatcagttgacccaggttcttgagcagttgaaaggtgaccctgattcacgccggattattgtttctgcatggaatgtgggggaattggataaaatggcgctggcaccatgccatgcttttttccagttctatgtcgcagacggcaaactttcctgccaactttaccaacgttcctgtgatgtgtttttaggcttaccattcaatattgcaagttatgccttattggtacatatgatggctcaacagtgcaatcttgatgtaggcgattttgtctggacagggggcgacacccatctttacaacaatcacttggaacagacccatcttcagttgagccgtgagccgcgcgcattacccaaattggtgattaaacgcaagccggattctctgtttgactaccgttttgaagactttgagattgtggattacgatccatatccgggtattaaagctccagttgcaatttaa

SEQ ID NO: 17925 - protein, 264 aa, Xenorhabdus nematophilus
MKQYLDLMKKVLEEGTAKDDRTGTGTRSIFGHQMRFNLQEGFPLVTTKRCHLRSIIHELLWFLNGDTNIKYLHDNGVSIWDEWADENGDLGPVYGKQWRAWGSADGRHIDQLTQVLEQLKGDPDSRRIIVSAWNVGELDKMALAPCHAFFQFYVADGKLSCQLYQRSCDVFLGLPFNIASYALLVHMMAQQCNLDVGDFVWTGGDTHLYNNHLEQTHLQLSREPRALPKLVIKRKPDSLFDYRFEDFEIVDYDPYPGIKAPVAI

SEQ ID NO: 17926 - DNA, 795 bp, Xylella fastidiosa
  CDS (1)..(795): transl_table=11
gtgaagcagtaccttgaattactgaatgatgtgcttgtgcatggcatacaaaagcctgaccgcactggcacggggacacgcagtgtgttcggttggcagatgcgatttgacttgagccaaggttttccactcgttacgactaaaaagctgcatttgcgttcgatcattcacgagttgctatggtttctcaggggggaaaccaatattgcttatcttaagaagcatcaggtacacatctgggacgagtgggccgatgctacgggtgagttgggacctgtttacggcaagcaatggcgccgttgggctggcgcggatggtcacgagatcgaccagatccgttggttgctggaggagatcaagcgtaatccagattcgcgccgcttggtgattagtgcttggaatgtggctgatcttccacagatggctttggtgccgtgccatgcactatttcaattctatgttgccaatggcaaattgagttgccagctctatcaacgtagcgctgatatttttcttggtgtccctttcaatatcgctagttatgcactgctcacccatatgttggctcaggtgactgggctagcggtcggtgattttgtgcatacgttgggtgatgcgcatttgtatgcgaatcatgtcgagcaagcatccgtgcaactggagcgtgtgccgcgaccgcaacctgtattaatgcttaatccggcagtgactgacttgtttgactttacctacgatgacatcgtgattgaaggttacgatccatatccggctatcaaggcaccggtggctgtgtga

SEQ ID NO: 17927 - protein, 264 aa, Xylella fastidiosa
MKQYLELLNDVLVHGIQKPDRTGTGTRSVFGWQMRFDLSQGFPLVTTKKLHLRSIIHELLWFLRGETNIAYLKKHQVHIWDEWADATGELGPVYGKQWRRWAGADGHEIDQIRWLLEEIKRNPDSRRLVISAWNVADLPQMALVPCHALFQFYVANGKLSCQLYQRSADIFLGVPFNIASYALLTHMLAQVTGLAVGDFVHTLGDAHLYANHVEQASVQLERVPRPQPVLMLNPAVTDLFDFTYDDIVIEGYDPYPAIKAPVAV

SEQ ID NO: 17928 - DNA, 795 bp, Xylella fastidiosa
  CDS (1)..(795): transl_table=11
gtgaagcagtaccttgaattactgaatgatgtgcttgtgcatggcataaaaaagcctgaccgcactggcacggggacacgcagtgtgttcggttggcagatgcgatttgacttgagccaaggttttccactcgttacgactaaaaagctgcatttgcgttcgatcattcacgagttgctatggtttctcaggggggaaaccaatattgcttatcttaagaagcatcaggtacacatctgggacgagtgggccgatgccacgggtgagttgggacctgtttacggcaagcaatggcgccgttgggctggtgcggatggtcacgagatcgaccagatccgttggttggtggaggagatcaagcgtaatccagattcgcgccgcttggtgattagtgcttggaatgtggctgatcttccacagatggctttggtgccgtgccatgcactgtttcaattctatgttgccaatggcaaattgagctgtcagctctatcaacgtagcgctgatatttttcttggcgtccctttcaatatcgctagttatgcactgctcacccatatgttggctcaggtgactgggctcgtggtcggtgattttgtgcatacgttgggtgatgcacatttgtatgctaatcatgtcgagcaagcatccgtgcaactggggcgtgtgccgcgaccgcaaccggtattaaggcttaatcaggcagtgactgacttgttcgactttacctacgatgacattgtgattgaaggttacgatccatatccggctatcaaggcaccggtggctgtgtga

SEQ ID NO: 17929 - protein, 264 aa, Xylella fastidiosa
MKQYLELLNDVLVHGIKKPDRTGTGTRSVFGWQMRFDLSQGFPLVTTKKLHLRSIIHELLWFLRGETNIAYLKKHQVHIWDEWADATGELGPVYGKQWRRWAGADGHEIDQIRWLVEEIKRNPDSRRLVISAWNVADLPQMALVPCHALFQFYVANGKLSCQLYQRSADIFLGVPFNIASYALLTHMLAQVTGLVVGDFVHTLGDAHLYANHVEQASVQLGRVPRPQPVLRLNQAVTDLFDFTYDDIVIEGYDPYPAIKAPVAV

SEQ ID NO: 17930 - DNA, 915 bp, Saccharomyces cerevisiae
  CDS (1)..(915)
atgactatggacggaaaaaacaaagaagaagagcaatatcttgatctatgcaaaagaatcattgatgaaggtgaatttaggccagatagaacaggcactggtacgttgagtctttttgcaccaccccagctgcgttttagtttacgtgatgataccttcccactactaacgaccaagaaggtttttactagaggtatcatacttgaactattgtggtttttggccggtgatacagacgctaacctattgtctgagcaaggtgttaagatttgggacggtaatggatctcgtgaatatttagataagatggggttcaaagataggaaagtaggagatctggggcccgtttacggatttcaatggaggcattttggtgctaaatacaagacgtgcgatgacgactatactggacaaggtattgatcaattgaaacaggttatacataaactaaagacaaatccctacgatagaagaatcattatgagtgcctggaacccagctgattttgacaaaatggctttgccgccatgccatattttttcacagttctatgtcagtttccccaaagaaggagaaggatccggtaagccccgcctttcatgcttattgtaccaacgttcttgtgatatggggttgggagtaccatttaacattgcatcatatgctttgttgactagaatgattgctaaagttgtcgacatggagccaggtgagttcattcatactttgggggatgcacatgtttataaagaccacattgatgccttgaaagaacaaatcaccagaaatccaagaccattcccgaaactaaagattaaaagggacgttaaagacattgatgatttcaagttgacagactttgaaattgaagattataatcctcatccaagaattcaaatgaaaatgagtgtataa

SEQ ID NO: 17931 - protein, 304 aa, Saccharomyces cerevisiae
MTMDGKNKEEEQYLDLCKRIIDEGEFRPDRTGTGTLSLFAPPQLRFSLRDDTFPLLTTKKVFTRGIILELLWFLAGDTDANLLSEQGVKIWDGNGSREYLDKMGFKDRKVGDLGPVYGFQWRHFGAKYKTCDDDYTGQGIDQLKQVIHKLKTNPYDRRIIMSAWNPADFDKMALPPCHIFSQFYVSFPKEGEGSGKPRLSCLLYQRSCDMGLGVPFNIASYALLTRMIAKVVDMEPGEFIHTLGDAHVYKDHIDALKEQITRNPRPFPKLKIKRDVKDIDDFKLTDFEIEDYNPHPRIQMKMSV

SEQ ID NO: 17932 - DNA, 795 bp, Yersinia pestis
  CDS (1)..(795): transl_table=11
atgaaacagtatctggatttgatgaaaaaagtgctggaagaaggcacacctaaagctgaccgtaccggtaccggcactctgtcaatttttgggcatcagatgcgtttcaatttacaagacggtttcccattggtcaccaccaagcgttgccacctacgttcgattatccatgagttgttatggttcctgaatggcgataccaacattgcttatctgaaggaaaataatgtctcaatctgggatgaatgggcagatgaaaacggcgatcttggtccgatttatggtaaacaatggcgtgcttggggggctgctgatggccgaaaaattgaccagttgagtaacgtagtcaatcaactgaagcaggaccctgattcgcgccggattattgtttctgcgtggaatgtgggcgaactggatcaaatggcgttggcaccatgccatgcctttttccagttctacgtggctgatggcaaactttcttgccaactgtaccaacgctcttgcgatgtgttccttggcttgccatttaacattgccagctatgcgttattagttcacatgatggcgcagcagtgtgatctggccgtaggcgattttgtctggactggcggggatactcacttgtatagcaaccatattgaccaggcgcatctgcaattgagccgtgagccacgagtattaccgaaactggtgatcaaacgtaaacctgattcattgtttgactaccatttcgatgattttgatattgagggctacgatcctcaccctggtattaaagcccctatcgcgatttaa

SEQ ID NO: 17933 - protein, 264 aa, Yersinia pestis
MKQYLDLMKKVLEEGTPKADRTGTGTLSIFGHQMRFNLQDGFPLVTTKRCHLRSIIHELLWFLNGDTNIAYLKENNVSIWDEWADENGDLGPIYGKQWRAWGAADGRKIDQLSNVVNQLKQDPDSRRIIVSAWNVGELDQMALAPCHAFFQFYVADGKLSCQLYQRSCDVFLGLPFNIASYALLVHMMAQQCDLAVGDFVWTGGDTHLYSNHIDQAHLQLSREPRVLPKLVIKRKPDSLFDYHFDDFDIEGYDPHPGIKAPIAI

SEQ ID NO: 17934 - DNA, 795 bp, Yersinia pseudotuberculosis
  CDS (1)..(795): transl_table=11
atgaaacagtatctggatttgatgaaaaaagtgctggaagaaggcacacctaaagctgaccgtaccggtaccggcactctgtcaatttttgggcatcagatgcgtttcaatttacaagacggtttcccattggtcaccaccaagcgttgccacctacgttcgattatccatgagttgttatggttcctgaatggcgataccaacattgcttatctgaaggaaaataatgtctcaatctgggatgaatgggcagatgaaaacggcgatcttggtccgatttatggtaaacaatggcgtgcttggggggctgctgatggccgaaaaattgaccagttgagtaacgtagtcaatcaactgaagcaggaccctgattcgcgccggattattgtttctgcgtggaatgtgggcgaactggatcaaatggcgttggcaccatgccatgcctttttccagttctacgtggctgatggcaaactttcttgccaactgtaccaacgctcttgcgatgtgttccttggcttgccatttaacattgccagctatgcgttattagttcacatgatggcgcagcagtgtgatctggccgtaggcgattttgtctggactggcggggatactcacttgtatagcaaccatattgaccagacgcatctgcaattgagccgtgagccacgagcattaccgaaactggtgatcaaacgtaaacctgattcattgtttgactaccatttcgatgattttgatattgagggctacgatcctcaccctggtattaaagcccctatcgcgatttaa

SEQ ID NO: 17935 - protein, 264 aa, Yersinia pseudotuberculosis
MKQYLDLMKKVLEEGTPKADRTGTGTLSIFGHQMRFNLQDGFPLVTTKRCHLRSIIHELLWFLNGDTNIAYLKENNVSIWDEWADENGDLGPIYGKQWRAWGAADGRKIDQLSNVVNQLKQDPDSRRIIVSAWNVGELDQMALAPCHAFFQFYVADGKLSCQLYQRSCDVFLGLPFNIASYALLVHMMAQQCDLAVGDFVWTGGDTHLYSNHIDQTHLQLSREPRALPKLVIKRKPDSLFDYHFDDFDIEGYDPHPGIKAPIAI

SEQ ID NO: 17936 - DNA, 24 bp, Artificial sequence
  (1)..(24): primer
atgaaacagtatttagaactgatg

SEQ ID NO: 17937 - DNA, 23 bp, Artificial sequence
  (1)..(23): primer
ttagatagccaccggcgctttaa

SEQ ID NO: 17938 - protein, 579 aa, Artificial sequence
  Variant (2)..(4): xaa in position 2 to 4 is any amino acid
  Variant (6)..(7): xaa in position 6 to 7 is any amino acid
  Variant (10)..(11): xaa in position 10 to 11 is any amino acid
  Variant (13)..(17): xaa in position 13 to 17 is any amino acid
  Variant (19)..(26): xaa in position 19 to 26 is any or no amino acid
  Variant (29)..(29): xaa in position 29 is any or no amino acid
  Variant (31)..(32): xaa in position 31 to 32 is any amino acid
  Variant (34)..(34): xaa in position 34 is any amino acid
  Variant (37)..(37): xaa in position 37 is any amino acid
  Variant (38)..(41): xaa in position 38 to 41 is any or no amino acid
  Variant (44)..(44): xaa in position 44 is any or no amino acid
  Variant (46)..(141): xaa in position 46 to 141 is any or no amino acid
  Variant (151)..(151): xaa in position 151 is any amino acid
  Variant (152)..(155): xaa in position 152 to 155 is any or no amino acid
  Variant (157)..(158): xaa in position 157 to 158 is any or no amino acid
  Variant (160)..(160): xaa in position 160 is any or no amino acid
  Variant (167)..(167): xaa in position 167 is any amino acid
  Variant (169)..(169): xaa in position 169 is any amino acid
  Variant (171)..(171): xaa in position 171 is any amino acid
  Variant (172)..(175): xaa in position 172 to 175 is any or no amino acid
  Variant (177)..(182): xaa in position 177 to 182 is any amino acid
  Variant (185)..(188): xaa in position 185 to 188 is any amino acid
  Variant (189)..(243): xaa in position 189 to 243 is any or no amino acid
  Variant (246)..(246): xaa in position 246 is any amino acid
  Variant (250)..(250): xaa in position 250 is any amino acid
  Variant (254)..(254): xaa in position 254 is any amino acid
  Variant (256)..(257): xaa in position 256 to 257 is any amino acid
  Variant (258)..(296): xaa in position 258 to 296 is any or no amino acid
  Variant (301)..(302): xaa in position 301 to 302 is any or no amino acid
  Variant (305)..(306): xaa in position 305 to 306 is any amino acid
  Variant (308)..(318): xaa in position 308 to 318 is any or no amino acid
  Variant (320)..(321): xaa in position 320 to 321 is any or no amino acid
  Variant (324)..(324): xaa in position 324 is any or no amino acid
  Variant (327)..(328): xaa in position 327 to 328 is any or no amino acid
  Variant (331)..(331): xaa in position 331 is any amino acid
  Variant (332)..(333): xaa in position 332 to 333 is any or no amino acid
  Variant (335)..(335): xaa in position 335 is any amino acid
  Variant (336)..(349): xaa in position 336 to 349 is any or no amino acid
  Variant (351)..(351): xaa in position 351 is any amino acid
  Variant (353)..(353): xaa in position 353 is any amino acid
  Variant (357)..(359): xaa in position 357 to 359 is any amino acid
  Variant (362)..(362): xaa in position 362 is any amino acid
  Variant (364)..(367): xaa in position 364 to 367 is any amino acid
  Variant (368)..(418): xaa in position 368 to 418 is any or no amino acid
  Variant (420)..(422): xaa in position 420 to 422 is any amino acid
  Variant (428)..(428): xaa in position 428 is any amino acid
  Variant (431)..(431): xaa in position 431 is any amino acid
  Variant (439)..(440): xaa in position 439 to 440 is any amino acid
  Variant (445)..(446): xaa in position 445 to 446 is any amino acid
  Variant (450)..(456): xaa in position 450 to 456 is any amino acid
  Variant (457)..(463): xaa in position 457 to 463 is any or no amino acid
  Variant (465)..(470): xaa in position 465 to 470 is any amino acid
  Variant (472)..(473): xaa in position 472 to 473 is any amino acid
  Variant (477)..(478): xaa in position 477 to 478 is any amino acid
  Variant (480)..(485): xaa in position 480 to 485 is any amino acid
  Variant (486)..(521): xaa in position 486 to 521 is any or no amino acid
  Variant (524)..(524): xaa in position 524 is any amino acid
  Variant (526)..(526): xaa in position 526 is any amino acid
  Variant (528)..(530): xaa in position 528 to 530 is any amino acid
  Variant (532)..(532): xaa in position 532 is any amino acid
  Variant (534)..(534): xaa in position 534 is any amino acid
  Variant (536)..(539): xaa in position 536 to 539 is any amino acid
  Variant (540)..(553): xaa in position 540 to 553 is any or no amino acid
  Variant (555)..(560): xaa in position 555 to 560 is any amino acid
  Variant (562)..(563): xaa in position 562 to 563 is any amino acid
  Variant (565)..(566): xaa in position 565 to 566 is any amino acid
  Variant (568)..(572): xaa in position 568 to 572 is any amino acid
  Variant (574)..(576): xaa in position 574 to 576 is any amino acid
YXXXLXXILXXGXXXXXRXXXXXXXXTGXGXXSXFGXXXXXRFXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFPLLTTKKVXXXXXKXXIXELLWFLXGXTXXXXXLXXXXXXIWXXXXXXXXXXXXXXXXXXXXXXXXXXXXXXXXXXXXXXXXXXXXXXXXXXXXXXXXXXXLGXVYGXQWRXWXXXXXXXXXXXXXXXXXXXXXXXXXXXXXXXXXXXXXXXXXIDQLXXVIXXIXXXXXXXXXXXPXXRRXIVXXWNXXXLXXXXXXXXXXXXXXXMXLXPCHXXXQFXVXXXXXXXXXXXXXXXXXXXXXXXXXXXXXXXXXXXXXXXXXXXXXXXXXXXXXXXLXXXLYQRSXDMXLGVPFNIXXYALLXXMIAXXXXXXXXXXXXXXGXXXXXXGXXHIYXXHXXXXXXXXXXXXXXXXXXXXXXXXXXXXXXXXXXXXXXXXXXQLXRXPXXXPXLXIXXXXXXXXXXXXXXXXXXIXXXXXXDXXLXXYXXXXXIXXXVAV

SEQ ID NO: 17939 - protein, 27 aa, Artificial sequence
  Variant (2)..(8): xaa in position 2 to 8 is any amino acid
  Variant (9)..(10): xaa in position 9 to 10 is any or no amino acid
  Variant (12)..(15): xaa in position 12 to 15 is any amino acid
  Variant (16)..(16): xaa in position 16 is Asp or Asn
  Variant (19)..(21): xaa in position 19 to 21 is any amino acid
  Variant (22)..(22): xaa in position 22 is Ala, Cys, Gly, Thr or Val
  Variant (23)..(26): xaa in position 23 to 26 is any amino acid
  Variant (27)..(27): xaa in position 27 is Ala, Asp, Glu, Gly or Ser
LXXXXXXXXXGXXXXXRTXXXXXXXXX

SEQ ID NO: 17940 - protein, 21 aa, Artificial sequence
  Variant (2)..(2): xaa in position 2 is any amino acid
  Variant (3)..(3): xaa in position 3 is Ile, Leu, Met or Val
  Variant (7)..(15): xaa in position 7 to 15 is any amino acid
  Variant (17)..(17): xaa in position 17 is any or no amino acid
  Variant (19)..(20): xaa in position 19 to 20 is any amino acid
  Variant (21)..(21): xaa in position 21 is Phe, Ile, Leu, Met or Val
PXXTTKXXXXXXXXXEXLXXX

SEQ ID NO: 17941 - protein, 37 aa, Artificial sequence
  Variant (2)..(2): xaa in position 2 is Ile, Leu, Met or Val
  Variant (3)..(5): xaa in position 3 to 5 is any amino acid
  Variant (6)..(6): xaa in position 6 is Ile, Leu or Val
  Variant (7)..(8): xaa in position 7 to 8 is any amino acid
  Variant (9)..(9): xaa in position 9 is Ile, Leu or Val
  Variant (10)..(12): xaa in position 10 to 12 is any amino acid
  Variant (14)..(14): xaa in position 14 is any amino acid
  Variant (15)..(15): xaa in position 15 is Cys, Asp, Gly, Asn or Ser
  Variant (18)..(18): xaa in position 18 is any amino acid
  Variant (19)..(19): xaa in position 19 is Ile, Leu, Met or Val
  Variant (20)..(22): xaa in position 20 to 22 is any amino acid
  Variant (23)..(23): xaa in position 23 is Phe, Trp or Tyr
  Variant (25)..(32): xaa in position 25 to 32 is any amino acid
  Variant (34)..(34): xaa in position 34 is any or no amino acid
  Variant (36)..(36): xaa in position 36 is any or no amino acid
QXXXXXXXXXXXPXXRRXXXXXXNXXXXXXXXLXPXC

SEQ ID NO: 17942 - protein, 32 aa, Artificial sequence
  Variant (2)..(3): xaa in position 2 to 3 is any amino acid
  Variant (4)..(6): xaa in position 4 to 6 is any or no amino acid
  Variant (8)..(8): xaa in position 8 is any or no amino acid
  Variant (11)..(11): xaa in position 11 is Ala, Cys, Gly or Val
  Variant (13)..(14): xaa in position 13 to 14 is any amino acid
  Variant (17)..(17): xaa in position 17 is Ile, Leu or Val
  Variant (18)..(18): xaa in position 18 is Asn or Pro
  Variant (21)..(21): xaa in position 21 is any amino acid
  Variant (22)..(22): xaa in position 22 is Ala, Gly, Ile or Val
  Variant (23)..(23): xaa in position 23 is Ala, Gly, Gln or Ser
  Variant (24)..(26): xaa in position 24 to 26 is any amino acid
  Variant (27)..(27): xaa in position 27 is Phe or Leu
  Variant (28)..(29): xaa in position 28 to 29 is any amino acid
  Variant (30)..(30): xaa in position 30 is Ile, Leu, Met or Val
  Variant (31)..(31): xaa in position 31 is any amino acid
LXXXXXQXRSXDXXLGXXFNXXXXXXXXXXXA

SEQ ID NO: 17943 - DNA, 1434 bp, Escherichia coli K12; identical to SEQ ID NO: 4679
  CDS (1)..(1434)

SEQ ID NO: 17944 - protein, 477 aa, Escherichia coli K12 [sequence omitted]

SEQ ID NO: 17945 - DNA, 1314 bp, Pyrococcus abyssi; identical to SEQ ID NO: 4681
  CDS (1)..(1314)

SEQ ID NO: 17946 - protein, 437 aa, Pyrococcus abyssi; identical to SEQ ID NO: 4682

SEQ ID NO: 17947 - DNA, 1425 bp, Chlamydia muridarum, Chlamydia trachomatis MoPn; identical to SEQ ID NO: 4683
  CDS (1)..(1425)

SEQ ID NO: 17948 - protein, 474 aa, Chlamydia muridarum, Chlamydia trachomatis MoPn; identical to SEQ ID NO: 4684

SEQ ID NO: 17949 - DNA, 1434 bp, Clostridium acetobutylicum; identical to SEQ ID NO: 4685
  CDS (1)..(1434)

SEQ ID NO: 17950 - protein, 477 aa, Clostridium acetobutylicum; identical to SEQ ID NO: 4686

SEQ ID NO: 17951 - DNA, 1431 bp, Yersinia pestis; identical to SEQ ID NO: 4687
  CDS (1)..(1431)

SEQ ID NO: 17952 - protein, 476 aa, Yersinia pestis; identical to SEQ ID NO: 4688

SEQ ID NO: 17953 - DNA, 1443 bp, Agrobacterium tumefaciens; identical to SEQ ID NO: 4689
  CDS (1)..(1443)

SEQ ID NO: 17954 - protein, 480 aa, Agrobacterium tumefaciens; identical to SEQ ID NO: 4690

SEQ ID NO: 17955 - DNA, 1479 bp, Nostoc sp. PCC 7120; identical to SEQ ID NO: 4691
  CDS (1)..(1479)

SEQ ID NO: 17956 - protein, 492 aa, Nostoc sp. PCC 7120; identical to SEQ ID NO: 4692

SEQ ID NO: 17957 - DNA, 1419 bp, Nostoc sp. PCC 7120; identical to SEQ ID NO: 4693
  CDS (1)..(1419)

SEQ ID NO: 17958 - protein, 472 aa, Nostoc sp. PCC 7120; identical to SEQ ID NO: 4694

SEQ ID NO: 17959 - DNA, 1431 bp, Haemophilus influenzae; identical to SEQ ID NO: 4695
  CDS (1)..(1431)

SEQ ID NO: 17960 - protein, 476 aa, Haemophilus influenzae; identical to SEQ ID NO: 4696

SEQ ID NO: 17961 - DNA, 1392 bp, Aquifex aeolicus; identical to SEQ ID NO: 4697
  CDS (1)..(1392)

SEQ ID NO: 17962 - protein, 463 aa, Aquifex aeolicus; identical to SEQ ID NO: 4698

SEQ ID NO: 17963 - DNA, 1371 bp, Pyrococcus horikoshii; identical to SEQ ID NO: 4699
  CDS (1)..(1371)

SEQ ID NO: 17964 - protein, 456 aa, Pyrococcus horikoshii; identical to SEQ ID NO: 4700

SEQ ID NO: 17965 - DNA, 1431 bp, Chlamydophila pneumoniae, Chlamydia pneumoniae; identical to SEQ ID NO: 4701
  CDS (1)..(1431)

SEQ ID NO: 17966 - protein, 476 aa, Chlamydophila pneumoniae, Chlamydia pneumoniae; identical to SEQ ID NO: 4702

SEQ ID NO: 17967 - DNA, 1452 bp, Lactococcus lactis subsp. lactis; identical to SEQ ID NO: 4703
  CDS (1)..(1452)

SEQ ID NO: 17968 - protein, 483 aa, Lactococcus lactis subsp. lactis; identical to SEQ ID NO: 4704

SEQ ID NO: 17969 - DNA, 1461 bp, Sinorhizobium meliloti; identical to SEQ ID NO: 4705
  CDS (1)..(1461)

SEQ ID NO: 17970 - protein, 486 aa, Sinorhizobium meliloti; identical to SEQ ID NO: 4706

SEQ ID NO: 17971 - DNA, 1425 bp, Chlamydia trachomatis; identical to SEQ ID NO: 4707
  CDS (1)..(1425)

SEQ ID NO: 17972 - protein, 474 aa, Chlamydia trachomatis; identical to SEQ ID NO: 4708

SEQ ID NO: 17973 - DNA, 1701 bp, Sulfolobus solfataricus; identical to SEQ ID NO: 4709
  CDS (1)..(1701)

SEQ ID NO: 17974 - protein, 566 aa, Sulfolobus solfataricus; identical to SEQ ID NO: 4710

SEQ ID NO: 17975 - DNA, 1566 bp, Methanococcus jannaschii; identical to SEQ ID NO: 4711
  CDS (1)..(1566)

SEQ ID NO: 17976 - protein, 521 aa, Methanococcus jannaschii; identical to SEQ ID NO: 4712

SEQ ID NO: 17977 - DNA, 1431 bp, Bacillus halodurans; identical to SEQ ID NO: 4713
  CDS (1)..(1431)

SEQ ID NO: 17978 - protein, 476 aa, Bacillus halodurans; identical to SEQ ID NO: 4714

SEQ ID NO: 17979 - DNA, 1455 bp, Vibrio cholerae; identical to SEQ ID NO: 4715
  CDS (1)..(1455)

SEQ ID NO: 17980 - protein, 484 aa, Vibrio cholerae; identical to SEQ ID NO: 4716

SEQ ID NO: 17981 - DNA, 1833 bp, Arabidopsis thaliana (mouse-ear cress); identical to SEQ ID NO: 4717
  CDS (1)..(1833)

SEQ ID NO: 17982 - protein, 610 aa, Arabidopsis thaliana (mouse-ear cress); identical to SEQ ID NO: 4718

SEQ ID NO: 17983 - DNA, 1461 bp, Thermotoga maritima; identical to SEQ ID NO: 4719
  CDS (1)..(1461)

SEQ ID NO: 17984 - protein, 486 aa, Thermotoga maritima; identical to SEQ ID NO: 4720

SEQ ID NO: 17985 - DNA, 1542 bp, Pseudomonas aeruginosa; identical to SEQ ID NO: 4721
  CDS (1)..(1542)

SEQ ID NO: 17986 - protein, 513 aa, Pseudomonas aeruginosa; identical to SEQ ID NO: 4722

SEQ ID NO: 17987 - DNA, 3078 bp, Arabidopsis thaliana (mouse-ear cress); identical to SEQ ID NO: 4723
  CDS (1)..(3078)

SEQ ID NO: 17988 - protein, 1025 aa, Arabidopsis thaliana (mouse-ear cress); identical to SEQ ID NO: 4724

SEQ ID NO: 17989 - DNA, 1434 bp, Streptococcus pneumoniae; identical to SEQ ID NO: 4725
  CDS (1)..(1434)

SEQ ID NO: 17990 - protein, 477 aa, Streptococcus pneumoniae; identical to SEQ ID NO: 4726

SEQ ID NO: 17991 - DNA, 2533 bp, Oryza sativa (rice); identical to SEQ ID NO: 4727
  CDS (114)..(1994)

SEQ ID NO: 17992 - protein, 626 aa, Oryza sativa (rice); identical to SEQ ID NO: 4728

SEQ ID NO: 17993 - DNA, 1818 bp, Zea mays (maize); identical to SEQ ID NO: 4729
  CDS (1)..(1818)

SEQ ID NO: 17994 - protein, 605 aa, Zea mays (maize); identical to SEQ ID NO: 4730

SEQ ID NO: 17995 - DNA, 1455 bp, Bacillus subtilis; identical to SEQ ID NO: 4731
  CDS (1)..(1455)

SEQ ID NO: 17996 - protein, 484 aa, Bacillus subtilis; identical to SEQ ID NO: 4732

SEQ ID NO: 17997 - DNA, 2168 bp, Manihot esculenta (cassava); identical to SEQ ID NO: 4733
  CDS (75)..(1901)

SEQ ID NO: 17998 - protein, 608 aa, Manihot esculenta (cassava); identical to SEQ ID NO: 4734

SEQ ID NO: 17999 - DNA, 2035 bp, Pisum sativum (garden pea); identical to SEQ ID NO: 4735
  CDS (82)..(1893)

SEQ ID NO: 18000 - protein, 603 aa, Pisum sativum (garden pea); identical to SEQ ID NO: 4736

SEQ ID NO: 18001 - DNA, 1476 bp, Synechocystis sp; identical to SEQ ID NO: 4737
  CDS (1)..(1476)

SEQ ID NO: 18002 - protein, 491 aa, Synechocystis sp; identical to SEQ ID NO: 4738

SEQ ID NO: 18003 - DNA, 1434 bp, Synechocystis sp; identical to SEQ ID NO: 4739
  CDS (1)..(1434)

SEQ ID NO: 18004 - protein, 477 aa, Synechocystis sp; identical to SEQ ID NO: 4740

SEQ ID NO: 18005 - DNA, 2868 bp, Zea mays (maize); identical to SEQ ID NO: 4741
  CDS (670)..(2868)

SEQ ID NO: 18006 - protein, 732 aa, Zea mays (maize); identical to SEQ ID NO: 4742

SEQ ID NO: 18007 - DNA, 2480 bp, Zea mays (maize); identical to SEQ ID NO: 4743
  CDS (58)..(2154)

SEQ ID NO: 18008 - protein, 698 aa, Zea mays (maize); identical to SEQ ID NO: 4744

SEQ ID NO: 18009 - DNA, 6027 bp, Zea mays (maize); identical to SEQ ID NO: 4745
  CDS (120)..(5144)

SEQ ID NO: 18010 - protein, 1674 aa, Zea mays (maize); identical to SEQ ID NO: 4746

SEQ ID NO: 18011 - DNA, 2991 bp, Zea mays (maize); identical to SEQ ID NO: 4747
  CDS (602)..(2470): n means a or g or c or t/u, s means g or c

SEQ ID NO: 18012 - protein, 622 aa, Zea mays (maize); identical to SEQ ID NO: 4748

SEQ ID NO: 18013 - DNA, 2360 bp, Solanum tuberosum (potato); identical to SEQ ID NO: 4749
  CDS (68)..(1993)

SEQ ID NO: 18014 - protein, 641 aa, Solanum tuberosum (potato); identical to SEQ ID NO: 4750

SEQ ID NO: 18015 - DNA, 2124 bp, Ipomoea batatas (sweet potato); identical to SEQ ID NO: 4751
  CDS (23)..(1849)

SEQ ID NO: 18016 - protein, 608 aa, Ipomoea batatas (sweet potato); identical to SEQ ID NO: 4752

SEQ ID NO: 18017 - DNA, 2287 bp, Sorghum bicolor (sorghum); identical to SEQ ID NO: 4753
  CDS (207)..(2033)

SEQ ID NO: 18018 - protein, 608 aa, Sorghum bicolor (sorghum); identical to SEQ ID NO: 4754

SEQ ID NO: 18019 - DNA, 4110 bp, Schizosaccharomyces pombe; identical to SEQ ID NO: 4755
  CDS (1)..(4110)

SEQ ID NO: 18020 - protein, 1369 aa, Schizosaccharomyces pombe; identical to SEQ ID NO: 4756

SEQ ID NO: 18021 - DNA, 1812 bp, Hordeum vulgare (barley); identical to SEQ ID NO: 4757
  CDS (1)..(1812)

SEQ ID NO: 18022 - protein, 603 aa, Hordeum vulgare (barley); identical to SEQ ID NO: 4758

SEQ ID NO: 18023 - DNA, 2161 bp, Solanum tuberosum (potato); identical to SEQ ID NO: 4759
  CDS (37)..(1860)

SEQ ID NO: 18024 - protein, 607 aa, Solanum tuberosum (potato); identical to SEQ ID NO: 4760

SEQ ID NO: 18025 - DNA, 2825 bp, Triticum aestivum; identical to SEQ ID NO: 4761
  CDS (162)..(2561)

SEQ ID NO: 18026 - protein, 799 aa, Triticum aestivum; identical to SEQ ID NO: 4762

SEQ ID NO: 18027 - DNA, 2771 bp, Triticum aestivum; identical to SEQ ID NO: 4763
  CDS (280)..(2550)

SEQ ID NO: 18028 - protein, 756 aa, Triticum aestivum; identical to SEQ ID NO: 4764

SEQ ID NO: 18029 - DNA, 4121 bp, Zea mays; identical to SEQ ID NO: 4765
  CDS (442)..(3954)

SEQ ID NO: 18030 - protein, 1170 aa, Zea mays; identical to SEQ ID NO: 4766

SEQ ID NO: 18031 - DNA, 3240 bp, Chlamydomonas reinhardtii; identical to SEQ ID NO: 4767
  CDS (138)..(2264)

SEQ ID NO: 18032 - protein, 708 aa, Chlamydomonas reinhardtii; identical to SEQ ID NO: 4768

SEQ ID NO: 18033 - DNA, 3049 bp, Chlamydomonas reinhardtii; identical to SEQ ID NO: 4769
  CDS (190)..(1920)

SEQ ID NO: 18034 - protein, 576 aa, Chlamydomonas reinhardtii; identical to SEQ ID NO: 4770

SEQ ID NO: 18035 - DNA, 2716 bp, Chlamydomonas reinhardtii; identical to SEQ ID NO: 4771
  CDS (93)..(2048)

SEQ ID NO: 18036 - protein, 651 aa, Chlamydomonas reinhardtii; identical to SEQ ID NO: 4772

SEQ ID NO: 18037 - DNA, 2325 bp, Ipomoea batatas; identical to SEQ ID NO: 4773
  CDS (155)..(2047)

SEQ ID NO: 18038 - protein, 630 aa, Ipomoea batatas; identical to SEQ ID NO: 4774

SEQ ID NO: 18039 - DNA, 1440 bp, Erwinia carotovora subsp; identical to SEQ ID NO: 4775
  CDS (1)..(1440)

SEQ ID NO: 18040 - protein, 479 aa, Erwinia carotovora subsp; identical to SEQ ID NO: 4776

SEQ ID NO: 18041 - DNA, 1497 bp, Bacillus thuringiensis serovar konkukian str; identical to SEQ ID NO: 4777
  CDS (1)..(1497)

SEQ ID NO: 18042 - protein, 498 aa, Bacillus thuringiensis serovar konkukian str; identical to SEQ ID NO: 4778

SEQ ID NO: 18043 - DNA, 1431 bp, Mycoplasma mobile; identical to SEQ ID NO: 4779
  CDS (1)..(1431): transl-table=4

SEQ ID NO: 18044 - protein, 476 aa, Mycoplasma mobile; identical to SEQ ID NO: 4780

SEQ ID NO: 18045 - DNA, 1815 bp, Hordeum bulbosum; identical to SEQ ID NO: 4781
  CDS (1)..(1815)

SEQ ID NO: 18046 - protein, 604 aa, Hordeum bulbosum; identical to SEQ ID NO: 4782

SEQ ID NO: 18047 - DNA, 1527 bp, Photobacterium profundum; identical to SEQ ID NO: 4783
  CDS (1)..(1527)

SEQ ID NO: 18048 - protein, 508 aa, Photobacterium profundum; identical to SEQ ID NO: 4784

SEQ ID NO: 18049 - DNA, 1569 bp, Methanococcus maripaludis; identical to SEQ ID NO: 4785
  CDS (1)..(1569)

SEQ ID NO: 18050 - protein, 522 aa, Methanococcus maripaludis; identical to SEQ ID NO: 4786

SEQ ID NO: 18051 - DNA, 1503 bp, Parachlamydia sp; identical to SEQ ID NO: 4787
  CDS (1)..(1503)

SEQ ID NO: 18052 - protein, 500 aa, Parachlamydia sp; identical to SEQ ID NO: 4788

SEQ ID NO: 18053 - DNA, 1452 bp, Rhodopseudomonas palustris; identical to SEQ ID NO: 4789
  CDS (1)..(1452)

SEQ ID NO: 18054 - protein, 483 aa, Rhodopseudomonas palustris; identical to SEQ ID NO: 4790

SEQ ID NO: 18055 - DNA, 1173 bp, Corynebacterium diphtheriae; identical to SEQ ID NO: 4791
  CDS (1)..(1173)

SEQ ID NO: 18056 - protein, 390 aa, Corynebacterium diphtheriae; identical to SEQ ID NO: 4792

SEQ ID NO: 18057 - DNA, 1578 bp, Ostreococcus tauri; identical to SEQ ID NO: 4793
  CDS (1)..(1578)

SEQ ID NO: 18058 - protein, 525 aa, Ostreococcus tauri; identical to SEQ ID NO: 4794

SEQ ID NO: 18059 - DNA, 1725 bp, Ostreococcus tauri; identical to SEQ ID NO: 4795
  CDS (1)..(1725)

SEQ ID NO: 18060 - protein, 574 aa, Ostreococcus tauri; identical to SEQ ID NO: 4796

SEQ ID NO: 18061 - DNA, 2022 bp, Ostreococcus tauri; identical to SEQ ID NO: 4797
  CDS (1)..(2022)

SEQ ID NO: 18062 - protein, 673 aa, Ostreococcus tauri; identical to SEQ ID NO: 4798

SEQ ID NO: 18063 - DNA, 2939 bp, Colocasia esculenta; identical to SEQ ID NO: 4799
  CDS (220)..(2634)

SEQ ID NO: 18064 - protein, 804 aa, Colocasia esculenta; identical to SEQ ID NO: 4800

SEQ ID NO: 18065 - DNA, 1554 bp, Thermoproteus tenax; identical to SEQ ID NO: 4801
  CDS (1)..(1554)

SEQ ID NO: 18066 - protein, 517 aa, Thermoproteus tenax; identical to SEQ ID NO: 4802

SEQ ID NO: 18067 - DNA, 1470 bp, Desulfovibrio vulgaris; identical to SEQ ID NO: 4803
  CDS (1)..(1470)

SEQ ID NO: 18068 - protein, 489 aa, Desulfovibrio vulgaris; identical to SEQ ID NO: 4804

SEQ ID NO: 18069 - DNA, 1323 bp, Thermus thermophilus; identical to SEQ ID NO: 4805
  CDS (1)..(1323)

SEQ ID NO: 18070 - protein, 440 aa, Thermus thermophilus; identical to SEQ ID NO: 4806

SEQ ID NO: 18071 - DNA, 1431 bp, Bacillus cereus; identical to SEQ ID NO: 4807
  CDS (1)..(1431)

SEQ ID NO: 18072 - protein, 476 aa, Bacillus cereus; identical to SEQ ID NO: 4808

SEQ ID NO: 18073 - DNA, 1476 bp, Treponema denticola; identical to SEQ ID NO: 4809
  CDS (1)..(1476)

SEQ ID NO: 18074 - protein, 491 aa, Treponema denticola; identical to SEQ ID NO: 4810

SEQ ID NO: 18075 - DNA, 1173 bp, Mycobacterium paratuberculosis; identical to SEQ ID NO: 4811
  CDS (1)..(1173)

SEQ ID NO: 18076 - protein, 390 aa, Mycobacterium paratuberculosis; identical to SEQ ID NO: 4812

SEQ ID NO: 18077 - DNA, 2486 bp, Phaseolus vulgaris; identical to SEQ ID NO: 4813
  CDS (39)..(2255)

SEQ ID NO: 18078 - protein, 738 aa, Phaseolus vulgaris; identical to SEQ ID NO: 4814

SEQ ID NO: 18079 - DNA, 2570 bp, Phaseolus vulgaris; identical to SEQ ID NO: 4815
  CDS (135)..(2309)

SEQ ID NO: 18080 - protein, 724 aa, Phaseolus vulgaris; identical to SEQ ID NO: 4816

SEQ ID NO: 18081 - DNA, 2444 bp, Phaseolus vulgaris; identical to SEQ ID NO: 4817
  CDS (78)..(2015)

SEQ ID NO: 18082 - protein, 645 aa, Phaseolus vulgaris; identical to SEQ ID NO: 4818

SEQ ID NO: 18083 - DNA, 1827 bp, Hordeum spontaneum; identical to SEQ ID NO: 4819
  CDS (1)..(1827)

SEQ ID NO: 18084 - protein, 608 aa, Hordeum spontaneum; identical to SEQ ID NO: 4820

SEQ ID NO: 18085 - DNA, 1248 bp, Gloeobacter violaceus; identical to SEQ ID NO: 4821
  CDS (1)..(1248)

SEQ ID NO: 18086 - protein, 415 aa, Gloeobacter violaceus; identical to SEQ ID NO: 4822

SEQ ID NO: 18087 - DNA, 3219 bp, Oryza sativa; identical to SEQ ID NO: 4823
  CDS (1)..(3219)

SEQ ID NO: 18088 - protein, 1072 aa, Oryza sativa; identical to SEQ ID NO: 4824

SEQ ID NO: 18089 - DNA, 2547 bp, Oryza sativa; identical to SEQ ID NO: 4825
  CDS (97)..(2022)

SEQ ID NO: 18090 - protein, 641 aa, Oryza sativa; identical to SEQ ID NO: 4826

SEQ ID NO: 18091 - DNA, 1242 bp, Streptomyces avermitilis; identical to SEQ ID NO: 4827
  CDS (1)..(1242)

SEQ ID NO: 18092 - protein, 413 aa, Streptomyces avermitilis; identical to SEQ ID NO: 4828

SEQ ID NO: 18093 - DNA, 2208 bp, Phaseolus vulgaris; identical to SEQ ID NO: 4829
  CDS (144)..(1991)

SEQ ID NO: 18094 - protein, 615 aa, Phaseolus vulgaris; identical to SEQ ID NO: 4830

SEQ ID NO: 18095 - DNA, 2748 bp, Oryza sativa; identical to SEQ ID NO: 4831
  CDS (1)..(2748)

SEQ ID NO: 18096 - protein, 915 aa, Oryza sativa; identical to SEQ ID NO: 4832

SEQ ID NO: 18097 - DNA, 1605 bp, Shewanella oneidensis; identical to SEQ ID NO: 4833
  CDS (1)..(1605)

SEQ ID NO: 18098 - protein, 534 aa, Shewanella oneidensis; identical to SEQ ID NO: 4834

SEQ ID NO: 18099 - DNA, 1173 bp, Corynebacterium efficiens; identical to SEQ ID NO: 4835
  CDS (1)..(1173)

SEQ ID NO: 18100 - protein, 390 aa, Corynebacterium efficiens; identical to SEQ ID NO: 4836

SEQ ID NO: 18101 - DNA, 2340 bp, Colocasia esculenta; identical to SEQ ID NO: 4837
  CDS (155)..(2086)

SEQ ID NO: 18102 - protein, 643 aa, Colocasia esculenta; identical to SEQ ID NO: 4838

SEQ ID NO: 18103 - DNA, 2409 bp, Hordeum vulgare; identical to SEQ ID NO: 4839
  CDS (1)..(2409)

SEQ ID NO: 18104 - protein, 802 aa, Hordeum vulgare; identical to SEQ ID NO: 4840

SEQ ID NO: 18105 - DNA, 2115 bp, Setaria italica; identical to SEQ ID NO: 4841
  CDS (142)..(1959)

SEQ ID NO: 18106 - protein, 605 aa, Setaria italica; identical to SEQ ID NO: 4842

SEQ ID NO: 18107 - DNA, 2081 bp, Triticum aestivum; identical to SEQ ID NO: 4843
  CDS (1)..(1800)

SEQ ID NO: 18108 - protein, 599 aa, Triticum aestivum; identical to SEQ ID NO: 4844

SEQ ID NO: 18109 - DNA, 1230 bp, Corynebacterium glutamicum; identical to SEQ ID NO: 4845
  CDS (1)..(1230)

SEQ ID NO: 18110 - protein, 409 aa, Corynebacterium glutamicum; identical to SEQ ID NO: 4846

SEQ ID NO: 18111 - DNA, 1356 bp, Pyrococcus furiosus; identical to SEQ ID NO: 4847
  CDS (1)..(1356)

SEQ ID NO: 18112 - protein, 451 aa, Pyrococcus furiosus; identical to SEQ ID NO: 4848

SEQ ID NO: 18113 - DNA, 2112 bp, Oryza sativa; identical to SEQ ID NO: 4849
  CDS (61)..(1887)

SEQ ID NO: 18114 - protein, 608 aa, Oryza sativa; identical to SEQ ID NO: 4850

SEQ ID NO: 18115 - DNA, 2496 bp, Oryza sativa; identical to SEQ ID NO: 4851
  CDS (1)..(2496)

SEQ ID NO: 18116 - protein, 831 aa, Oryza sativa; identical to SEQ ID NO: 4852

SEQ ID NO: 18117 - DNA, 1443 bp, Rhizobium loti; identical to SEQ ID NO: 4853
  CDS (1)..(1443)

SEQ ID NO: 18118 - protein, 480 aa, Rhizobium loti; identical to SEQ ID NO: 4854

SEQ ID NO: 18119 - DNA, 2100 bp, Pisum sativum; identical to SEQ ID NO: 4855
  CDS (6)..(1847)

SEQ ID NO: 18120 - protein, 613 aa, Pisum sativum; identical to SEQ ID NO: 4856

SEQ ID NO: 18121 - DNA, 3386 bp, Triticum aestivum; identical to SEQ ID NO: 4857
  CDS (251)..(2995)

SEQ ID NO: 18122 - protein, 914 aa, Triticum aestivum; identical to SEQ ID NO: 4858

SEQ ID NO: 18123 - DNA, 2919 bp, Oryza sativa; identical to SEQ ID NO: 4859
  CDS (165)..(2597)

SEQ ID NO: 18124 - protein, 810 aa, Oryza sativa; identical to SEQ ID NO: 4860

SEQ ID NO: 18125 - DNA, 2394 bp, Oryza sativa; identical to SEQ ID NO: 4861
  CDS (34)..(2118)

SEQ ID NO: 18126 - protein, 694 aa, Oryza sativa; identical to SEQ ID NO: 4862

SEQ ID NO: 18127 - DNA, 2903 bp, Oryza sativa; identical to SEQ ID NO: 4863
  CDS (86)..(2335)

SEQ ID NO: 18128 - protein, 749 aa, Oryza sativa; identical to SEQ ID NO: 4864

SEQ ID NO: 18129 - DNA, 1719 bp, Sulfolobus tokodaii; identical to SEQ ID NO: 4865
  CDS (1)..(1719)

SEQ ID NO: 18130 - protein, 572 aa, Sulfolobus tokodaii; identical to SEQ ID NO: 4866

SEQ ID NO: 18131 - DNA, 2270 bp, Perilla frutescens; identical to SEQ ID NO: 4867
  CDS (172)..(1986)

SEQ ID NO: 18132 - protein, 604 aa, Perilla frutescens; identical to SEQ ID NO: 4868

SEQ ID NO: 18133 - DNA, 1701 bp, Sulfolobus acidocaldarius; identical to SEQ ID NO: 4869
  CDS (1)..(1701)

SEQ ID NO: 18134 - protein, 566 aa, Sulfolobus acidocaldarius; identical to SEQ ID NO: 4870

SEQ ID NO: 18135 - DNA, 2793 bp, Triticum aestivum; identical to SEQ ID NO: 4871
  CDS (135)..(2531)

SEQ ID NO: 18136 - protein, 798 aa, Triticum aestivum; identical to SEQ ID NO: 4872

SEQ ID NO: 18137 - DNA, 5346 bp, Triticum aestivum; identical to SEQ ID NO: 4873
  CDS (29)..(4915)

SEQ ID NO: 18138 - protein, 1628 aa, Triticum aestivum; identical to SEQ ID NO: 4874

SEQ ID NO: 18139 - DNA, 2502 bp, Arabidopsis thaliana; identical to SEQ ID NO: 4875
  CDS (1)..(2379)

SEQ ID NO: 18140 - protein, 792 aa, Arabidopsis thaliana; identical to SEQ ID NO: 4876

SEQ ID NO: 18141 - DNA, 2592 bp, Sorghum bicolor; identical to SEQ ID NO: 4877
  CDS (59)..(1948)

SEQ ID NO: 18142 - protein, 629 aa, Sorghum bicolor; identical to SEQ ID NO: 4878

SEQ ID NO: 18143 - DNA, 1815 bp, Triticum turgidum subsp; identical to SEQ ID NO: 4879
  CDS (1)..(1815)

SEQ ID NO: 18144 - protein, 604 aa, Triticum turgidum subsp; identical to SEQ ID NO: 4880

SEQ ID NO: 18145 - DNA, 2575 bp, Manihot esculenta; identical to SEQ ID NO: 4881
  CDS (50)..(2305)

SEQ ID NO: 18146 - protein, 751 aa, Manihot esculenta; identical to SEQ ID NO: 4882

SEQ ID NO: 18147 - DNA, 2842 bp, Triticum aestivum; identical to SEQ ID NO: 4883
  CDS (89)..(2488)

SEQ ID NO: 18148 - protein, 799 aa, Triticum aestivum; identical to SEQ ID NO: 4884

SEQ ID NO: 18149 - DNA, 1818 bp, Triticum monococcum; identical to SEQ ID NO: 4885
  CDS (1)..(1818)

SEQ ID NO: 18150 - protein, 605 aa, Triticum monococcum; identical to SEQ ID NO: 4886

SEQ ID NO: 18151 - DNA, 2081 bp, Triticum aestivum; identical to SEQ ID NO: 4887
  CDS (120)..(1919)

SEQ ID NO: 18152 - protein, 599 aa, Triticum aestivum; identical to SEQ ID NO: 4888

SEQ ID NO: 18153 - DNA, 2591 bp, Triticum aestivum; identical to SEQ ID NO: 4889
  CDS (256)..(2199)

SEQ ID NO: 18154 - protein, 647 aa, Triticum aestivum; identical to SEQ ID NO: 4890

SEQ ID NO: 18155 - DNA, 1872 bp, Oryza sativa; identical to SEQ ID NO: 4891
  CDS (1)..(1872)

SEQ ID NO: 18156 - protein, 623 aa, Oryza sativa; identical to SEQ ID NO: 4892

SEQ ID NO: 18157 - DNA, 2028 bp, Triticum aestivum; identical to SEQ ID NO: 4893
  CDS (30)..(1754)

SEQ ID NO: 18158 - protein, 574 aa, Triticum aestivum; identical to SEQ ID NO: 4894

SEQ ID NO: 18159 - DNA, 3901 bp, Vigna unguiculata; identical to SEQ ID NO: 4895
  CDS (161)..(3604)

SEQ ID NO: 18160 - protein, 1147 aa, Vigna unguiculata; identical to SEQ ID NO: 4896

SEQ ID NO: 18161 - DNA, 3519 bp, Vigna unguiculata; identical to SEQ ID NO: 4897
  CDS (386)..(3010)

SEQ ID NO: 18162 - protein, 874 aa, Vigna unguiculata; identical to SEQ ID NO: 4898

SEQ ID NO: 18163 - DNA, 2221 bp, Phaseolus vulgaris; identical to SEQ ID NO: 4899
  CDS (30)..(1850)

SEQ ID NO: 18164 - protein, 606 aa, Phaseolus vulgaris; identical to SEQ ID NO: 4900

SEQ ID NO: 18165 - DNA, 2107 bp, Astragalus membranaceus; identical to SEQ ID NO: 4901
  CDS (96)..(1919)

SEQ ID NO: 18166 - protein, 607 aa, Astragalus membranaceus; identical to SEQ ID NO: 4902

SEQ ID NO: 18167 - DNA, 1389 bp, Bradyrhizobium japonicum; identical to SEQ ID NO: 4903
  CDS (1)..(1389)

SEQ ID NO: 18168 - protein, 462 aa, Bradyrhizobium japonicum; identical to SEQ ID NO: 4904

SEQ ID NO: 18169 - DNA, 1530 bp, Agrobacterium tumefaciens; identical to SEQ ID NO: 4905
  CDS (1)..(1530)

SEQ ID NO: 18170 - protein, 509 aa, Agrobacterium tumefaciens; identical to SEQ ID NO: 4906

SEQ ID NO: 18171 - DNA, 1449 bp, Bradyrhizobium japonicum; identical to SEQ ID NO: 4907
  CDS (1)..(1449)

SEQ ID NO: 18172 - protein, 482 aa, Bradyrhizobium japonicum; identical to SEQ ID NO: 4908

SEQ ID NO: 18173 - DNA, 1431 bp, Bacillus cereus; identical to SEQ ID NO: 4909
  CDS (1)..(1431)

SEQ ID NO: 18174 - protein, 476 aa, Bacillus cereus; identical to SEQ ID NO: 4910

SEQ ID NO: 18175 - DNA, 1458 bp, Bacillus stearothermophilus; identical to SEQ ID NO: 4911
  CDS (1)..(1458)

SEQ ID NO: 18176 - protein, 485 aa, Bacillus stearothermophilus; identical to SEQ ID NO: 4912

SEQ ID NO: 18177 - DNA, 1533 bp, Bordetella bronchiseptica; identical to SEQ ID NO: 4913
  CDS (1)..(1533)

SEQ ID NO: 18178 - protein, 510 aa, Bordetella bronchiseptica; identical to SEQ ID NO: 4914

SEQ ID NO: 18179 - DNA, 1428 bp, Chlamydophila caviae; identical to SEQ ID NO: 4915
  CDS (1)..(1428)

SEQ ID NO: 18180 - protein, 475 aa, Chlamydophila caviae; identical to SEQ ID NO: 4916

SEQ ID NO: 18181 - DNA, 1467 bp, Chlorobium tepidum; identical to SEQ ID NO: 4917
  CDS (1)..(1467)

SEQ ID NO: 18182 - protein, 488 aa, Chlorobium tepidum; identical to SEQ ID NO: 4918

SEQ ID NO: 18183 - DNA, 1449 bp, Clostridium perfringens; identical to SEQ ID NO: 4919
  CDS (1)..(1449)

SEQ ID NO: 18184 - protein, 482 aa, Clostridium perfringens; identical to SEQ ID NO: 4920

SEQ ID NO: 18185 - DNA, 1335 bp, Deinococcus radiodurans; identical to SEQ ID NO: 4921
  CDS (1)..(1335)

SEQ ID NO: 18186 - protein, 444 aa, Deinococcus radiodurans; identical to SEQ ID NO: 4922

SEQ ID NO: 18187 - DNA, 1386 bp, Fusobacterium nucleatum; identical to SEQ ID NO: 4923
  CDS (1)..(1386)

SEQ ID NO: 18188 - protein, 461 aa, Fusobacterium nucleatum; identical to SEQ ID NO: 4924

SEQ ID NO: 18189 - DNA, 1377 bp, Gloeobacter violaceus; identical to SEQ ID NO: 4925
  CDS (1)..(1377)

SEQ ID NO: 18190 - protein, 458 aa, Gloeobacter violaceus; identical to SEQ ID NO: 4926

SEQ ID NO: 18191 - DNA, 1440 bp, Lactobacillus plantarum; identical to SEQ ID NO: 4927
  CDS (1)..(1440)

SEQ ID NO: 18192 - protein, 479 aa, Lactobacillus plantarum; identical to SEQ ID NO: 4928

SEQ ID NO: 18193 - DNA, 1488 bp, Nitrosomonas europaea; identical to SEQ ID NO: 4929
  CDS (1)..(1488)

SEQ ID NO: 18194 - protein, 495 aa, Nitrosomonas europaea; identical to SEQ ID NO: 4930

SEQ ID NO: 18195 - DNA, 1434 bp, Oceanobacillus iheyensis; identical to SEQ ID NO: 4931
  CDS (1)..(1434)

SEQ ID NO: 18196 - protein, 477 aa, Oceanobacillus iheyensis; identical to SEQ ID NO: 4932

SEQ ID NO: 18197 - DNA, 1443 bp, Pasteurella multocida; identical to SEQ ID NO: 4933
  CDS (1)..(1443)

SEQ ID NO: 18198 - protein, 480 aa, Pasteurella multocida; identical to SEQ ID NO: 4934

SEQ ID NO: 18199 - DNA, 1506 bp, Prochlorococcus marinus; identical to SEQ ID NO: 4935
  CDS (1)..(1506)

SEQ ID NO: 18200 - protein, 501 aa, Prochlorococcus marinus; identical to SEQ ID NO: 4936

SEQ ID NO: 18201 - DNA, 1500 bp, Prochlorococcus marinus; identical to SEQ ID NO: 4937
  CDS (1)..(1500)

SEQ ID NO: 18202 - protein, 499 aa, Prochlorococcus marinus; identical to SEQ ID NO: 4938

SEQ ID NO: 18203 - DNA, 1452 bp, Prochlorococcus marinus subsp; identical to SEQ ID NO: 4939
  CDS (1)..(1452)

SEQ ID NO: 18204 - protein, 483 aa, Prochlorococcus marinus subsp; identical to SEQ ID NO: 4940

SEQ ID NO: 18205 - DNA, 1560 bp, Pseudomonas putida; identical to SEQ ID NO: 4941
  CDS (1)..(1560)

SEQ ID NO: 18206 - protein, 519 aa, Pseudomonas putida; identical to SEQ ID NO: 4942

SEQ ID NO: 18207 - DNA, 1455 bp, Pseudomonas syringae; identical to SEQ ID NO: 4943
  CDS (1)..(1455)

SEQ ID NO: 18208 - protein, 484 aa, Pseudomonas syringae; identical to SEQ ID NO: 4944

SEQ ID NO: 18209 - DNA, 1626 bp, Ralstonia solanacearum; identical to SEQ ID NO: 4945
  CDS (1)..(1626)

SEQ ID NO: 18210 - protein, 541 aa, Ralstonia solanacearum; identical to SEQ ID NO: 4946

SEQ ID NO: 18211 - DNA, 1446 bp, Rhizobium loti; identical to SEQ ID NO: 4947
  CDS (1)..(1446)

SEQ ID NO: 18212 - protein, 481 aa, Rhizobium loti; identical to SEQ ID NO: 4948

SEQ ID NO: 18213 - DNA, 1443 bp, Rhizobium tropici; identical to SEQ ID NO: 4949
  CDS (1)..(1443)

SEQ ID NO: 18214 - protein, 480 aa, Rhizobium tropici; identical to SEQ ID NO: 4950

SEQ ID NO: 18215 - DNA, 1524 bp, Rhodopirellula baltica; identical to SEQ ID NO: 4951
  CDS (1)..(1524)

SEQ ID NO: 18216 - protein, 507 aa, Rhodopirellula baltica; identical to SEQ ID NO: 4952

SEQ ID NO: 18217 - DNA, 1434 bp, Rhodobacter sphaeroides; identical to SEQ ID NO: 4953
  CDS (1)..(1434)

SEQ ID NO: 18218 - protein, 477 aa, Rhodobacter sphaeroides; identical to SEQ ID NO: 4954

SEQ ID NO: 18219 - DNA, 1434 bp, Salmonella typhimurium; identical to SEQ ID NO: 4955
  CDS (1)..(1434)

SEQ ID NO: 18220 - protein, 477 aa, Salmonella typhimurium; identical to SEQ ID NO: 4956

SEQ ID NO: 18221 - DNA, 1431 bp, Streptococcus mutans; identical to SEQ ID NO: 4957
  CDS (1)..(1431)

SEQ ID NO: 18222 - protein, 476 aa, Streptococcus mutans; identical to SEQ ID NO: 4958

SEQ ID NO: 18223 - DNA, 1425 bp, Synechococcus elongatus; identical to SEQ ID NO: 4959
  CDS (1)..(1425)

SEQ ID NO: 18224 - protein, 474 aa, Synechococcus elongatus; identical to SEQ ID NO: 4960

SEQ ID NO: 18225 - DNA, 1398 bp, Synechococcus sp; identical to SEQ ID NO: 4961
  CDS (1)..(1398)

SEQ ID NO: 18226 - protein, 465 aa, Synechococcus sp; identical to SEQ ID NO: 4962

SEQ ID NO: 18227 - DNA, 1542 bp, Synechococcus sp; identical to SEQ ID NO: 4963
  CDS (1)..(1542)

SEQ ID NO: 18228 - protein, 513 aa, Synechococcus sp; identical to SEQ ID NO: 4964

SEQ ID NO: 18229 - DNA, 1317 bp, Thermus caldophilus; identical to SEQ ID NO: 4965
  CDS (1)..(1317)

SEQ ID NO: 18230 - protein, 438 aa, Thermus caldophilus; identical to SEQ ID NO: 4966

SEQ ID NO: 18231 - DNA, 1458 bp, Vibrio parahaemolyticus; identical to SEQ ID NO: 4967
  CDS (1)..(1458)

SEQ ID NO: 18232 - protein, 485 aa, Vibrio parahaemolyticus; identical to SEQ ID NO: 4968

SEQ ID NO: 18233 - DNA, 1458 bp, Vibrio vulnificus; identical to SEQ ID NO: 4969
  CDS (1)..(1458)

SEQ ID NO: 18234 - protein, 485 aa, Vibrio vulnificus; identical to SEQ ID NO: 4970

SEQ ID NO: 18235 - DNA, 1425 bp, Xanthomonas axonopodis; identical to SEQ ID NO: 4971
  CDS (1)..(1425)

SEQ ID NO: 18236 - protein, 474 aa, Xanthomonas axonopodis; identical to SEQ ID NO: 4972

SEQ ID NO: 18237 - DNA, 1425 bp, Xanthomonas campestris; identical to SEQ ID NO: 4973
  CDS (1)..(1425)

SEQ ID NO: 18238 - protein, 474 aa, Xanthomonas campestris; identical to SEQ ID NO: 4974

SEQ ID NO: 18239 - DNA, 2345 bp, Antirrhinum majus; identical to SEQ ID NO: 4975
  CDS (10)..(1836)

SEQ ID NO: 18240 - protein, 608 aa, Antirrhinum majus; identical to SEQ ID NO: 4976

SEQ ID NO: 18241 - DNA, 2211 bp, Ipomoea batatas; identical to SEQ ID NO: 4977
  CDS (93)..(1919)

SEQ ID NO: 18242 - protein, 608 aa, Ipomoea batatas; identical to SEQ ID NO: 4978

SEQ ID NO: 18243 - DNA, 2988 bp, Pisum sativum; identical to SEQ ID NO: 4979
  CDS (140)..(2398)

SEQ ID NO: 18244 - protein, 752 aa, Pisum sativum; identical to SEQ ID NO: 4980

SEQ ID NO: 18245 - DNA, 2329 bp, Arabidopsis thaliana; identical to SEQ ID NO: 4981
  CDS (67)..(2025)

SEQ ID NO: 18246 - protein, 652 aa, Arabidopsis thaliana; identical to SEQ ID NO: 4982

SEQ ID NO: 18247 - DNA, 4127 bp, Solanum tuberosum; identical to SEQ ID NO: 4983
  CDS (143)..(3835)

SEQ ID NO: 18248 - protein, 1230 aa, Solanum tuberosum; identical to SEQ ID NO: 4984

SEQ ID NO: 18249 - DNA, 25 bp, Artificial sequence
  (1)..(25): primer
atgcaggttttacatgtatgttcag

SEQ ID NO: 18250 - DNA, 26 bp, Artificial sequence
  (1)..(26): primer
ttatttcaagcgatagtaaagctcac

SEQ ID NO: 18251 - protein, 56 aa, Artificial sequence; identical to SEQ ID NO: 6176
  Variant (1)..(1): xaa in position 1 is Gly or Ala
  Variant (2)..(4): xaa in position 2 to 4 is any amino acid
  Variant (5)..(5): xaa in position 5 is Ala, Ser or Cys
  Variant (6)..(7): xaa in position 6 to 7 is any amino acid
  Variant (8)..(8): xaa in position 8 is Val, Ile, Leu or Ala
  Variant (9)..(9): xaa in position 9 is any amino acid
  Variant (10)..(10): xaa in position 10 is Thr, Ala or Val
  Variant (13)..(14): xaa in position 13 to 14 is any amino acid
  Variant (15)..(15): xaa in position 15 is Tyr, Met or His
  Variant (16)..(16): xaa in position 16 is Ala, Ser, Leu, Lys or Val
  Variant (17)..(17): xaa in position 17 is any amino acid
  Variant (18)..(18): xaa in position 18 is Glu, Gln or Asp
  Variant (19)..(19): xaa in position 19 is Ile, Leu, Val or Glu
  Variant (20)..(28): xaa in position 20 to 28 is any amino acid
  Variant (29)..(43): xaa in position 29 to 43 is any or no amino acid
  Variant (44)..(44): xaa in position 44 is Gly, Val or Tyr
  Variant (45)..(45): xaa in position 45 is Ile or Val
  Variant (46)..(46): xaa in position 46 is any amino acid
  Variant (49)..(49): xaa in position 49 is Ile, Met, Val, Leu or Cys
  Variant (51)..(52): xaa in position 51 to 52 is any amino acid
  Variant (53)..(53): xaa in position 53 is any or no amino acid
  Variant (54)..(54): xaa in position 54 is Trp, Tyr, Phe or Leu
  Variant (55)..(55): xaa in position 55 is any amino acid
  Variant (56)..(56): xaa in position 56 is Pro or Glu

SEQ ID NO: 18252 - protein, 65 aa, Artificial sequence; identical to SEQ ID NO: 6177
  Variant (1)..(1): xaa in position 1 is Lys, Arg or Phe
  Variant (2)..(4): xaa in position 2 to 4 is any amino acid
  Variant (5)..(5): xaa in position 5 is Lys, Arg, Ala or Glu
  Variant (6)..(7): xaa in position 6 to 7 is any amino acid
  Variant (8)..(8): xaa in position 8 is Leu, Val or Ile
  Variant (9)..(11): xaa in position 9 to 11 is any amino acid
  Variant (12)..(12): xaa in position 12 is Leu, Val, Phe, Met or Thr
  Variant (13)..(13): xaa in position 13 is any amino acid
  Variant (14)..(14): xaa in position 14 is Leu, Ile, Phe or Val
  Variant (15)..(19): xaa in position 15 to 19 is any amino acid
  Variant (20)..(22): xaa in position 20 to 22 is any or no amino acid
  Variant (23)..(23): xaa in position 23 is Leu, Val, Ile or Met
  Variant (24)..(24): xaa in position 24 is Ile, Val, Phe, Leu, Tyr or Met
  Variant (25)..(26): xaa in position 25 to 26 is any amino acid
  Variant (27)..(27): xaa in position 27 is Ile or Val
  Variant (28)..(28): xaa in position 28 is Gly, Ser, Thr, Cys or Ala
  Variant (30)..(30): xaa in position 30 is Leu, Ile or Phe
  Variant (31)..(32): xaa in position 31 to 32 is any amino acid
  Variant (33)..(33): xaa in position 33 is any or no amino acid
  Variant (37)..(37): xaa in position 37 is any amino acid
  Variant (38)..(38): xaa in position 38 is Asp, His or Glu
  Variant (39)..(39): xaa in position 39 is any amino acid
  Variant (40)..(40): xaa in position 40 is Ile, Leu, Val, Met, Ala or Thr
  Variant (41)..(54): xaa in position 41 to 54 is any amino acid
  Variant (55)..(59): xaa in position 55 to 59 is any or no amino acid
  Variant (60)..(60): xaa in position 60 is Val, Ile, Ala, Leu or Tyr
  Variant (61)..(61): xaa in position 61 is Leu, Ile, Val, Met or Cys
  Variant (62)..(62): xaa in position 62 is Leu, Val, Ile or Ala
  Variant (64)..(64): xaa in position 64 is any amino acid
  Variant (65)..(65): xaa in position 65 is Gly, Ala, Ser, Pro or Cys

SEQ ID NO: 18253 - protein, 51 aa, Artificial sequence; identical to SEQ ID NO: 6178
  Variant (1)..(1): xaa in position 1 is Phe, Tyr, Leu or His
  Variant (2)..(5): xaa in position 2 to 5 is any amino acid
  Variant (6)..(6): xaa in position 6 is Ala, Ser, Ile or Val
  Variant (7)..(7): xaa in position 7 is His, Arg or Gln
  Variant (8)..(8): xaa in position 8 is any amino acid
  Variant (9)..(9): xaa in position 9 is Ile, Val, Leu, Met or Ala
  Variant (10)..(10): xaa in position 10 is any amino acid
  Variant (11)..(11): xaa in position 11 is Ala, Gly or Thr
  Variant (12)..(12): xaa in position 12 is Gly, Ala or Ser
  Variant (13)..(13): xaa in position 13 is any amino acid
  Variant (15)..(16): xaa in position 15 to 16 is any amino acid
  Variant (17)..(17): xaa in position 17 is Leu, Ile, Val, Ala, Met or Cys
  Variant (18)..(18): xaa in position 18 is Met, Ile, Val, His or Cys
  Variant (19)..(19): xaa in position 19 is Pro or Thr
  Variant (21)..(21): xaa in position 21 is any amino acid
  Variant (22)..(22): xaa in position 22 is Phe or Tyr
  Variant (24)..(24): xaa in position 24 is Pro or Ala
  Variant (25)..(25): xaa in position 25 is Cys, Phe or Leu
  Variant (27)..(27): xaa in position 27 is Leu or Ile
  Variant (28)..(28): xaa in position 28 is any amino acid
  Variant (29)..(29): xaa in position 29 is Gln, Asn or Pro
  Variant (30)..(30): xaa in position 30 is Leu, Met or Ile
  Variant (31)..(31): xaa in position 31 is any amino acid
  Variant (32)..(32): xaa in position 32 is Ala, Gly or Ser
  Variant (33)..(33): xaa in position 33 is Met, Leu or Gln
  Variant (34)..(34): xaa in position 34 is any amino acid
  Variant (35)..(35): xaa in position 35 is Tyr, Phe, Cys or Leu
  Variant (36)..(36): xaa in position 36 is Gly, Ala or Asn
  Variant (37)..(37): xaa in position 37 is Thr, Ser, Ala or Cys
  Variant (38)..(38): xaa in position 38 is Val, Ile, Leu, Pro or Ala
  Variant (39)..(39): xaa in position 39 is Pro, Cys or Val
  Variant (40)..(40): xaa in position 40 is Ile, Val, Leu or Ala
  Variant (41)..(41): xaa in position 41 is Val, Ala or Cys
  Variant (42)..(42): xaa in position 42 is Arg, His, Ala, Ser or Thr
  Variant (43)..(43): xaa in position 43 is any amino acid
  Variant (44)..(44): xaa in position 44 is Thr or Val
  Variant (47)..(47): xaa in position 47 is Leu or Ile
  Variant (48)..(48): xaa in position 48 is any amino acid
  Variant (49)..(49): xaa in position 49 is Asp or Glu
  Variant (50)..(50): xaa in position 50 is Thr, Ser or Val
  Variant (51)..(51): xaa in position 51 is Val or Ile

SEQ ID NO: 18254 - DNA, 1518 bp, Saccharomyces cerevisiae; identical to SEQ ID NO: 2533
  CDS (1)..(1518)

SEQ ID NO: 18255 - protein, 505 aa, Saccharomyces cerevisiae; identical to SEQ ID NO: 2534

SEQ ID NO: 18256 - DNA, 1548 bp, Mus musculus (house mouse); identical to SEQ ID NO: 2535
  CDS (1)..(1548)

SEQ ID NO: 18257 - protein, 515 aa, Mus musculus (house mouse); identical to SEQ ID NO: 2536

SEQ ID NO: 18258 - DNA, 1593 bp, Fugu rubripes (Japanese pufferfish); identical to SEQ ID NO: 2537
  CDS (1)..(1593)

SEQ ID NO: 18259 - protein, 530 aa, Fugu rubripes (Japanese pufferfish); identical to SEQ ID NO: 2538

SEQ ID NO: 18260 - DNA, 1506 bp, Vibrio cholerae; identical to SEQ ID NO: 2539
  CDS (1)..(1506)

SEQ ID NO: 18261 - protein, 501 aa, Vibrio cholerae; identical to SEQ ID NO: 2540

SEQ ID NO: 18262 - DNA, 1470 bp, Pseudomonas aeruginosa; identical to SEQ ID NO: 2541
  CDS (1)..(1470)

SEQ ID NO: 18263 - protein, 489 aa, Pseudomonas aeruginosa; identical to SEQ ID NO: 2542

SEQ ID NO: 18264 - DNA, 1485 bp, Staphylococcus aureus; identical to SEQ ID NO: 2543
  CDS (1)..(1485)

SEQ ID NO: 18265 - protein, 494 aa, Staphylococcus aureus; identical to SEQ ID NO: 2544

SEQ ID NO: 18266 - DNA, 1488 bp, Streptococcus pneumoniae; identical to SEQ ID NO: 2545
  CDS (1)..(1488)

SEQ ID NO: 18267 - protein, 495 aa, Streptococcus pneumoniae; identical to SEQ ID NO: 2546

SEQ ID NO: 18268 - DNA, 1476 bp, Salmonella enterica subsp. enterica serovar Typhi; identical to SEQ ID NO: 2547
  CDS (1)..(1476)

SEQ ID NO: 18269 - protein, 491 aa, Salmonella enterica subsp. enterica serovar Typhi; identical to SEQ ID NO: 2548

SEQ ID NO: 18270 - DNA, 1476 bp, Agrobacterium tumefaciens; identical to SEQ ID NO: 2549
  CDS (1)..(1476)

SEQ ID NO: 18271 - protein, 491 aa, Agrobacterium tumefaciens; identical to SEQ ID NO: 2550

SEQ ID NO: 18272 - DNA, 1530 bp, Nostoc sp. PCC 7120; identical to SEQ ID NO: 2551
  CDS (1)..(1530)

SEQ ID NO: 18273 - protein, 509 aa, Nostoc sp. PCC 7120; identical to SEQ ID NO: 2552

SEQ ID NO: 18274 - DNA, 1386 bp, Agrobacterium tumefaciens; identical to SEQ ID NO: 2553
  CDS (1)..(1386)

SEQ ID NO: 18275 - protein, 461 aa, Agrobacterium tumefaciens; identical to SEQ ID NO: 2554

SEQ ID NO: 18276 - DNA, 1476 bp, Brucella melitensis; identical to SEQ ID NO: 2555
  CDS (1)..(1476)

SEQ ID NO: 18277 - protein, 491 aa, Brucella melitensis; identical to SEQ ID NO: 2556

SEQ ID NO: 18278 - DNA, 1458 bp, Zymomonas mobilis; identical to SEQ ID NO: 2557
  CDS (1)..(1458)

SEQ ID NO: 18279 - protein, 485 aa, Zymomonas mobilis; identical to SEQ ID NO: 2558

SEQ ID NO: 18280 - DNA, 1470 bp, Bacillus subtilis; identical to SEQ ID NO: 2559
  CDS (1)..(1470)

SEQ ID NO: 18281 - protein, 489 aa, Bacillus subtilis; identical to SEQ ID NO: 2560

SEQ ID NO: 18282 - DNA, 1401 bp, Mycobacterium tuberculosis; identical to SEQ ID NO: 2561
  CDS (1)..(1401)

SEQ ID NO: 18283 - protein, 466 aa, Mycobacterium tuberculosis; identical to SEQ ID NO: 2562

SEQ ID NO: 18284 - DNA, 1545 bp, Mycobacterium tuberculosis; identical to SEQ ID NO: 2563
  CDS (1)..(1545)

SEQ ID NO: 18285 - protein, 514 aa, Mycobacterium tuberculosis; identical to SEQ ID NO: 2564

SEQ ID NO: 18286 - DNA, 1320 bp, Chlamydia trachomatis; identical to SEQ ID NO: 2565
  CDS (1)..(1320)

SEQ ID NO: 18287 - protein, 439 aa, Chlamydia trachomatis; identical to SEQ ID NO: 2566

SEQ ID NO: 18288 - DNA, 1773 bp, Deinococcus radiodurans; identical to SEQ ID NO: 2567
  CDS (1)..(1773)

SEQ ID NO: 18289 - protein, 590 aa, Deinococcus radiodurans; identical to SEQ ID NO: 2568

SEQ ID NO: 18290 - DNA, 1467 bp, Pseudomonas aeruginosa; identical to SEQ ID NO: 2569
  CDS (1)..(1467)

SEQ ID NO: 18291 - protein, 488 aa, Pseudomonas aeruginosa; identical to SEQ ID NO: 2570

SEQ ID NO: 18292 - DNA, 1422 bp, Caulobacter crescentus; identical to SEQ ID NO: 2571
  CDS (1)..(1422)

SEQ ID NO: 18293 - protein, 473 aa, Caulobacter crescentus; identical to SEQ ID NO: 2572

SEQ ID NO: 18294 - DNA, 1437 bp, Borrelia burgdorferi (Lyme disease spirochete); identical to SEQ ID NO: 2573
  CDS (1)..(1437)

SEQ ID NO: 18295 - protein, 478 aa, Borrelia burgdorferi (Lyme disease spirochete); identical to SEQ ID NO: 2574

SEQ ID NO: 18296 - DNA, 1539 bp, Chlamydophila pneumoniae, Chlamydia pneumoniae; identical to SEQ ID NO: 2575
  CDS (1)..(1539)

SEQ ID NO: 18297 - protein, 512 aa, Chlamydophila pneumoniae, Chlamydia pneumoniae; identical to SEQ ID NO: 2576

SEQ ID NO: 18298 - DNA, 1476 bp, Escherichia coli; identical to SEQ ID NO: 2577
  CDS (1)..(1476)

SEQ ID NO: 18299 - protein, 491 aa, Escherichia coli; identical to SEQ ID NO: 2578

SEQ ID NO: 18300 - DNA, 1548 bp, Treponema pallidum subsp. pallidum (syphilis spirochete); identical to SEQ ID NO: 2579
  CDS (1)..(1548)

SEQ ID NO: 18301 - protein, 515 aa, Treponema pallidum subsp. pallidum (syphilis spirochete); identical to SEQ ID NO: 2580

SEQ ID NO: 18302 - DNA, 1476 bp, Buchnera sp; identical to SEQ ID NO: 2581
  CDS (1)..(1476)

SEQ ID NO: 18303 - protein, 491 aa, Buchnera sp; identical to SEQ ID NO: 2582

SEQ ID NO: 18304 - DNA, 1512 bp, Lactococcus lactis subsp. lactis; identical to SEQ ID NO: 2583
  CDS (1)..(1512)

SEQ ID NO: 18305 - protein, 503 aa, Lactococcus lactis subsp. lactis; identical to SEQ ID NO: 2584

SEQ ID NO: 18306 - DNA, 1572 bp, Drosophila melanogaster; identical to SEQ ID NO: 2585
  CDS (1)..(1572)

SEQ ID NO: 18307 - protein, 523 aa, Drosophila melanogaster; identical to SEQ ID NO: 2586

SEQ ID NO: 18308 - DNA, 1575 bp, Synechococcus sp; identical to SEQ ID NO: 2587
  CDS (1)..(1575)

SEQ ID NO: 18309 - protein, 524 aa, Synechococcus sp; identical to SEQ ID NO: 2588

SEQ ID NO: 18310 - DNA, 1485 bp, Haemophilus influenzae; identical to SEQ ID NO: 2589
  CDS (1)..(1485)

SEQ ID NO: 18311 - protein, 494 aa, Haemophilus influenzae; identical to SEQ ID NO: 2590

SEQ ID NO: 18312 - DNA, 1446 bp, Neisseria meningitidis; identical to SEQ ID NO: 2591
  CDS (1)..(1446)

SEQ ID NO: 18313 - protein, 481 aa, Neisseria meningitidis; identical to SEQ ID NO: 2592

SEQ ID NO: 18314 - DNA, 1278 bp, Helicobacter pylori; identical to SEQ ID NO: 2593
  CDS (1)..(1278)

SEQ ID NO: 18315 - protein, 425 aa, Helicobacter pylori; identical to SEQ ID NO: 2594

SEQ ID NO: 18316 - DNA, 1434 bp, Xylella fastidiosa; identical to SEQ ID NO: 2595
  CDS (1)..(1434)

SEQ ID NO: 18317 - protein, 477 aa, Xylella fastidiosa; identical to SEQ ID NO: 2596

SEQ ID NO: 18318 - DNA, 1296 bp, Aquifex aeolicus; identical to SEQ ID NO: 2597
  CDS (1)..(1296)

SEQ ID NO: 18319 - protein, 431 aa, Aquifex aeolicus; identical to SEQ ID NO: 2598

SEQ ID NO: 18320 - DNA, 1491 bp, Thermotoga maritima; identical to SEQ ID NO: 2599
  CDS (1)..(1491)

SEQ ID NO: 18321 - protein, 496 aa, Thermotoga maritima; identical to SEQ ID NO: 2600

SEQ ID NO: 18322 - DNA, 1494 bp, Kluyveromyces marxianus var. lactis, Candida sphaerica; identical to SEQ ID NO: 2601
  CDS (1)..(1494)

SEQ ID NO: 18323 - protein, 497 aa, Kluyveromyces marxianus var. lactis, Candida sphaerica; identical to SEQ ID NO: 2602

SEQ ID NO: 18324 - DNA, 2813 bp, Erwinia chrysanthemi; identical to SEQ ID NO: 2603
  CDS (322)..(1797)

SEQ ID NO: 18325 - protein, 491 aa, Erwinia chrysanthemi; identical to SEQ ID NO: 2604

SEQ ID NO: 18326 - DNA, 3244 bp, Plasmodium falciparum; identical to SEQ ID NO: 2605
  CDS (184)..(2916)

SEQ ID NO: 18327 - protein, 910 aa, Plasmodium falciparum; identical to SEQ ID NO: 2606

SEQ ID NO: 18328 - DNA, 1785 bp, Medicago sativa (alfalfa); identical to SEQ ID NO: 2607
  CDS (38)..(1585)

SEQ ID NO: 18329 - protein, 515 aa, Medicago sativa (alfalfa); identical to SEQ ID NO: 2608

SEQ ID NO: 18330 - DNA, 1689 bp, Solanum tuberosum (potato); identical to SEQ ID NO: 2609
  CDS (46)..(1581)

SEQ ID NO: 18331 - protein, 511 aa, Solanum tuberosum (potato); identical to SEQ ID NO: 2610

SEQ ID NO: 18332 - DNA, 1530 bp, Synechocystis sp; identical to SEQ ID NO: 2611
  CDS (1)..(1530)

SEQ ID NO: 18333 - protein, 509 aa, Synechocystis sp; identical to SEQ ID NO: 2612

SEQ ID NO: 18334 - DNA, 1953 bp, Nicotiana tabacum (common tobacco); identical to SEQ ID NO: 2613
  CDS (43)..(1824)

SEQ ID NO: 18335 - protein, 593 aa, Nicotiana tabacum (common tobacco); identical to SEQ ID NO: 2614

SEQ ID NO: 18336 - DNA, 1869 bp, Nicotiana tabacum (common tobacco); identical to SEQ ID NO: 2615
  CDS (22)..(1788)

SEQ ID NO: 18337 - protein, 588 aa, Nicotiana tabacum (common tobacco); identical to SEQ ID NO: 2616

SEQ ID NO: 18338 - DNA, 2058 bp, Solanum tuberosum (potato); identical to SEQ ID NO: 2617
  CDS (41)..(1774)

SEQ ID NO: 18339 - protein, 577 aa, Solanum tuberosum (potato); identical to SEQ ID NO: 2618

SEQ ID NO: 18340 - DNA, 2049 bp, Spinacia oleracea (spinach); identical to SEQ ID NO: 2619
  CDS (147)..(1871)

SEQ ID NO: 18341 - protein, 574 aa, Spinacia oleracea (spinach); identical to SEQ ID NO: 2620

SEQ ID NO: 18342 - DNA, 2359 bp, Petroselinum crispum (parsley); identical to SEQ ID NO: 2621
  CDS (172)..(1986)

SEQ ID NO: 18343 - protein, 604 aa, Petroselinum crispum (parsley); identical to SEQ ID NO: 2622

SEQ ID NO: 18344 - DNA, 1848 bp, Petroselinum crispum (parsley); identical to SEQ ID NO: 2623
  CDS (41)..(1528)

SEQ ID NO: 18345 - protein, 495 aa, Petroselinum crispum (parsley); identical to SEQ ID NO: 2624

SEQ ID NO: 18346 - DNA, 1957 bp, Petroselinum crispum (parsley); identical to SEQ ID NO: 2625
  CDS (74)..(1678)

SEQ ID NO: 18347 - protein, 534 aa, Petroselinum crispum (parsley); identical to SEQ ID NO: 2626

SEQ ID NO: 18348 - DNA, 1569 bp, Caenorhabditis elegans; identical to SEQ ID NO: 2627
  CDS (1)..(1569)

SEQ ID NO: 18349 - protein, 522 aa, Caenorhabditis elegans; identical to SEQ ID NO: 2628

SEQ ID NO: 18350 - DNA, 1779 bp, Streptomyces coelicolor; identical to SEQ ID NO: 2629
  CDS (1)..(1779)

SEQ ID NO: 18351 - protein, 592 aa, Streptomyces coelicolor; identical to SEQ ID NO: 2630

SEQ ID NO: 18352 - DNA, 1524 bp, Streptomyces coelicolor; identical to SEQ ID NO: 2631
  CDS (1)..(1524)

SEQ ID NO: 18353 - protein, 507 aa, Streptomyces coelicolor; identical to SEQ ID NO: 2632

SEQ ID NO: 18354 - DNA, 1422 bp, Schizosaccharomyces pombe; identical to SEQ ID NO: 2633
  CDS (1)..(1422)

SEQ ID NO: 18355 - protein, 473 aa, Schizosaccharomyces pombe; identical to SEQ ID NO: 2634

SEQ ID NO: 18356 - DNA, 1503 bp, Schizosaccharomyces pombe; identical to SEQ ID NO: 2635
  CDS (1)..(1503)

SEQ ID NO: 18357 - protein, 500 aa, Schizosaccharomyces pombe; identical to SEQ ID NO: 2636

SEQ ID NO: 18358 - DNA, 1428 bp, Schizosaccharomyces pombe; identical to SEQ ID NO: 2637
  CDS (1)..(1428)

SEQ ID NO: 18359 - protein, 475 aa, Schizosaccharomyces pombe; identical to SEQ ID NO: 2638

SEQ ID NO: 18360 - DNA, 1461 bp, Leuconostoc mesenteroides; identical to SEQ ID NO: 2639
  CDS (1)..(1461)

SEQ ID NO: 18361 - protein, 486 aa, Leuconostoc mesenteroides; identical to SEQ ID NO: 2640

SEQ ID NO: 18362 - DNA, 3038 bp, Corynebacterium glutamicum; identical to SEQ ID NO: 2641
  CDS (115)..(1659)

SEQ ID NO: 18363 - protein, 514 aa, Corynebacterium glutamicum; identical to SEQ ID NO: 2642

SEQ ID NO: 18364 - DNA, 1852 bp, Nicotiana tabacum; identical to SEQ ID NO: 2643
  CDS (102)..(1634)

SEQ ID NO: 18365 - protein, 510 aa, Nicotiana tabacum; identical to SEQ ID NO: 2644

SEQ ID NO: 18366 - DNA, 1821 bp, Nicotiana tabacum; identical to SEQ ID NO: 2645
  CDS (88)..(1623)

SEQ ID NO: 18367 - protein, 511 aa, Nicotiana tabacum; identical to SEQ ID NO: 2646

SEQ ID NO: 18368 - DNA, 1808 bp, Chlamydia trachomatis; identical to SEQ ID NO: 2647
  CDS (105)..(1643)

SEQ ID NO: 18369 - protein, 512 aa, Chlamydia trachomatis; identical to SEQ ID NO: 2648

SEQ ID NO: 18370 - DNA, 2750 bp, Plasmodium falciparum; identical to SEQ ID NO: 2649
  CDS (48)..(2258)

SEQ ID NO: 18371 - protein, 736 aa, Plasmodium falciparum; identical to SEQ ID NO: 2650

SEQ ID NO: 18372 - DNA, 1509 bp, Debaryomyces hansenii; identical to SEQ ID NO: 2651
  CDS (1)..(1509)

SEQ ID NO: 18373 - protein, 502 aa, Debaryomyces hansenii; identical to SEQ ID NO: 2652

SEQ ID NO: 18374 - DNA, 1503 bp, Candida glabrata; identical to SEQ ID NO: 2653
  CDS (1)..(1503)

SEQ ID NO: 18375 - protein, 500 aa, Candida glabrata; identical to SEQ ID NO: 2654

SEQ ID NO: 18376 - DNA, 1485 bp, Bacillus thuringiensis serovar konkukian str; identical to SEQ ID NO: 2655
  CDS (1)..(1485)

SEQ ID NO: 18377 - protein, 494 aa, Bacillus thuringiensis serovar konkukian str; identical to SEQ ID NO: 2656

SEQ ID NO: 18378 - DNA, 1554 bp, Oryza sativa; identical to SEQ ID NO: 2657
  CDS (1)..(1554)

SEQ ID NO: 18379 - protein, 517 aa, Oryza sativa; identical to SEQ ID NO: 2658

SEQ ID NO: 18380 - DNA, 1500 bp, Photobacterium profundum; identical to SEQ ID NO: 2659
  CDS (1)..(1500)

SEQ ID NO: 18381 - protein, 499 aa, Photobacterium profundum; identical to SEQ ID NO: 2660

SEQ ID NO: 18382 - DNA, 1551 bp, Parachlamydia sp; identical to SEQ ID NO: 2661
  CDS (1)..(1551)

SEQ ID NO: 18383 - protein, 516 aa, Parachlamydia sp; identical to SEQ ID NO: 2662

SEQ ID NO: 18384 - DNA, 1515 bp, Rhodopseudomonas palustris; identical to SEQ ID NO: 2663
  CDS (1)..(1515)

SEQ ID NO: 18385 - protein, 504 aa, Rhodopseudomonas palustris; identical to SEQ ID NO: 2664

SEQ ID NO: 18386 - DNA, 1650 bp, Corynebacterium diphtheriae; identical to SEQ ID NO: 2665
  CDS (1)..(1650)

SEQ ID NO: 18387 - protein, 549 aa, Corynebacterium diphtheriae; identical to SEQ ID NO: 2666

SEQ ID NO: 18388 - DNA, 1446 bp, uncultured bacterium 581; identical to SEQ ID NO: 2667
  CDS (1)..(1446)

SEQ ID NO: 18389 - protein, 481 aa, uncultured bacterium 581; identical to SEQ ID NO: 2668

SEQ ID NO: 18390 - DNA, 1602 bp, Nonomuraea sp; identical to SEQ ID NO: 2669
  CDS (1)..(1602)

SEQ ID NO: 18391 - protein, 533 aa, Nonomuraea sp; identical to SEQ ID NO: 2670

SEQ ID NO: 18392 - DNA, 1476 bp, Listeria monocytogenes; identical to SEQ ID NO: 2671
  CDS (1)..(1476)

SEQ ID NO: 18393 - protein, 491 aa, Listeria monocytogenes; identical to SEQ ID NO: 2672

SEQ ID NO: 18394 - DNA, 1485 bp, Bacillus cereus; identical to SEQ ID NO: 2673
  CDS (1)..(1485)

SEQ ID NO: 18395 - protein, 494 aa, Bacillus cereus; identical to SEQ ID NO: 2674

SEQ ID NO: 18396 - DNA, 1410 bp, Mycobacterium paratuberculosis; identical to SEQ ID NO: 2675
  CDS (1)..(1410)

SEQ ID NO: 18397 - protein, 469 aa, Mycobacterium paratuberculosis; identical to SEQ ID NO: 2676

SEQ ID NO: 18398 - DNA, 2454 bp, Mycobacterium paratuberculosis; identical to SEQ ID NO: 2677
  CDS (1)..(2454)

SEQ ID NO: 18399 - protein, 817 aa, Mycobacterium paratuberculosis; identical to SEQ ID NO: 2678

SEQ ID NO: 18400 - DNA, 1545 bp, Mycobacterium paratuberculosis; identical to SEQ ID NO: 2679
  CDS (1)..(1545)

SEQ ID NO: 18401 - protein, 514 aa, Mycobacterium paratuberculosis; identical to SEQ ID NO: 2680

SEQ ID NO: 18402 - DNA, 1449 bp, Lactobacillus johnsonii; identical to SEQ ID NO: 2681
  CDS (1)..(1449)

SEQ ID NO: 18403 - protein, 482 aa, Lactobacillus johnsonii; identical to SEQ ID NO: 2682

SEQ ID NO: 18404 - DNA, 1539 bp, Ashbya gossypii; identical to SEQ ID NO: 2683
  CDS (1)..(1539)

SEQ ID NO: 18405 - protein, 512 aa, Ashbya gossypii; identical to SEQ ID NO: 2684

SEQ ID NO: 18406 - DNA, 1734 bp, Oryza sativa; identical to SEQ ID NO: 2685
  CDS (1)..(1734)

SEQ ID NO: 18407 - protein, 577 aa, Oryza sativa; identical to SEQ ID NO: 2686

SEQ ID NO: 18408 - DNA, 1467 bp, Gluconobacter oxydans; identical to SEQ ID NO: 2687
  CDS (1)..(1467)

SEQ ID NO: 18409 - protein, 488 aa, Gluconobacter oxydans; identical to SEQ ID NO: 2688

SEQ ID NO: 18410 - DNA, 1581 bp, Vibrio vulnificus; identical to SEQ ID NO: 2689
  CDS (1)..(1581)

SEQ ID NO: 18411 - protein, 526 aa, Vibrio vulnificus; identical to SEQ ID NO: 2690

SEQ ID NO: 18412 - DNA, 1476 bp, Photorhabdus luminescens; identical to SEQ ID NO: 2691
  CDS (1)..(1476)

SEQ ID NO: 18413 - protein, 491 aa, Photorhabdus luminescens; identical to SEQ ID NO: 2692

SEQ ID NO: 18414 - DNA, 1539 bp, Gloeobacter violaceus; identical to SEQ ID NO: 2693
  CDS (1)..(1539)

SEQ ID NO: 18415 - protein, 512 aa, Gloeobacter violaceus; identical to SEQ ID NO: 2694

SEQ ID NO: 18416 - DNA, 1539 bp, Gloeobacter violaceus; identical to SEQ ID NO: 2695
  CDS (1)..(1539)

SEQ ID NO: 18417 - protein, 512 aa, Gloeobacter violaceus; identical to SEQ ID NO: 2696

SEQ ID NO: 18418 - DNA, 1479 bp, Chromobacterium violaceum; identical to SEQ ID NO: 2697
  CDS (1)..(1479)

SEQ ID NO: 18419 - protein, 492 aa, Chromobacterium violaceum; identical to SEQ ID NO: 2698

SEQ ID NO: 18420 - DNA, 2229 bp, Giardia lamblia ATCC 50803; identical to SEQ ID NO: 2699
  CDS (1)..(2229)

SEQ ID NO: 18421 - protein, 742 aa, Giardia lamblia ATCC 50803; identical to SEQ ID NO: 2700

SEQ ID NO: 18422 - DNA, 2850 bp, Plasmodium yoelii yoelii; identical to SEQ ID NO: 2701
  CDS (1)..(2850)

SEQ ID NO: 18423 - protein, 949 aa, Plasmodium yoelii yoelii; identical to SEQ ID NO: 2702

SEQ ID NO: 18424 - DNA, 1476 bp, Neurospora crassa; identical to SEQ ID NO: 2703
  CDS (1)..(1476)

SEQ ID NO: 18425 - protein, 491 aa, Neurospora crassa; identical to SEQ ID NO: 2704

SEQ ID NO: 18426 - DNA, 1524 bp, Synechococcus sp; identical to SEQ ID NO: 2705
  CDS (1)..(1524)

SEQ ID NO: 18427 - protein, 507 aa, Synechococcus sp; identical to SEQ ID NO: 2706

SEQ ID NO: 18428 - DNA, 1455 bp, Rhodopirellula baltica; identical to SEQ ID NO: 2707
  CDS (1)..(1455)

SEQ ID NO: 18429 - protein, 484 aa, Rhodopirellula baltica; identical to SEQ ID NO: 2708

SEQ ID NO: 18430 - DNA, 1524 bp, Prochlorococcus marinus subsp; identical to SEQ ID NO: 2709
  CDS (1)..(1524)

SEQ ID NO: 18431 - protein, 507 aa, Prochlorococcus marinus subsp; identical to SEQ ID NO: 2710

SEQ ID NO: 18432 - DNA, 1524 bp, Prochlorococcus marinus; identical to SEQ ID NO: 2711
  CDS (1)..(1524)

SEQ ID NO: 18433 - protein, 507 aa, Prochlorococcus marinus; identical to SEQ ID NO: 2712

SEQ ID NO: 18434 - DNA, 1521 bp, Prochlorococcus marinus; identical to SEQ ID NO: 2713
  CDS (1)..(1521)

SEQ ID NO: 18435 - protein, 506 aa, Prochlorococcus marinus; identical to SEQ ID NO: 2714

SEQ ID NO: 18436 - DNA, 1488 bp, Haemophilus ducreyi; identical to SEQ ID NO: 2715
  CDS (1)..(1488)

SEQ ID NO: 18437 - protein, 495 aa, Haemophilus ducreyi; identical to SEQ ID NO: 2716

SEQ ID NO: 18438 - DNA, 1497 bp, Candidatus Blochmannia floridanus; identical to SEQ ID NO: 2717
  CDS (1)..(1497)

SEQ ID NO: 18439 - protein, 498 aa, Candidatus Blochmannia floridanus; identical to SEQ ID NO: 2718

SEQ ID NO: 18440 - DNA, 1768 bp, Oryza sativa; identical to SEQ ID NO: 2719
  CDS (2)..(1768)

SEQ ID NO: 18441 - protein, 588 aa, Oryza sativa; identical to SEQ ID NO: 2720

SEQ ID NO: 18442 - DNA, 1548 bp, Bos indicus; identical to SEQ ID NO: 2721
  CDS (1)..(1548)

SEQ ID NO: 18443 - protein, 515 aa, Bos indicus; identical to SEQ ID NO: 2722

SEQ ID NO: 18444 - DNA, 1536 bp, Chlamydophila caviae; identical to SEQ ID NO: 2723
  CDS (1)..(1536)

SEQ ID NO: 18445 - protein, 511 aa, Chlamydophila caviae; identical to SEQ ID NO: 2724

SEQ ID NO: 18446 - DNA, 1524 bp, Streptomyces avermitilis; identical to SEQ ID NO: 2725
  CDS (1)..(1524)

SEQ ID NO: 18447 - protein, 507 aa, Streptomyces avermitilis; identical to SEQ ID NO: 2726

SEQ ID NO: 18448 - DNA, 1647 bp, Streptomyces avermitilis; identical to SEQ ID NO: 2727
  CDS (1)..(1647)

SEQ ID NO: 18449 - protein, 548 aa, Streptomyces avermitilis; identical to SEQ ID NO: 2728

SEQ ID NO: 18450 - DNA, 1491 bp, Nitrosomonas europaea; identical to SEQ ID NO: 2729
  CDS (1)..(1491)

SEQ ID NO: 18451 - protein, 496 aa, Nitrosomonas europaea; identical to SEQ ID NO: 2730

SEQ ID NO: 18452 - DNA, 1524 bp, Enterococcus faecalis; identical to SEQ ID NO: 2731
  CDS (1)..(1524)

SEQ ID NO: 18453 - protein, 507 aa, Enterococcus faecalis; identical to SEQ ID NO: 2732

SEQ ID NO: 18454 - DNA, 1464 bp, Tropheryma whipplei; identical to SEQ ID NO: 2733
  CDS (1)..(1464)

SEQ ID NO: 18455 - protein, 487 aa, Tropheryma whipplei; identical to SEQ ID NO: 2734

SEQ ID NO: 18456 - DNA, 2145 bp, Leishmania mexicana; identical to SEQ ID NO: 2735
  CDS (298)..(1986)

SEQ ID NO: 18457 - protein, 562 aa, Leishmania mexicana; identical to SEQ ID NO: 2736

SEQ ID NO: 18458 - DNA, 1494 bp, Dictyostelium discoideum; identical to SEQ ID NO: 2737
  CDS (1)..(1494)

SEQ ID NO: 18459 - protein, 497 aa, Dictyostelium discoideum; identical to SEQ ID NO: 2738

SEQ ID NO: 18460 - DNA, 1503 bp, Xylella fastidiosa; identical to SEQ ID NO: 2739
  CDS (1)..(1503)

SEQ ID NO: 18461 - protein, 500 aa, Xylella fastidiosa; identical to SEQ ID NO: 2740

SEQ ID NO: 18462 - DNA, 1506 bp, Vibrio parahaemolyticus; identical to SEQ ID NO: 2741
  CDS (1)..(1506)

SEQ ID NO: 18463 - protein, 501 aa, Vibrio parahaemolyticus; identical to SEQ ID NO: 2742

SEQ ID NO: 18464 - DNA, 1533 bp, Pseudomonas syringae; identical to SEQ ID NO: 2743
  CDS (1)..(1533)

SEQ ID NO: 18465 - protein, 510 aa, Pseudomonas syringae; identical to SEQ ID NO: 2744

SEQ ID NO: 18466 - DNA, 1470 bp, Pseudomonas syringae; identical to SEQ ID NO: 2745
  CDS (1)..(1470)

SEQ ID NO: 18467 - protein, 489 aa, Pseudomonas syringae; identical to SEQ ID NO: 2746

SEQ ID NO: 18468 - DNA, 1458 bp, Pseudomonas putida; identical to SEQ ID NO: 2747
  CDS (1)..(1458)

SEQ ID NO: 18469 - protein, 485 aa, Pseudomonas putida; identical to SEQ ID NO: 2748

SEQ ID NO: 18470 - DNA, 1506 bp, Pseudomonas putida; identical to SEQ ID NO: 2749
  CDS (1)..(1506)

SEQ ID NO: 18471 - protein, 501 aa, Pseudomonas putida; identical to SEQ ID NO: 2750

SEQ ID NO: 18472 - DNA, 1470 bp, Pseudomonas putida; identical to SEQ ID NO: 2751
  CDS (1)..(1470)

SEQ ID NO: 18473 - protein, 489 aa, Pseudomonas putida; identical to SEQ ID NO: 2752

SEQ ID NO: 18474 - DNA, 1485 bp, Lactobacillus plantarum; identical to SEQ ID NO: 2753
  CDS (1)..(1485)

SEQ ID NO: 18475 - protein, 494 aa, Lactobacillus plantarum; identical to SEQ ID NO: 2754

SEQ ID NO: 18476 - DNA, 1440 bp, Clostridium tetani; identical to SEQ ID NO: 2755
  CDS (1)..(1440)

SEQ ID NO: 18477 - protein, 479 aa, Clostridium tetani; identical to SEQ ID NO: 2756

SEQ ID NO: 18478 - DNA, 1512 bp, Bradyrhizobium japonicum; identical to SEQ ID NO: 2757
  CDS (1)..(1512)

SEQ ID NO: 18479 - protein, 503 aa, Bradyrhizobium japonicum; identical to SEQ ID NO: 2758

SEQ ID NO: 18480 - DNA, 1497 bp, Bacteroides thetaiotaomicron; identical to SEQ ID NO: 2759
  CDS (1)..(1497)

SEQ ID NO: 18481 - protein, 498 aa, Bacteroides thetaiotaomicron; identical to SEQ ID NO: 2760

SEQ ID NO: 18482 - DNA, 4583 bp, Mus musculus; identical to SEQ ID NO: 2761
  CDS (119)..(2488)

SEQ ID NO: 18483 - protein, 789 aa, Mus musculus; identical to SEQ ID NO: 2762

SEQ ID NO: 18484 - DNA, 1485 bp, Staphylococcus epidermidis; identical to SEQ ID NO: 2763
  CDS (1)..(1485)

SEQ ID NO: 18485 - protein, 494 aa, Staphylococcus epidermidis; identical to SEQ ID NO: 2764

SEQ ID NO: 18486 - DNA, 1590 bp, Yersinia pestis; identical to SEQ ID NO: 2765
  CDS (1)..(1590)

SEQ ID NO: 18487 - protein, 529 aa, Yersinia pestis; identical to SEQ ID NO: 2766

SEQ ID NO: 18488 - DNA, 1530 bp, Synechococcus elongatus; identical to SEQ ID NO: 2767
  CDS (1)..(1530)

SEQ ID NO: 18489 - protein, 509 aa, Synechococcus elongatus; identical to SEQ ID NO: 2768

SEQ ID NO: 18490 - DNA, 1473 bp, Shewanella oneidensis; identical to SEQ ID NO: 2769
  CDS (1)..(1473)

SEQ ID NO: 18491 - protein, 490 aa, Shewanella oneidensis; identical to SEQ ID NO: 2770

SEQ ID NO: 18492 - DNA, 1476 bp, Oceanobacillus iheyensis; identical to SEQ ID NO: 2771
  CDS (1)..(1476)

SEQ ID NO: 18493 - protein, 491 aa, Oceanobacillus iheyensis; identical to SEQ ID NO: 2772

SEQ ID NO: 18494 - DNA, 1344 bp, Corynebacterium efficiens; identical to SEQ ID NO: 2773
  CDS (1)..(1344)

SEQ ID NO: 18495 - protein, 447 aa, Corynebacterium efficiens; identical to SEQ ID NO: 2774

SEQ ID NO: 18496 - DNA, 1545 bp, Corynebacterium efficiens; identical to SEQ ID NO: 2775
  CDS (1)..(1545)

SEQ ID NO: 18497 - protein, 514 aa, Corynebacterium efficiens; identical to SEQ ID NO: 2776

SEQ ID NO: 18498 - DNA, 1668 bp, Bifidobacterium longum; identical to SEQ ID NO: 2777
  CDS (1)..(1668)

SEQ ID NO: 18499 - protein, 555 aa, Bifidobacterium longum; identical to SEQ ID NO: 2778

SEQ ID NO: 18500 - DNA, 1284 bp, Rhodococcus opacus; identical to SEQ ID NO: 2779
  CDS (1)..(1284)

SEQ ID NO: 18501 - protein, 427 aa, Rhodococcus opacus; identical to SEQ ID NO: 2780

SEQ ID NO: 18502 - DNA, 2879 bp, Leishmania guyanensis; identical to SEQ ID NO: 2781
  CDS (205)..(1893): n means a or g or c or t/u, s means g or c

SEQ ID NO: 18503 - protein, 562 aa, Leishmania guyanensis; identical to SEQ ID NO: 2782

SEQ ID NO: 18504 - DNA, 1689 bp, Leishmania mexicana; identical to SEQ ID NO: 2783
  CDS (1)..(1689): n means a or g or c or t/u, s means g or c

SEQ ID NO: 18505 - protein, 562 aa, Leishmania mexicana; identical to SEQ ID NO: 2784
  Xaa in position 76-148 and 492-510 is unknown

SEQ ID NO: 18506 - DNA, 2916 bp, Leishmania amazonensis; identical to SEQ ID NO: 2785
  CDS (207)..(1895): n means a or g or c or t/u, y means t/u or c

SEQ ID NO: 18507 - protein, 562 aa, Leishmania amazonensis; identical to SEQ ID NO: 2786
  Xaa in position 462 and 481 is unknown

SEQ ID NO: 18508 - DNA, 1440 bp, Chlorobium tepidum; identical to SEQ ID NO: 2787
  CDS (1)..(1440)

SEQ ID NO: 18509 - protein, 479 aa, Chlorobium tepidum; identical to SEQ ID NO: 2788

SEQ ID NO: 18510 - DNA, 2187 bp, Methylobacterium extorquens; identical to SEQ ID NO: 2789
  CDS (640)..(2187)

SEQ ID NO: 18511 - protein, 515 aa, Methylobacterium extorquens; identical to SEQ ID NO: 2790

SEQ ID NO: 18512 - DNA, 1476 bp, Bartonella henselae; identical to SEQ ID NO: 2791
  CDS (1)..(1476)

SEQ ID NO: 18513 - protein, 491 aa, Bartonella henselae; identical to SEQ ID NO: 2792

SEQ ID NO: 18514 - DNA, 2266 bp, Toxoplasma gondii; identical to SEQ ID NO: 2793
  CDS (169)..(1851)

SEQ ID NO: 18515 - protein, 560 aa, Toxoplasma gondii; identical to SEQ ID NO: 2794

SEQ ID NO: 18516 - DNA, 1923 bp, Xanthomonas campestris; identical to SEQ ID NO: 2795
  CDS (1)..(1923)

SEQ ID NO: 18517 - protein, 640 aa, Xanthomonas campestris; identical to SEQ ID NO: 2796

SEQ ID NO: 18518 - DNA, 1431 bp, Xanthomonas campestris; identical to SEQ ID NO: 2797
  CDS (1)..(1431)

SEQ ID NO: 18519 - protein, 476 aa, Xanthomonas campestris; identical to SEQ ID NO: 2798

SEQ ID NO: 18520 - DNA, 1839 bp, Xanthomonas axonopodis; identical to SEQ ID NO: 2799
  CDS (1)..(1839)

SEQ ID NO: 18521 - protein, 612 aa, Xanthomonas axonopodis; identical to SEQ ID NO: 2800

SEQ ID NO: 18522 - DNA, 1431 bp, Xanthomonas axonopodis; identical to SEQ ID NO: 2801
  CDS (1)..(1431)

SEQ ID NO: 18523 - protein, 476 aa, Xanthomonas axonopodis; identical to SEQ ID NO: 2802

SEQ ID NO: 18524 - DNA, 1458 bp, Thermoanaerobacter tengcongensis; identical to SEQ ID NO: 2803
  CDS (1)..(1458)

SEQ ID NO: 18525 - protein, 485 aa, Thermoanaerobacter tengcongensis; identical to SEQ ID NO: 2804

SEQ ID NO: 18526 - DNA, 1762 bp, Oryza sativa; identical to SEQ ID NO: 2805
  CDS (41)..(1558)

SEQ ID NO: 18527 - protein, 505 aa, Oryza sativa; identical to SEQ ID NO: 2806

SEQ ID NO: 18528 - DNA, 1305 bp, Encephalitozoon cuniculi; identical to SEQ ID NO: 2807
  CDS (1)..(1305)

SEQ ID NO: 18529 - protein, 434 aa, Encephalitozoon cuniculi; identical to SEQ ID NO: 2808

SEQ ID NO: 18530 - DNA, 2125 bp, Drosophila melanogaster; identical to SEQ ID NO: 2809
  CDS (158)..(1738)

SEQ ID NO: 18531 - protein, 526 aa, Drosophila melanogaster; identical to SEQ ID NO: 2810

SEQ ID NO: 18532 - DNA, 1470 bp, Ralstonia solanacearum; identical to SEQ ID NO: 2811
  CDS (1)..(1470)

SEQ ID NO: 18533 - protein, 489 aa, Ralstonia solanacearum; identical to SEQ ID NO: 2812

SEQ ID NO: 18534 - DNA, 1521 bp, Enterococcus mundtii; identical to SEQ ID NO: 2813
  CDS (1)..(1521)

SEQ ID NO: 18535 - protein, 506 aa, Enterococcus mundtii; identical to SEQ ID NO: 2814

SEQ ID NO: 18536 - DNA, 2230 bp, Homo sapiens; identical to SEQ ID NO: 2815
  CDS (54)..(1601)

SEQ ID NO: 18537 - protein, 515 aa, Homo sapiens [sequence omitted]

SEQ ID NO: 18538 - DNA, 1470 bp, Rhizobium loti; identical to SEQ ID NO: 2817
  CDS (1)..(1470)

SEQ ID NO: 18539 - protein, 489 aa, Rhizobium loti; identical to SEQ ID NO: 2818

SEQ ID NO: 18540 - DNA, 1428 bp, Rhizobium loti; identical to SEQ ID NO: 2819
  CDS (1)..(1428)

SEQ ID NO: 18541 - protein, 475 aa, Rhizobium loti; identical to SEQ ID NO: 2820

SEQ ID NO: 18542 - DNA, 3584 bp, Plasmodium berghei; identical to SEQ ID NO: 2821
  CDS (370)..(3222)

SEQ ID NO: 18543 - protein, 950 aa, Plasmodium berghei; identical to SEQ ID NO: 2822

SEQ ID NO: 18544 - DNA, 1491 bp, Pasteurella multocida; identical to SEQ ID NO: 2823
  CDS (1)..(1491)

SEQ ID NO: 18545 - protein, 496 aa, Pasteurella multocida; identical to SEQ ID NO: 2824

SEQ ID NO: 18546 - DNA, 1470 bp, Pseudomonas putida; identical to SEQ ID NO: 2825
  CDS (1)..(1470)

SEQ ID NO: 18547 - protein, 489 aa, Pseudomonas putida; identical to SEQ ID NO: 2826

SEQ ID NO: 18548 - DNA, 1566 bp, Trypanosoma brucei; identical to SEQ ID NO: 2827
  CDS (1)..(1566)

SEQ ID NO: 18549 - protein, 521 aa, Trypanosoma brucei; identical to SEQ ID NO: 2828

SEQ ID NO: 18550 - DNA, 1904 bp, Triticum aestivum; identical to SEQ ID NO: 2829
  CDS (153)..(1682)

SEQ ID NO: 18551 - protein, 509 aa, Triticum aestivum; identical to SEQ ID NO: 2830

SEQ ID NO: 18552 - DNA, 2098 bp, Solanum tuberosum; identical to SEQ ID NO: 2831
  CDS (27)..(1775)

SEQ ID NO: 18553 - protein, 582 aa, Solanum tuberosum; identical to SEQ ID NO: 2832

SEQ ID NO: 18554 - DNA, 1924 bp, Dunaliella bioculata; identical to SEQ ID NO: 2833
  CDS (68)..(1840)

SEQ ID NO: 18555 - protein, 590 aa, Dunaliella bioculata; identical to SEQ ID NO: 2834

SEQ ID NO: 18556 - DNA, 1976 bp, Cyanidium caldarium; identical to SEQ ID NO: 2835
  CDS (46)..(1848)

SEQ ID NO: 18557 - protein, 600 aa, Cyanidium caldarium; identical to SEQ ID NO: 2836

SEQ ID NO: 18558 - DNA, 2106 bp, Drosophila melanogaster; identical to SEQ ID NO: 2837
  CDS (28)..(1746)

SEQ ID NO: 18559 - protein, 572 aa, Drosophila melanogaster; identical to SEQ ID NO: 2838

SEQ ID NO: 18560 - DNA, 1777 bp, Mesembryanthemum crystallinum; identical to SEQ ID NO: 2839
  CDS (39)..(1589)

SEQ ID NO: 18561 - protein, 516 aa, Mesembryanthemum crystallinum; identical to SEQ ID NO: 2840

SEQ ID NO: 18562 - DNA, 1542 bp, Mus musculus; identical to SEQ ID NO: 2841
  CDS (1)..(1542)

SEQ ID NO: 18563 - protein, 513 aa, Mus musculus; identical to SEQ ID NO: 2842

SEQ ID NO: 18564 - DNA, 1485 bp, Actinobacillus actinomycetemcomitans; identical to SEQ ID NO: 2843
  CDS (1)..(1485)

SEQ ID NO: 18565 - protein, 494 aa, Actinobacillus actinomycetemcomitans; identical to SEQ ID NO: 2844

SEQ ID NO: 18566 - DNA, 1473 bp, Buchnera aphidicola; identical to SEQ ID NO: 2845
  CDS (1)..(1473)

SEQ ID NO: 18567 - protein, 490 aa, Buchnera aphidicola; identical to SEQ ID NO: 2846

SEQ ID NO: 18568 - DNA, 1473 bp, Buchnera aphidicola; identical to SEQ ID NO: 2847
  CDS (1)..(1473)

SEQ ID NO: 18569 - protein, 490 aa, Buchnera aphidicola; identical to SEQ ID NO: 2848

SEQ ID NO: 18570 - DNA, 2049 bp, Ceratitis capitata; identical to SEQ ID NO: 2849
  CDS (60)..(1640)

SEQ ID NO: 18571 - protein, 526 aa, Ceratitis capitata; identical to SEQ ID NO: 2850

SEQ ID NO: 18572 - DNA, 1524 bp, Chlamydia muridarum; identical to SEQ ID NO: 2851
  CDS (1)..(1524)

SEQ ID NO: 18573 - protein, 507 aa, Chlamydia muridarum; identical to SEQ ID NO: 2852

SEQ ID NO: 18574 - DNA, 2062 bp, Drosophila melanogaster; identical to SEQ ID NO: 2853
  CDS (303)..(1877)

SEQ ID NO: 18575 - protein, 524 aa, Drosophila melanogaster; identical to SEQ ID NO: 2854

SEQ ID NO: 18576 - DNA, 1536 bp, Emericella nidulans; identical to SEQ ID NO: 2855
  CDS (1)..(1536)

SEQ ID NO: 18577 - protein, 511 aa, Emericella nidulans; identical to SEQ ID NO: 2856

SEQ ID NO: 18578 - DNA, 1957 bp, Leuconostoc mesenteroides; identical to SEQ ID NO: 2857
  CDS (206)..(1666)

SEQ ID NO: 18579 - protein, 486 aa, Leuconostoc mesenteroides; identical to SEQ ID NO: 2858

SEQ ID NO: 18580 - DNA, 2055 bp, Macropus robustus; identical to SEQ ID NO: 2859
  CDS (94)..(1641)

SEQ ID NO: 18581 - protein, 515 aa, Macropus robustus; identical to SEQ ID NO: 2860

SEQ ID NO: 18582 - DNA, 1530 bp, Nostoc punctiforme; identical to SEQ ID NO: 2861
  CDS (1)..(1530)

SEQ ID NO: 18583 - protein, 509 aa, Nostoc punctiforme; identical to SEQ ID NO: 2862

SEQ ID NO: 18584 - DNA, 1476 bp, Rhizobium meliloti; identical to SEQ ID NO: 2863
  CDS (1)..(1476)

SEQ ID NO: 18585 - protein, 491 aa, Rhizobium meliloti; identical to SEQ ID NO: 2864

SEQ ID NO: 18586 - DNA, 2853 bp, Homo sapiens; identical to SEQ ID NO: 2865
  CDS (273)..(2648)

SEQ ID NO: 18587 - protein, 791 aa, Homo sapiens; identical to SEQ ID NO: 2866

SEQ ID NO: 18588 - DNA, 1970 bp, Arabidopsis thaliana; identical to SEQ ID NO: 2867
  CDS (60)..(1790)

SEQ ID NO: 18589 - protein, 576 aa, Arabidopsis thaliana; identical to SEQ ID NO: 2868

SEQ ID NO: 18590 - DNA, 2112 bp, Arabidopsis thaliana; identical to SEQ ID NO: 2869
  CDS (142)..(1932)

SEQ ID NO: 18591 - protein, 596 aa, Arabidopsis thaliana; identical to SEQ ID NO: 2870

SEQ ID NO: 18592 - DNA, 2161 bp, Arabidopsis thaliana; identical to SEQ ID NO: 2871
  CDS (90)..(1967)

SEQ ID NO: 18593 - protein, 625 aa, Arabidopsis thaliana; identical to SEQ ID NO: 2872

SEQ ID NO: 18594 - DNA, 1936 bp, Arabidopsis thaliana; identical to SEQ ID NO: 2873
  CDS (136)..(1686)

SEQ ID NO: 18595 - protein, 516 aa, Arabidopsis thaliana; identical to SEQ ID NO: 2874

SEQ ID NO: 18596 - DNA, 1959 bp, Arabidopsis thaliana; identical to SEQ ID NO: 2875
  CDS (194)..(1741)

SEQ ID NO: 18597 - protein, 515 aa, Arabidopsis thaliana [sequence omitted]

SEQ ID NO: 18598 - DNA, 1503 bp, Xenopus laevis; identical to SEQ ID NO: 2877
  CDS (1)..(1503)

SEQ ID NO: 18599 - protein, 500 aa, Xenopus laevis; identical to SEQ ID NO: 2878

SEQ ID NO: 18600 - DNA, 2004 bp, Arabidopsis thaliana; identical to SEQ ID NO: 2879
  CDS (51)..(1850)

SEQ ID NO: 18601 - protein, 599 aa, Arabidopsis thaliana; identical to SEQ ID NO: 2880

SEQ ID NO: 18602 - DNA, 23 bp, Artificial sequence
  (1)..(23): primer
atgagtgaaggccccgtcaaatt

SEQ ID NO: 18603 - DNA, 25 bp, Artificial sequence
  (1)..(25): primer
ctaattatccttcgtatcttctggc

SEQ ID NO: 18604 - protein, 806 aa, Artificial sequence
  Variant (2)..(3): xaa in position 2 to 3 is any amino acid
  Variant (7)..(9): xaa in position 7 to 9 is any amino acid
  Variant (11)..(12): xaa in position 11 to 12 is any amino acid
  Variant (14)..(17): xaa in position 14 to 17 is any amino acid
  Variant (19)..(23): xaa in position 19 to 23 is any amino acid
  Variant (25)..(32): xaa in position 25 to 32 is any amino acid
  Variant (34)..(35): xaa in position 34 to 35 is any amino acid
  Variant (37)..(81): xaa in position 37 to 81 is any amino acid
  Variant (83)..(95): xaa in position 83 to 95 is any amino acid
  Variant (97)..(225): xaa in position 97 to 225 is any amino acid
  Variant (227)..(230): xaa in position 227 to 230 is any amino acid
  Variant (232)..(258): xaa in position 232 to 258 is any amino acid
  Variant (260)..(262): xaa in position 260 to 262 is any amino acid
  Variant (266)..(266): xaa in position 266 is any amino acid
  Variant (268)..(268): xaa in position 268 is any amino acid
  Variant (270)..(271): xaa in position 270 to 271 is any amino acid
  Variant (273)..(275): xaa in position 273 to 275 is any amino acid
  Variant (277)..(285): xaa in position 277 to 285 is any amino acid
  Variant (287)..(290): xaa in position 287 to 290 is any amino acid
  Variant (300)..(300): xaa in position 300 is any amino acid
  Variant (302)..(302): xaa in position 302 is any amino acid
  Variant (304)..(307): xaa in position 304 to 307 is any amino acid
  Variant (310)..(310): xaa in position 310 is any amino acid
  Variant (312)..(318): xaa in position 312 to 318 is any amino acid
  Variant (321)..(323): xaa in position 321 to 323 is any amino acid
  Variant (325)..(328): xaa in position 325 to 328 is any amino acid
  Variant (330)..(332): xaa in position 330 to 332 is any amino acid
  Variant (334)..(335): xaa in position 334 to 335 is any amino acid
  Variant (337)..(339): xaa in position 337 to 339 is any amino acid
  Variant (341)..(342): xaa in position 341 to 342 is any amino acid
  Variant (344)..(347): xaa in position 344 to 347 is any amino acid
  Variant (349)..(351): xaa in position 349 to 351 is any amino acid
  Variant (354)..(355): xaa in position 354 to 355 is any amino acid
  Variant (359)..(360): xaa in position 359 to 360 is any amino acid
  Variant (362)..(366): xaa in position 362 to 366 is any amino acid
  Variant (370)..(370): xaa in position 370 is any amino acid
  Variant (372)..(382): xaa in position 372 to 382 is any amino acid
  Variant (385)..(385): xaa in position 385 is any amino acid
  Variant (387)..(387): xaa in position 387 is any amino acid
  Variant (389)..(405): xaa in position 389 to 405 is any amino acid
  Variant (409)..(438): xaa in position 409 to 438 is any amino acid
  Variant (440)..(451): xaa in position 440 to 451 is any amino acid
  Variant (453)..(455): xaa in position 453 to 455 is any amino acid
  Variant (457)..(465): xaa in position 457 to 465 is any amino acid
  Variant (467)..(467): xaa in position 467 is any amino acid
  Variant (470)..(470): xaa in position 470 is any amino acid
  Variant (475)..(478): xaa in position 475 to 478 is any amino acid
  Variant (481)..(493): xaa in position 481 to 493 is any amino acid
  Variant (495)..(524): xaa in position 495 to 524 is any amino acid
  Variant (526)..(531): xaa in position 526 to 531 is any amino acid
  Variant (534)..(534): xaa in position 534 is any amino acid
  Variant (536)..(543): xaa in position 536 to 543 is any amino acid
  Variant (545)..(545): xaa in position 545 is any amino acid
  Variant (548)..(588): xaa in position 548 to 588 is any amino acid
  Variant (592)..(592): xaa in position 592 is any amino acid
  Variant (594)..(595): xaa in position 594 to 595 is any amino acid
  Variant (597)..(599): xaa in position 597 to 599 is any amino acid
  Variant (601)..(604): xaa in position 601 to 604 is any amino acid
  Variant (606)..(609): xaa in position 606 to 609 is any amino acid
  Variant (611)..(614): xaa in position 611 to 614 is any amino acid
  Variant (616)..(797): xaa in position 616 to 797 is any amino acid
  Variant (799)..(800): xaa in position 799 to 800 is any amino acid
  Variant (802)..(805): xaa in position 802 to 805 is any amino acid
GXXGDLXXXKXXPXXXXLXXXXXLXXXXXXXXGXXRXXXXXXXXXXXXXXXXXXXXXXXXXXXXXXXXXXXXXXXXXXXXXYXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXPXXXXXXXXXXXXXXXXXXXXXXXXXXXRXXXEKPXGXDXXSXXXLXXXXXXXXXEXXXXRIDHYLGKEXVXNXXXXRFXNXXXXXXXWNXXXIXXXXIXXXEXXGXXXRXXYXXXXGXXXRDXXQNHXXQXXXXXAMEXPXXXXXXXXXXXEKXKXLXXXXXXXXXXXXXXXXXGQYXXXXXXXXXXXXXXXXXXXXXXXXXXXXXXYXXXXXXXXXXXXSXXXTXXXXXXXXXNXRWXGVPFXXXXGKXXXXXXXXXXXXXFXXXXXXXXXXXXXXXXXXXXXXXXXXXXXXNXXXXXXQPXEXXXXXXXXKXPGXXXXXXXXXXXXXXXXXXXXXXXXXXXXXXXXXXXXXXXXXAYEXLXXDXXXGXXXXFXXXXEXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXGXXXXP

SEQ ID NO: 18605 - protein, 150 aa, Artificial sequence; identical to SEQ ID NO: 2917
  Variant (1)..(1): xaa in position 1 is Arg or Lys
  Variant (2)..(2): xaa in position 2 is Val, Ile, Leu or Ala
  Variant (3)..(3): xaa in position 3 is Ile, Val, Met or Ala
  Variant (4)..(4): xaa in position 4 is Ile, Val, Leu, Met or Ala
  Variant (8)..(8): xaa in position 8 is Phe, Ile, Leu or Tyr
  Variant (9)..(9): xaa in position 9 is Gly or Ala
  Variant (10)..(10): xaa in position 10 is any amino acid
  Variant (11)..(11): xaa in position 11 is Asp, Ser or Asn
  Variant (12)..(13): xaa in position 12 to 13 is any amino acid
  Variant (14)..(14): xaa in position 14 is Ser, Thr or Asn
  Variant (15)..(15): xaa in position 15 is Ala, Ser, Phe or Tyr
  Variant (16)..(17): xaa in position 16 to 17 is any amino acid
  Variant (18)..(18): xaa in position 18 is Leu, Ile, Val or Phe
  Variant (19)..(21): xaa in position 19 to 21 is any amino acid
  Variant (22)..(22): xaa in position 22 is Leu, Ile or Val
  Variant (23)..(27): xaa in position 23 to 27 is any amino acid
  Variant (28)..(28): xaa in position 28 is Glu, Asp, Pro or Ser
  Variant (29)..(30): xaa in position 29 to 30 is any amino acid
  Variant (31)..(31): xaa in position 31 is Ile, Val, Leu, Thr or Met
  Variant (32)..(32): xaa in position 32 is Tyr, Phe or Leu
  Variant (33)..(33): xaa in position 33 is Arg, His or Leu
  Variant (34)..(34): xaa in position 34 is Ile, Val, Met or Leu
  Variant (37)..(37): xaa in position 37 is Tyr or Phe
  Variant (39)..(39): xaa in position 39 is Gly, Ser or Ala
  Variant (40)..(40): xaa in position 40 is Lys, Arg or Glu
  Variant (41)..(42): xaa in position 41 to 42 is any amino acid
  Variant (43)..(43): xaa in position 43 is Val, Ile, Leu, Ala or Met
  Variant (44)..(44): xaa in position 44 is any amino acid
  Variant (45)..(45): xaa in position 45 is Asn, Gly, Gln or Ala
  Variant (46)..(46): xaa in position 46 is Leu, Ile, Met, Phe or Val
  Variant (47)..(49): xaa in position 47 to 49 is any amino acid
  Variant (50)..(50): xaa in position 50 is Arg, Lys or Glu
  Variant (51)..(51): xaa in position 51 is Phe or Tyr
  Variant (52)..(52): xaa in position 52 is any amino acid
  Variant (54)..(59): xaa in position 54 to 59 is any amino acid
  Variant (60)..(60): xaa in position 60 is any or no amino acid
  Variant (61)..(61): xaa in position 61 is Trp, Met, Asn or Leu
  Variant (62)..(63): xaa in position 62 to 63 is any amino acid
  Variant (64)..(65): xaa in position 64 to 65 is any or no amino acid
  Variant (66)..(66): xaa in position 66 is Ile, Val or Ala
  Variant (67)..(68): xaa in position 67 to 68 is any amino acid
  Variant (69)..(69): xaa in position 69 is Val, Ile, Met or Leu
  Variant (70)..(70): xaa in position 70 is any amino acid
  Variant (71)..(71): xaa in position 71 is Ile, Leu, Val, Phe or Ser
  Variant (72)..(74): xaa in position 72 to 74 is any amino acid
  Variant (76)..(77): xaa in position 76 to 77 is any amino acid
  Variant (78)..(78): xaa in position 78 is Gly, Asp, Val or Ala
  Variant (79)..(81): xaa in position 79 to 81 is any amino acid
  Variant (82)..(82): xaa in position 82 is Arg or Lys
  Variant (83)..(84): xaa in position 83 to 84 is any or no amino acid
  Variant (85)..(85): xaa in position 85 is Tyr or Phe
  Variant (86)..(86): xaa in position 86 is Tyr, Phe or Trp
  Variant (87)..(87): xaa in position 87 is Asp, Glu, Ala or Asn
  Variant (88)..(89): xaa in position 88 to 89 is any amino acid
  Variant (91)..(91): xaa in position 91 is any amino acid
  Variant (92)..(92): xaa in position 92 is any or no amino acid
  Variant (93)..(93): xaa in position 93 is Leu, Ile, Val, Met or Ala
  Variant (94)..(94): xaa in position 94 is Arg, Lys or Leu
  Variant (96)..(96): xaa in position 96 is Met, Val, Ile or Leu
  Variant (97)..(97): xaa in position 97 is Val, Met, Ile, Leu or Phe
  Variant (98)..(98): xaa in position 98 is Gln, Pro or Thr
  Variant (99)..(99): xaa in position 99 is Asn or Ser
  Variant (100)..(100): xaa in position 100 is His, Gln or Pro
  Variant (101)..(102): xaa in position 101 to 102 is any amino acid
  Variant (103)..(103): xaa in position 103 is Gln, Glu, Asn or Leu
  Variant (104)..(104): xaa in position 104 is Leu, Ile, Val, Met or Thr
  Variant (105)..(105): xaa in position 105 is Leu, Met, Val, Ile, Phe or Tyr
  Variant (106)..(106): xaa in position 106 is any amino acid
  Variant (107)..(107): xaa in position 107 is Leu, Met, Ile, Val, Trp or Phe
  Variant (108)..(109): xaa in position 108 to 109 is any amino acid
  Variant (111)..(111): xaa in position 111 is Glu, Asp, Ser or Asn
  Variant (112)..(112): xaa in position 112 is any amino acid
  Variant (114)..(118): xaa in position 114 to 118 is any amino acid
  Variant (119)..(121): xaa in position 119 to 121 is any or no amino acid
  Variant (122)..(122): xaa in position 122 is Ile, Val, Leu, Phe or Met
  Variant (123)..(124): xaa in position 123 to 124 is any amino acid
  Variant (125)..(125): xaa in position 125 is Glu, Lys, Ala, Arg or His
  Variant (126)..(126): xaa in position 126 is Lys or Val
  Variant (127)..(128): xaa in position 127 to 128 is any amino acid
  Variant (129)..(129): xaa in position 129 is Val, Ile, Ala, Leu or Phe
  Variant (130)..(130): xaa in position 130 is Leu, Ile, Val, Phe or Met
  Variant (131)..(140): xaa in position 131 to 140 is any amino acid
  Variant (141)..(145): xaa in position 141 to 145 is any or no amino acid
  Variant (146)..(146): xaa in position 146 is Val, Leu, Ile, Ala or Ser
  Variant (147)..(147): xaa in position 147 is any amino acid
  Variant (148)..(148): xaa in position 148 is Gly or Ala
  Variant (149)..(149): xaa in position 149 is Gln or Arg
  Variant (150)..(150): xaa in position 150 is Tyr or Phe

SEQ ID NO: 18606 - protein, 44 aa, Artificial sequence; identical to SEQ ID NO: 2918
  Variant (1)..(1): xaa in position 1 is Tyr or Leu
  Variant (2)..(2): xaa in position 2 is any amino acid
  Variant (3)..(13): xaa in position 3 to 13 is any or no amino acid
  Variant (15)..(17): xaa in position 15 to 17 is any amino acid
  Variant (19)..(19): xaa in position 19 is Phe or Tyr
  Variant (20)..(25): xaa in position 20 to 25 is any amino acid
  Variant (26)..(26): xaa in position 26 is Ile, Val, Leu or Phe
  Variant (27)..(29): xaa in position 27 to 29 is any amino acid
  Variant (30)..(30): xaa in position 30 is Arg, Asn, Phe or Gln
  Variant (31)..(31): xaa in position 31 is Trp or Phe
  Variant (32)..(32): xaa in position 32 is any amino acid
  Variant (33)..(33): xaa in position 33 is Gly or Asp
  Variant (34)..(34): xaa in position 34 is Val or Thr
  Variant (36)..(36): xaa in position 36 is Phe or Ile
  Variant (37)..(37): xaa in position 37 is any amino acid
  Variant (38)..(38): xaa in position 38 is Leu, Met, Ile, Val or Phe
  Variant (39)..(40): xaa in position 39 to 40 is any amino acid
  Variant (41)..(41): xaa in position 41 is Gly or Ala
  Variant (43)..(43): xaa in position 43 is any amino acid
  Variant (44)..(44): xaa in position 44 is Leu, Met or Val

SEQ ID NO: 18607 - protein, 97 aa, Artificial sequence; identical to SEQ ID NO: 2919
  Variant (1)..(1): xaa in position 1 is Asn, Asp, Gln, Arg or Lys
  Variant (2)..(4): xaa in position 2 to 4 is any amino acid
  Variant (5)..(5): xaa in position 5 is Ile, Leu, Met, Phe or Val
  Variant (6)..(6): xaa in position 6 is any amino acid
  Variant (7)..(7): xaa in position 7 is Ile, Leu, Val, Ala or Ser
  Variant (8)..(8): xaa in position 8 is any amino acid
  Variant (9)..(9): xaa in position 9 is Pro or His
  Variant (10)..(12): xaa in position 10 to 12 is any amino acid
  Variant (13)..(13): xaa in position 13 is Ile, Val, Met, Leu, Phe or Ala
  Variant (14)..(19): xaa in position 14 to 19 is any amino acid
  Variant (20)..(20): xaa in position 20 is Lys, Ser or Arg
  Variant (21)..(29): xaa in position 21 to 29 is any amino acid
  Variant (30)..(35): xaa in position 30 to 35 is any or no amino acid
  Variant (36)..(36): xaa in position 36 is Leu, Ile, Met or Val
  Variant (37)..(44): xaa in position 37 to 44 is any amino acid
  Variant (45)..(64): xaa in position 45 to 64 is any or no amino acid
  Variant (65)..(65): xaa in position 65 is Ala, Gly, Pro or Ser
  Variant (66)..(66): xaa in position 66 is Tyr or Leu
  Variant (67)..(68): xaa in position 67 to 68 is any amino acid
  Variant (69)..(69): xaa in position 69 is Leu, Met or Tyr
  Variant (70)..(70): xaa in position 70 is Leu, Ile, Phe or Met
  Variant (71)..(71): xaa in position 71 is any amino acid
  Variant (72)..(72): xaa in position 72 is Asp, Glu, Ala, Asn or His
  Variant (73)..(75): xaa in position 73 to 75 is any amino acid
  Variant (76)..(76): xaa in position 76 is Gly, Ser or Asp
  Variant (77)..(80): xaa in position 77 to 80 is any amino acid
  Variant (81)..(81): xaa in position 81 is Phe or Tyr
  Variant (82)..(85): xaa in position 82 to 85 is any amino acid
  Variant (86)..(86): xaa in position 86 is any or no amino acid
  Variant (87)..(87): xaa in position 87 is Val, Ile, Leu, Ala or Gln
  Variant (88)..(90): xaa in position 88 to 90 is any amino acid
  Variant (92)..(96): xaa in position 92 to 96 is any amino acid
  Variant (97)..(97): xaa in position 97 is Ile, Val, Leu, Phe or Ala

SEQ ID NO: 18608 - DNA, 291 bp, Escherichia coli K12
  CDS (1)..(291): transl_table=11
gtgctgtcaaaactaccccgtagactccgatcttttcaaacatattgcaccatccgtgtacatcggggtgaggatatgaaatcaatggataagttaacaacaggtgttgcctatggcacatcggcgggtaatgctggtttctgggcattgcagttactcgataaagtaactccgtcacagtgggctgcaatcggtgtgctgggtagcctggtttttggcctgctgacgtatctgacaaatctttatttcaagattaaagaagacaggcgtaaggctgcgagaggagagtaa

SEQ ID NO: 18609 - protein, 96 aa, Escherichia coli K12
MLSKLPRRLRSFQTYCTIRVHRGEDMKSMDKLTTGVAYGTSAGNAGFWALQLLDKVTPSQWAAIGVLGSLVFGLLTYLTNLYFKIKEDRRKAARGE

SEQ ID NO: 18610 - DNA, 216 bp, Bacteriophage 933W
  CDS (1)..(216): transl_table=11
atgtaccagatggaaaaaatcacaacaggtgtgtcatacaccacgtcagcggtgggaacgggctactggttcctgcagttgctggacagggtttccccgtctcagtgggcggcaataggcgtgctggggagtctgctgtttgggctgctgacatatctgacgaacctgtatttcaagattaaagaagaccggcgtaaggcggcacggggagagtaa

SEQ ID NO: 18611 - protein, 71 aa, Bacteriophage 933W
MYQMEKITTGVSYTTSAVGTGYWFLQLLDRVSPSQWAAIGVLGSLLFGLLTYLTNLYFKIKEDRRKAARGE

SEQ ID NO: 18612 - DNA, 291 bp, Bacteriophage VT2-Sa
  CDS (1)..(291): transl_table=11
atgcgtcagggaccatcggtgtgtgccggtggtcttttttattgttgtgagcttccggattgcgggagacggggtatgtaccagatggaaaaaatcacaacaggtgtgtcatacaccacgtcagcggtgggaacgggctactggttcctgcagttgctggacagggtttccccgtctcagtgggcggcaataggcgtgctggggagtctgctgtttgggctgctgacatatctgacgaacctgtatttcaagattaaagaagaccggcgtaaggcggcacggggagagtaa

SEQ ID NO: 18613 - protein, 96 aa, Bacteriophage VT2-Sa
MRQGPSVCAGGLFYCCELPDCGRRGMYQMEKITTGVSYTTSAVGTGYWFLQLLDRVSPSQWAAIGVLGSLLFGLLTYLTNLYFKIKEDRRKAARGE

SEQ ID NO: 18614 - DNA, 315 bp, Escherichia coli O157:H7 EDL933
  CDS (1)..(315): transl_table=11
gtgggtcgtctgagacgcctgcatgagttatcagagccatcagtagttaactggtggcttttttattgttgtcagcttccggataacgggagacggggtatgtaccagatggaaaaaatcacaacaggtgtgtcatacaccacgtcagcggtagggacgggatactggttactgcaactgctggacaaagtctctccgtcccagtgggtggcaataggtgtactggggagtctgctgtttggcctgctgacgtatctgactaacctgtatttcaaaatcagggaggaccgccgtaagacggcgcggggagactaa

SEQ ID NO: 18615 - protein, 104 aa, Escherichia coli O157:H7 EDL933
MGRLRRLHELSEPSVVNWWLFYCCQLPDNGRRGMYQMEKITTGVSYTTSAVGTGYWLLQLLDKVSPSQWVAIGVLGSLLFGLLTYLTNLYFKIREDRRKTARGD

SEQ ID NO: 18616 - DNA, 315 bp, Escherichia coli O157:H7 EDL933
  CDS (1)..(315): transl_table=11
gtgggtcgtctgagacgcctgcatgagttatcagagccatcagtagttaactggtggcttttttattgttgtcagcttccggataacgggagacggggtatgtaccagatggaaaaaatcacaacgggtgtgtcatacaccacgtcagcggtggggacgggatactggttactgcagctgctggacaaagtctctccgtcccagtgggtggcgataggcgtgctggggagtctgctgtttgggctgctgacatatctgacgaacctgtatttcaagattaaagaagaccggcgtaaggcggcgcggggagagtaa

SEQ ID NO: 18617 - protein, 104 aa, Escherichia coli O157:H7 EDL933
MGRLRRLHELSEPSVVNWWLFYCCQLPDNGRRGMYQMEKITTGVSYTTSAVGTGYWLLQLLDKVSPSQWVAIGVLGSLLFGLLTYLTNLYFKIKEDRRKAARGE

SEQ ID NO: 18618 - DNA, 273 bp, Escherichia coli O157:H7 EDL933
  CDS (1)..(273): transl_table=11
gtgtgtgccggtggtcttttttattgttgtgagcttccggattgcgggagacggggtatgtaccagatggaaaaaatcacaacaggtgtgtcatacaccacgtcagcggtgggaacgggctactggttcctgcagttgctggacagggtttccccgtctcagtgggcggcaataggcgtgctggggagtctgctgtttgggctgctgacatatctgacgaacctgtatttcaagattaaagaagaccggcgtaaggcggcacggggagagtaa

SEQ ID NO: 18619 - protein, 90 aa, Escherichia coli O157:H7 EDL933
MCAGGLFYCCELPDCGRRGMYQMEKITTGVSYTTSAVGTGYWFLQLLDRVSPSQWAAIGVLGSLLFGLLTYLTNLYFKIKEDRRKAARGE

SEQ ID NO: 18620 - DNA, 216 bp, Escherichia coli O157:H7
  CDS (1)..(216): transl_table=11
atgtaccagatggaaaaaataacaacaggtgtgtcatacaccacgtcagcggtggggacgggatactggctactgcagttgctggacaaagtctccccatcccagtgggtggcaataggcgtattgggtagcttggtgtttggcttgctgacgtatctgacaaacctttatttcaagattaaagaagataagcgtaaggctgcgagaggtgaataa

SEQ ID NO: 18621 - protein, 71 aa, Escherichia coli O157:H7
MYQMEKITTGVSYTTSAVGTGYWLLQLLDKVSPSQWVAIGVLGSLVFGLLTYLTNLYFKIKEDKRKAARGE

SEQ ID NO: 18622 - DNA, 207 bp, Escherichia coli O157:H7
  CDS (1)..(207): transl_table=11
atggaaaaaatcacaacaggtgtgtcatacaccacgtcagcggtggggacggaatactggttactgcagctgctggacaaagtctctccgtcccagtgggtggcaataggagtgctgggaagtctgctgtttggcctgctgacgtatctgactaacctgtatttcaaaatcagagaggaccgtcgtaaggtggcgcggggagagtag

SEQ ID NO: 18623 - protein, 68 aa, Escherichia coli O157:H7
MEKITTGVSYTTSAVGTEYWLLQLLDKVSPSQWVAIGVLGSLLFGLLTYLTNLYFKIREDRRKVARGE

SEQ ID NO: 18624 - DNA, 216 bp, Escherichia coli O157:H7
  CDS (1)..(216): transl_table=11
atgtaccagatggaaaaaatcacaacgggtgtgtcatacaccacgtcagcggtggggacgggatactggttactgcagctgctggacaaagtctctccgtcccagtgggtggcgataggtgtgctggggagtctgctgtttggcctgctgacgtatctgactaacctgtatttcaaaatcagagaggaccgtcgtaaggcggcgcggggagagtaa

SEQ ID NO: 18625 - protein, 71 aa, Escherichia coli O157:H7
MYQMEKITTGVSYTTSAVGTGYWLLQLLDKVSPSQWVAIGVLGSLLFGLLTYLTNLYFKIREDRRKAARGE

SEQ ID NO: 18626 - DNA, 216 bp, Escherichia coli O157:H7
  CDS (1)..(216): transl_table=11
atgtaccagatggaaaaaatcacaacgggtgtgtcatacaccacgtcagcggtggggacgggatactggttactgcagctgctggacaaagtctctccgtcccagtgggtggcgataggcgtgctggggagtctgctgtttgggctgctgacatatctgacgaacctgtatttcaagattaaagaagaccggcgtaaggcggcgcggggagagtaa

SEQ ID NO: 18627 - protein, 71 aa, Escherichia coli O157:H7
MYQMEKITTGVSYTTSAVGTGYWLLQLLDKVSPSQWVAIGVLGSLLFGLLTYLTNLYFKIKEDRRKAARGE

SEQ ID NO: 18628 - DNA, 216 bp, Escherichia coli O157:H7
  CDS (1)..(216): transl_table=11
atgtaccagatggaaaaaatcacaacaggtgtgtcatacaccacgtcagcggtagggacgggatactggttactgcaactgctggacaaagtctctccgtcccagtgggtggcaataggtgtactggggagtctgctgtttggcctgctgacgtatctgactaacctgtatttcaaaatcagggaggaccgccgtaagacggcgcggggagactaa

SEQ ID NO: 18629 - protein, 71 aa, Escherichia coli O157:H7
MYQMEKITTGVSYTTSAVGTGYWLLQLLDKVSPSQWVAIGVLGSLLFGLLTYLTNLYFKIREDRRKTARGD

SEQ ID NO: 18630 - DNA, 207 bp, Escherichia coli O157:H7
  CDS (1)..(207): transl_table=11
atggaaaaaatcacaacgggtgtgtcatacaccacgtcagcggtggggacgggatactggttactgcagctgctggacaaagtctctccgtcccagtgggtggcgataggcgtgctggggagtctgctgtttgggctgctgacatatctgacgaacctgtatttcaagattaaagaagaccggcgtaaggcggcgcggggagagtaa

SEQ ID NO: 18631 - protein, 68 aa, Escherichia coli O157:H7
MEKITTGVSYTTSAVGTGYWLLQLLDKVSPSQWVAIGVLGSLLFGLLTYLTNLYFKIKEDRRKAARGE

SEQ ID NO: 18632 - DNA, 207 bp, Escherichia coli O157:H7
  CDS (1)..(207): transl_table=11
atggaaaaaatcacaacaggtgtgtcatacaccacgtcagcggtggggacgggatactggttactgcagctgctggacaaagtctctccgtcccagtgggtggcaatcggtgtgctggggagtctgctgtttggcctgctgacgtatctgactaacctgtatttcaaaatcagagaggaccgtcgtaaggcggcgcggggggagtaa

SEQ ID NO: 18633 - protein, 68 aa, Escherichia coli O157:H7
MEKITTGVSYTTSAVGTGYWLLQLLDKVSPSQWVAIGVLGSLLFGLLTYLTNLYFKIREDRRKAARGE

SEQ ID NO: 18634 - DNA, 216 bp, Shigella flexneri 2a str. 301
  CDS (1)..(216): transl_table=11
atgaaatccatggacaaaatttcaacgggcattgcctacggcacctccgccggcagtgccggctactggtttttgcagtggttggatcaggtcaggccatcacagtgggctgcgattggtgtgctgggaagtctgcttctggggcttctgacttatctgacgaatctgtatttcaaaataagagaagacaagcgtaaggctgcacggggagagtaa

SEQ ID NO: 18635 - protein, 71 aa, Shigella flexneri 2a str. 301
MKSMDKISTGIAYGTSAGSAGYWFLQWLDQVRPSQWAAIGVLGSLLLGLLTYLTNLYFKIREDKRKAARGE

SEQ ID NO: 18636 - DNA, 216 bp, Shigella flexneri 2a str. 301
  CDS (1)..(216): transl_table=11
atgaaatccatggacaaaatttcaacgggcattgcctacggcacctccgcaggcagtgctggctactggtttttacagtggcttgatcaggtcagtccgtcacagtgggctgcgattggtgtactggggagtctggttctgggcttcctgacttatctgacaaatctgtacttcaaaatcagagaagacaagcgtaaggctgcgagaggtgaataa

SEQ ID NO: 18637 - protein, 71 aa, Shigella flexneri 2a str. 301
MKSMDKISTGIAYGTSAGSAGYWFLQWLDQVSPSQWAAIGVLGSLVLGFLTYLTNLYFKIREDKRKAARGE

SEQ ID NO: 18638 - DNA, 321 bp, Escherichia coli CFT073
  CDS (1)..(321): transl_table=11
gtgtcagtgggtcgtctgagacgcttgcatgagttatcagagccatcagtagttaactggtggcttttttattgttgtcagcttccggataacgggagacggggtatggaccagatggaaaaaatcacaacaggtgtgtcatacaccacgtcagcggtgggaacgggctactggttcctgcagttgctggacagggtttccccgtctcagtgggcggcaataggcgtgctgggaagtctgctgtttgggctgctgacatatctgactaacctgtatttcaaaatcagagaggaccgtcgtaaggcggcacggggagagtaa

SEQ ID NO: 18639 - protein, 106 aa, Escherichia coli CFT073
MSVGRLRRLHELSEPSVVNWWLFYCCQLPDNGRRGMDQMEKITTGVSYTTSAVGTGYWFLQLLDRVSPSQWAAIGVLGSLLFGLLTYLTNLYFKIREDRRKAARGE

SEQ ID NO: 18640 - DNA, 216 bp, Escherichia coli CFT073
  CDS (1)..(216): transl_table=11
atgaaatcaatggataagttaacaacaggtatcgcctatggcacatcggctggtaatgctggtttctgggcattgcagttactcgataaagtaactccgtcacagtgggctgcaatcggtgtgctgggtagtctggtttttggcctgctgacgtatctgacaaacctttatttcaagattaaagaagacaggcgtaaggttgcgagaagagagtaa

SEQ ID NO: 18641 - protein, 71 aa, Escherichia coli CFT073
MKSMDKLTTGIAYGTSAGNAGFWALQLLDKVTPSQWAAIGVLGSLVFGLLTYLTNLYFKIKEDRRKVARRE

SEQ ID NO: 18642 - DNA, 216 bp, Shigella flexneri 2a str. 2457T
  CDS (1)..(216): transl_table=11
atgaaatccatggacaaaatttcaacgggcattgcctacggcacctcctcaggcagtgctggctactggtttttacagtggcttgatcaggtcagtccgtcacagtgggctgcgattggtgtactggggagtctggttctgggcttcctgacttatctgacaaatctgtacttcaaaatcagagaagacaagcgtaaggctgcacggggagagtaa

SEQ ID NO: 18643 - protein, 71 aa, Shigella flexneri 2a str. 2457T
MKSMDKISTGIAYGTSSGSAGYWFLQWLDQVSPSQWAAIGVLGSLVLGFLTYLTNLYFKIREDKRKAARGE

SEQ ID NO: 18644 - DNA, 180 bp, Shigella flexneri 2a str. 2457T
  CDS (1)..(180): transl_table=11
atggaccagatggaaaaaatcacaacaggtgtgtcatacaccacgtcagcggtgggaacgggctactggttcctgcagttgctggacagggtttccccgtctcagtgggcggcaataggcgtgctggggagtctgctgtttgggctgctgacatatctgactgaggtgtactggcaatag

SEQ ID NO: 18645 - protein, 59 aa, Shigella flexneri 2a str. 2457T
MDQMEKITTGVSYTTSAVGTGYWFLQLLDRVSPSQWAAIGVLGSLLFGLLTYLTEVYWQ

SEQ ID NO: 18646 - DNA, 213 bp, Yersinia pseudotuberculosis IP 32953
  CDS (1)..(213): transl_table=11
atgaaaatggagaggctcacaaccggtatctcttataccgcgagcggtggcggcgcactgttttggtttaaacaattactgaatggatttgcccctgagcaatgggcggctattggtgtgctgggtagcttgatgtttgctttcctaacattcctaaccaacctatatttcaaggtgcgcgaagataagcggaaagcggcgaagggggaataa

SEQ ID NO: 18647 - protein, 70 aa, Yersinia pseudotuberculosis IP 32953
MKMERLTTGISYTASGGGALFWFKQLLNGFAPEQWAAIGVLGSLMFAFLTFLTNLYFKVREDKRKAAKGE

SEQ ID NO: 18648 - DNA, 216 bp, Shigella sonnei Ss046
  CDS (1)..(216): transl_table=11
atgaaatccatggataagttaacaacgggtgtcgcctatggcacctcagcaggtagtgccgggtactggtttttacagctgctagataaagtcacgccctcacagtgggcggcaattggagtgctgggtagcctggtatttggcctgctgacgtacctgacaaacctttatttcaagattaaagaagataagcgcaaggctgcgagaggtggataa

SEQ ID NO: 18649 - protein, 71 aa, Shigella sonnei Ss046
MKSMDKLTTGVAYGTSAGSAGYWFLQLLDKVTPSQWAAIGVLGSLVFGLLTYLTNLYFKIKEDKRKAARGG

SEQ ID NO: 18650 - DNA, 216 bp, Shigella sonnei Ss046
  CDS (1)..(216): transl_table=11
atgtatcagatggaaaaaatatcaacaggcattgcctacggcacctccgccggcagtgccggctactggtttttgcagtggttggatcaggtcagtccatcacagtgggctgcgattggtgtgctgggaagtctgcttctggggcttctgacttatctgacaaatctgtatttcaaaataagagaagacaagcgtaaggctgcgagaggtgaataa

SEQ ID NO: 18651 - protein, 71 aa, Shigella sonnei Ss046
MYQMEKISTGIAYGTSAGSAGYWFLQWLDQVSPSQWAAIGVLGSLLLGLLTYLTNLYFKIREDKRKAARGE

SEQ ID NO: 18652 - DNA, 207 bp, Bacteriophage H19B
  CDS (1)..(207): transl_table=11
atggaaaaaatcacaacaggtgtgtcatacaccacgtcagcggtagggacgggatactggttactgcaactgctggacaaagtctctccgtcccagtgggtggcaataggtgtactggggagtctgctgtttggcctgctgacgtatctgactaacctgtatttcaaaatcagagaggaccggcgtaaggcggtgcggggagagtaa

SEQ ID NO: 18653 - protein, 68 aa, Bacteriophage H19B
MEKITTGVSYTTSAVGTGYWLLQLLDKVSPSQWVAIGVLGSLLFGLLTYLTNLYFKIREDRRKAVRGE

SEQ ID NO: 18654 - DNA, 291 bp, Stx1
  CDS (1)..(291): transl_table=11
atgcgtcagggaccatcggtgtgtgccggtggtcttttttattgttgtgagcttccggattgcgggaggcggggtatgaaccagatggaaaaaatcacaacaggtgtgtcatacaccacgtcagcggtgggaacgggctactggttcctgcagttgctggacagggtttccccgtctcagtgggcggcaataggcgtgctggggagtctgctgtttggtctgctgacgtacctgacgaacctgtatttcaaaatcagagaggacaggcgtaaggcggcacggggagagtaa

SEQ ID NO: 18655 - protein, 96 aa, Stx1
MRQGPSVCAGGLFYCCELPDCGRRGMNQMEKITTGVSYTTSAVGTGYWFLQLLDRVSPSQWAAIGVLGSLLFGLLTYLTNLYFKIREDRRKAARGE

SEQ ID NO: 18656 - DNA, 150 bp, Escherichia coli
  CDS (1)..(150): transl_table=11
atgaaatccatggacaaaatttcaacgagcattgcctacggcacctccgcaggcagtgctggctactggtttttacagtggcttgatcaggtcagtccgtcacagtgggctgcgattggtgtactggggagtctggttctgggcttctag

SEQ ID NO: 18657 - protein, 49 aa, Escherichia coli
MKSMDKISTSIAYGTSAGSAGYWFLQWLDQVSPSQWAAIGVLGSLVLGF

SEQ ID NO: 18658 - DNA, 216 bp, Escherichia coli
  CDS (1)..(216): transl_table=11
atgaaatccatggacaaaatttcaacgagcattgcctacggcacctccgcaggcagtgctggctactggtttttacagtggcttgatcaggtcagtccgtcacagtgggctgcgattggtgtactggggagtctggttctgggcttcctgacttatctgacaaatctgtacttcaaaatcagagaagacagaagaaaggctgcgagaggtgaataa

SEQ ID NO: 18659 - protein, 71 aa, Escherichia coli
MKSMDKISTSIAYGTSAGSAGYWFLQWLDQVSPSQWAAIGVLGSLVLGFLTYLTNLYFKIREDRRKAARGE

SEQ ID NO: 18660 - DNA, 216 bp, Shigella dysenteriae
  CDS (1)..(216): transl_table=11
atgtaccagatggaaaaaatcacaacaggtgtgtcatacaccacgtcagcggtgggaatgggctactggttcctgcagtttctggacagggtctccccgtctcagtgggcggcaataggcgtactggggagtctgctgtttgggctgctgacatatctgactaacctgtatttcaaaatcagagaggaccggcgtaaggcggcgcggggagagtaa

SEQ ID NO: 18661 - protein, 71 aa, Shigella dysenteriae
MYQMEKITTGVSYTTSAVGMGYWFLQFLDRVSPSQWAAIGVLGSLLFGLLTYLTNLYFKIREDRRKAARGE

SEQ ID NO: 18662 - DNA, 216 bp, Escherichia coli O6
  CDS (1)..(216): transl_table=11
atgaaatccatggataagttaacaacgggtgtcgcctatggtacctcagcaggtagtgccgggtactggtttttacagttgctcgataaagtcacgccctcacagtgggcggcaataggtgtgctgggtagcctggtatttggcctgctgacgtacctgacaaacctttatttcaagattaaagaagataagcgcaaggctgcgagaggtgaataa

SEQ ID NO: 18663 - protein, 71 aa, Escherichia coli O6
MKSMDKLTTGVAYGTSAGSAGYWFLQLLDKVTPSQWAAIGVLGSLVFGLLTYLTNLYFKIKEDKRKAARGE

SEQ ID NO: 18664 - DNA, 216 bp, Bacteriophage P21
  CDS (1)..(216): transl_table=11
atgaaatcaatggacaaaatctcaactggcattgcctacggaacatctgctggtagtgcgggatactggtttttgcagtggttggatcaggtcagtccgtcacagtgggctgcgattggagtgcttggaagccttgtgttgggttttctcacttatctgacaaatctgtatttcaaaatcagagaagacagacgaaaggctgcgagaggtgaataa

SEQ ID NO: 18665 - protein, 71 aa, Bacteriophage P21
MKSMDKISTGIAYGTSAGSAGYWFLQWLDQVSPSQWAAIGVLGSLVLGFLTYLTNLYFKIREDRRKAARGE

SEQ ID NO: 18666 - DNA, 24 bp, Artificial sequence
  (1)..(24): primer
atgctgtcaaaactaccccgtaga

SEQ ID NO: 18667 - DNA, 23 bp, Artificial sequence
  (1)..(23): primer
ttactctcctctcgcagccttac

SEQ ID NO: 18668 - protein, 71 aa, Artificial sequence
  Variant (2)..(3): xaa in position 2 to 3 is any amino acid
  Variant (14)..(14): xaa in position 14 is any amino acid
  Variant (18)..(20): xaa in position 18 to 20 is any amino acid
  Variant (24)..(24): xaa in position 24 is any amino acid
  Variant (27)..(27): xaa in position 27 is any amino acid
  Variant (30)..(30): xaa in position 30 is any amino acid
  Variant (37)..(37): xaa in position 37 is any amino acid
  Variant (47)..(47): xaa in position 47 is any amino acid
  Variant (49)..(49): xaa in position 49 is any amino acid
  Variant (67)..(67): xaa in position 67 is any amino acid
MXXMEKITTGVSYXTSAXXXGYWXLQXLDXVSPSQWXAIGVLGSLLXGXLTYLTNLYFKIREDRRKXARGE

SEQ ID NO: 18669 - protein, 10 aa, Artificial sequence
  Variant (2)..(2): xaa in position 2 is Asp or Glu
  Variant (5)..(5): xaa in position 5 is Ser or Thr
  Variant (7)..(7): xaa in position 7 is Gly or Ser
  Variant (8)..(8): xaa in position 8 is Ile or Val
  Variant (9)..(9): xaa in position 9 is Ala or Ser
MXKIXTXXXY

SEQ ID NO: 18670 - protein, 6 aa, Artificial sequence
  Variant (2)..(2): xaa in position 2 is Phe or Leu
  Variant (5)..(5): xaa in position 5 is any amino acid
WXLQXL

SEQ ID NO: 18671 - protein, 14 aa, Artificial sequence
  Variant (5)..(5): xaa in position 5 is any or no amino acid
  Variant (7)..(7): xaa in position 7 is any or no amino acid
PSQWXAXIGVLGSL

SEQ ID NO: 18672 - DNA, 294 bp, Escherichia coli K12
  CDS (1)..(294): transl_table=11
atgagccagaacgctacggttaacgtcgacatcaaattaggcgtcaataaattccatgttgatgagggccacccgcatatcattctggcggaaaatcccgatatcaatgaattccataaattaatgaaagcctgccctgccggactttataagcaggatgacgcaggaaacattcattttgattccgccggttgtctggagtgcggcacctgtcgggtgctgtgcggtaacactattctcgaacagtggcaatatcccgcaggcaccttcggtattgattttcgctacggctaa

SEQ ID NO: 18673 - protein, 97 aa, Escherichia coli K12
MSQNATVNVDIKLGVNKFHVDEGHPHIILAENPDINEFHKLMKACPAGLYKQDDAGNIHFDSAGCLECGTCRVLCGNTILEQWQYPAGTFGIDFRYG

SEQ ID NO: 18674 - DNA, 300 bp, Mesorhizobium loti MAFF303099
  CDS (1)..(300): transl_table=11
atgacgatggccgtgacgaagttacgtgtcgaggagaagctttatcagaaccgctatctggtcgatccgggccgcccgcatatcaaagtgcgaccgcacgagaggccgagcgcgaacctgctcgcgctgacacacatctgcccggccaaatgctatgagttgaacgacaagggacaggtggagaccacttccgacggctgcatggaatgcggcacctgtcgcgtgctgtgcgaggccagcggtgagatcgtgtggaattacccgcgcggcggcttcggcgttctcttcaagttcggatga

SEQ ID NO: 18675 - protein, 99 aa, Mesorhizobium loti MAFF303099
MTMAVTKLRVEEKLYQNRYLVDPGRPHIKVRPHERPSANLLALTHICPAKCYELNDKGQVETTSDGCMECGTCRVLCEASGEIVWNYPRGGFGVLFKFG

SEQ ID NO: 18676 - DNA, 273 bp, Thermoplasma volcanium GSS1
  CDS (1)..(273): transl_table=11
atgaaaatagaagaaaaattatcgttattaaattataaaacggataaatcatacgcacatataacaataaacccggatatatgcagtacatgcccagatcatttctgcgtgtttgcgtgccctgccaactgctatacgcttataaatggcaagcttaacttcaaatatgaagactgcgtagaatgtggaacctgcgatatagcctgctcccatgggagtgttaagtggacgctaccaaagggggataacggagttatatacaaatacgggtga

SEQ ID NO: 18677 - protein, 90 aa, Thermoplasma volcanium GSS1
MKIEEKLSLLNYKTDKSYAHITINPDICSTCPDHFCVFACPANCYTLINGKLNFKYEDCVECGTCDIACSHGSVKWTLPKGDNGVIYKYG

SEQ ID NO: 18678 - DNA, 279 bp, Thermotoga maritima MSB8
  CDS (1)..(279): transl_table=11
gtgaggatcgaagataaactctatttgaacagatacagaacggatgaggaaaatccgcatctcaaaataaaagatgaaagcatctgtgcggaaaaatgttccgatcgaccatgtgtgagctgttgtcctgcggatgtgtacgagtggacggagagtggaatggaggtgaaattcgaggggtgtctcgagtgtggcacctgtaggattgtttgtccctttggaaacatagaatggaattatccaaggggaaattacggtgtgctctacaaattcgggtga

SEQ ID NO: 18679 - protein, 92 aa, Thermotoga maritima MSB8
MRIEDKLYLNRYRTDEENPHLKIKDESICAEKCSDRPCVSCCPADVYEWTESGMEVKFEGCLECGTCRIVCPFGNIEWNYPRGNYGVLYKFG

SEQ ID NO: 18680 - DNA, 297 bp, Escherichia coli O157:H7
  CDS (1)..(297): transl_table=11
gtggaatctggcgggcgatgttatcaggagtgttcgatgtctgtagcccgtaatctctggcgcgctgctgatgcgccgcacattgttccggctgactccgttgagcgtcagatggtacaacggttgattaacgcctgtccggtaggtcttttttcgctcacaccggaaggtgacttacgcgttgattatcacggctgcctggagtgtggcacctgccgtttgctgtgcgacgaatccacactacaacagtggcgctatccgccttccggattcggcatcacctaccgatttggataa

SEQ ID NO: 18681 - protein, 98 aa, Escherichia coli O157:H7
MESGGRCYQECSMSVARNLWRAADAPHIVPADSVERQMVQRLINACPVGLFSLTPEGDLRVDYHGCLECGTCRLLCDESTLQQWRYPPSGFGITYRFG

SEQ ID NO: 18682 - DNA, 282 bp, Sulfolobus tokodaii str. 7
  CDS (1)..(282): transl_table=11
atgagagtagaagaaaggctttatactttaaggtataaaagggatgagaaaccgcatctagagataaaagatcaacaaacctgcaataaatgtcacgaaacttataagtcaccgtgtatcacagtctgtccagcaaacgtatactcttttgccgaaggaaaaataatagtctcatatgaaaattgccttgaatgcggagcttgcaaaatagtttgtcccttcaataacattatttggagatacccaagatatggtttagggatatctttaagatacggatga

SEQ ID NO: 18683 - protein, 93 aa, Sulfolobus tokodaii str. 7
MRVEERLYTLRYKRDEKPHLEIKDQQTCNKCHETYKSPCITVCPANVYSFAEGKIIVSYENCLECGACKIVCPFNNIIWRYPRYGLGISLRYG

SEQ ID NO: 18684 - DNA, 273 bp, Thermoplasma acidophilum DSM 1728
  CDS (1)..(273): transl_table=11
atgaagattgaggaaaagctttccctgttaaactacaagacggatcgatcatacgcgcacataacgatcgatcccgatatatgtgctggatgcccagatcacttctgtgttttcgcctgtcctgcaaactgctacacactcataaacggtaagctgaacttcaagtatgaagactgtgtagaatgcggcacatgcgacatagcgtgctcacacggtagcgtgaaatggacgcttccgaagggagacaacggagtcatatacaaatatgggtga

SEQ ID NO: 18685 - protein, 90 aa, Thermoplasma acidophilum DSM 1728
MKIEEKLSLLNYKTDRSYAHITIDPDICAGCPDHFCVFACPANCYTLINGKLNFKYEDCVECGTCDIACSHGSVKWTLPKGDNGVIYKYG

SEQ ID NO: 18686 - DNA, 291 bp, Pyrobaculum aerophilum str. IM2
  CDS (1)..(291): transl_table=11
atgagtttgaagtactttacaattgaagaaaggcttaatgcaaatgcttgggacgttgatgtccacaggccacatataagaattaaagacccggagaagtgcagaaaatgtgaaaaaaagccgtgtacttatatgtgtccagcaaaatgctacgtacaacagggggattacgtagtgcttagcacagaggcgtgtgtggaatgcggcacttgccgcgttgtgtgcccacacggcagtatagaatggaattacccgcggtctggcatgggaatttggtatagatttacttga

SEQ ID NO: 18687 - protein, 96 aa, Pyrobaculum aerophilum str. IM2
MSLKYFTIEERLNANAWDVDVHRPHIRIKDPEKCRKCEKKPCTYMCPAKCYVQQGDYVVLSTEACVECGTCRVVCPHGSIEWNYPRSGMGIWYRFT

SEQ ID NO: 18688 - DNA, 285 bp, Fusobacterium nucleatum subsp. nucleatum ATCC 25586
  CDS (1)..(285): transl_table=11
atgaagaagatgacaatagaagataaacttggattaaatgtttttcatgttgatgaagaaaattctcatattgatgtagataaaaattttactgatgaagtagaaattaaaaaattattattggcttgtccagcagaatgttataaatacattgatggaaaattaagtttcagtcatttaggttgtctagaatgtggaacttgtagagtgctttcacatggaaaaattgtaaaatcttggaaacatccaatcggagaagtaggagttacttttagacaaggataa

SEQ ID NO: 18689 - protein, 94 aa, Fusobacterium nucleatum subsp. nucleatum ATCC 25586
MKKMTIEDKLGLNVFHVDEENSHIDVDKNFTDEVEIKKLLLACPAECYKYIDGKLSFSHLGCLECGTCRVLSHGKIVKSWKHPIGEVGVTFRQG

SEQ ID NO: 18690 - DNA, 297 bp, Shigella flexneri 2a str. 301
  CDS (1)..(297): transl_table=11
gtggcatctggcgggcgatgttatcaggagtctgcgatgtctgtagcccgtaatctctggcgcgttgctgatgcgccgcacattgttccggctgactccgttgagcgtcagatggtacaacggttgattaacgcctgtccggtaggtcttttttctctcacacaggaaggtgacttacgtattgactatcgcggctgcctggagtgtggcacctgccgtttgctgtgcgacgaatccacactacaacagtggcgctatccgccttccggattcggcatcacctaccgctttggataa

SEQ ID NO: 18691 - protein, 98 aa, Shigella flexneri 2a str. 301
MASGGRCYQESAMSVARNLWRVADAPHIVPADSVERQMVQRLINACPVGLFSLTQEGDLRIDYRGCLECGTCRLLCDESTLQQWRYPPSGFGITYRFG

SEQ ID NO: 18692 - DNA, 297 bp, Escherichia coli CFT073
  CDS (1)..(297): transl_table=11
gtggcatctgacgggcgatgttatcaggagtctacgatgtctgtagcccgtaatctctggcgcgctgccgatgcgccgcacattgttccagctgactccgttgagcgccagacggcacaacggttgattaacgcctgtccggctggtcttttttcgctcacacctgaaggtgacttacgcgttgattatcacggctgcctggagtgtggcacctgccgtttgctgtgcgacgaatcaacactacaacagtggcgctatccgccttccggattcggcatcacctaccgctttggataa

SEQ ID NO: 18693 - protein, 98 aa, Escherichia coli CFT073
MASDGRCYQESTMSVARNLWRAADAPHIVPADSVERQTAQRLINACPAGLFSLTPEGDLRVDYHGCLECGTCRLLCDESTLQQWRYPPSGFGITYRFG

SEQ ID NO: 18694 - DNA, 297 bp, Rhodopseudomonas palustris CGA009
  CDS (1)..(297): transl_table=11
atgacaacggaagccccggttcgcgtcgaagacaagctgtatcagaaccgctatctggtcgacgtcggcaatgcccacatcaaggtcaagccccacaccaagccatcgccgcaactgctggcgctgttgaaagtgtgcccggcgcactgctacgagctgaacagtaacggacaggtcgaagtgacgccggacggctgcgtcgaatgcggcacctgccgggtgctcgccgaaggtggcggcgacatcgagtggagctacccgcgcggcggctacggcgtgctgttcaagttcggctga

SEQ ID NO: 18695 - protein, 98 aa, Rhodopseudomonas palustris CGA009
MTTEAPVRVEDKLYQNRYLVDVGNAHIKVKPHTKPSPQLLALLKVCPAHCYELNSNGQVEVTPDGCVECGTCRVLAEGGGDIEWSYPRGGYGVLFKFG

SEQ ID NO: 18696 - DNA, 294 bp, Salmonella enterica subsp. enterica serovar Choleraesuis str
  CDS (1)..(294): transl_table=11
atgagttcggacaataaggtgaatgttgacgtcaaattgggcgtaaataaattttacgtagatgaaggacacccacatatcattttgcgatcctcgcctgacatgcaggagtttaataaattaataaaagcctgccctgccggactctataagctggacgatgcgggaaatattcattttgactccgcgggctgcctggaatgcgggacctgcagggttctctgcggcaatactcttctcgaaaaatgggaatacccggcgggaacgttcggcgttgagtttcgctacggctga

SEQ ID NO: 18697 - protein, 97 aa, Salmonella enterica subsp. enterica serovar Choleraesuis str
MSSDNKVNVDVKLGVNKFYVDEGHPHIILRSSPDMQEFNKLIKACPAGLYKLDDAGNIHFDSAGCLECGTCRVLCGNTLLEKWEYPAGTFGVEFRYG

SEQ ID NO: 18698 - DNA, 291 bp, Sulfolobus acidocaldarius DSM 639
  CDS (1)..(291): transl_table=11
atgagaattgaggaaaggttatatactttaagatataagagagacgaaaaaccacacttatcaataattgagcccaataagtgtcaaaagtgtgctgaaattaatggagtacctgaaccatgtatcgttgtttgcccagcaaatgtgtactcatgggtagacaacaatagaatagtagtatcctatgagaactgtgttgagtgcggagcctgtagaatagcatgtccattcgataatatttcctggaagtatccaagatatggtctcggagtagcatttagatatgggtaa

SEQ ID NO: 18699 - protein, 96 aa, Sulfolobus acidocaldarius DSM 639
MRIEERLYTLRYKRDEKPHLSIIEPNKCQKCAEINGVPEPCIVVCPANVYSWVDNNRIVVSYENCVECGACRIACPFDNISWKYPRYGLGVAFRYG

SEQ ID NO: 18700 - DNA, 297 bp, Shigella sonnei Ss046
  CDS (1)..(297): transl_table=11
gtggcatctggcgggcgatgttatcaggagtctgcgatgtctgtagcccataatctctggcgcgttgctgatgcgccgcacattgttccggctgactccgttgagcgtcagatggtacaacggttgattaacgcctgtccggcaggtcttttttcgctcacaccggaaggtgacttacgcgttgattatcacggctgcctggagtgtggcacctgccgtttgctgtgcgacgaatccacactacaacagtggcgctatccgccttccggattcggcatcacctaccgctttggataa

SEQ ID NO: 18701 - protein, 98 aa, Shigella sonnei Ss046
MASGGRCYQESAMSVAHNLWRVADAPHIVPADSVERQMVQRLINACPAGLFSLTPEGDLRVDYHGCLECGTCRLLCDESTLQQWRYPPSGFGITYRFG

SEQ ID NO: 18702 - DNA, 291 bp, Rhodospirillum rubrum
  CDS (1)..(291)
atggcgatgagcgacaaaatcgaagaaaagctgtatcagaaccgctatcgggttgacgagggctgtccccacgtccgtatcgatgcgtccaaggtcccctccgagcagttgaaggcgatggtcgacatctgccccgccggctgctacgtggaaggggagaacggcaaggtcgaagttgttcccgatggttgcatggagtgcgggacctgtcgcattgtgtgtcaggaaaccggtgaactggaatgggcctatccgcgtggcggctatggcattctgttcaagtttggctga

SEQ ID NO: 18703 - protein, 96 aa, Rhodospirillum rubrum
MAMSDKIEEKLYQNRYRVDEGCPHVRIDASKVPSEQLKAMVDICPAGCYVEGENGKVEVVPDGCMECGTCRIVCQETGELEWAYPRGGYGILFKFG

SEQ ID NO: 18704 - DNA, 300 bp, Burkholderia fungorum LB400
  CDS (1)..(300)
atgagcaccgtacccgtcaacgtagaggaaaagctgttccagaaccgttaccgcgtggatgcggggcggccgcacatccgcatcaaggacgccgacgtgtgcctgagcgagtgcagcgcgaagagttgcaccttcgtctgcccggcgtcctgctacaaggccgaaggcaacggcgcggtaacgctgatcaccgacggttgcctcgaatgcggcagctgccgcattctctgtaccgaccaccagaacatcgagtgggactacccgcgcggcggtcacggcatcctgttcaaattcggttga

SEQ ID NO: 18705 - protein, 99 aa, Burkholderia fungorum LB400
MSTVPVNVEEKLFQNRYRVDAGRPHIRIKDADVCLSECSAKSCTFVCPASCYKAEGNGAVTLITDGCLECGSCRILCTDHQNIEWDYPRGGHGILFKFG

SEQ ID NO: 18706 - DNA, 285 bp, Azotobacter vinelandii AvOP
  CDS (1)..(285): transl_table=11
atgtcgaagatcgaagaaaagctgttccaggatcgttatcgggtcgactccggccggccgcacatcaggatcaaggaccccgaccattgcaccgaatgtctggaaaagcagtgcaccgtctgctgtccggccggttgctacacccgcgaaaccaacggcaaggtcaccctggtgaccgacggctgcctggagtgcggaacctgcaggatcatttgccaggacagcggcaacctggagtgggaatggcccaggggcggattcggaatcctgttcaagttcggttga

SEQ ID NO: 18707 - protein, 94 aa, Azotobacter vinelandii AvOP
MSKIEEKLFQDRYRVDSGRPHIRIKDPDHCTECLEKQCTVCCPAGCYTRETNGKVTLVTDGCLECGTCRIICQDSGNLEWEWPRGGFGILFKFG

SEQ ID NO: 18708 - DNA, 300 bp, Burkholderia vietnamiensis G4
  CDS (1)..(300): transl_table=11
atgagcaccgtgacagtcaacgtcgaggaaaagctgtttcagaaccgctaccgcgtcgacgcgggccggccccacatccgcatcaagagcacggacgtctgcctgaacgactgcaggcagaagagctgcacgttcgtctgcccggcgtcgtgctacaaggccgaaggcaacggcgcggtgacgctgatcaccgacggctgcctcgagtgcgggagctgccggatcctgtgcagcgaacatcagaacatcgaatgggagtacccgcggggcggccacgggatcctgttcaagttcggttga

SEQ ID NO: 18709 - protein, 99 aa, Burkholderia vietnamiensis G4
MSTVTVNVEEKLFQNRYRVDAGRPHIRIKSTDVCLNDCRQKSCTFVCPASCYKAEGNGAVTLITDGCLECGSCRILCSEHQNIEWEYPRGGHGILFKFG

SEQ ID NO: 18710 - DNA, 282 bp, Desulfitobacterium hafniense DCB-2
  CDS (1)..(282): transl_table=11
atgaagaaattaagtttggcagataaattgtctctgaacaaatttgaagtgaatgaaggagagcctcatatccggatcgatcagcaggtctgccggacctgccgagaaaaaagctgccttaccgcttgtccggcggggctttacagcgaacaaaacgaccagattacagtggaatgggcaggttgcctggagtgcggaacctgccggatcatctgtggcaaaaaggccatctcctgggagtatcctcaagggggattcggaatcatttatcgtcaaggatag

SEQ ID NO: 18711 - protein, 93 aa, Desulfitobacterium hafniense DCB-2
MKKLSLADKLSLNKFEVNEGEPHIRIDQQVCRTCREKSCLTACPAGLYSEQNDQITVEWAGCLECGTCRIICGKKAISWEYPQGGFGIIYRQG

SEQ ID NO: 18712 - DNA, 279 bp, Desulfitobacterium hafniense DCB-2
  CDS (1)..(279): transl_table=11
atgaaattagatgataaattgtatttggtgcgctttaacacagacaaattaaatcacatcaaaatcagcaacggcgaactttgtttaaagtgcaaagacaaagtatgcacctttatttgcccggcccatgtctatgactgggatgaagaagagaatcgcattgctgtcggctatgaaggctgtttggaatgcggtacctgccgtgtagcctgcccccatggcaatattcaatgggattatccacggggcggtttcggagtctcctggaagaacggctga

SEQ ID NO: 18713 - protein, 92 aa, Desulfitobacterium hafniense DCB-2
MKLDDKLYLVRFNTDKLNHIKISNGELCLKCKDKVCTFICPAHVYDWDEEENRIAVGYEGCLECGTCRVACPHGNIQWDYPRGGFGVSWKNG

SEQ ID NO: 18714 - DNA, 297 bp, Desulfitobacterium hafniense DCB-2
  CDS (1)..(297): transl_table=11
atgatcatcaagaataacgtcaacgtcgatcacaaactgggcatcaataaatttcatgtggatgaagaaaatgcccatatcgttttaaaagaagacaacctggacatgaaggaatatcagaaactggtgatcgcctgcccggcagggttatataagatcgacgaaaaaggaaatccccaatttgactatgcgggatgcttagaatgcggaacttgtcgggtgttgtgcggcaagaccattatagaaaaatgggagcttccccagggaacgctggggatagaattcagattcgggtaa

SEQ ID NO: 18715 - protein, 98 aa, Desulfitobacterium hafniense DCB-2
MIIKNNVNVDHKLGINKFHVDEENAHIVLKEDNLDMKEYQKLVIACPAGLYKIDEKGNPQFDYAGCLECGTCRVLCGKTIIEKWELPQGTLGIEFRFG

SEQ ID NO: 18716 - DNA, 288 bp, Desulfitobacterium hafniense DCB-2
  CDS (1)..(288): transl_table=11
atgagtcaggtcaatgtcgatcagaagcttggggtcaataagttccatgtggatgaagaaaacgcccatattgtcatgaaagaggggaatatcgatcgggcggaatatcaaaaattggttctggcctgtccggcagggttatataaaattaatgacagcggcgacattcaatttgactacgccgggtgtctggagtgcggcacctgccgggtgctttgcggtaaaacccttttggataaatgggaatttcctctgggaaccttaggtgtggagtttagatacgggtga

SEQ ID NO: 18717 - protein, 95 aa, Desulfitobacterium hafniense DCB-2
MSQVNVDQKLGVNKFHVDEENAHIVMKEGNIDRAEYQKLVLACPAGLYKINDSGDIQFDYAGCLECGTCRVLCGKTLLDKWEFPLGTLGVEFRYG

SEQ ID NO: 18718 - DNA, 279 bp, Moorella thermoacetica ATCC 39073
  CDS (1)..(279): transl_table=11
atgcgcctggaggataaactctttcttaatcgttatcagaccgacaaacaccctcacctgcgcatcaaggaccgggaggtctgccgccactgcgagggcaaaccctgtacctttatctgcccggcccgggtttacgtctggaacgaaagggaagaacgcatcgagaccgcctatgaaggttgcgtcgaatgcggcacctgccgctacgggtgtgcccatgataacatcgactggcgctatccccgcggcggtttcggtatcttgtataagtatggttaa

SEQ ID NO: 18719 - protein, 92 aa, Moorella thermoacetica ATCC 39073
MRLEDKLFLNRYQTDKHPHLRIKDREVCRHCEGKPCTFICPARVYVWNEREERIETAYEGCVECGTCRYGCAHDNIDWRYPRGGFGILYKYG

SEQ ID NO: 18720 - DNA, 285 bp, Syntrophomonas wolfei str. Goettingen
  CDS (1)..(285): transl_table=11
atgagtgaaatattaggattgaaagccaagctgggattggatgtttttaaagccgataaagaagctcatataaagatcaggccaggtatggagaaagacccccgcttgaaaagggcgattctggtatgcccggccgggctttatagcgaaaatgccgaaggtgtcgttgaatttaccattgatggatgcctggaatgcggcacttgccgtctggcttgcggtaccgaggtcttggaatggaattatcccggcggcggaagcggagtgcaatttcgcttcggctag

SEQ ID NO: 18721 - protein, 94 aa, Syntrophomonas wolfei str. Goettingen
MSEILGLKAKLGLDVFKADKEAHIKIRPGMEKDPRLKRAILVCPAGLYSENAEGVVEFTIDGCLECGTCRLACGTEVLEWNYPGGGSGVQFRFG

SEQ ID NO: 18722 - DNA, 288 bp, Syntrophobacter fumaroxidans MPOB
  CDS (1)..(288): transl_table=11
gtgaaacgcttgagcatcgaacagttgctgggaatgaacaagttcgtggtggatgacgaggaggcgcacatcaaggtgaaccgggaggtttgcgcgtcatgcccggacaagccttgcacctgggcatgtccggccgggctctacagcgtcaaggacggcgcgctgagcttcgattacgccgggtgcctggagtgcggcacgtgccgcgtggcctgccccaacgccggctccgccatcgactggaactatccgcgcggaggtttcggagtccacttccgctatggatga

SEQ ID NO: 18723 - protein, 95 aa, Syntrophobacter fumaroxidans MPOB
MKRLSIEQLLGMNKFVVDDEEAHIKVNREVCASCPDKPCTWACPAGLYSVKDGALSFDYAGCLECGTCRVACPNAGSAIDWNYPRGGFGVHFRYG

SEQ ID NO: 18724 - DNA, 297 bp, Rhizobium leguminosarum
  CDS (1)..(297): transl_table=11
atgagggcgaccatcattgagcgcattgaggacaagctgtaccaaaaccgatatctcgtcgacactggacgtccgcatataacagtgcgaccgcaccggtcgccaagcccgaacctgctcgccttgacgcaaatctgtccggccaaatgctacgagctgaacgaaattggtcaggtggcgattgttcccgatggctgcttggaatgcggcacatgcagagtgttgtgcgaagctagtggcgacataaagtggaatataccccggggcgggttcggggtcctcttcaaattcggatga

SEQ ID NO: 18725 - protein, 98 aa, Rhizobium leguminosarum
MRATIIERIEDKLYQNRYLVDTGRPHITVRPHRSPSPNLLALTQICPAKCYELNEIGQVAIVPDGCLECGTCRVLCEASGDIKWNIPRGGFGVLFKFG

SEQ ID NO: 18726 - DNA, 297 bp, Rhizobium leguminosarum bv
  CDS (1)..(297): transl_table=11
atgaaggcgaccaccattgagcgcattgaggataagctgtaccaaaaccgatatctcgtcgatactggacgcccacacattacggtgcggccgcatcggtcgccaagcccaagcctgctcgccttgacgcaaatctgtccggccaaatgctacgaggtgaacgaaattggtcaagtggcgattgtttcggatggctgcttggaatgcggcacatgcagagtgttatgcgaagcgagtggcgacataaagtggaattatccccggggagggttcggggtcctcttcaaattcggatga

SEQ ID NO: 18727 - protein, 98 aa, Rhizobium leguminosarum bv
MKATTIERIEDKLYQNRYLVDTGRPHITVRPHRSPSPSLLALTQICPAKCYEVNEIGQVAIVSDGCLECGTCRVLCEASGDIKWNYPRGGFGVLFKFG

SEQ ID NO: 18728 - DNA, 300 bp, Rhizobium loti
  CDS (1)..(300): transl_table=11
atgacgatggccgtgacgaagttacgagtcgaggagaagctttatcagaaccgctatctggtcgatccgggccgcccgcatatcaaagtgcgaccgcacgagaggccgagcgcgaacctgctcgcgctgacacacatctgcccggccaagtgctatgagttgaacgacaagggacaggtggagaccacttccgacggctgcatggaatgcggcacctgtcgcgtgttgtgcgaggccaacggtgagatcgtatggaattacccgcgcggcggctttggcgtactcttcaagtttggatga

SEQ ID NO: 18729 - protein, 99 aa, Rhizobium loti
MTMAVTKLRVEEKLYQNRYLVDPGRPHIKVRPHERPSANLLALTHICPAKCYELNDKGQVETTSDGCMECGTCRVLCEANGEIVWNYPRGGFGVLFKFG

SEQ ID NO: 18730 - DNA, 294 bp, Azospirillum brasilense
  CDS (1)..(294): transl_table=11
atgagcatcgtggtcaagatcgaagagaagctgtaccagaaccgctacatcgtggacgagagccggccgcacatccagatccgcaacgacgcggtctgcaagtcctgcgagtcccaggcctgcaccatctgctgcccggcggcctgctacagcaagaacgagacgggcagcgtgacgctggccaccgacggctgcctggaatgcggcacctgccgcgtggtctgccaggacaaggaaaatattcagtgggactacccacggggcggctacggcatcagttataagtttggttga

SEQ ID NO: 18731 - protein, 97 aa, Azospirillum brasilense
MSIVVKIEEKLYQNRYIVDESRPHIQIRNDAVCKSCESQACTICCPAACYSKNETGSVTLATDGCLECGTCRVVCQDKENIQWDYPRGGYGISYKFG

SEQ ID NO: 18732 - DNA, 285 bp, Acetobacter diazotrophicus
  CDS (1)..(285): transl_table=11
atgagcgatcgggtcgaagaccgtctgttccagaacaggtatgtcgtggatgtcgggcggccgcatattaccgtccgtccgcatgaaaccccgtcgcaggcgctcctggtcatgacgcgcatctgtcccgccggctgttacagccagaatgaacagggacaggtggaagtcgccgccgacgggtgcatggaatgcgggacgtgtcgcgtcgtgtgctccaagacgggcgatatcgaatggcagtatccgcgtggtggatacggtgtccttttcaagttcggttaa

SEQ ID NO: 18733 - protein, 94 aa, Acetobacter diazotrophicus
MSDRVEDRLFQNRYVVDVGRPHITVRPHETPSQALLVMTRICPAGCYSQNEQGQVEVAADGCMECGTCRVVCSKTGDIEWQYPRGGYGVLFKFG

SEQ ID NO: 18734 - DNA, 294 bp, Azorhizobium caulinodans
  CDS (1)..(294): transl_table=11
atggctgacgcatcggtccgtgtcgaggacaagctcttctacaatcgctacctggtcgattccggccgggcccacatcaaggtgcggccgcacaccgagccgccgccggccctgctgagcatgctcaagctgtgcccggcccgctgctacgaactcaatgaagccgggcaggtggaagtcaccgtggacggctgcgtggaatgcggcacctgccgcgtcatcgccgagccctcgggcgacatagaatggacctatccgcgcggcggcttcggcgtgctgttcaagttcggctga

SEQ ID NO: 18735 - protein, 97 aa, Azorhizobium caulinodans
MADASVRVEDKLFYNRYLVDSGRAHIKVRPHTEPPPALLSMLKLCPARCYELNEAGQVEVTVDGCVECGTCRVIAEPSGDIEWTYPRGGFGVLFKFG

SEQ ID NO: 18736 - DNA, 285 bp, Azotobacter vinelandii
  CDS (1)..(285): transl_table=11
atgtcgaagatcgaagaaaagctgttccaggatcgttatcgggtcgactccggccggccgcacatcaggatcaaggaccccgaccattgcaccgaattgtctgaaaagcagtgcaccgtctgctgtccggccggttgctacacccgcgaaaccaacggcaaggtcaccctggtgaccgacggctgcctggagtgcggaacctgcaggatcatttgccaggacagcggcaacctggagtgggaatggcccaggggcggattcggaatcctgttcaagttcggttga

SEQ ID NO: 18737 - protein, 94 aa, Azotobacter vinelandii
MSKIEEKLFQDRYRVDSGRPHIRIKDPDHCTELSEKQCTVCCPAGCYTRETNGKVTLVTDGCLECGTCRIICQDSGNLEWEWPRGGFGILFKFG

SEQ ID NO: 18738 - DNA, 297 bp, Bradyrhizobium japonicum
  CDS (1)..(297): transl_table=11
atgaatgtcgaaccctccgtgcgcgtcgaagacaagctgtactacaaccgttatcttgtcgacgccgggcaccctcacgtcagggtacgtgcgcacaagacgccatcgccgcagctcctcacacttttgaaggcctgcccggcgcgatgctacgagctcaacgacaacggccaggtcgaagttacagttgatggctgcattgaatgcggtacctgccgcgtgatcgccgagccgaccggcgacatcgaatggagccacccgcgcggcggatatggtgttctgttcaagtttgggtga

SEQ ID NO: 18739 - protein, 98 aa, Bradyrhizobium japonicum
MNVEPSVRVEDKLYYNRYLVDAGHPHVRVRAHKTPSPQLLTLLKACPARCYELNDNGQVEVTVDGCIECGTCRVIAEPTGDIEWSHPRGGYGVLFKFG

SEQ ID NO: 18740 - DNA, 288 bp, Escherichia coli O157
  CDS (1)..(288): transl_table=11
atgacttctcccgtcaatgtggacgtcaaactgggcgtcaataaattcaatgtcgatgaagagcatccgcacattgttgtgaaagccgatgccgataaacaggcgctggagctgctggtgaaagcgtgccccgcaggtctgtacaagaagcaggatgacggcagtgtgcgcttcgattacgccggatgtctggagtgcggcacctgtcgcattctggggctggggtcggcgctggaacagtgggaatacccgcgcggcacctttggtgtggagttccgttacggctga

SEQ ID NO: 18741 - protein, 95 aa, Escherichia coli O157
MTSPVNVDVKLGVNKFNVDEEHPHIVVKADADKQALELLVKACPAGLYKKQDDGSVRFDYAGCLECGTCRILGLGSALEQWEYPRGTFGVEFRYG

SEQ ID NO: 18742 - DNA, 297 bp, Rhizobium leguminosarum
  CDS (1)..(297): transl_table=11
atgaaggcgaccaccattgagcgcattgaggataagctgtaccaaaaccgatatctcgtcgatactagacgcccacacattacggtgcggccgcatcggtcgccaagcccaagcctgctcgccttgacgcaaatctgtccggccaaatgctacgaggtgaacgaaattggtcaagtggcgattgtttcggatggctgcttggaatgcggcacatgcagagtgttagccgaagcgagtggcgacataaagtggaattatccccggggagggttcggggtcctcttcaaattcggatga

SEQ ID NO: 18743 - protein, 98 aa, Rhizobium leguminosarum
MKATTIERIEDKLYQNRYLVDTRRPHITVRPHRSPSPSLLALTQICPAKCYEVNEIGQVAIVSDGCLECGTCRVLAEASGDIKWNYPRGGFGVLFKFG

SEQ ID NO: 18744 - DNA, 300 bp, Rhizobium leguminosarum bv
  CDS (1)..(300): transl_table=11
atgacggttgcagtgacgaacatacgcgtagaggacaagctttaccaaaatcgatacgtggtcgatgccggacgcccgcatattagggtgcgtccacacgattggccaagcgtaaatctgtatgccctcacaagtgtctgtccggccaagtgctacgaattgaatgaccagggccaagtggaggttatcgccgatgggtgcatggagtgcggcacgtgccgcgtactctgcgaggcaagtggagatatcgagtggaactatccgagaggcggtttcggcgttctcttcaagttcggataa

SEQ ID NO: 18745 - protein, 99 aa, Rhizobium leguminosarum bv
MTVAVTNIRVEDKLYQNRYVVDAGRPHIRVRPHDWPSVNLYALTSVCPAKCYELNDQGQVEVIADGCMECGTCRVLCEASGDIEWNYPRGGFGVLFKFG

SEQ ID NO: 18746 - DNA, 297 bp, Rhizobium leguminosarum bv
  CDS (1)..(297): transl_table=11
atgaaggccatcgttaagcggcgagttgaggacaagctttaccagaaccgatatctggttgacccgggccgtccacacatatcggtcagaaaacacctgtttccaaccccaaacctaatcgccttgacgcaagtgtgtccggcgaaatgctatcagctgaacgacagacgtcaagtgatcatcgtttccgatggctgcttggaatgcgggacatgcaacgtgttatgcggacccgacggcgacattgagtggacgtatccacgaggtgggttcggcgttctcttcaagtttggatga

SEQ ID NO: 18747 - protein, 98 aa, Rhizobium leguminosarum bv
MKAIVKRRVEDKLYQNRYLVDPGRPHISVRKHLFPTPNLIALTQVCPAKCYQLNDRRQVIIVSDGCLECGTCNVLCGPDGDIEWTYPRGGFGVLFKFG

SEQ ID NO: 18748 - DNA, 297 bp, Rhizobium meliloti
  CDS (1)..(297): transl_table=11
atgaagacggcaatcgcggagcgtatcgaagacaagctttaccagaaccgctatctggtcgacgcagggcgtccacacattacagtgcggccacaccggtcgccaagcttaaacctgctcgcgctcacgcgagtctgcccggccaaatgctacgagttgaatgaaactgggcaagtggaagtcactgccgatggctgcatggagtgcggcacatgcagagtgttgtgcgaggcaaacggtgacgtcgagtggagctatccacgaggtggcttcggtgtcctcttcaagttcggatga

SEQ ID NO: 18749 - protein, 98 aa, Rhizobium meliloti
MKTAIAERIEDKLYQNRYLVDAGRPHITVRPHRSPSLNLLALTRVCPAKCYELNETGQVEVTADGCMECGTCRVLCEANGDVEWSYPRGGFGVLFKFG

SEQ ID NO: 18750 - DNA, 294 bp, Rhizobium sp
  CDS (1)..(294): transl_table=11
atgacagcttcagtcgttcgcattgaagacaagctttaccaaaaccgttacctggtggacgcggggcggccgcacatcaaggtgcggcagcatcagtctccgagcccaaacctgcttgcgctgaccgttgtttgcccagcgaaatgctacgaggtgaatgaagacggccaagtagaggttattgcggatggatgcatggaatgcgggacatgtagagtactgtgcgaagagagcggtgacattgattggagctatccgcgaggtggattcggtgtgctctttaaattcggatga

SEQ ID NO: 18751 - protein, 97 aa, Rhizobium sp
MTASVVRIEDKLYQNRYLVDAGRPHIKVRQHQSPSPNLLALTVVCPAKCYEVNEDGQVEVIADGCMECGTCRVLCEESGDIDWSYPRGGFGVLFKFG

SEQ ID NO: 18752 - DNA, 288 bp, Salmonella typhi
  CDS (1)..(288): transl_table=11
atgacatctcccgtcaatgtggacgtcaaattgggcgtcaataagttcaatgtggatgaagatagcccgcacatcattctcaaaaccgatcctgataaacaggcgctggaggtgctggttaaggcctgtccggcgggactgtataaaaagcaggacgacggtagcgttcgttttgattacgccgggtgcctggagtgcggaacatgccggatcctcggccttgatacggcgctggaaaaatgggaatacccacgcgggacgtttggcgtggagttccgctacggctaa

SEQ ID NO: 18753 - protein, 95 aa, Salmonella typhi
MTSPVNVDVKLGVNKFNVDEDSPHIILKTDPDKQALEVLVKACPAGLYKKQDDGSVRFDYAGCLECGTCRILGLDTALEKWEYPRGTFGVEFRYG

SEQ ID NO: 18754 - DNA, 288 bp, Salmonella typhimurium
  CDS (1)..(288): transl_table=11
atgacatctcccgttaatgtggacgtcaaactgggcgtcaataagttcaatgtggatgaagacagcccgcacatcattctcaaaaccgatcctgataaacaggcgctggaggtgctgattaaggcctgtccggcgggactgtataaaaagcaggacgacggcagcgttcgttttgattacgccgggtgcctggagtgcggaacgtgccggatcctcggccttgatacggcgctggaaaaatgggaatacccgcgcgggacgtttggcgtagagttccgctacggctaa

SEQ ID NO: 18755 - protein, 95 aa, Salmonella typhimurium
MTSPVNVDVKLGVNKFNVDEDSPHIILKTDPDKQALEVLIKACPAGLYKKQDDGSVRFDYAGCLECGTCRILGLDTALEKWEYPRGTFGVEFRYG

SEQ ID NO: 18756 - DNA, 288 bp, Shigella flexneri
  CDS (1)..(288): transl_table=11
atgacttctcccgtcaatgtggacgtcaaactgggcgtcaataaattcaatgtcgatgaagagcatccgcacattgttgtgaaggccgatgctgataaacaggtgctggagctgctggtgaaagcgtgccccgcaggtctgtacaagaagcaggatgacggcagtgtgcgcttcgattacgccggatgtctggagtgcggcacctgtcgcattctggggctggggtcggcgctggaacagtgggaatacccgcgcggcacctttggtgtggagttccgttacggctga

SEQ ID NO: 18757 - protein, 95 aa, Shigella flexneri
MTSPVNVDVKLGVNKFNVDEEHPHIVVKADADKQVLELLVKACPAGLYKKQDDGSVRFDYAGCLECGTCRILGLGSALEQWEYPRGTFGVEFRYG

SEQ ID NO: 18758 - DNA, 297 bp, Escherichia coli
  CDS (1)..(297): transl_table=11
gtggcatctggcgggcgatgttatcaggagtctgcgatgtctgtagcccgtaatctctggcgcgttgctgatgcgccgcacattgttccggctgactccgttgagcgccagacggcagaacggttgattaacgcctgtccggcaggtcttttttcgctcacaccggaaggtaacttacgtattgactatcgcagttgcctggagtgtggcacctgccgtttgctgtgcgacgaatcaacactacaacagtggcgctatccgccttccggattcggcatcacctaccgctttggataa

SEQ ID NO: 18759 - protein, 98 aa, Escherichia coli
MASGGRCYQESAMSVARNLWRVADAPHIVPADSVERQTAERLINACPAGLFSLTPEGNLRIDYRSCLECGTCRLLCDESTLQQWRYPPSGFGITYRFG

SEQ ID NO: 18760 - DNA, 23 bp, Artificial sequence
  (1)..(23): primer
atgagccagaacgctacggttaa

SEQ ID NO: 18761 - DNA, 24 bp, Artificial sequence
  (1)..(24): primer
ttagccgtagcgaaaatcaatacc

SEQ ID NO: 18762 - protein, 97 aa, Artificial sequence
  Variant (3)..(3): xaa in position 3 is any amino acid
  Variant (6)..(9): xaa in position 6 to 9 is any amino acid
  Variant (11)..(12): xaa in position 11 to 12 is any amino acid
  Variant (14)..(16): xaa in position 14 to 16 is any amino acid
  Variant (17)..(17): xaa in position 17 is any or no amino acid
  Variant (20)..(20): xaa in position 20 is any amino acid
  Variant (22)..(36): xaa in position 22 to 36 is any amino acid
  Variant (37)..(42): xaa in position 37 to 42 is any or no amino acid
  Variant (46)..(47): xaa in position 46 to 47 is any amino acid
  Variant (49)..(54): xaa in position 49 to 54 is any amino acid
  Variant (55)..(56): xaa in position 55 to 56 is any or no amino acid
  Variant (58)..(62): xaa in position 58 to 62 is any amino acid
  Variant (74)..(80): xaa in position 74 to 80 is any amino acid
  Variant (81)..(82): xaa in position 81 to 82 is any or no amino acid
  Variant (84)..(84): xaa in position 84 is any amino acid
  Variant (87)..(87): xaa in position 87 is any amino acid
  Variant (89)..(90): xaa in position 89 to 90 is any amino acid
  Variant (93)..(93): xaa in position 93 is any amino acid
VEXKLXXXXYXXDXXXXHIXVXXXXXXXXXXXXXXXXXXXXXCPAXXYXXXXXXXXVXXXXXGCLECGTCRVLXXXXXXXXXWXYPXGXXGVXFKFG

SEQ ID NO: 18763 - protein, 11 aa, Artificial sequence
  Variant (3)..(3): xaa in position 3 is Ile, Leu, Met or Val
  Variant (9)..(9): xaa in position 9 is Asn or Arg
  Variant (10)..(10): xaa in position 10 is any amino acid
  Variant (11)..(11): xaa in position 11 is Ala, Gly, Ile, Leu or Val
GCXECGTCXXX

SEQ ID NO: 18764 - protein, 15 aa, Artificial sequence
  Variant (2)..(3): xaa in position 2 to 3 is any amino acid
  Variant (5)..(5): xaa in position 5 is any amino acid
  Variant (7)..(7): xaa in position 7 is Asp, Glu, Gly, Asn or Thr
  Variant (8)..(8): xaa in position 8 is any amino acid
  Variant (10)..(10): xaa in position 10 is Ile or Val
  Variant (11)..(11): xaa in position 11 is any amino acid
  Variant (12)..(12): xaa in position 12 is Phe, Trp or Tyr
  Variant (13)..(13): xaa in position 13 is Lys or Arg
  Variant (14)..(14): xaa in position 14 is any amino acid
WXXPXGXXGXXXXXG

SEQ ID NO: 18765 - DNA, 1047 bp, Escherichia coli K12; identical to SEQ ID NO: 1323
  CDS (1)..(1047)

SEQ ID NO: 18766 - protein, 348 aa, Escherichia coli K12; identical to SEQ ID NO: 1324

SEQ ID NO: 18767 - DNA, 1235 bp, Salmonella typhimurium; identical to SEQ ID NO: 1325
  CDS (165)..(1235)

SEQ ID NO: 18768 - protein, 356 aa, Salmonella typhimurium; identical to SEQ ID NO: 1326

SEQ ID NO: 18769 - DNA, 1086 bp, Deinococcus radiodurans; identical to SEQ ID NO: 1327
  CDS (1)..(1086)

SEQ ID NO: 18770 - protein, 361 aa, Deinococcus radiodurans; identical to SEQ ID NO: 1328

SEQ ID NO: 18771 - DNA, 1056 bp, Neisseria meningitidis; identical to SEQ ID NO: 1329
  CDS (1)..(1056)

SEQ ID NO: 18772 - protein, 351 aa, Neisseria meningitidis; identical to SEQ ID NO: 1330

SEQ ID NO: 18773 - DNA, 1047 bp, Yersinia pestis; identical to SEQ ID NO: 1331
  CDS (1)..(1047)

SEQ ID NO: 18774 - protein, 348 aa, Yersinia pestis; identical to SEQ ID NO: 1332

SEQ ID NO: 18775 - DNA, 1071 bp, Escherichia coli; identical to SEQ ID NO: 1333
  CDS (1)..(1071)

SEQ ID NO: 18776 - protein, 356 aa, Escherichia coli; identical to SEQ ID NO: 1334

SEQ ID NO: 18777 - DNA, 1131 bp, Nostoc sp. PCC 7120; identical to SEQ ID NO: 1335
  CDS (1)..(1131)

SEQ ID NO: 18778 - protein, 376 aa, Nostoc sp. PCC 7120; identical to SEQ ID NO: 1336

SEQ ID NO: 18779 - DNA, 1053 bp, Salmonella enterica subsp. enterica serovar Typhi; identical to SEQ ID NO: 1337
  CDS (1)..(1053)

SEQ ID NO: 18780 - protein, 350 aa, Salmonella enterica subsp. enterica serovar Typhi; identical to SEQ ID NO: 1338

SEQ ID NO: 18781 - DNA, 1077 bp, Pseudomonas aeruginosa; identical to SEQ ID NO: 1339
  CDS (1)..(1077)

SEQ ID NO: 18782 - protein, 358 aa, Pseudomonas aeruginosa; identical to SEQ ID NO: 1340

SEQ ID NO: 18783 - DNA, 1047 bp, Buchnera sp; identical to SEQ ID NO: 1341
  CDS (1)..(1047)

SEQ ID NO: 18784 - protein, 348 aa, Buchnera sp; identical to SEQ ID NO: 1342

SEQ ID NO: 18785 - DNA, 1074 bp, Vibrio cholerae; identical to SEQ ID NO: 1343
  CDS (1)..(1074)

SEQ ID NO: 18786 - protein, 357 aa, Vibrio cholerae; identical to SEQ ID NO: 1344

SEQ ID NO: 18787 - DNA, 1038 bp, Lactococcus lactis subsp. lactis; identical to SEQ ID NO: 1345
  CDS (1)..(1038)

SEQ ID NO: 18788 - protein, 345 aa, Lactococcus lactis subsp. lactis; identical to SEQ ID NO: 1346

SEQ ID NO: 18789 - DNA, 1023 bp, Lactococcus lactis subsp. lactis; identical to SEQ ID NO: 1347
  CDS (1)..(1023)

SEQ ID NO: 18790 - protein, 340 aa, Lactococcus lactis subsp. lactis; identical to SEQ ID NO: 1348

SEQ ID NO: 18791 - DNA, 1032 bp, Streptococcus pneumoniae; identical to SEQ ID NO: 1349
  CDS (1)..(1032)

SEQ ID NO: 18792 - protein, 343 aa, Streptococcus pneumoniae; identical to SEQ ID NO: 1350

SEQ ID NO: 18793 - DNA, 1095 bp, Pseudomonas aeruginosa; identical to SEQ ID NO: 1351
  CDS (1)..(1095)

SEQ ID NO: 18794 - protein, 364 aa, Pseudomonas aeruginosa; identical to SEQ ID NO: 1352

SEQ ID NO: 18795 - DNA, 1110 bp, Caulobacter crescentus; identical to SEQ ID NO: 1353
  CDS (1)..(1110)

SEQ ID NO: 18796 - protein, 369 aa, Caulobacter crescentus; identical to SEQ ID NO: 1354

SEQ ID NO: 18797 - DNA, 1032 bp, Streptococcus pneumoniae; identical to SEQ ID NO: 1355
  CDS (1)..(1032)

SEQ ID NO: 18798 - protein, 343 aa, Streptococcus pneumoniae; identical to SEQ ID NO: 1356

SEQ ID NO: 18799 - DNA, 1047 bp, Buchnera aphidicola; identical to SEQ ID NO: 1357
  CDS (1)..(1047)

SEQ ID NO: 18800 - protein, 348 aa, Buchnera aphidicola; identical to SEQ ID NO: 1358

SEQ ID NO: 18801 - DNA, 1089 bp, Haemophilus influenzae; identical to SEQ ID NO: 1359
  CDS (1)..(1089)

SEQ ID NO: 18802 - protein, 362 aa, Haemophilus influenzae; identical to SEQ ID NO: 1360

SEQ ID NO: 18803 - DNA, 1502 bp, Candida albicans; identical to SEQ ID NO: 1361
  CDS (336)..(1442)

SEQ ID NO: 18804 - protein, 368 aa, Candida albicans; identical to SEQ ID NO: 1362

SEQ ID NO: 18805 - DNA, 1113 bp, Saccharomyces cerevisiae; identical to SEQ ID NO: 1363
  CDS (1)..(1113)

SEQ ID NO: 18806 - protein, 370 aa, Saccharomyces cerevisiae; identical to SEQ ID NO: 1364

SEQ ID NO: 18807 - DNA, 2048 bp, Saccharomyces cerevisiae; identical to SEQ ID NO: 1365
  CDS (619)..(1731)

SEQ ID NO: 18808 - protein, 370 aa, Saccharomyces cerevisiae; identical to SEQ ID NO: 1366

SEQ ID NO: 18809 - DNA, 1107 bp, Schizosaccharomyces pombe; identical to SEQ ID NO: 1367
  CDS (1)..(1107)

SEQ ID NO: 18810 - protein, 368 aa, Schizosaccharomyces pombe; identical to SEQ ID NO: 1368

SEQ ID NO: 18811 - DNA, 1089 bp, Amycolatopsis orientalis; identical to SEQ ID NO: 1369
  CDS (1)..(1089)

SEQ ID NO: 18812 - protein, 362 aa, Amycolatopsis orientalis; identical to SEQ ID NO: 1370

SEQ ID NO: 18813 - DNA, 1119 bp, Schizosaccharomyces pombe; identical to SEQ ID NO: 1371
  CDS (1)..(1119)

SEQ ID NO: 18814 - protein, 372 aa, Schizosaccharomyces pombe; identical to SEQ ID NO: 1372

SEQ ID NO: 18815 - DNA, 1248 bp, Corynebacterium glutamicum; identical to SEQ ID NO: 1373
  CDS (101)..(1228)

SEQ ID NO: 18816 - protein, 375 aa, Corynebacterium glutamicum; identical to SEQ ID NO: 1374

SEQ ID NO: 18817 - DNA, 1083 bp, Methylophilus methylotrophus; identical to SEQ ID NO: 1375
  CDS (1)..(1083)

SEQ ID NO: 18818 - protein, 360 aa, Methylophilus methylotrophus; identical to SEQ ID NO: 1376

SEQ ID NO: 18819 - DNA, 1107 bp, Debaryomyces hansenii; identical to SEQ ID NO: 1377
  CDS (1)..(1107)

SEQ ID NO: 18820 - protein, 368 aa, Debaryomyces hansenii; identical to SEQ ID NO: 1378

SEQ ID NO: 18821 - DNA, 1074 bp, Yarrowia lipolytica; identical to SEQ ID NO: 1379
  CDS (1)..(1074)

SEQ ID NO: 18822 - protein, 357 aa, Yarrowia lipolytica; identical to SEQ ID NO: 1380

SEQ ID NO: 18823 - DNA, 1089 bp, Yarrowia lipolytica; identical to SEQ ID NO: 1381
  CDS (1)..(1089)

SEQ ID NO: 18824 - protein, 362 aa, Yarrowia lipolytica; identical to SEQ ID NO: 1382

SEQ ID NO: 18825 - DNA, 1119 bp, Kluyveromyces lactis; identical to SEQ ID NO: 1383
  CDS (1)..(1119)

SEQ ID NO: 18826 - protein, 372 aa, Kluyveromyces lactis; identical to SEQ ID NO: 1384

SEQ ID NO: 18827 - DNA, 1095 bp, Kluyveromyces lactis; identical to SEQ ID NO: 1385
  CDS (1)..(1095)

SEQ ID NO: 18828 - protein, 364 aa, Kluyveromyces lactis; identical to SEQ ID NO: 1386

SEQ ID NO: 18829 - DNA, 1074 bp, Erwinia carotovora subsp; identical to SEQ ID NO: 1387
  CDS (1)..(1074)

SEQ ID NO: 18830 - protein, 357 aa, Erwinia carotovora subsp; identical to SEQ ID NO: 1388

SEQ ID NO: 18831 - DNA, 1047 bp, Erwinia carotovora subsp; identical to SEQ ID NO: 1389
  CDS (1)..(1047)

SEQ ID NO: 18832 - protein, 348 aa, Erwinia carotovora subsp; identical to SEQ ID NO: 1390

SEQ ID NO: 18833 - DNA, 1056 bp, Erwinia carotovora subsp; identical to SEQ ID NO: 1391
  CDS (1)..(1056)

SEQ ID NO: 18834 - protein, 351 aa, Erwinia carotovora subsp; identical to SEQ ID NO: 1392

SEQ ID NO: 18835 - DNA, 1113 bp, Acinetobacter sp; identical to SEQ ID NO: 1393
  CDS (1)..(1113)

SEQ ID NO: 18836 - protein, 370 aa, Acinetobacter sp; identical to SEQ ID NO: 1394

SEQ ID NO: 18837 - DNA, 1056 bp, Acinetobacter sp; identical to SEQ ID NO: 1395
  CDS (1)..(1056)

SEQ ID NO: 18838 - protein, 351 aa, Acinetobacter sp; identical to SEQ ID NO: 1396

SEQ ID NO: 18839 - DNA, 1119 bp, Candida glabrata; identical to SEQ ID NO: 1397
  CDS (1)..(1119)

SEQ ID NO: 18840 - protein, 372 aa, Candida glabrata; identical to SEQ ID NO: 1398

SEQ ID NO: 18841 - DNA, 1071 bp, Candida glabrata; identical to SEQ ID NO: 1399
  CDS (1)..(1071)

SEQ ID NO: 18842 - protein, 356 aa, Candida glabrata; identical to SEQ ID NO: 1400

SEQ ID NO: 18843 - DNA, 1083 bp, Photobacterium profundum; identical to SEQ ID NO: 1401
  CDS (1)..(1083)

SEQ ID NO: 18844 - protein, 360 aa, Photobacterium profundum; identical to SEQ ID NO: 1402

SEQ ID NO: 18845 - DNA, 1053 bp, Photobacterium profundum; identical to SEQ ID NO: 1403
  CDS (1)..(1053)

SEQ ID NO: 18846 - protein, 350 aa, Photobacterium profundum; identical to SEQ ID NO: 1404

SEQ ID NO: 18847 - DNA, 1113 bp, Photobacterium profundum; identical to SEQ ID NO: 1405
  CDS (1)..(1113)

SEQ ID NO: 18848 - protein, 370 aa, Photobacterium profundum; identical to SEQ ID NO: 1406

SEQ ID NO: 18849 - DNA, 1056 bp, Photobacterium profundum; identical to SEQ ID NO: 1407
  CDS (1)..(1056)

SEQ ID NO: 18850 - protein, 351 aa, Photobacterium profundum; identical to SEQ ID NO: 1408

SEQ ID NO: 18851 - DNA, 1092 bp, Parachlamydia sp; identical to SEQ ID NO: 1409
  CDS (1)..(1092)

SEQ ID NO: 18852 - protein, 363 aa, Parachlamydia sp; identical to SEQ ID NO: 1410

SEQ ID NO: 18853 - DNA, 1095 bp, Rhodopseudomonas palustris; identical to SEQ ID NO: 1411
  CDS (1)..(1095)

SEQ ID NO: 18854 - protein, 364 aa, Rhodopseudomonas palustris; identical to SEQ ID NO: 1412

SEQ ID NO: 18855 - DNA, 1100 bp, Amycolatopsis methanolica; identical to SEQ ID NO: 1413
  CDS (1)..(1086)

SEQ ID NO: 18856 - protein, 361 aa, Amycolatopsis methanolica; identical to SEQ ID NO: 1414

SEQ ID NO: 18857 - DNA, 1071 bp, Treponema denticola; identical to SEQ ID NO: 1415
  CDS (1)..(1071)

SEQ ID NO: 18858 - protein, 356 aa, Treponema denticola; identical to SEQ ID NO: 1416

SEQ ID NO: 18859 - DNA, 1068 bp, Geobacter sulfurreducens; identical to SEQ ID NO: 1417
  CDS (1)..(1068)

SEQ ID NO: 18860 - protein, 355 aa, Geobacter sulfurreducens; identical to SEQ ID NO: 1418

SEQ ID NO: 18861 - DNA, 1095 bp, Ashbya gossypii; identical to SEQ ID NO: 1419
  CDS (1)..(1095)

SEQ ID NO: 18862 - protein, 364 aa, Ashbya gossypii; identical to SEQ ID NO: 1420

SEQ ID NO: 18863 - DNA, 1122 bp, Ashbya gossypii; identical to SEQ ID NO: 1421
  CDS (1)..(1122)

SEQ ID NO: 18864 - protein, 373 aa, Ashbya gossypii; identical to SEQ ID NO: 1422

SEQ ID NO: 18865 - DNA, 1098 bp, Amycolatopsis balhimycina; identical to SEQ ID NO: 1423
  CDS (1)..(1098)

SEQ ID NO: 18866 - protein, 365 aa, Amycolatopsis balhimycina; identical to SEQ ID NO: 1424

SEQ ID NO: 18867 - DNA, 1071 bp, Vibrio vulnificus; identical to SEQ ID NO: 1425
  CDS (1)..(1071)

SEQ ID NO: 18868 - protein, 356 aa, Vibrio vulnificus; identical to SEQ ID NO: 1426

SEQ ID NO: 18869 - DNA, 1047 bp, Photorhabdus luminescens; identical to SEQ ID NO: 1427
  CDS (1)..(1047)

SEQ ID NO: 18870 - protein, 348 aa, Photorhabdus luminescens; identical to SEQ ID NO: 1428

SEQ ID NO: 18871 - DNA, 1053 bp, Photorhabdus luminescens; identical to SEQ ID NO: 1429
  CDS (1)..(1053)

SEQ ID NO: 18872 - protein, 350 aa, Photorhabdus luminescens; identical to SEQ ID NO: 1430

SEQ ID NO: 18873 - DNA, 1095 bp, Photorhabdus luminescens; identical to SEQ ID NO: 1431
  CDS (1)..(1095)

SEQ ID NO: 18874 - protein, 364 aa, Photorhabdus luminescens; identical to SEQ ID NO: 1432

SEQ ID NO: 18875 - DNA, 1119 bp, Gloeobacter violaceus; identical to SEQ ID NO: 1433
  CDS (1)..(1119)

SEQ ID NO: 18876 - protein, 372 aa, Gloeobacter violaceus; identical to SEQ ID NO: 1434

SEQ ID NO: 18877 - DNA, 1107 bp, Chromobacterium violaceum; identical to SEQ ID NO: 1435
  CDS (1)..(1107)

SEQ ID NO: 18878 - protein, 368 aa, Chromobacterium violaceum; identical to SEQ ID NO: 1436

SEQ ID NO: 18879 - DNA, 1059 bp, Chromobacterium violaceum; identical to SEQ ID NO: 1437
  CDS (1)..(1059)

SEQ ID NO: 18880 - protein, 352 aa, Chromobacterium violaceum; identical to SEQ ID NO: 1438

SEQ ID NO: 18881 - DNA, 1140 bp, Neurospora crassa; identical to SEQ ID NO: 1439
  CDS (1)..(1140)

SEQ ID NO: 18882 - protein, 379 aa, Neurospora crassa; identical to SEQ ID NO: 1440

SEQ ID NO: 18883 - DNA, 1092 bp, Neurospora crassa; identical to SEQ ID NO: 1441
  CDS (1)..(1092)

SEQ ID NO: 18884 - protein, 363 aa, Neurospora crassa; identical to SEQ ID NO: 1442

SEQ ID NO: 18885 - DNA, 1068 bp, Synechococcus sp; identical to SEQ ID NO: 1443
  CDS (1)..(1068)

SEQ ID NO: 18886 - protein, 355 aa, Synechococcus sp; identical to SEQ ID NO: 1444

SEQ ID NO: 18887 - DNA, 1053 bp, Rhodopirellula baltica; identical to SEQ ID NO: 1445
  CDS (1)..(1053)

SEQ ID NO: 18888 - protein, 350 aa, Rhodopirellula baltica; identical to SEQ ID NO: 1446

SEQ ID NO: 18889 - DNA, 1068 bp, Prochlorococcus marinus subsp; identical to SEQ ID NO: 1447
  CDS (1)..(1068)

SEQ ID NO: 18890 - protein, 355 aa, Prochlorococcus marinus subsp; identical to SEQ ID NO: 1448

SEQ ID NO: 18891 - DNA, 1083 bp, Prochlorococcus marinus; identical to SEQ ID NO: 1449
  CDS (1)..(1083)

SEQ ID NO: 18892 - protein, 360 aa, Prochlorococcus marinus; identical to SEQ ID NO: 1450

SEQ ID NO: 18893 - DNA, 1074 bp, Prochlorococcus marinus; identical to SEQ ID NO: 1451
  CDS (1)..(1074)

SEQ ID NO: 18894 - protein, 357 aa, Prochlorococcus marinus; identical to SEQ ID NO: 1452

SEQ ID NO: 18895 - DNA, 1113 bp, Haemophilus ducreyi; identical to SEQ ID NO: 1453
  CDS (1)..(1113)

SEQ ID NO: 18896 - protein, 370 aa, Haemophilus ducreyi; identical to SEQ ID NO: 1454

SEQ ID NO: 18897 - DNA, 1080 bp, Haemophilus ducreyi; identical to SEQ ID NO: 1455
  CDS (1)..(1080)

SEQ ID NO: 18898 - protein, 359 aa, Haemophilus ducreyi; identical to SEQ ID NO: 1456

SEQ ID NO: 18899 - DNA, 1086 bp, Candidatus Blochmannia floridanus; identical to SEQ ID NO: 1457
  CDS (1)..(1086)

SEQ ID NO: 18900 - protein, 361 aa, Candidatus Blochmannia floridanus; identical to SEQ ID NO: 1458

SEQ ID NO: 18901 - DNA, 1074 bp, Bordetella pertussis; identical to SEQ ID NO: 1459
  CDS (1)..(1074)

SEQ ID NO: 18902 - protein, 357 aa, Bordetella pertussis; identical to SEQ ID NO: 1460

SEQ ID NO: 18903 - DNA, 1119 bp, Bordetella bronchiseptica; identical to SEQ ID NO: 1461
  CDS (1)..(1119)

SEQ ID NO: 18904 - protein, 372 aa, Bordetella bronchiseptica; identical to SEQ ID NO: 1462

SEQ ID NO: 18905 - DNA, 1179 bp, Nitrosomonas europaea; identical to SEQ ID NO: 1463
  CDS (1)..(1179)

SEQ ID NO: 18906 - protein, 392 aa, Nitrosomonas europaea; identical to SEQ ID NO: 1464

SEQ ID NO: 18907 - DNA, 1083 bp, Coxiella burnetii; identical to SEQ ID NO: 1465
  CDS (1)..(1083)

SEQ ID NO: 18908 - protein, 360 aa, Coxiella burnetii; identical to SEQ ID NO: 1466

SEQ ID NO: 18909 - DNA, 834 bp, Vibrio anguillarum; identical to SEQ ID NO: 1467
  CDS (1)..(834)

SEQ ID NO: 18910 - protein, 277 aa, Vibrio anguillarum; identical to SEQ ID NO: 1468

SEQ ID NO: 18911 - DNA, 1143 bp, Xylella fastidiosa; identical to SEQ ID NO: 1469
  CDS (1)..(1143)

SEQ ID NO: 18912 - protein, 380 aa, Xylella fastidiosa; identical to SEQ ID NO: 1470

SEQ ID NO: 18913 - DNA, 1053 bp, Vibrio parahaemolyticus; identical to SEQ ID NO: 1471
  CDS (1)..(1053)

SEQ ID NO: 18914 - protein, 350 aa, Vibrio parahaemolyticus; identical to SEQ ID NO: 1472

SEQ ID NO: 18915 - DNA, 1053 bp, Vibrio parahaemolyticus; identical to SEQ ID NO: 1473
  CDS (1)..(1053)

SEQ ID NO: 18916 - protein, 350 aa, Vibrio parahaemolyticus; identical to SEQ ID NO: 1474

SEQ ID NO: 18917 - DNA, 1074 bp, Vibrio parahaemolyticus; identical to SEQ ID NO: 1475
  CDS (1)..(1074)

SEQ ID NO: 18918 - protein, 357 aa, Vibrio parahaemolyticus; identical to SEQ ID NO: 1476

SEQ ID NO: 18919 - DNA, 1083 bp, Pseudomonas syringae; identical to SEQ ID NO: 1477
  CDS (1)..(1083)

SEQ ID NO: 18920 - protein, 360 aa, Pseudomonas syringae; identical to SEQ ID NO: 1478

SEQ ID NO: 18921 - DNA, 1077 bp, Pseudomonas syringae; identical to SEQ ID NO: 1479
  CDS (1)..(1077)

SEQ ID NO: 18922 - protein, 358 aa, Pseudomonas syringae; identical to SEQ ID NO: 1480

SEQ ID NO: 18923 - DNA, 1062 bp, Pseudomonas putida; identical to SEQ ID NO: 1481
  CDS (1)..(1062)

SEQ ID NO: 18924 - protein, 353 aa, Pseudomonas putida; identical to SEQ ID NO: 1482

SEQ ID NO: 18925 - DNA, 1113 bp, Pseudomonas putida; identical to SEQ ID NO: 1483
  CDS (1)..(1113)

SEQ ID NO: 18926 - protein, 370 aa, Pseudomonas putida; identical to SEQ ID NO: 1484

SEQ ID NO: 18927 - DNA, 1086 bp, Bradyrhizobium japonicum; identical to SEQ ID NO: 1485
  CDS (1)..(1086)

SEQ ID NO: 18928 - protein, 361 aa, Bradyrhizobium japonicum; identical to SEQ ID NO: 1486

SEQ ID NO: 18929 - DNA, 1053 bp, Yersinia pestis; identical to SEQ ID NO: 1487
  CDS (1)..(1053)

SEQ ID NO: 18930 - protein, 350 aa, Yersinia pestis; identical to SEQ ID NO: 1488

SEQ ID NO: 18931 - DNA, 1077 bp, Yersinia pestis; identical to SEQ ID NO: 1489
  CDS (1)..(1077)

SEQ ID NO: 18932 - protein, 358 aa, Yersinia pestis; identical to SEQ ID NO: 1490

SEQ ID NO: 18933 - DNA, 1038 bp, Wigglesworthia glossinidia brevipalpis; identical to SEQ ID NO: 1491
  CDS (1)..(1038)

SEQ ID NO: 18934 - protein, 345 aa, Wigglesworthia glossinidia brevipalpis; identical to SEQ ID NO: 1492

SEQ ID NO: 18935 - DNA, 1053 bp, Vibrio vulnificus; identical to SEQ ID NO: 1493
  CDS (1)..(1053)

SEQ ID NO: 18936 - protein, 350 aa, Vibrio vulnificus; identical to SEQ ID NO: 1494

SEQ ID NO: 18937 - DNA, 1053 bp, Vibrio vulnificus; identical to SEQ ID NO: 1495
  CDS (1)..(1053)

SEQ ID NO: 18938 - protein, 350 aa, Vibrio vulnificus; identical to SEQ ID NO: 1496

SEQ ID NO: 18939 - DNA, 1071 bp, Vibrio vulnificus; identical to SEQ ID NO: 1497
  CDS (1)..(1071)

SEQ ID NO: 18940 - protein, 356 aa, Vibrio vulnificus; identical to SEQ ID NO: 1498

SEQ ID NO: 18941 - DNA, 1062 bp, Synechococcus elongatus; identical to SEQ ID NO: 1499
  CDS (1)..(1062)

SEQ ID NO: 18942 - protein, 353 aa, Synechococcus elongatus; identical to SEQ ID NO: 1500

SEQ ID NO: 18943 - DNA, 1032 bp, Streptococcus mutans; identical to SEQ ID NO: 1501
  CDS (1)..(1032)

SEQ ID NO: 18944 - protein, 343 aa, Streptococcus mutans; identical to SEQ ID NO: 1502

SEQ ID NO: 18945 - DNA, 1035 bp, Streptococcus mutans; identical to SEQ ID NO: 1503
  CDS (1)..(1035)

SEQ ID NO: 18946 - protein, 344 aa, Streptococcus mutans; identical to SEQ ID NO: 1504

SEQ ID NO: 18947 - DNA, 1008 bp, Streptococcus agalactiae; identical to SEQ ID NO: 1505
  CDS (1)..(1008)

SEQ ID NO: 18948 - protein, 335 aa, Streptococcus agalactiae; identical to SEQ ID NO: 1506

SEQ ID NO: 18949 - DNA, 1065 bp, Shewanella oneidensis; identical to SEQ ID NO: 1507
  CDS (1)..(1065)

SEQ ID NO: 18950 - protein, 354 aa, Shewanella oneidensis; identical to SEQ ID NO: 1508

SEQ ID NO: 18951 - DNA, 1092 bp, Shewanella oneidensis; identical to SEQ ID NO: 1509
  CDS (1)..(1092)

SEQ ID NO: 18952 - protein, 363 aa, Shewanella oneidensis; identical to SEQ ID NO: 1510

SEQ ID NO: 18953 - DNA, 1059 bp, Shewanella oneidensis; identical to SEQ ID NO: 1511
  CDS (1)..(1059)

SEQ ID NO: 18954 - protein, 352 aa, Shewanella oneidensis; identical to SEQ ID NO: 1512

SEQ ID NO: 18955 - DNA, 1053 bp, Escherichia coli O6; identical to SEQ ID NO: 1513
  CDS (1)..(1053)

SEQ ID NO: 18956 - protein, 350 aa, Escherichia coli O6; identical to SEQ ID NO: 1514

SEQ ID NO: 18957 - DNA, 1170 bp, Corynebacterium efficiens; identical to SEQ ID NO: 1515
  CDS (1)..(1170)

SEQ ID NO: 18958 - protein, 389 aa, Corynebacterium efficiens; identical to SEQ ID NO: 1516

SEQ ID NO: 18959 - DNA, 1134 bp, Bifidobacterium longum; identical to SEQ ID NO: 1517
  CDS (1)..(1134)

SEQ ID NO: 18960 - protein, 377 aa, Bifidobacterium longum; identical to SEQ ID NO: 1518

SEQ ID NO: 18961 - DNA, 1233 bp, Bifidobacterium longum; identical to SEQ ID NO: 1519
  CDS (1)..(1233)

SEQ ID NO: 18962 - protein, 410 aa, Bifidobacterium longum; identical to SEQ ID NO: 1520

SEQ ID NO: 18963 - DNA, 1221 bp, Phytophthora infestans; identical to SEQ ID NO: 1521
  CDS (20)..(1153)

SEQ ID NO: 18964 - protein, 377 aa, Phytophthora infestans; identical to SEQ ID NO: 1522

SEQ ID NO: 18965 - DNA, 1062 bp, Chlorobium tepidum; identical to SEQ ID NO: 1523
  CDS (1)..(1062)

SEQ ID NO: 18966 - protein, 353 aa, Chlorobium tepidum; identical to SEQ ID NO: 1524

SEQ ID NO: 18967 - DNA, 1074 bp, Xanthomonas campestris; identical to SEQ ID NO: 1525
  CDS (1)..(1074)

SEQ ID NO: 18968 - protein, 357 aa, Xanthomonas campestris; identical to SEQ ID NO: 1526

SEQ ID NO: 18969 - DNA, 1074 bp, Xanthomonas axonopodis; identical to SEQ ID NO: 1527
  CDS (1)..(1074)

SEQ ID NO: 18970 - protein, 357 aa, Xanthomonas axonopodis; identical to SEQ ID NO: 1528

SEQ ID NO: 18971 - DNA, 1080 bp, Ralstonia solanacearum; identical to SEQ ID NO: 1529
  CDS (1)..(1080)

SEQ ID NO: 18972 - protein, 359 aa, Ralstonia solanacearum; identical to SEQ ID NO: 1530

SEQ ID NO: 18973 - DNA, 1179 bp, Ralstonia solanacearum; identical to SEQ ID NO: 1531
  CDS (1)..(1179)

SEQ ID NO: 18974 - protein, 392 aa, Ralstonia solanacearum; identical to SEQ ID NO: 1532

SEQ ID NO: 18975 - DNA, 1065 bp, Synechococcus sp; identical to SEQ ID NO: 1533
  CDS (1)..(1065)

SEQ ID NO: 18976 - protein, 354 aa, Synechococcus sp; identical to SEQ ID NO: 1534

SEQ ID NO: 18977 - DNA, 1035 bp, Escherichia coli; identical to SEQ ID NO: 1535
  CDS (1)..(1035)

SEQ ID NO: 18978 - protein, 344 aa, Escherichia coli; identical to SEQ ID NO: 1536

SEQ ID NO: 18979 - DNA, 1200 bp, Stigmatella aurantiaca; identical to SEQ ID NO: 1537
  CDS (62)..(1147)

SEQ ID NO: 18980 - protein, 361 aa, Stigmatella aurantiaca; identical to SEQ ID NO: 1538

SEQ ID NO: 18981 - DNA, 1092 bp, Rhizobium loti; identical to SEQ ID NO: 1539
  CDS (1)..(1092)

SEQ ID NO: 18982 - protein, 363 aa, Rhizobium loti; identical to SEQ ID NO: 1540

SEQ ID NO: 18983 - DNA, 1083 bp, Amycolatopsis mediterranei; identical to SEQ ID NO: 1541
  CDS (1)..(1083)

SEQ ID NO: 18984 - protein, 360 aa, Amycolatopsis mediterranei; identical to SEQ ID NO: 1542

SEQ ID NO: 18985 - DNA, 1053 bp, Pasteurella multocida; identical to SEQ ID NO: 1543
  CDS (1)..(1053)

SEQ ID NO: 18986 - protein, 350 aa, Pasteurella multocida; identical to SEQ ID NO: 1544

SEQ ID NO: 18987 - DNA, 1086 bp, Pasteurella multocida; identical to SEQ ID NO: 1545
  CDS (1)..(1086)

SEQ ID NO: 18988 - protein, 361 aa, Pasteurella multocida; identical to SEQ ID NO: 1546

SEQ ID NO: 18989 - DNA, 1125 bp, Emericella nidulans; identical to SEQ ID NO: 1547
  CDS (1)..(1125)

SEQ ID NO: 18990 - protein, 374 aa, Emericella nidulans; identical to SEQ ID NO: 1548

SEQ ID NO: 18991 - DNA, 1089 bp, Emericella nidulans; identical to SEQ ID NO: 1549
  CDS (1)..(1089)

SEQ ID NO: 18992 - protein, 362 aa, Emericella nidulans; identical to SEQ ID NO: 1550

SEQ ID NO: 18993 - DNA, 1239 bp, Vibrio cholerae; identical to SEQ ID NO: 1551
  CDS (114)..(1175)

SEQ ID NO: 18994 - protein, 353 aa, Vibrio cholerae; identical to SEQ ID NO: 1552

SEQ ID NO: 18995 - DNA, 2184 bp, Candida albicans; identical to SEQ ID NO: 1553
  CDS (461)..(1573)

SEQ ID NO: 18996 - protein, 370 aa, Candida albicans; identical to SEQ ID NO: 1554

SEQ ID NO: 18997 - DNA, 1047 bp, Buchnera aphidicola; identical to SEQ ID NO: 1555
  CDS (1)..(1047)

SEQ ID NO: 18998 - protein, 348 aa, Buchnera aphidicola; identical to SEQ ID NO: 1556

SEQ ID NO: 18999 - DNA, 1047 bp, Buchnera aphidicola; identical to SEQ ID NO: 1557
  CDS (1)..(1047)

SEQ ID NO: 19000 - protein, 348 aa, Buchnera aphidicola; identical to SEQ ID NO: 1558

SEQ ID NO: 19001 - DNA, 1047 bp, Erwinia herbicola; identical to SEQ ID NO: 1559
  CDS (1)..(1047)

SEQ ID NO: 19002 - protein, 348 aa, Erwinia herbicola; identical to SEQ ID NO: 1560

SEQ ID NO: 19003 - DNA, 1047 bp, Salmonella typhimurium; identical to SEQ ID NO: 1561
  CDS (1)..(1047)

SEQ ID NO: 19004 - protein, 348 aa, Salmonella typhimurium; identical to SEQ ID NO: 1562

SEQ ID NO: 19005 - DNA, 23 bp, Artificial sequence
  (1)..(23): primer
atgaacagaactgacgaactccg

SEQ ID NO: 19006 - DNA, 24 bp, Artificial sequence
  (1)..(24): primer
ttagaagcgggtatctaccgcaga

SEQ ID NO: 19007 - protein, 352 aa, Artificial sequence
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(40): xaa in position 37 to 40 is any amino acid
  Variant (42)..(43): xaa in position 42 to 43 is any amino acid
  Variant (45)..(46): xaa in position 45 to 46 is any amino acid
  Variant (51)..(51): xaa in position 51 is any amino acid
  Variant (54)..(55): xaa in position 54 to 55 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(128): xaa in position 121 to 128 is any amino acid
  Variant (130)..(130): xaa in position 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(167): xaa in position 166 to 167 is any amino acid
  Variant (170)..(170): xaa in position 170 is any amino acid
  Variant (173)..(173): xaa in position 173 is any amino acid
  Variant (175)..(175): xaa in position 175 is any amino acid
  Variant (180)..(180): xaa in position 180 is any amino acid
  Variant (182)..(182): xaa in position 182 is any amino acid
  Variant (184)..(187): xaa in position 184 to 187 is any amino acid
  Variant (189)..(190): xaa in position 189 to 190 is any amino acid
  Variant (192)..(194): xaa in position 192 to 194 is any amino acid
  Variant (196)..(198): xaa in position 196 to 198 is any amino acid
  Variant (200)..(200): xaa in position 200 is any amino acid
  Variant (202)..(207): xaa in position 202 to 207 is any amino acid
  Variant (209)..(214): xaa in position 209 to 214 is any amino acid
  Variant (216)..(216): xaa in position 216 is any amino acid
  Variant (219)..(221): xaa in position 219 to 221 is any amino acid
  Variant (223)..(224): xaa in position 223 to 224 is any amino acid
  Variant (229)..(237): xaa in position 229 to 237 is any amino acid
  Variant (240)..(268): xaa in position 240 to 268 is any amino acid
  Variant (270)..(270): xaa in position 270 is any amino acid
  Variant (273)..(273): xaa in position 273 is any amino acid
  Variant (276)..(276): xaa in position 276 is any amino acid
  Variant (278)..(281): xaa in position 278 to 281 is any amino acid
  Variant (283)..(284): xaa in position 283 to 284 is any amino acid
  Variant (286)..(291): xaa in position 286 to 291 is any amino acid
  Variant (293)..(295): xaa in position 293 to 295 is any amino acid
  Variant (297)..(304): xaa in position 297 to 304 is any amino acid
  Variant (306)..(306): xaa in position 306 is any amino acid
  Variant (308)..(308): xaa in position 308 is any amino acid
  Variant (311)..(314): xaa in position 311 to 314 is any amino acid
  Variant (316)..(316): xaa in position 316 is any amino acid
  Variant (318)..(333): xaa in position 318 to 333 is any amino acid
  Variant (336)..(336): xaa in position 336 is any amino acid
  Variant (338)..(338): xaa in position 338 is any amino acid
  Variant (341)..(341): xaa in position 341 is any amino acid
  Variant (343)..(344): xaa in position 343 to 344 is any amino acid
  Variant (346)..(347): xaa in position 346 to 347 is any amino acid
  Variant (349)..(351): xaa in position 349 to 351 is any amino acid
LXXPXXXXXXXPXXXXXXXXXXXXRXXXXXIXXGXDXXXXRXXVXXGPCSXHDXXAAXXYAXXLXXXXXXXXXXXXLXXXMRXYXEKPRTXXXGWKGLIXDPXXXXXXXXXXGLXXXRXLXXXXXXXXGXPXAXEXLDXXXXQXXXDXXXXXAIGARTTESQXHRXXASXLSXPXGFKNXTXGXXXXAXXAXXXAXXXHXFXXXXXXGXXXXXXTXGNXXXHXXLRGGXXXXXXXXXNYXXXXXXXXXXXXXXXXXXXXXXXXXXXXXDXSHXNSXKXXXXQXXVXXXXXXQXXXGXXXXXXXXGXMXESXXXXGXQXXXXXXXXXXXXXXXXYGXSXTDXCXXWXXTXXXL

SEQ ID NO: 19008 - protein, 24 aa, Artificial sequence
  Variant (2)..(2): xaa in position 2 is any amino acid
  Variant (3)..(3): xaa in position 3 is Leu, Val, Phe, Ile, Ala or Met
  Variant (4)..(4): xaa in position 4 is Val, Ile, Leu or Ala
  Variant (5)..(5): xaa in position 5 is Val or Ile
  Variant (6)..(6): xaa in position 6 is Val, Ile, Cys or Thr
  Variant (11)..(11): xaa in position 11 is Ile, Val, Ser or Leu
  Variant (12)..(12): xaa in position 12 is His or Asp
  Variant (13)..(13): xaa in position 13 is Asp or Asn
  Variant (14)..(15): xaa in position 14 to 15 is any amino acid
  Variant (16)..(16): xaa in position 16 is Ala, Ser, Gln or Thr
  Variant (17)..(17): xaa in position 17 is Ala, Val or Gly
  Variant (18)..(18): xaa in position 18 is any amino acid
  Variant (19)..(19): xaa in position 19 is Glu, Asp, Ala or Gln
  Variant (21)..(21): xaa in position 21 is Ala, Gly, Cys or Ser
  Variant (22)..(22): xaa in position 22 is any amino acid
  Variant (23)..(23): xaa in position 23 is Arg, Lys, Gln, His or Leu
  Variant (24)..(24): xaa in position 24 is Leu, Ile or Phe
RXXXXXGPCSXXXXXXXXXYXXXX

SEQ ID NO: 19009 - protein, 42 aa, Artificial sequence; identical to SEQ ID NO: 2884
  Variant (1)..(1): xaa in position 1 is Leu, Ile, Phe or Met
  Variant (2)..(2): xaa in position 2 is any amino acid
  Variant (3)..(3): xaa in position 3 is Ile, Val, Leu or Met
  Variant (4)..(4): xaa in position 4 is Val, Ile or Leu
  Variant (7)..(7): xaa in position 7 is Val, Ala or Thr
  Variant (9)..(9): xaa in position 9 is Phe, Leu, Thr or Val
  Variant (10)..(10): xaa in position 10 is Glu or Ala
  Variant (15)..(16): xaa in position 15 to 16 is any amino acid
  Variant (17)..(17): xaa in position 17 is any or no amino acid
  Variant (19)..(19): xaa in position 19 is Trp or Tyr
  Variant (20)..(20): xaa in position 20 is Lys or Arg
  Variant (22)..(22): xaa in position 22 is Leu, Phe, Met or Tyr
  Variant (23)..(23): xaa in position 23 is Ile, Val, Ala or Leu
  Variant (24)..(24): xaa in position 24 is any amino acid
  Variant (25)..(25): xaa in position 25 is Asp, Glu or Gln
  Variant (27)..(27): xaa in position 27 is any amino acid
  Variant (28)..(28): xaa in position 28 is Leu, Met, Ile, Val, Ala or Thr
  Variant (29)..(29): xaa in position 29 is Asp, Asn or Ser
  Variant (30)..(33): xaa in position 30 to 33 is any amino acid
  Variant (34)..(34): xaa in position 34 is Ile, Val, Leu or Met
  Variant (35)..(36): xaa in position 35 to 36 is any amino acid
  Variant (38)..(38): xaa in position 38 is Leu, Ile, Met or Val
  Variant (39)..(40): xaa in position 39 to 40 is any amino acid
  Variant (41)..(41): xaa in position 41 is Ala, Ser, Gly, Val or Thr

SEQ ID NO: 19010 - protein, 65 aa, Artificial sequence; identical to SEQ ID NO: 2885
  Variant (2)..(2): xaa in position 2 is any amino acid
  Variant (4)..(4): xaa in position 4 is Asp, Tyr, Gln, Asn or Glu
  Variant (5)..(9): xaa in position 5 to 9 is any amino acid
  Variant (10)..(10): xaa in position 10 is Tyr, Phe or Leu
  Variant (11)..(12): xaa in position 11 to 12 is any amino acid
  Variant (13)..(13): xaa in position 13 is Asp or Glu
  Variant (14)..(15): xaa in position 14 to 15 is any amino acid
  Variant (16)..(16): xaa in position 16 is Ser, Ala, Thr or Cys
  Variant (17)..(17): xaa in position 17 is Trp, Phe, Tyr, Leu or Val
  Variant (18)..(18): xaa in position 18 is any amino acid
  Variant (19)..(19): xaa in position 19 is Ala or Ser
  Variant (20)..(20): xaa in position 20 is Ile or Val
  Variant (24)..(24): xaa in position 24 is Thr, Ser or Asn
  Variant (25)..(25): xaa in position 25 is Thr, Val, Ala, Ser or Ile
  Variant (26)..(26): xaa in position 26 is Glu or Ala
  Variant (27)..(27): xaa in position 27 is Ser, Asp or Asn
  Variant (29)..(29): xaa in position 29 is any amino acid
  Variant (32)..(32): xaa in position 32 is Glu, Gln, Phe or Met
  Variant (33)..(33): xaa in position 33 is Leu, Met, Val, Ile or Phe
  Variant (34)..(34): xaa in position 34 is Ala, Ser, Thr, Cys or Val
  Variant (36)..(36): xaa in position 36 is Gly, Ala or Asn
  Variant (37)..(39): xaa in position 37 to 39 is any amino acid
  Variant (40)..(40): xaa in position 40 is Pro or Ala
  Variant (41)..(41): xaa in position 41 is Val, Ile, Thr or Leu
  Variant (43)..(43): xaa in position 43 is Phe, Met, Tyr or Ile
  Variant (46)..(46): xaa in position 46 is any amino acid
  Variant (47)..(47): xaa in position 47 is Thr, Ser or Arg
  Variant (48)..(48): xaa in position 48 is any amino acid
  Variant (50)..(53): xaa in position 50 to 53 is any amino acid
  Variant (54)..(54): xaa in position 54 is Ala or Met
  Variant (55)..(55): xaa in position 55 is any amino acid
  Variant (56)..(56): xaa in position 56 is Asp, Asn or Glu
  Variant (57)..(57): xaa in position 57 is Ala or Gly
  Variant (58)..(59): xaa in position 58 to 59 is any amino acid
  Variant (60)..(60): xaa in position 60 is Ala or Ser
  Variant (61)..(61): xaa in position 61 is Ala, Ser, Val or Thr
  Variant (62)..(64): xaa in position 62 to 64 is any amino acid
  Variant (65)..(65): xaa in position 65 is His or Gln

SEQ ID NO: 19011 - protein, 71 aa, Artificial sequence; identical to SEQ ID NO: 2886
  Variant (1)..(1): xaa in position 1 is Thr or Ser
  Variant (2)..(2): xaa in position 2 is any amino acid
  Variant (5)..(7): xaa in position 5 to 7 is any amino acid
  Variant (8)..(8): xaa in position 8 is His or Phe
  Variant (9)..(9): xaa in position 9 is Val, Ile, Leu or Ala
  Variant (10)..(10): xaa in position 10 is Ile or Val
  Variant (11)..(11): xaa in position 11 is Leu or Met
  Variant (14)..(14): xaa in position 14 is Gly, Ser or Ala
  Variant (15)..(16): xaa in position 15 to 16 is any amino acid
  Variant (17)..(22): xaa in position 17 to 22 is any or no amino acid
  Variant (23)..(23): xaa in position 23 is Pro, Thr or Ser
  Variant (25)..(25): xaa in position 25 is Tyr, Phe or His
  Variant (26)..(29): xaa in position 26 to 29 is any amino acid
  Variant (30)..(30): xaa in position 30 is Val, Ile or Leu
  Variant (31)..(36): xaa in position 31 to 36 is any amino acid
  Variant (37)..(37): xaa in position 37 is Leu, Met, Ile, Tyr or His
  Variant (38)..(40): xaa in position 38 to 40 is any amino acid
  Variant (41)..(51): xaa in position 41 to 51 is any or no amino acid
  Variant (52)..(52): xaa in position 52 is Leu, Ile or Val
  Variant (53)..(53): xaa in position 53 is Met, Val, Ile or Leu
  Variant (54)..(54): xaa in position 54 is Ile or Val
  Variant (56)..(56): xaa in position 56 is Cys, Phe, Ala, Thr, Tyr or Val
  Variant (57)..(57): xaa in position 57 is Ser, Asn or Ala
  Variant (59)..(59): xaa in position 59 is Gly, Ala or Asp
  Variant (61)..(61): xaa in position 61 is Ser or Cys
  Variant (62)..(62): xaa in position 62 is any amino acid
  Variant (64)..(66): xaa in position 64 to 66 is any amino acid
  Variant (67)..(67): xaa in position 67 is Arg, Asn, Lys, Leu or Glu
  Variant (69)..(70): xaa in position 69 to 70 is any amino acid
  Variant (71)..(71): xaa in position 71 is Val or Ile

SEQ ID NO: 19012 - protein, 41 aa, Artificial sequence; identical to SEQ ID NO: 2887
  Variant (2)..(2): xaa in position 2 is any amino acid
  Variant (4)..(4): xaa in position 4 is Ile, Leu, Val, Ala or Met
  Variant (7)..(7): xaa in position 7 is His, Asn, Phe or Tyr
  Variant (8)..(8): xaa in position 8 is Leu or Ile
  Variant (9)..(10): xaa in position 9 to 10 is any amino acid
  Variant (12)..(12): xaa in position 12 is any amino acid
  Variant (14)..(19): xaa in position 14 to 19 is any amino acid
  Variant (20)..(30): xaa in position 20 to 30 is any or no amino acid
  Variant (32)..(32): xaa in position 32 is any amino acid
  Variant (34)..(34): xaa in position 34 is Ile or Val
  Variant (37)..(37): xaa in position 37 is Ala, Pro, Gly, Lys, Ser or Glu
  Variant (39)..(39): xaa in position 39 is Ile, Leu or Val
  Variant (40)..(40): xaa in position 40 is any amino acid
  Variant (41)..(41): xaa in position 41 is Trp, Ile, Leu or Phe

SEQ ID NO: 19013 - DNA, 1185 bp, Saccharomyces cerevisiae
  CDS (1)..(1185)
atgtggacaaacactttcaaatggtgcagcaaaactgagaaggagaccactactgcagacgccaaggtgtgtgctagcgtgcagggcctgaaggccctgcagcagcaaattatggatagcaccactgtgcgtgggtccgttaataacacgatgactccaggcgggattaaccagtggcatttccacaataagcgtgcgaacaaagtgtgcacgcctacagtactaatccatggatacgctgcctcgtcgatggcgttctacaggacgtttgagaacctgtcagacaacattaaagatctatatgccatcgacttgccagccaatggtgcctcagaggcgccagcattgcaagtgaacaaaaccaagaagatcaagtctctcaggtttaagcatatagaagatgacgtagtaatccctgtgatagagaagcgccccccagcagaggacatcaagtcacacctggagcagtacgaaagctacttcgtagacaggatagagcaatggcggaaggataacaagcttcgcaaaataaacgtggtgggccattcattcggaggatatatttcattcaaatacgccctcaagtaccctgattccattgagaaactgtgtctcatatctcctcttggtgtggaaaacagtatacatgctatcacccacaaatgggagcccaacaccacctatccacttacgtttaccgacccatcgtcccgatattatacaagaaagctgaacgtaccgcggtttatctttgaaaaccagctaaacgttttgaagtggatgggacccataggctccaaattgtgctcgaactacatctccaccgcatacgtaaaagttccggatcagatatataaggactatcttttgcactcatttgtcgggaagaaccagacggtgcaaccacagacaatcaaggtgttcacccatttgtttgaaaggaatctgatcgctagagatccgataataaacaacgttcgttttttgaacccagcaacgcctgtcatgttcatgtatggcgagcacgattggatggataaatatgcgggctacttgactactgaatcaatgctaaaaaacaaggcaaaggctagctacgttgaagtccctgatgctggccataatcttttcctggacaacccgcagcactttgcctcttctttagtctcgttcctgtcaaagtaa

SEQ ID NO: 19014 - protein, 394 aa, Saccharomyces cerevisiae
MWTNTFKWCSKTEKETTTADAKVCASVQGLKALQQQIMDSTTVRGSVNNTMTPGGINQWHFHNKRANKVCTPTVLIHGYAASSMAFYRTFENLSDNIKDLYAIDLPANGASEAPALQVNKTKKIKSLRFKHIEDDVVIPVIEKRPPAEDIKSHLEQYESYFVDRIEQWRKDNKLRKINVVGHSFGGYISFKYALKYPDSIEKLCLISPLGVENSIHAITHKWEPNTTYPLTFTDPSSRYYTRKLNVPRFIFENQLNVLKWMGPIGSKLCSNYISTAYVKVPDQIYKDYLLHSFVGKNQTVQPQTIKVFTHLFERNLIARDPIINNVRFLNPATPVMFMYGEHDWMDKYAGYLTTESMLKNKAKASYVEVPDAGHNLFLDNPQHFASSLVSFLSK

SEQ ID NO: 19015 - DNA, 1362 bp, Saccharomyces cerevisiae
  CDS (1)..(1362)
atgcttttaataaagaggtacttgatggaccctgaaagtttaaggaggcagataatgaatgtatataaatgttacatgtggaagagagcgttccacagtaatagaagcctactggaagttaaacgtcgtgaaaagagtctccagagaaaaattttggaaaggattcttagacccaaggaggaaaatgctgtcaaaaaatctggattcaagctatggtcaagccatttgaataacccacacaaaacttatatgcggctggaggaattacagagacgtattatggaagaggtacacgttgaaggtattaaaaagaatgataagttattcaacgaaataaatcaatggcatttccaaaatgaaaacacaagtactgttcgaacaccaacattgctgatacatggctatgccgcatcttcaatgtcttttttcagaaattatccaggtctgtccaagcacatccgaaatttatactcaattgacatgccagcgagcggattgtcttcagtaccgtctttagagatcaatacaacaacacctctgccgttagatatcaaatttattggagaaaataaatttaaggttccatatacaataaatgcaaatcacaataaatttgtgattcaaatgtacgaagatttctatctcgacagaatcgagcaatggcgcattgataacaaattgggcaaaatgaatgttgtggggcattcttttggcggatatttatcttttaaatatgctgttaaatatccaaactcggtaaacaaactttgcttggtatccccactaggagtggaaaggaatatctggtctgtaaataataatttccactccaacactctttatactatcgattttaaaaatccaaattccaagttttactccaaaagaaatatgattccaaaatacttatttgaacaacaatttcacattttgagaatgatgggaccattaggagctaagttatgttggaattacataatggcggcatatagccgagtcccatcgttggcatacaaagagtacatatttgaactgttttacggtaagggaggtataccggaggttacgacagatattttcaaagcgttattttcaagatgtatcctagcaaaggaccccttgatggattctctgcaatatttaaatgttaagaaattattgatagtatatgggcaatatgattggatgaataaaaaagccggtatgttcatggtcaaagagttgaacaatttaaagaactgtctagaaggagcaagttatttagaaataccttcttccggtcacaatctttttttagataacccagaatcattcaaccaatctatagtgtccttcttatcagacgaaactaaatcgccttga

SEQ ID NO: 19016 - protein, 453 aa, Saccharomyces cerevisiae
MLLIKRYLMDPESLRRQIMNVYKCYMWKRAFHSNRSLLEVKRREKSLQRKILERILRPKEENAVKKSGFKLWSSHLNNPHKTYMRLEELQRRIMEEVHVEGIKKNDKLFNEINQWHFQNENTSTVRTPTLLIHGYAASSMSFFRNYPGLSKHIRNLYSIDMPASGLSSVPSLEINTTTPLPLDIKFIGENKFKVPYTINANHNKFVIQMYEDFYLDRIEQWRIDNKLGKMNVVGHSFGGYLSFKYAVKYPNSVNKLCLVSPLGVERNIWSVNNNFHSNTLYTIDFKNPNSKFYSKRNMIPKYLFEQQFHILRMMGPLGAKLCWNYIMAAYSRVPSLAYKEYIFELFYGKGGIPEVTTDIFKALFSRCILAKDPLMDSLQYLNVKKLLIVYGQYDWMNKKAGMFMVKELNNLKNCLEGASYLEIPSSGHNLFLDNPESFNQSIVSFLSDETKSP

SEQ ID NO: 19017 - DNA, 1338 bp, Saccharomyces cerevisiae
  CDS (1)..(1338)
atgttcaagtcaactttaaactccataataagaagacccttgaaaggttttcaacttcttagaggggctgactcatcgaatacacggccacagtcccctagagcctccgcaagagatgttacagagaaacagatattaagaactccgtcagcaccaactgcaataccattaagggagattatctatagagtcccaagcttgtttcctcgccctttagaagattctgttaaggacttccgagattttatcaagaacgaggatgcattccagactgaacttttgaaaacgctgccattctaccccactccttcggaatcaaaaacagcaagacttataagaactgttgttgatgatgagggcaattacatcaatgaattttgcatacgccctcgaaaaacctcagtgcctgaggctgacttaaaacatctggttttcattcatgggtatggcgccggattgggttttttcatcaagaattttgaggatattccactattggataacgagtggtgcatacatgccatcgatttgcctgggtatggtttttcttcaagacctaagtttccgttcgagtatccgagagataatattcacagcgttcaagattggtttcacgaaagaatacacacatggtttagtaaaagaaatcttttgaaccgacctgagaaaaacattgttatggcacattctttagggtcttacttgatggctttatatttgcaaaaatataaggaatctccatcttttaaaaagctgatcctttgttccccagcaggcgtgtcttatagagatttcaacaatactgcttcagaggttgaaaaatggaaaccgcctccttggtggtatgtcaagctttgggacagaaatatctcgccttttacactagtaagaaattttcgccagttaggttcgaagattacaagtggatggtcatatcggcgctttaagcacattttgaatggtgatccagaacagtcaaaacggtttgaagccttgcatagatacgcatatgctattttcaataaacgtggttcaggtgaatacttattaagctttgctttgaaatgtggtggtgaaccaagactatcattggagcagcagctattcgatggcaaaaagtctgatattttaaagaatagtaattgtgactggctttggctttatggcgatgacgattggatggatgtgaatggtggacttagagtatcaagattcttgaaagagaagttgaaacaaaaaagtaacgtcatcattgttcctcattcagggcatcacttgtacctggataactataagtttttcaataatattcttacgaaagaaatgcaaaaaatataa

SEQ ID NO: 19018 - protein, 445 aa, Saccharomyces cerevisiae
MFKSTLNSIIRRPLKGFQLLRGADSSNTRPQSPRASARDVTEKQILRTPSAPTAIPLREIIYRVPSLFPRPLEDSVKDFRDFIKNEDAFQTELLKTLPFYPTPSESKTARLIRTVVDDEGNYINEFCIRPRKTSVPEADLKHLVFIHGYGAGLGFFIKNFEDIPLLDNEWCIHAIDLPGYGFSSRPKFPFEYPRDNIHSVQDWFHERIHTWFSKRNLLNRPEKNIVMAHSLGSYLMALYLQKYKESPSFKKLILCSPAGVSYRDFNNTASEVEKWKPPPWWYVKLWDRNISPFTLVRNFRQLGSKITSGWSYRRFKHILNGDPEQSKRFEALHRYAYAIFNKRGSGEYLLSFALKCGGEPRLSLEQQLFDGKKSDILKNSNCDWLWLYGDDDWMDVNGGLRVSRFLKEKLKQKSNVIIVPHSGHHLYLDNYKFFNNILTKEMQKI

SEQ ID NO: 19019 - DNA, 1287 bp, Schizosaccharomyces pombe
  CDS (1)..(1287)
atgagccaagtgaaagtcgcggtgagaagtgaggaagcagctaattcttatacgcaaacgtttggcatgtcctggaggcaatggcgtcaagcatgctctgaagaatatgcgaaacaatgtgagcgtgaagtcctgcacactgtcgattttattcgggaaaatgaaaaggacccagaaaggttagttgaagttgtagattccaaaatctacgataatgatggattggtacatgaggtttgtgttagtgataaagcaacaggaaaagcgaacaagcgaagcattgtttacatgcatgggtatggagctggtcttggtttttactttcggaacatggatggtttgactaagggtgtgacaaaggattttaattcttattttgttgattggctaggcatgggaaactcgtcaagaccgcctttcgatatcaaggggcaaaccgcttcagagaaggtcgaagaaacagagaggtttttcactgagtcattagaaacatggagaatcggtcatggtatcgagaaaatgatccttgtgggccatagtatgggaggttatttgtctgctgtctacgccatgcaatatccggaacgtgttgagaaactcttactagttagtccagttgccattcctgaaaacccttttgcaagcaacgatgatgcggaagtttacaattccgttgcttcctctgctgtgcatgctgttatggatgaacctcctttaagtaatgttactaatgaggttctgcaaacccaagaggaaactacaggtttagagccttcccggccaagcaagccaaagaatcctcttccaagatttatcaccttcttatgggagcaaaatgttacaccattttctctacttcgtttaagcgggcctttaggtcctaaactaatgagtttttggtctagcagaaggttttcaacgcttcccccggaaacgtttagggcattacataattactgctactcaatatttcgtctcaagggttccagcgagtatgcacttggcaatttgctcgctcccggagctttcgctagacgatgtattatgaatcgcttgcgcatgttgaagtgtcgaactatattcatgtatggagataaagattggatggatgatgttgctggtttagaagcgacaaacagattgaaggagatgaatattgaggcggagcaccacataatttcaaatgctggtcaccattgctatcttgataaccctgaagattttaatgagattgtactaaaggagatacgaatgagtttacgttctttttcttcgatttcagagtaa

SEQ ID NO: 19020 - protein, 428 aa, Schizosaccharomyces pombe
MSQVKVAVRSEEAANSYTQTFGMSWRQWRQACSEEYAKQCEREVLHTVDFIRENEKDPERLVEVVDSKIYDNDGLVHEVCVSDKATGKANKRSIVYMHGYGAGLGFYFRNMDGLTKGVTKDFNSYFVDWLGMGNSSRPPFDIKGQTASEKVEETERFFTESLETWRIGHGIEKMILVGHSMGGYLSAVYAMQYPERVEKLLLVSPVAIPENPFASNDDAEVYNSVASSAVHAVMDEPPLSNVTNEVLQTQEETTGLEPSRPSKPKNPLPRFITFLWEQNVTPFSLLRLSGPLGPKLMSFWSSRRFSTLPPETFRALHNYCYSIFRLKGSSEYALGNLLAPGAFARRCIMNRLRMLKCRTIFMYGDKDWMDDVAGLEATNRLKEMNIEAEHHIISNAGHHCYLDNPEDFNEIVLKEIRMSLRSFSSISE

SEQ ID NO: 19021 - DNA, 1621 bp, Arabidopsis thaliana
  CDS (86)..(1342)
agtagcaaacttctcgattccttgattcgtgggaaaaagaaagtctagatttttgtggattttgattttgtgattccgtgattgtatgaacttgagccgttttgcttcgagattaagaatggcggaagaaatctcaaagacgaaggtgggatcttcttctactgcttcggtggctgattcatctgctgctgcgtcggctgcaacgaatgcggccaaatcaagatggaaaattttgtggcctaattcgctccggtggattcctacgtccaccgattacatcatcgccgccgagaaacgtcttctctccatcctcaagacgccttatgtacaagagcaagtcagtattggttcaggaccaccaggttctaaaatcaggtggtttaggtctacgagcaatgagtcacgttacatcaacactgttacatttgatgccaaggagggagctcctacactcgtcatggttcatggttatggtgcttctcaagggtttttcttccgtaattttgatgctcttgccagtcgatttagagtgatcgctattgatcaacttgggtggggtggttcaagtaggcctgattttacatgtagaagcacagaagaaactgaggcatggtttatcgactcctttgaggaatggcgtaaagcccagaatctcagtaactttattctattaggacattcttttggaggctatgttgctgctaaatacgcgcttaagcatcctgaacatgttcaacacttaattctggtgggatctgctgggttctcagcagaagcagatgccaaatcagaatggctcactaaatttagagcaacatggaaaggtgcagtcctaaatcatttatgggagtcaaatttcactcctcagaagctggttagaggattaggtccttggggtccaggtcttgtaaatcggtatacaactgcaagatttggtgcacattcggagggaactgggctaacagaagaggaagccaaattgctaaccgattatgtgtaccatactttggctgcaaaggctagtggagagttatgcttgaaatacatcttctcatttggagcatttgctaggaagcccctcttacaaagtgcatcagagtggaaagtgccaacaacgtttatctatggaatgaatgattggatgaactatcaaggtgcggtggaagcgaggaaatccatgaaggtcccttgcgaaatcattcgggttccacagggtggtcattttgtgttcatagacaacccaattggttttcattctgcagtgctttatgcttgccgcaagtttatatctcaagactcctctcatgatcaacaactcctagatggtctacgattggtttagtcatagtatcttgttccttttaccttccaaatttattctatatgtgtatacaagtatatatgaaaaagaacataaaaaagaattactttctttatttgaatattcggttgtgtattggagtttcaagtcctctttccatgtctaaaagttctatttgtaacgttcttgatttcactctaaaacctcttaaagtgtttcaaatgtgatctcattatcgacatccaagttgtaatctttcacaatccacaataatcttttatctcattttttacattttac

SEQ ID NO: 19022 - protein, 418 aa, Arabidopsis thaliana
MNLSRFASRLRMAEEISKTKVGSSSTASVADSSAAASAATNAAKSRWKILWPNSLRWIPTSTDYIIAAEKRLLSILKTPYVQEQVSIGSGPPGSKIRWFRSTSNESRYINTVTFDAKEGAPTLVMVHGYGASQGFFFRNFDALASRFRVIAIDQLGWGGSSRPDFTCRSTEETEAWFIDSFEEWRKAQNLSNFILLGHSFGGYVAAKYALKHPEHVQHLILVGSAGFSAEADAKSEWLTKFRATWKGAVLNHLWESNFTPQKLVRGLGPWGPGLVNRYTTARFGAHSEGTGLTEEEAKLLTDYVYHTLAAKASGELCLKYIFSFGAFARKPLLQSASEWKVPTTFIYGMNDWMNYQGAVEARKSMKVPCEIIRVPQGGHFVFIDNPIGFHSAVLYACRKFISQDSSHDQQLLDGLRLV

SEQ ID NO: 19023 - DNA, 1068 bp, Caenorhabditis elegans
  CDS (1)..(1068)
atgaccgaaactgatattgcaacttcaaaaccttggttttcaacctcttcatgttcatcaaaaagtgagaaattggcagaagctgaaaatcggatttttaccgcacttggaataaagttttcatctgaactggtccagattccattcaaaaacactgaaatcaacacaattactgtgaattgtgagaacgagagttctgaactaaaatcaaaatatccaattgttttgattcatggatttggagctggagttgctctttggggatctgccattaagaggcttgcacaatttcaaaatgtttatgctatagatctacctggatttggccgctcgagtcgcacaaaattctcaactgatccagagactgctgaaaaggaaatgattgaagcaatcgagcaatggagagttaaaatgaatttggaaaagatgaatctggttggtcactcatttggtggatacctctccacatcttacgccctcaagtatcctaaacgaatagaaaacctaatacttgctgatccatgggggttcacagatgtggacccgagttttttggaaaagttgacgaaacggcaaaaagctctgttttgggttattctgaagtttaatccacttgctgctctaagactcgttggtggatatggcccatctcttatgaagcgtctacgcccggatctagaacaaaaatactctgaagatgtgtatgactacatttacctagctaactcgggaaatccaacaggagaaataattttcaaaagcttgtcagagaatttacgatgggcaaagaacccaatgagcaaaagattccacgagttagataaaaccgttcctgtaaaatttattcacggaggaatgagctgggtggattggaaaaccactagggaaatgtttggaagtatggatcatgtagagtcacatatcatagaaggagccggccaccatgtctacgcagacgatactgatcgatttgtggagctcgtcataggatctttgaaggatggaaagactggagatctggtgccagaagaagtgaatttggaagaagatattgtgactccactgtag

SEQ ID NO: 19024 - protein, 355 aa, Caenorhabditis elegans
MTETDIATSKPWFSTSSCSSKSEKLAEAENRIFTALGIKFSSELVQIPFKNTEINTITVNCENESSELKSKYPIVLIHGFGAGVALWGSAIKRLAQFQNVYAIDLPGFGRSSRTKFSTDPETAEKEMIEAIEQWRVKMNLEKMNLVGHSFGGYLSTSYALKYPKRIENLILADPWGFTDVDPSFLEKLTKRQKALFWVILKFNPLAALRLVGGYGPSLMKRLRPDLEQKYSEDVYDYIYLANSGNPTGEIIFKSLSENLRWAKNPMSKRFHELDKTVPVKFIHGGMSWVDWKTTREMFGSMDHVESHIIEGAGHHVYADDTDRFVELVIGSLKDGKTGDLVPEEVNLEEDIVTPL

SEQ ID NO: 19025 - DNA, 1152 bp, Oryza sativa
  CDS (1)..(1152)
atggtttgtgttagttacaagatacaacctcctaaggttgtattaattgttggtgtggtgtttcttcctggttttatgctctcagctatattgttaacaaatatacttcagttctttcttcattttgctctagatatatctgaggctctttgcaattttctaattggtggtgcactttttatatctctttacagaactggctatgtccaagaacaagttaacattggctcctctccacccggatcaaaagttagatggtttagatcatcaagtgatgagccaagattcatcaatactgtaacatttgatagcgaagaaaatgctcccacccttgtcatggtccatgggtatggtgcttcacagggtttcttctttcgaaactttgatgcccttgcaagccgtttcagggtgattgccattgatcagcttggttggggtggatcaagtagacctgacttcacttgtaaaagtactgaagaaactgaggcatggttcatagattcctttgaggaatggcgcaaagcaaagaatctcagtaattttatattgctcggtcactcttttggaggatatgttgcggcaaagtacgctttacagcatcctgagcacgtccaacacttgatcttggtcggccctgctggcttttcatcagaaacagagcatagctctgagtggttaaccaagttccgagctacatggaaaggcatgctagtgaatcatctatgggagtccaattttactcctcaaagaatagtgagaggattgggtccttggggaccaggcttagttcagagatataccagtgccagatttggctcacattcaacagattacatttaccatactttggctgccaaagctagtggagagttgtgcttaaaacatatattttcctttggggcattcgtgaggaaacctcttctgcaaagtgcatccgattggaaagtgccaactactttcatatatggccaacaagattggatgaattaccaaggtgcacagcaagcacggaaagaaatgaaaggaggacattttgtgttcatagataatccttcggggttccactccgcggtcttccacgcatgccgcaagtttctatctggagatggagaggaaggcctctctcttcctgaaggcctaacatcggcctga

SEQ ID NO: 19026 - protein, 383 aa, Oryza sativa
MVCVSYKIQPPKVVLIVGVVFLPGFMLSAILLTNILQFFLHFALDISEALCNFLIGGALFISLYRTGYVQEQVNIGSSPPGSKVRWFRSSSDEPRFINTVTFDSEENAPTLVMVHGYGASQGFFFRNFDALASRFRVIAIDQLGWGGSSRPDFTCKSTEETEAWFIDSFEEWRKAKNLSNFILLGHSFGGYVAAKYALQHPEHVQHLILVGPAGFSSETEHSSEWLTKFRATWKGMLVNHLWESNFTPQRIVRGLGPWGPGLVQRYTSARFGSHSTDYIYHTLAAKASGELCLKHIFSFGAFVRKPLLQSASDWKVPTTFIYGQQDWMNYQGAQQARKEMKGGHFVFIDNPSGFHSAVFHACRKFLSGDGEEGLSLPEGLTSA

SEQ ID NO: 19027 - DNA, 1485 bp, Debaryomyces hansenii CBS767
  CDS (1)..(1485)
atgttgagtacgaaaaatttgctgaagatacatgtgaatcaaataagatttgctagttttaaggttcccaagtcttatgtacctagtaagctaaacagacatattccttttaaactggctctatcaatatggtaccagtcattgaaaccaggtagattacaaactttacaagatgagcttactgagttgatgttaccaactgaattgaactctcatttagtcaaggaaaataagaaagtgagaatcgacaatgatgggaattatttgaatgaactttcttttgaaataaataacaattcagacaagccaactaagcatgttgtatttatacatggctatggtgcatctttgggatgctttgccagaaattatcaaatcattaatagtttgcaagatcggagatacaattacaaagtccatttcttggataacatttctttcggattgtcatcgaacccaaaaatcacatcatcgctcattaacggaagaataccaacatgtccatcagtaaagatgtatgatcctgaacctactactaaggaaaatgtatacaataagtattacaaattaattgaatcgtacgaaattaataaggaagaattccaagaataccaagacaagtttattcctattttaaatgaaatggagaaatattatattgaggcaattgaaaattggcgtattgagtctaaaatcgataagattgattatttggttggacattcttttggtggttattggacaagttcatatgctgtcaaatacccacaaaatttatcaaatttgattttattatcacctgttggggtcgaaaggcacgtacatgctgtcacaaatcctatcgatgaaattaagactcaacctatcaaacctagcgtggatccaacctcctatcattttttaactcgtatgccaatgcttacaggaaagcatgtaataaactggtacactgtattgccttacttacctaagttactcagatggctaggaccttggggagttagcagatattataaagagaggtatggtaaacttttcaaggttaataaggtgacatcccaacttggtggagcttcagaagtcttccagcatgaaaacgaccttattattggtaccaataaagaatgctatttattatttgaatatctttataattctacaaccattggatcacaatctgacatttatatcaaatatttattaactccttgcacggtcagtaaatggcccctttatgataagtttacgaatttcttcaagaattcaccaacttcggaattcagaattcattttgtttacggagaatatgattttatgaattccgaagcaggcttaaagttagccgaaaagatcaaccatctatccgaaagtcctattgcagattttcataaaattccacaaggagggcataacatgtacttagataatccgtttgatacgaacaaaatgcttcacaatattatccaaaagcaagatgatctttga

SEQ ID NO: 19028 - protein, 494 aa, Debaryomyces hansenii CBS767
MLSTKNLLKIHVNQIRFASFKVPKSYVPSKLNRHIPFKLALSIWYQSLKPGRLQTLQDELTELMLPTELNSHLVKENKKVRIDNDGNYLNELSFEINNNSDKPTKHVVFIHGYGASLGCFARNYQIINSLQDRRYNYKVHFLDNISFGLSSNPKITSSLINGRIPTCPSVKMYDPEPTTKENVYNKYYKLIESYEINKEEFQEYQDKFIPILNEMEKYYIEAIENWRIESKIDKIDYLVGHSFGGYWTSSYAVKYPQNLSNLILLSPVGVERHVHAVTNPIDEIKTQPIKPSVDPTSYHFLTRMPMLTGKHVINWYTVLPYLPKLLRWLGPWGVSRYYKERYGKLFKVNKVTSQLGGASEVFQHENDLIIGTNKECYLLFEYLYNSTTIGSQSDIYIKYLLTPCTVSKWPLYDKFTNFFKNSPTSEFRIHFVYGEYDFMNSEAGLKLAEKINHLSESPIADFHKIPQGGHNMYLDNPFDTNKMLHNIIQKQDDL

SEQ ID NO: 19029 - DNA, 1329 bp, Debaryomyces hansenii CBS767
  CDS (1)..(1329)
atgctagttgtcccgcaaagactatttagcgtttccagggttgttaaaaactcatcgtcgtctgggttccccggtttcaactttaatttaaatcaacttttgaattcaaatctcaaatttttgccaaatattagaaagaaatcaatagtgcatgacgagacggctgctatcgacacgccaaagaagttgaggattattgaaaatcgctacaaaaggtcaacacatcctacttctgtgcctttgaataagctattctcaaacaactttcctttgtcaataagtgattctatcgacgattatgcatacagacgtaatccattaaaattccagcatgacttattatcacttttgccgttttatcctcaggcagattcgtcaggaagatcaagtcaggctcttcaagttaagcttgactcggggaattatattaatgagtttgttatttatccgcctaataaaacagaagccgatgcaagtactatgaatcatttgattatgatccatggatatggtggtggattagggtttttcttaaaaaacttcgatgagatatcttctcttgacaactggtgtattcattccattgatttattggggtatggatgttcatcaaggcctcctttcaagctagctaaggatgatttagagcacgttgaaaagtggttccacgattcatacactgagtggcttataaaaagaaacctcagtcacctaccacctctgcaagtcttagtgatgggtcactctatgggtgcttatttgatggctacgtatggtgttaaggtcaaccctaagttctgccgcaaattgctaatgatatcgccgggggcagtaattaaacacagaaaacaaatatttgtccctaaatattttgcaaaactttgggagcaaaatatttcccctttcactttagtgagaaaagctggtccgttaggctcgaaggtagtaagtggctggtcttccagaaggtttgcaaatttgccatctaaagagtcaaaattattacacaagtatgcctacgggatcttccagagtcccggctcaggggaatatatgctcaattatttacttgctccaggagctgatgcacggttcccattagtagagagagatattcacaagcttgactgcgaagtgttatggtgctatggtaaagaagattggatggacaaacttggtggtgaactatgttcaaaacttataaacaggcaacataaagattctgataaaagtaaggtcttagaaatcgatgatagtggacatcatatatatctcgacaatcctaaaaagtttaataagcttttactagacgaaatgaaaaaattttag

SEQ ID NO: 19030 - protein, 442 aa, Debaryomyces hansenii CBS767
MLVVPQRLFSVSRVVKNSSSSGFPGFNFNLNQLLNSNLKFLPNIRKKSIVHDETAAIDTPKKLRIIENRYKRSTHPTSVPLNKLFSNNFPLSISDSIDDYAYRRNPLKFQHDLLSLLPFYPQADSSGRSSQALQVKLDSGNYINEFVIYPPNKTEADASTMNHLIMIHGYGGGLGFFLKNFDEISSLDNWCIHSIDLLGYGCSSRPPFKLAKDDLEHVEKWFHDSYTEWLIKRNLSHLPPLQVLVMGHSMGAYLMATYGVKVNPKFCRKLLMISPGAVIKHRKQIFVPKYFAKLWEQNISPFTLVRKAGPLGSKVVSGWSSRRFANLPSKESKLLHKYAYGIFQSPGSGEYMLNYLLAPGADARFPLVERDIHKLDCEVLWCYGKEDWMDKLGGELCSKLINRQHKDSDKSKVLEIDDSGHHIYLDNPKKFNKLLLDEMKKF

SEQ ID NO: 19031 - DNA, 1413 bp, Debaryomyces hansenii CBS767
  CDS (1)..(1413)
atgagttctacgcaagttgaaactaagacggagggagttccggaaaaaccgaacgcttggaatgatagaaggaacaaaaaaaacgaattccaagatggaagggtcttaccggtttatacgtggaaagagtcagctagggattggtacaagcagggattacagaaaagttatactgacgagcaagtggaatataatttgcttctgagtttgccgttttatccggaaacagatggaaaaagaaaggcagagattatcaatacagacatcggtggcggaaactatatccatgaattttatattgagaatacagaaaagccgagcacaccagcagtggtagataaggatccggtaaccgatgttgtattgatacacgggtatgctgcttcgttggggttatttatcgataattttgacttgttatcgtcggcacccggtattaagatacatgccattgatcttttagggtttgggttctcgtctaggcccaagtttccaagctttccatcagagaccaaaggggacatattcaagatcgaagattggtttattgatgcggttgaggaatggagaaagaaacgtaacatcaataggtttattttgatgggccattcgtttggcggatacttaagttgtgcgtacgtgttgaagtataacaagagcttagttgatgcagcaggaaaactgcagcctggaatggttgataagttggtgttgattagtcctgtagggcttgagagaaataagttttccttgttgaaggacgaagcatctgaaggtatatccgatgaacgtagaaagctggaaaatcaagacgctccaagtatagcgttagaggatgaagttaacgctgaccaggaatcaatcattcataatgaggaccaagagtctaccgaggaaaaggtatcgaggagtagaaggttgcttgatgcgttatggagacgtaattactcgccattttctatcgttcgtaatatgggacctttaaaatctaagatgatttctagatggactacccatagatttgcccatatatatttcacaaaccctatgcaatttcaagccatgcacgattacatatatagagtattcaacggtaagggttcgggcgaatttgcaattactaggattttagcaactggtgcgttgccaaagttgccattattagacagatgtcccgaaaaatttgtcaagatgaatactccaaccttttggatatatggtgataaagattggatgaatgacgaagccgggttggaaatgacaaatgagatcaataagttgtcaagcatagctatgggaaagaacttggcccaattcagtatattaccaaattcaggacatcatctttatttggataatccaaaagatttcaataaagaaattttcaaatttataggctttaaaagctcatag

SEQ ID NO: 19032 - protein, 470 aa, Debaryomyces hansenii CBS767
MSSTQVETKTEGVPEKPNAWNDRRNKKNEFQDGRVLPVYTWKESARDWYKQGLQKSYTDEQVEYNLLLSLPFYPETDGKRKAEIINTDIGGGNYIHEFYIENTEKPSTPAVVDKDPVTDVVLIHGYAASLGLFIDNFDLLSSAPGIKIHAIDLLGFGFSSRPKFPSFPSETKGDIFKIEDWFIDAVEEWRKKRNINRFILMGHSFGGYLSCAYVLKYNKSLVDAAGKLQPGMVDKLVLISPVGLERNKFSLLKDEASEGISDERRKLENQDAPSIALEDEVNADQESIIHNEDQESTEEKVSRSRRLLDALWRRNYSPFSIVRNMGPLKSKMISRWTTHRFAHIYFTNPMQFQAMHDYIYRVFNGKGSGEFAITRILATGALPKLPLLDRCPEKFVKMNTPTFWIYGDKDWMNDEAGLEMTNEINKLSSIAMGKNLAQFSILPNSGHHLYLDNPKDFNKEIFKFIGFKSS

SEQ ID NO: 19033 - DNA, 1404 bp, Debaryomyces hansenii CBS767
  CDS (1)..(1404)
atgggtgaaagaagaccatcatcaatctcgttaactaaatccctaaccgattggtggtcgtttccaaaatacttgaaaagtggcagtgacagtttaccagacgaaaatcgaagtgaaggaatcgaacaagccaaattgaggaatcggttaattgagtatgaattgttcaaggctattctatcagacgatatctaccttcatcccccaaatagcgaaaatggtattccggaggacgctcaaattacaggagaatttgtagatgttgatattggagggggggtgacgatccatgaattttatttggaaaatagggtgaaagcagtctcccccaacgaagtagttgatattgtgttaattcatggatatatggcagctttgggatatttcgtgaagaatttcgagcagatcgttaaggcaaaaccaggggtacggttgcatgttatagatctaccagggtttgggaactcgtctcggcctaaatttcctaccgaattcttagttaagccttctacaaaaagcgaggagatcgaacagattttgaacatagaagattggtttatcaataagatcgaagagtggagaatccaccgaaacttgaggcattttaaattgataggacattctatgggtggttatttgtctagttgttatttaatgaagtacaacaaccaatactgtgacctgcgagaagatgactccaagattattaccgagttcatcatagtaagtccaatgggaacggaatcaaattacatcagtttgataaataataagctggatttccatgacagtagtgatcctttaaaggatttggttactgtacagacagaggacgaaattatagtccacgacgaagagttcaaagagttgtgggaaaagctaggcaaaccaaagtttccaaaacacattttattgcaaaaactatgggagtggaataagtccccatttcaaatgttacagattttaggaccattttattcgaagttattatcctattggtcatttcaacggttcaggaatttaagagttaatgacggtgaaaatgaagttaatgttgatttaattctcaagctccacaattattcatattccattttcaaccagttccagggatctggagagctagcaattaccaagttgatcaatcatgaaatattggccaaactaccactatgtgatagaggattcgtcaaatacctacatgattcggaaattaggaccttgtggctctacggtgataaagattggatgaatttcaaaggaggatatcacattttcgagcaattatctaagattaattctttgagttcatttcaaatcatcaaggatgccggccatcatatttatttagacaatcctgaagaatttaacaagtcttgtttagaatttttcaatttaatatag

SEQ ID NO: 19034 - protein, 467 aa, Debaryomyces hansenii CBS767
MGERRPSSISLTKSLTDWWSFPKYLKSGSDSLPDENRSEGIEQAKLRNRLIEYELFKAILSDDIYLHPPNSENGIPEDAQITGEFVDVDIGGGVTIHEFYLENRVKAVSPNEVVDIVLIHGYMAALGYFVKNFEQIVKAKPGVRLHVIDLPGFGNSSRPKFPTEFLVKPSTKSEEIEQILNIEDWFINKIEEWRIHRNLRHFKLIGHSMGGYLSSCYLMKYNNQYCDLREDDSKIITEFIIVSPMGTESNYISLINNKLDFHDSSDPLKDLVTVQTEDEIIVHDEEFKELWEKLGKPKFPKHILLQKLWEWNKSPFQMLQILGPFYSKLLSYWSFQRFRNLRVNDGENEVNVDLILKLHNYSYSIFNQFQGSGELAITKLINHEILAKLPLCDRGFVKYLHDSEIRTLWLYGDKDWMNFKGGYHIFEQLSKINSLSSFQIIKDAGHHIYLDNPEEFNKSCLEFFNLI

SEQ ID NO: 19035 - DNA, 1260 bp, Yarrowia lipolytica CLIB99
  CDS (1)..(1260)
atgtcggaacttgaagagaccagaaacgtccgaatgaagcggttcccgtacaaggaggcgctgcgacagtggtggaacgcgccctcggccgagaaggccgaattcgacgttctgtccatgctccccttctttcctaagcccgatgccacccgaacagcaacgtccaaactcgtcgacattggtaaaaacagatacatcaacgagttccacatccaaaacaccaccaatggaaccccccatcgcaacctcgtcatgctccacggctacggaactggcctggggatcttcttccagaactacgaccagatctcctctacacccgattggaacgtcttctctcttgatctactcggtctaggccgatcctcaagacggcccaaattcaagatccagacctcggacacagacaagaagattgtgaacgaaaaaaccggcgaagtcgtctaccctgcggtgatcgagtcagagaactactttatcgacgccattgaggactggagacaggtgcgcaagattgaaaaattcactcttatgggccactccatgggcggctacctcgcagctgcctacgccttcaagtaccccgagagagtagaaaaactcattctggtgtcccccgtaggtgtggagagatcaggagacgtggaggtggacgattcggcttctcttctgcaaggagccaaagaaattgccgctcaacctgttcccgacgaacgtctgttcccagccatcacccacgacgaaggcatgaaggtccatcctggcgctatccctccccaggagaaaatccactggcttatgaagtatctgtggacccaccactactcgcccttcatgctgatccgacaggctcctccgggagtaggagtgcgtctcatgtcagcctggtctttgtggcgattccaggatctcagcgaagaggatcgaatgaaactccatctgtactcctacaagctcatggacagcaaggcgtctggagagctggctctgactcggcttctcaagcctgtagcactggctagaatgcctctactggatcgccttgacaaaatcaagtgtcccaccatgtggatgtacggagagaaggactggatgaatgccgaggcaggagccgaggccacccagactctcaaccgaaacgccagcaatgaaaacaacacccagagcgtgttcaagctggtcaagagagcaggtcaccatatttatcttgataacacccgagcgtttaactctctgattgtcgactttatgacccgatag

SEQ ID NO: 19036 - protein, 419 aa, Yarrowia lipolytica CLIB99
MSELEETRNVRMKRFPYKEALRQWWNAPSAEKAEFDVLSMLPFFPKPDATRTATSKLVDIGKNRYINEFHIQNTTNGTPHRNLVMLHGYGTGLGIFFQNYDQISSTPDWNVFSLDLLGLGRSSRRPKFKIQTSDTDKKIVNEKTGEVVYPAVIESENYFIDAIEDWRQVRKIEKFTLMGHSMGGYLAAAYAFKYPERVEKLILVSPVGVERSGDVEVDDSASLLQGAKEIAAQPVPDERLFPAITHDEGMKVHPGAIPPQEKIHWLMKYLWTHHYSPFMLIRQAPPGVGVRLMSAWSLWRFQDLSEEDRMKLHLYSYKLMDSKASGELALTRLLKPVALARMPLLDRLDKIKCPTMWMYGEKDWMNAEAGAEATQTLNRNASNENNTQSVFKLVKRAGHHIYLDNTRAFNSLIVDFMTR

SEQ ID NO: 19037 - DNA, 1470 bp, Yarrowia lipolytica CLIB99
  CDS (1)..(1470)
atgacccttgccgcctgtcaaaagagagctcttggtgcggtggagacggttctggcgtcggttcgtgttttccagcactcccgcgcccagcataccgcttctgcgtcgtcatcagcgtctggatcgagcaaaaagttccgacctcctactcctccagcgggtattccgctttcgaaaatcttcaacaacttgttcccgctgagctactcggaatcgtttcaacagtggcgagaccgagacgagaagggcgacactgctcaagatgctgtcctgtccatgatgccgttctaccccaacagagagactcagtcggtggtggctcgcacgctgccaggtggcgaacagcaggatctgtaccgtgaagggcgtgtgattcggaccccagtcagtgggtctgagttcatcaacgagtttgagatcagccagtacaaagccgatggtacctctattgcagatcaggacacacatcacattatggtgttacatggctacggtgctgggctgggattcttctttcgcaacttcaacgcgctttccaagatccccaactcccagattcacgcgctggacctcttgggctacggtttgagctctcggccgtctttccacatcagatcgaacccacgcactttgctgttcaagaaatgggaggagcaggtgacgatagccgaaaacttcttcctggactcgattgaggagtggcgccagaagaagggcattaaaaagttcagcgtggtggctcactcgcttggtgcgtatctcatttccgaatacgctgtcaagtacccaggtcacattgacaagattgttctggcctctccagcagctgtctcacacactggaatgcagttccagcaacagactgacagcaattctgacaagggaaaattgtctaacaaaaaggcctccctcaaagacatttctcaatcttccatcgataccaaccccacatttactacagccgagtcgaaaatccccaagattccgctgtggttcaaaattggctgggaactcaacttttcaccgtttgccctggtgcgtcagaccggccctctgggtccccgatttgtgtctgggtggacctcccgaagattccctattgacaaccacaccacggaggaagagagcaaagccatgcacaaatacacgtacgagattttccgacgaaagggctctggagagttctgtctcaactacctgctcgctcctggagctgttcctagacggcctctcgtggaacgggtccataaactgggcgaactgggtatctcgaccacctgggtgtatggctccaacgactgggtggacgtgaatggaggccacgagagtgccagacgaatcaaacgggctggaggtgatgccgaagtgcatgttgtgcccggagctggtcatcagctatacatggaccagcccagccggttcaacgagattgttgtgaatttccttcgacgaaacacctcgagccactag

SEQ ID NO: 19038 - protein, 489 aa, Yarrowia lipolytica CLIB99
MTLAACQKRALGAVETVLASVRVFQHSRAQHTASASSSASGSSKKFRPPTPPAGIPLSKIFNNLFPLSYSESFQQWRDRDEKGDTAQDAVLSMMPFYPNRETQSVVARTLPGGEQQDLYREGRVIRTPVSGSEFINEFEISQYKADGTSIADQDTHHIMVLHGYGAGLGFFFRNFNALSKIPNSQIHALDLLGYGLSSRPSFHIRSNPRTLLFKKWEEQVTIAENFFLDSIEEWRQKKGIKKFSVVAHSLGAYLISEYAVKYPGHIDKIVLASPAAVSHTGMQFQQQTDSNSDKGKLSNKKASLKDISQSSIDTNPTFTTAESKIPKIPLWFKIGWELNFSPFALVRQTGPLGPRFVSGWTSRRFPIDNHTTEEESKAMHKYTYEIFRRKGSGEFCLNYLLAPGAVPRRPLVERVHKLGELGISTTWVYGSNDWVDVNGGHESARRIKRAGGDAEVHVVPGAGHQLYMDQPSRFNEIVVNFLRRNTSSH

SEQ ID NO: 19039 - DNA, 1230 bp, Kluyveromyces lactis NRRL Y
  CDS (1)..(1230)
atgacagttcgcagaagcttggcattgaggctgttgaggaaaggaatgtcgcaaccagacgagctctctttgaagcgttctggctggaaacagtggtggaatagtttaaattacgatgcaaagggtagtttgaagcatttgcaacagaatcttatggaccaattgcagtttgattccgggatatctgtcgaaaattcgatgctattgggcgagatcaaccaatggcggatctcgaatcctacggcaaaagcagtgggggtacctactttgatgatccatgggtatgctgcatcgtcaatgacatttttcaggaatttcgagcagctttcgttgtccttgaaagatgtctacgctgtagatttgcccgggaacgggttgtcgaaagagttacctctctcagtagactctatgcaaaaacctgacagagtagagttcaacgaaactgtgaagggtcagtatttccgtttgcagaatccggttgatgaagagaaatataagaaacatttggctcattatgaggactattacgtcgatgccttggaaaaatggagaaaggaaaacaaattgtccaagattaatttggttggccactcgtacggtggctatctaactttcaaatactctttgaaatacccagataacgtccataaactatgtcttgtgtcaccacttggtgtggaaagaagcatattttctatccataaccatttggaaccggaaagagattatgaaatacaatccgaagaccctagcaaatcgaactactcgaataaaagaaatataccaaaacttatcttacaataccaaaataaagctctaagatggatgggtcccctgggagccaaagcttgttggggttatgtgaatagctcttatggtagagttccaagcgtcccttacagggagtacgtgtttcaattggttttcggtaagggaattatgactgatacctctatcagaatattcaaccaactattctcaagaagcctgttagcatatgatccgatcatggattctttggataaagttaaagtgtcaaaattgatgttggtttatggtgaacacgattggatgaataaagtcgctggaaggctggcgatagaggagttcaatagtataagaaaaagctacgatggaactttcgatatcgtgagtagagctggtcacaatttggttttggataacccatcagagttcaactccaaattggtcgactttctaagggattaa

SEQ ID NO: 19040 - protein, 409 aa, Kluyveromyces lactis NRRL Y
MTVRRSLALRLLRKGMSQPDELSLKRSGWKQWWNSLNYDAKGSLKHLQQNLMDQLQFDSGISVENSMLLGEINQWRISNPTAKAVGVPTLMIHGYAASSMTFFRNFEQLSLSLKDVYAVDLPGNGLSKELPLSVDSMQKPDRVEFNETVKGQYFRLQNPVDEEKYKKHLAHYEDYYVDALEKWRKENKLSKINLVGHSYGGYLTFKYSLKYPDNVHKLCLVSPLGVERSIFSIHNHLEPERDYEIQSEDPSKSNYSNKRNIPKLILQYQNKALRWMGPLGAKACWGYVNSSYGRVPSVPYREYVFQLVFGKGIMTDTSIRIFNQLFSRSLLAYDPIMDSLDKVKVSKLMLVYGEHDWMNKVAGRLAIEEFNSIRKSYDGTFDIVSRAGHNLVLDNPSEFNSKLVDFLRD

SEQ ID NO: 19041 - DNA, 1086 bp, Xenopus laevis
  CDS (1)..(1086)
atggcggagggatccgatatggtttcttcctactccgaaagagggctcataggtgccctaagagcagccgtctggtcttttgtgtcagggtggctttccagttggcttcccgcctggtgccctacatcaatacctcatctcaaagaagcagaagagaaaatgctgaagagtataacgcgtacttacagtaaagaacacatacttatatctggtggaaataaggtatggaccttggcatttaaacaaccattatcaaataaaaccccacttgttctgctacatggatttggtggaggggttggactgtgggtgctcaactttgaaaacatttgccaagacaggacagtttatgcatgtgacatcttgggatttggacgcagtagtaggccacactttcaaggagatgcagagaaagctgaggaacagtttgtacagtcgatcgaagagtggaggaaggaattaggtctggagaaaatgatttttcttggacataatcttggtgcatttttggcctctgcttattctttaaagtatccttcacgggtgaaaagtcttattttagtggagccatggggattcccggacagacctgataatgcagatgaaggaagaccaattccgatctggattaaagcagtaggtgctatgctgagtccatttaatccactagcagggcttcgtctagctggacctttaggtttaagccttgtccagcgtttgcgaccagatttcaagaaaaagtattcctcaatgtttgatgatgatacagtaacagaatatatctaccactgtaatgcacagtcacctagtggtgagacagctttcaggaatatgaccgttccatatggttgggcacaaagaccaatgctgcagcgtattgataaaatgcacctagacattccaatcaccgtgatttatggtgcacgatcttgcattgatggcaattctggaagcaccatacagtcactgcggccaaactcctatgtgaagactattgcaattcgtggtgcaggccattatgtatttgctgatcagcccgaagattttaaccaaaaagtaacagagatatgtgattctgtggactga

SEQ ID NO: 19042 - protein, 361 aa, Xenopus laevis
MAEGSDMVSSYSERGLIGALRAAVWSFVSGWLSSWLPAWCPTSIPHLKEAEEKMLKSITRTYSKEHILISGGNKVWTLAFKQPLSNKTPLVLLHGFGGGVGLWVLNFENICQDRTVYACDILGFGRSSRPHFQGDAEKAEEQFVQSIEEWRKELGLEKMIFLGHNLGAFLASAYSLKYPSRVKSLILVEPWGFPDRPDNADEGRPIPIWIKAVGAMLSPFNPLAGLRLAGPLGLSLVQRLRPDFKKKYSSMFDDDTVTEYIYHCNAQSPSGETAFRNMTVPYGWAQRPMLQRIDKMHLDIPITVIYGARSCIDGNSGSTIQSLRPNSYVKTIAIRGAGHYVFADQPEDFNQKVTEICDSVD

SEQ ID NO: 19043 - DNA, 1161 bp, Candida glabrata CBS138
  CDS (1)..(1161)
atgtggtgcaaaggcgatgacctcgagactttgcaatataaggtgatggaggaagtgcctgtcgagggccagcgggcggtgctgcggtgtggggtgaaccagtggtacttcagaggcggtgaccgggtggtgactccgacgctgctagtgcatgggtatggagcctcttctatggcgtaccaccgctgttttgcgccgctgtcgaggcacatacgggacctgtatgctatagacctcccggccaatgggctgagcgaggcaccgccgctggtggcagagggtgaggcgccaaaggccaagtttaagatcgaggagaacaagttcaccgtggtgcagggcgccagacgtgctgccgagccggtgacggatgcccaggtggatcaggagctgatgctgcgcacacaccgggagaagaggcggtacttgcagcagtacgaggactactatgtggagagcatcgagcagtggcgaaaggagaacaacctagacaagttcaaccttgtgggccactcgtttggcgggtacctgtcctacaagtacgccctgaagtaccctgagtccgtgaacaagctctgcctgctgtcaccgctgggtatggagcgcaacatacactcgataaataacacgtttgaggagaacgtggtctatgaactgcaggagtctgatccttcctcatacctgtacactagaaagcgcaaggctccaaagttcctgttcgagaaccagtttagcgtgctcaggtggatggggccaataggagacaagctgtgtctgtcctttatcaattccagttacgccaaggtacccagccaggcatacaaggactacttgttcgagtccttcctgggcaagaagcatttcgccaagcagaacgtccatgctctgaagcacttgttcacacgcagtctgctcgcaagagaccccatcatggacaccatagacaagttgaaagtgccagatgtatctgtattttacggtgaccacgactggatgaacagctacgctggttatctcatggtcgaacgcttgaagaagtttagagttgccagcacttcaggtggctctgcctcctatttggaagtacctgacgcaggacataacctgttcctagataacccagactacttcagcaagaaacttgtccagtttctcagcgagtaa

SEQ ID NO: 19044 - protein, 386 aa, Candida glabrata CBS138
MWCKGDDLETLQYKVMEEVPVEGQRAVLRCGVNQWYFRGGDRVVTPTLLVHGYGASSMAYHRCFAPLSRHIRDLYAIDLPANGLSEAPPLVAEGEAPKAKFKIEENKFTVVQGARRAAEPVTDAQVDQELMLRTHREKRRYLQQYEDYYVESIEQWRKENNLDKFNLVGHSFGGYLSYKYALKYPESVNKLCLLSPLGMERNIHSINNTFEENVVYELQESDPSSYLYTRKRKAPKFLFENQFSVLRWMGPIGDKLCLSFINSSYAKVPSQAYKDYLFESFLGKKHFAKQNVHALKHLFTRSLLARDPIMDTIDKLKVPDVSVFYGDHDWMNSYAGYLMVERLKKFRVASTSGGSASYLEVPDAGHNLFLDNPDYFSKKLVQFLSE

SEQ ID NO: 19045 - DNA, 1356 bp, Candida glabrata CBS138
  CDS (1)..(1356)
atgtcgatttcaaagtttgggaaaagatcttttagaaatgttgctagcaagttgctgaggttatcctcattgggtgaaaagagttctgaggttgtaggtaaagatggaagtgctattatacatgctactgcccctactgcaaagccactatatgagattgtgagggacctgccgagattatttcctcgctcattagctgagtcaaagcgtgattacgctacctttcacagtaatgttgacttaatgcagttggagttgctccgaacgttgcctttctttgaaaggacaggttacaacaaaagagcatatttgaggaaaactgagatagatagtgatggcaactatatcaatgagcttgttattgaacctgcgaatgtggacccgaataagaagaggaaaagactgatttttgtacacggatatggggctgggcttggtttctatttgaaaaattatgaacacctaccattgctggatgattcttggtctatacatgctattgatctgcccggttatggcttctcgtcaagaatggattttcctttccagttcccaagagatgatacatcagtggtgtgcgactggtttataagtaggctacgaactttgtttgagaaaagaggatttgataaatctgataatatcgtgatggctcactcaatgggtgcatatcttatggctttctatttgaataaatacccagactcagtgaaaaagatggtaatgtgttcgcctgctggtatctcacgaagtcagtatagtattaacaacaatatcactgaagatatttcctctgggaaagaggaaatcaaactaaaaataaagaaggtgccttggtggtacacaaagctatgggatcgcaacatttcaccatttgtgctggtaagaaagacaggaatattaggttctaagattacttcaggctggacctacagaagatttaaaccgatattattgaataaagagaataattatgagcaatttgaaaaattgcacagatattcatttgccatattcaatatgaagggctcgggggagtacctcctcagttttgttctcgagtgcggaggagaccccaggtcacctttggagaatagtttattttccagtgatgccaataaatttggcatcgataatgcaggtatcaaaaacagctcttgtgaatgggtgtgggtttacggtgcaaatgattggatggatatccatggagcagagagggtcacaaaagatttccttatgaacaatcgcaagaaaagtagagtggtgacaattccagaatcgggacatcacctctattttgataactaccccatgttcaattcattgttgattgacgaaatgaaatctttgcagtaa

SEQ ID NO: 19046 - protein, 451 aa, Candida glabrata CBS138
MSISKFGKRSFRNVASKLLRLSSLGEKSSEVVGKDGSAIIHATAPTAKPLYEIVRDLPRLFPRSLAESKRDYATFHSNVDLMQLELLRTLPFFERTGYNKRAYLRKTEIDSDGNYINELVIEPANVDPNKKRKRLIFVHGYGAGLGFYLKNYEHLPLLDDSWSIHAIDLPGYGFSSRMDFPFQFPRDDTSVVCDWFISRLRTLFEKRGFDKSDNIVMAHSMGAYLMAFYLNKYPDSVKKMVMCSPAGISRSQYSINNNITEDISSGKEEIKLKIKKVPWWYTKLWDRNISPFVLVRKTGILGSKITSGWTYRRFKPILLNKENNYEQFEKLHRYSFAIFNMKGSGEYLLSFVLECGGDPRSPLENSLFSSDANKFGIDNAGIKNSSCEWVWVYGANDWMDIHGAERVTKDFLMNNRKKSRVVTIPESGHHLYFDNYPMFNSLLIDEMKSLQ

SEQ ID NO: 19047 - DNA, 1272 bp, Candida glabrata CBS138
  CDS (1)..(1272)
atggttagaaatagttcgcaggtcaggcacttcagtagctatttgagactgtgccagcaacaaaagaaccttgaaaccagggtgatttccagaatacttaaacctgccaatagcactgataacaatgaagcaagatcgggatggaagctttgggcaggtcatttgttcaagaccaagaaggagacttttgacaagctaaagatgctacagagtcgcatcatgggcgatattgaaattgcaggacatagcagcaacaaaattctcttcgatgagatcaatcagtggcatttccacaacaatttagcaaaaaaggtcaggacaccaacagtgcttatacatggttatgctgcaacttcaacagccttctttagaagcataccatacttgaacagagacatcaaggacttgtataccattgatctaccagggaatggtttgtcatttacaccttctcttgatttagaagttagtaaaccattaccattaaagatagaaaatattgatgatggcaacgagtttcagctgccttatgttattgattctgctcatcaccggtacgtattacagaaattgcttgactattatgtcgaccgaatcgagcaatggaggcttgataataagctaggcaagattaacgtggttgctcattcttatggcggttatttatctttcaattatgcactaaaataccctgctaatatcaacaccttaggattgatctctcctcttggtgttgagagaaatatttattcaattaacaatgagttccatagcagaacaatttacaaaagggaatggaacgattgtaactctatgttttatgatagaaaattcaagctcaacgactatcttttccagaaacaactgaaaccactaaggtggttaggccctataggtgcaaagctatgttggaactacatccggtctgcatacgccagagtaccttcaattgattacaaagactacaccttcgagacattctatggaaggggaggcttaccagaacagacttcccaaatttttacttcattattgacaagttccttactagcaagggatccattgcttgaccatgtatcgcaactacaagtcccgaaattaatcatgatgtatggccagtacgactggatgaataaaaacggtggaaagctcatgacccagatattcaacggtgaaacaaaatatatagatataccaaacgccggccacaacttattcctggataacccatccgactttgcttctcagttgacaacattcttggctgactaa

SEQ ID NO: 19048 - protein, 423 aa, Candida glabrata CBS138
MVRNSSQVRHFSSYLRLCQQQKNLETRVISRILKPANSTDNNEARSGWKLWAGHLFKTKKETFDKLKMLQSRIMGDIEIAGHSSNKILFDEINQWHFHNNLAKKVRTPTVLIHGYAATSTAFFRSIPYLNRDIKDLYTIDLPGNGLSFTPSLDLEVSKPLPLKIENIDDGNEFQLPYVIDSAHHRYVLQKLLDYYVDRIEQWRLDNKLGKINVVAHSYGGYLSFNYALKYPANINTLGLISPLGVERNIYSINNEFHSRTIYKREWNDCNSMFYDRKFKLNDYLFQKQLKPLRWLGPIGAKLCWNYIRSAYARVPSIDYKDYTFETFYGRGGLPEQTSQIFTSLLTSSLLARDPLLDHVSQLQVPKLIMMYGQYDWMNKNGGKLMTQIFNGETKYIDIPNAGHNLFLDNPSDFASQLTTFLAD

SEQ ID NO: 19049 - DNA, 1155 bp, Ashbya gossypii
  CDS (1)..(1155)
atggcgcacaacaccaacggaggacctgtggcgctccggatactgcgccgactgctgaatgcagtgcccgcggaccagcaggcatctgggtttattctctggctgcagaaccgggggcagaacggcagcgcgcaggtggagagatggcagacagccttgatggagccgctgggcgccgctggcagagagtccgtggtggggggcctacaccagtggtactttgcgaacgcgggcgcgccgatccgcacgcccacggtgctactgcacgggtacgcgtcgtccgcggtgagcttccaccgcaacctcgcggcgctgggcgcgcaggtggagcagctatacgcgctggacctgccaggcaacggcatgtcgcaggagctgccgctggggcccgcggcggcgcgcgcactggcgcggcgttgtggcgcgcgcgcggacatccgcgcgctggcggactactacctggacgcgctcgagcggtggcgcgcggccaacgggctggagacgctgaacgccgccggccattcgttcggcggctacctggcattcaagtacgcgttgaggcaccccgcgcgcgtgcagcggctatgcctcgtgtccccgctcggcgtcgaggcgcagacagcgggtcggcgcatgcccggcagggcgacgcgccgccggacccgtcctccgaccccggcctcgccgcactacacgcgcgcggccgcgcttccgccgctcctcttcgagcagcagctgcgcgtgctccgctggctcggaccgctgggcgcgcacctgctgtggcaatacgtgaacgcgtcgttctcgcgcgtgccgggccgcgagttccacaggtacacgtttgccctgctgcaccgcctcgcgctgcgcccgttgccgcgcaagctgttcaccggtctcttcaccaacgcgctgctcgcgcgcgacccgctgctggactcgctagcggagctaaaggtcccgaatgtgcagctgctctacggcgaccacgactggatggacgcgcgtgcgggccgggccctggtcgcggagctcaacgctctgcgcggccgcccggacgcctccttagccatagtccccgctgccggccacaatctcttcctcgacaaccctgaggacttccactcctggctcttggattttctacgtgtatag

SEQ ID NO: 19050 - protein, 384 aa, Ashbya gossypii
MAHNTNGGPVALRILRRLLNAVPADQQASGFILWLQNRGQNGSAQVERWQTALMEPLGAAGRESVVGGLHQWYFANAGAPIRTPTVLLHGYASSAVSFHRNLAALGAQVEQLYALDLPGNGMSQELPLGPAAARALARRCGARADIRALADYYLDALERWRAANGLETLNAAGHSFGGYLAFKYALRHPARVQRLCLVSPLGVEAQTAGRRMPGRATRRRTRPPTPASPHYTRAAALPPLLFEQQLRVLRWLGPLGAHLLWQYVNASFSRVPGREFHRYTFALLHRLALRPLPRKLFTGLFTNALLARDPLLDSLAELKVPNVQLLYGDHDWMDARAGRALVAELNALRGRPDASLAIVPAAGHNLFLDNPEDFHSWLLDFLRV

SEQ ID NO: 19051 - DNA, 1602 bp, Neurospora crassa
  CDS (1)..(1602)
atgtcggcttccgacaccactcttcctccttcctcgtcgcgggcaacgcagacaaaggccgagaaggattcaaaggctcgcggcgccggctctgccttttttcctcttggttacaaggaagccgcacaacaatggtggtccagcgtaaccgctcgccaagccgagcgcaacgtcctctccttcatccccttcctccgcgaagccaccgccgataacgcttccacagcctctcaactttccgatctcgccaacgccgacccattcggccaccgcgtatggcgtcaaaccatggtccctctttccggcaaagaccgagccctgaacgagttctcgatcgagcgagtcggcgagcaagtcgacgacaccctcgtcatgctgcacggctacggcgccggcctcggctttttctacaagaactacgagccgctcagccgcgttcccggctggaagctctactccctcgacatgctcggcatgggcaactctgcgcgcccaccgttcaagatccacgccaaggaccaacagggcaagatccgcgaggccgaggcctggtttattgatgcgttggaggagtggcgaaaagcccgcaagatcgagcgcttcacgctcatgggtcattcgttgggtggctacctggccgtctcgtatgcgctcaagtaccccggccgtctgaacaagctgatcctcgcctcgcctgcgggtatcccggaggacccgtgggccgttaacgccgcgatgccggagcctgaagagtccgcgtacggcaacgagtttacgcaggaccaggaaagcatcgtcaacagggagacgcccgagggaggggctaatacggctttcatccaggctgatcccaaggataagaaagctgtcgcctcatcagccgggaaacccaacaacaacaataacaacggcaccaacaccaaaaaggacacagccccaccccgccgtcccattcccggctggatctcctggctctgggacgccaatgtttcccccttctccatcgtgcgcatgaccggccctctcggtccccgcttcgtctcgggctggacctctcgccggttcaaccacctccctcccgacgaaaaagaagcccttcacacatattcctactcgcttttccgccaaaagggttcaggcgaatacgtcctcccctacctcctcgccccgggtgcgtttgctcggtcccccgtgatcaaccgtatccaagacgtcggccgccaaataatcgctcaacccccctcctcgggttctactccagaacaaccggcagcagctccagtccgtgaagcaggtttccccatcgtcttcctctacggtgaaaacgactggatggacgttgcgggcgggtacgcggctgaagagaaaatcagaaagagggtggagcaggccttgactgaccagacccgaaccgaagaagaaaggaagagggagaacggcagtgccaaggtggtggtgattaggagggcgggacatcatttgtatatcgacaacccggacgagtttaatgaggttgtcatgaaagagttggaggagacgaaggagtggggaaggaggatgagggcggaagggttgctgccacctatgccggttgagaaataa

SEQ ID NO: 19052 - protein, 533 aa, Neurospora crassa
MSASDTTLPPSSSRATQTKAEKDSKARGAGSAFFPLGYKEAAQQWWSSVTARQAERNVLSFIPFLREATADNASTASQLSDLANADPFGHRVWRQTMVPLSGKDRALNEFSIERVGEQVDDTLVMLHGYGAGLGFFYKNYEPLSRVPGWKLYSLDMLGMGNSARPPFKIHAKDQQGKIREAEAWFIDALEEWRKARKIERFTLMGHSLGGYLAVSYALKYPGRLNKLILASPAGIPEDPWAVNAAMPEPEESAYGNEFTQDQESIVNRETPEGGANTAFIQADPKDKKAVASSAGKPNNNNNNGTNTKKDTAPPRRPIPGWISWLWDANVSPFSIVRMTGPLGPRFVSGWTSRRFNHLPPDEKEALHTYSYSLFRQKGSGEYVLPYLLAPGAFARSPVINRIQDVGRQIIAQPPSSGSTPEQPAAAPVREAGFPIVFLYGENDWMDVAGGYAAEEKIRKRVEQALTDQTRTEEERKRENGSAKVVVIRRAGHHLYIDNPDEFNEVVMKELEETKEWGRRMRAEGLLPPMPVEK

SEQ ID NO: 19053 - DNA, 1080 bp, Caenorhabditis elegans
  CDS (1)..(1080)
atgtcaatttttgaatatacttggtacttatcttggattccttccaggtttccatacttttcgtgtccatcgaaaagtcagcggttagctgaagcagaaggacggatactttcagcacttggcatcaaatatctggctagacttattcagattccattcaaaaacactgaaatcagtacgataactgtcaactgtgaaagtgagcagcccattgtgaaggcgaaatatccgattgtcttgattcatggatttggagcaggagttgcgttgtggggttctgcgatcaagcgtcttgctcaatttcagacagttcacgcttttgatctaccaggattcggtagatcatctcgccccaaattctcatcagacccagaaactgccgaaactgaaatgatcgactcaatcgaacaatggagagataaaatgaacttggagaagatgaacctggttggtcattcattcggaggatacctagccacatcctacgctctgaagtatcctaaaagagtcgagaatctcatacttgccgatccttggggcttcaatgagatggatccagaattcgcgcaaaaactcactagtcgtcagaaaaacattttttgggtcattcaacagttcaatccactggcggttctgagacttgttggaggatatggaccatctctcgtgagacgtcttcgtccagatcttgcactgaagtactctgaagacgtgtatgactacatttacttggcaaactccagggatccaacgggagaagaggttttcaagtgtttatcggaaaacttgggatgggctaagcaaccaatgagcaagaggttccacgaacttgacaacaccgttccagtcacatttattcacggagagcgcagttggattgactggagaacaacgagaagattgttcggagagctcgagcacgtcgagtcacatatcatggacagtgctggtcatcatgtctacgcagatgatgccgacaaatttgtgcaactcgtgataggatctttaaaggacgggaagacgggagagctggtgccagaggaagtgaacttggaagaagaaatcgtgacaccgatttag

SEQ ID NO: 19054 - protein, 359 aa, Caenorhabditis elegans
MSIFEYTWYLSWIPSRFPYFSCPSKSQRLAEAEGRILSALGIKYLARLIQIPFKNTEISTITVNCESEQPIVKAKYPIVLIHGFGAGVALWGSAIKRLAQFQTVHAFDLPGFGRSSRPKFSSDPETAETEMIDSIEQWRDKMNLEKMNLVGHSFGGYLATSYALKYPKRVENLILADPWGFNEMDPEFAQKLTSRQKNIFWVIQQFNPLAVLRLVGGYGPSLVRRLRPDLALKYSEDVYDYIYLANSRDPTGEEVFKCLSENLGWAKQPMSKRFHELDNTVPVTFIHGERSWIDWRTTRRLFGELEHVESHIMDSAGHHVYADDADKFVQLVIGSLKDGKTGELVPEEVNLEEEIVTPI

SEQ ID NO: 19055 - DNA, 1029 bp, Mus musculus
  CDS (1)..(1029)
atggctgatgatctggagcagcagcctcagggctggctgagtagctggctccccacttggcgccccacttccatgtctcaactgaagaatgtggaagccaggatcctccagtgtctccagaacaagttcctggcccgttatgtatccctcccaaaccagaacaagatctggacggtgactgtgagcccagaacaaaaggatcgcacccctctggtgatggtacatggctttgggggcggtgtgggcctctggatcctcaacatggattcactgagtgcccgccgcacacttcatacctttgatctgcttggttttgggcgaagctcaaggccaacattcccaagggacccagaaggagctgaagatgagtttgtggcctcaatagagacatggcgggagaccatgggaatccccaccatgatcctcctggggcacagtttgggaggattcctggccacttcttactctatcaagtaccctgaaagagttaaacatcttatcctggtggatccatggggctttcccctacgaccaactgaccctagtgagatccgtgcacctccaacctgggtcaaggctgtggcatctgtcctgggacgttccaatccactggctgttcttcgagtggctgggccttgggggcctgggctggtgcagagattccgtccagacttcaagcgcaagtttgcagacttctttgaggatgacaccatctcggaatacatctaccactgcaatgcacagaatcccagtggggaaacggcattcaaagccatgatggagtcctttggctgggcccggcgccccatgttggagcgaatccacttaattcgaaaagatgtgcccatcaccatgatctatggggccaacacctggatagataccagcacagggaagaaggtgaagatgcaaaggccggattcctacgtccgagacatggagatcgagggcgcatcccaccacgtctatgctgaccagccacacatcttcaatgctgtggtagaagagatctgcaactcagttgactga

SEQ ID NO: 19056 - protein, 342 aa, Mus musculus
MADDLEQQPQGWLSSWLPTWRPTSMSQLKNVEARILQCLQNKFLARYVSLPNQNKIWTVTVSPEQKDRTPLVMVHGFGGGVGLWILNMDSLSARRTLHTFDLLGFGRSSRPTFPRDPEGAEDEFVASIETWRETMGIPTMILLGHSLGGFLATSYSIKYPERVKHLILVDPWGFPLRPTDPSEIRAPPTWVKAVASVLGRSNPLAVLRVAGPWGPGLVQRFRPDFKRKFADFFEDDTISEYIYHCNAQNPSGETAFKAMMESFGWARRPMLERIHLIRKDVPITMIYGANTWIDTSTGKKVKMQRPDSYVRDMEIEGASHHVYADQPHIFNAVVEEICNSVD

SEQ ID NO: 19057 - DNA, 1029 bp, Homo sapiens
  CDS (1)..(1029)
atggccgatgatctggagcagcagtctcaaggctggctgagtagctggctgcccacgtggcgccccacttccatgtctcagctgaagaatgtggaagccaggatcctccagtgtctccagaataagttcctggccagatatgtatccctcccaaaccagaataagatctggacggtgactgtgagccccgagcaaaacgaccgcacccccttggtgatggtgcatggttttgggggcggcgtgggtctctggatcctcaacatggactcactgagtgcccgccgcacactgcacaccttcgatctgcttggcttcgggcgaagctcaaggccagcattcccaagggacccggagggggctgaggatgagtttgtgacatcgatagagacatggcgggagaccatggggatccccagcatgatcctcctggggcacagtttgggaggattcctggccacttcttactcaatcaagtaccctgatagagttaaacacctcatcctggtggacccatggggctttcccctccgaccaactaaccccagtgggatctgtgcacccccagcctgggtcaaagccgtggcatctgtcctaggacgttccaatccattggctgttcttcgagtagctgggccctgggggcctggtctggtgcagcgattccggccggacttcaaacgcaagtttgcagacttctttgaagatgataccatatcagagtatatttaccactgcaacgcacagaatcccagtggtgagacagcattcaaagccatgatggagtcctttggctgggcccggcgccctatgctggagcgaattcacttgattcgaaaagatgtgcctatcactatgatctacgggtccgacacctggatagataccagtacgggaaaaaaggtgaagatgcagcggccggattcctatgtccgagacatggagattaagggtgcctcccaccatgtctatgctgaccagccacacatcttcaatgctgtggtggaggagatctgcgactcagttgattga

SEQ ID NO: 19058 - protein, 342 aa, Homo sapiens
MADDLEQQSQGWLSSWLPTWRPTSMSQLKNVEARILQCLQNKFLARYVSLPNQNKIWTVTVSPEQNDRTPLVMVHGFGGGVGLWILNMDSLSARRTLHTFDLLGFGRSSRPAFPRDPEGAEDEFVTSIETWRETMGIPSMILLGHSLGGFLATSYSIKYPDRVKHLILVDPWGFPLRPTNPSGICAPPAWVKAVASVLGRSNPLAVLRVAGPWGPGLVQRFRPDFKRKFADFFEDDTISEYIYHCNAQNPSGETAFKAMMESFGWARRPMLERIHLIRKDVPITMIYGSDTWIDTSTGKKVKMQRPDSYVRDMEIKGASHHVYADQPHIFNAVVEEICDSVD

SEQ ID NO: 19059 - DNA, 1328 bp, Homo sapiens
  CDS (7)..(1056)
gcggctatggcggcggaggaggaggaggtggactctgccgacaccggagagaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtttaagtctagtgcagcgtttaaggcctgatttcaaacgaaagtattcttcaatgttcgaagacgatactgtgacagaatacatctaccactgtaatgtgcagactccaagtggtgagacagcttcaaagaatatgactattccttatggatgggcaaaaaggccaatgctccagcgaattggtaaaatgcaccctgacattccagtttcagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaagagtagtgaatacaacacacaaccaggcagccttcttgactatactttgcacatgttttctttaggaattcactcacacatttaaaccagttagtgccttctagaagaatggctttcctttctcctacacaaaattgaaatatacaagtctctaaatataatacctttaaataaaaggttatttgtccctctgaaaaa

SEQ ID NO: 19060 - protein, 349 aa, Homo sapiens
MAAEEEEVDSADTGERSGWLTGWLPTWCPTSISHLKEAEEKMLKCVPCTYKKEPVRISNGNKIWTLKFSHNISNKTPLVLLHGFGGGLGLWALNFGDLCTNRPVYAFDLLGFGRSSRPRFDSDAEEVENQFVESIEEWRCALGLDKMILLGHNLGGFLAAAYSLKYPSRVNHLILVEPWGFPERPDLADQDRPIPVWIRALGAALTPFNPLAGLRIAGPFGLSLVQRLRPDFKRKYSSMFEDDTVTEYIYHCNVQTPSGETASKNMTIPYGWAKRPMLQRIGKMHPDIPVSVIFGARSCIDGNSGTSIQSLRPHSYVKTIAILGAGHYVYADQPEEFNQKVKEICDTVD

SEQ ID NO: 19061 - DNA, 25 bp, Artificial sequence
  (1)..(25): primer
atgtggacaaacactttcaaatggt

SEQ ID NO: 19062 - DNA, 25 bp, Artificial sequence
  (1)..(25): primer
ttactttgacaggaacgagactaaa

SEQ ID NO: 19063 - protein, 474 aa, Artificial sequence
  Variant (9)..(12): xaa in position 9 to 12 is any amino acid
  Variant (14)..(19): xaa in position 14 to 19 is any amino acid
  Variant (21)..(29): xaa in position 21 to 29 is any amino acid
  Variant (30)..(35): xaa in position 30 to 35 is any or no amino acid
  Variant (38)..(38): xaa in position 38 is any amino acid
  Variant (40)..(40): xaa in position 40 is any amino acid
  Variant (42)..(42): xaa in position 42 is any amino acid
  Variant (44)..(55): xaa in position 44 to 55 is any amino acid
  Variant (56)..(108): xaa in position 56 to 108 is any or no amino acid
  Variant (110)..(111): xaa in position 110 to 111 is any amino acid
  Variant (114)..(115): xaa in position 114 to 115 is any amino acid
  Variant (118)..(118): xaa in position 118 is any amino acid
  Variant (121)..(124): xaa in position 121 to 124 is any amino acid
  Variant (126)..(129): xaa in position 126 to 129 is any amino acid
  Variant (130)..(134): xaa in position 130 to 134 is any or no amino acid
  Variant (140)..(140): xaa in position 140 is any amino acid
  Variant (145)..(147): xaa in position 145 to 147 is any amino acid
  Variant (149)..(149): xaa in position 149 is any amino acid
  Variant (153)..(164): xaa in position 153 to 164 is any or no amino acid
  Variant (166)..(167): xaa in position 166 to 167 is any amino acid
  Variant (169)..(170): xaa in position 169 to 170 is any amino acid
  Variant (172)..(172): xaa in position 172 is any amino acid
  Variant (174)..(175): xaa in position 174 to 175 is any amino acid
  Variant (177)..(177): xaa in position 177 is any amino acid
  Variant (179)..(205): xaa in position 179 to 205 is any amino acid
  Variant (206)..(279): xaa in position 206 to 279 is any or no amino acid
  Variant (282)..(283): xaa in position 282 to 283 is any amino acid
  Variant (286)..(286): xaa in position 286 is any amino acid
  Variant (287)..(287): xaa in position 287 is any or no amino acid
  Variant (289)..(290): xaa in position 289 to 290 is any amino acid
  Variant (292)..(324): xaa in position 292 to 324 is any amino acid
  Variant (325)..(354): xaa in position 325 to 354 is any or no amino acid
  Variant (356)..(362): xaa in position 356 to 362 is any amino acid
  Variant (364)..(364): xaa in position 364 is any amino acid
  Variant (367)..(379): xaa in position 367 to 379 is any amino acid
  Variant (380)..(405): xaa in position 380 to 405 is any or no amino acid
  Variant (409)..(411): xaa in position 409 to 411 is any amino acid
  Variant (414)..(417): xaa in position 414 to 417 is any amino acid
  Variant (419)..(427): xaa in position 419 to 427 is any amino acid
  Variant (428)..(454): xaa in position 428 to 454 is any or no amino acid
  Variant (456)..(457): xaa in position 456 to 457 is any or no amino acid
  Variant (461)..(461): xaa in position 461 is any amino acid
  Variant (464)..(464): xaa in position 464 is any amino acid
  Variant (467)..(469): xaa in position 467 to 469 is any amino acid
  Variant (471)..(473): xaa in position 471 to 473 is any amino acid
VLIHGYGAXXXXFXXXXXXLXXXXXXXXXXXXXXXDLXGXGXSXXXXXXXXXXXXXXXXXXXXXXXXXXXXXXXXXXXXXXXXXXXXXXXXXXXXXXXXXXXXXXXXXEXXFIXXIEXWRXXXXLXXXXXXXXXLVGHSXGGYLXXXYXLKYXXXXXXXXXXXXPXXVXXLXLXXPXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRXXGPXXGXXLXXXXXXXXXXXXXXXXXXXXXXXXXXXXXXXXXXXXXXXXXXXXXXXXXXXXXXXXXXXXXXXLXXXXXXXRXPLXXXXXXXXXXXXXXXXXXXXXXXXXXXXXXXXXXXXXXXIYGXXXWMXXXXGXXXXXXXXXXXXXXXXXXXXXXXXXXXXXXXXXXXXIXXAGHXLYXDNXXXFXXXV

SEQ ID NO: 19064 - protein, 9 aa, Artificial sequence
  Variant (2)..(2): xaa in position 2 is any or no amino acid
  Variant (4)..(4): xaa in position 4 is any or no amino acid
  Variant (6)..(6): xaa in position 6 is any amino acid
  Variant (8)..(8): xaa in position 8 is any amino acid
DXLXGXGXS

SEQ ID NO: 19065 - protein, 26 aa, Artificial sequence
  Variant (3)..(3): xaa in position 3 is Phe or Tyr
  Variant (4)..(4): xaa in position 4 is any amino acid
  Variant (5)..(5): xaa in position 5 is Ala, Ser or Thr
  Variant (6)..(7): xaa in position 6 to 7 is any amino acid
  Variant (9)..(9): xaa in position 9 is any amino acid
  Variant (10)..(10): xaa in position 10 is Phe, Ile, Leu, Met or Val
  Variant (11)..(11): xaa in position 11 is any amino acid
  Variant (12)..(12): xaa in position 12 is His or Tyr
  Variant (13)..(13): xaa in position 13 is Asn or Pro
  Variant (14)..(18): xaa in position 14 to 18 is any amino acid
  Variant (19)..(19): xaa in position 19 is Ala or Leu
  Variant (20)..(23): xaa in position 20 to 23 is any amino acid
  Variant (24)..(24): xaa in position 24 is Pro, Gln or Ser
  Variant (25)..(25): xaa in position 25 is any amino acid
  Variant (26)..(26): xaa in position 26 is Ala, Gly or Ile
GGXXXXXYXXXXXXXXXXXXXXXXXX

SEQ ID NO: 19066 - protein, 12 aa, Artificial sequence
  Variant (3)..(3): xaa in position 3 is Ala, Asp, Glu, Gln or Ser
  Variant (4)..(4): xaa in position 4 is any amino acid
  Variant (5)..(5): xaa in position 5 is Asp, Ser or Thr
  Variant (6)..(6): xaa in position 6 is any amino acid
  Variant (7)..(7): xaa in position 7 is Ile, Met or Val
  Variant (8)..(8): xaa in position 8 is Asp or Asn
  Variant (9)..(10): xaa in position 9 to 10 is any amino acid
  Variant (11)..(11): xaa in position 11 is Ala, Gly, Ser or Thr
  Variant (12)..(12): xaa in position 12 is Ala or Gly
YGXXXXXXXXXX

SEQ ID NO: 19067 - protein, 13 aa, Artificial sequence
  Variant (2)..(2): xaa in position 2 is any or no amino acid
  Variant (4)..(4): xaa in position 4 is any amino acid
  Variant (5)..(5): xaa in position 5 is Ile, Leu or Val
  Variant (6)..(6): xaa in position 6 is Phe or Tyr
  Variant (7)..(7): xaa in position 7 is any amino acid
  Variant (9)..(9): xaa in position 9 is Asp, Asn or Gln
  Variant (10)..(12): xaa in position 10 to 12 is any amino acid
GXHXXXXDXXXXF

SEQ ID NO: 19068 - DNA, 1818 bp, Escherichia coli; identical to SEQ ID NO: 13510
  CDS (1)..(1818)

SEQ ID NO: 19069 - protein, 605 aa, Escherichia coli; identical to SEQ ID NO: 13511

SEQ ID NO: 19070 - DNA, 1665 bp, Mesorhizobium loti MAFF303099; identical to SEQ ID NO: 13512
  CDS (1)..(1665): transl_table=11

SEQ ID NO: 19071 - protein, 554 aa, Mesorhizobium loti MAFF303099; identical to SEQ ID NO: 13513

SEQ ID NO: 19072 - DNA, 1635 bp, Mesorhizobium loti MAFF303099; identical to SEQ ID NO: 13514
  CDS (1)..(1635): transl_table=11

SEQ ID NO: 19073 - protein, 544 aa, Mesorhizobium loti MAFF303099; identical to SEQ ID NO: 13515

SEQ ID NO: 19074 - DNA, 1851 bp, Thermoplasma volcanium GSS1; identical to SEQ ID NO: 13516
  CDS (1)..(1851): transl_table=11

SEQ ID NO: 19075 - protein, 616 aa, Thermoplasma volcanium GSS1; identical to SEQ ID NO: 13517

SEQ ID NO: 19076 - DNA, 1422 bp, Thermotoga maritima MSB8; identical to SEQ ID NO: 13518
  CDS (1)..(1422): transl_table=11

SEQ ID NO: 19077 - protein, 473 aa, Thermotoga maritima MSB8; identical to SEQ ID NO: 13519

SEQ ID NO: 19078 - DNA, 1671 bp, Thermotoga maritima MSB8; identical to SEQ ID NO: 13520
  CDS (1)..(1671): transl_table=11

SEQ ID NO: 19079 - protein, 556 aa, Thermotoga maritima MSB8; identical to SEQ ID NO: 13521

SEQ ID NO: 19080 - DNA, 1737 bp, Bacillus halodurans C-125; identical to SEQ ID NO: 13522
  CDS (1)..(1737): transl_table=11

SEQ ID NO: 19081 - protein, 578 aa, Bacillus halodurans C-125; identical to SEQ ID NO: 13523

SEQ ID NO: 19082 - DNA, 1704 bp, Streptococcus pyogenes M1 GAS; identical to SEQ ID NO: 13524
  CDS (1)..(1704): transl_table=11

SEQ ID NO: 19083 - protein, 567 aa, Streptococcus pyogenes M1 GAS; identical to SEQ ID NO: 13525

SEQ ID NO: 19084 - DNA, 1614 bp, Streptococcus pyogenes M1 GAS; identical to SEQ ID NO: 13526
  CDS (1)..(1614): transl_table=11

SEQ ID NO: 19085 - protein, 537 aa, Streptococcus pyogenes M1 GAS; identical to SEQ ID NO: 13527

SEQ ID NO: 19086 - DNA, 1974 bp, Deinococcus radiodurans R1; identical to SEQ ID NO: 13528
  CDS (1)..(1974): transl_table=11

SEQ ID NO: 19087 - protein, 657 aa, Deinococcus radiodurans R1; identical to SEQ ID NO: 13529

SEQ ID NO: 19088 - DNA, 1497 bp, Deinococcus radiodurans R1; identical to SEQ ID NO: 13530
  CDS (1)..(1497): transl_table=11

SEQ ID NO: 19089 - protein, 498 aa, Deinococcus radiodurans R1; identical to SEQ ID NO: 13531

SEQ ID NO: 19090 - DNA, 1695 bp, Deinococcus radiodurans R1; identical to SEQ ID NO: 13532
  CDS (1)..(1695): transl_table=11

SEQ ID NO: 19091 - protein, 564 aa, Deinococcus radiodurans R1; identical to SEQ ID NO: 13533

SEQ ID NO: 19092 - DNA, 1452 bp, Deinococcus radiodurans R1; identical to SEQ ID NO: 13534
  CDS (1)..(1452): transl_table=11

SEQ ID NO: 19093 - protein, 483 aa, Deinococcus radiodurans R1; identical to SEQ ID NO: 13535

SEQ ID NO: 19094 - DNA, 1659 bp, Deinococcus radiodurans R1; identical to SEQ ID NO: 13536
  CDS (1)..(1659): transl_table=11

SEQ ID NO: 19095 - protein, 552 aa, Deinococcus radiodurans R1; identical to SEQ ID NO: 13537

SEQ ID NO: 19096 - DNA, 1824 bp, Mycoplasma pulmonis UAB CTIP; identical to SEQ ID NO: 13538
  CDS (1)..(1824): transl_table=4

SEQ ID NO: 19097 - protein, 607 aa, Mycoplasma pulmonis UAB CTIP; identical to SEQ ID NO: 13539

SEQ ID NO: 19098 - DNA, 1806 bp, Mycobacterium tuberculosis CDC1551; identical to SEQ ID NO: 13540
  CDS (1)..(1806): transl_table=11

SEQ ID NO: 19099 - protein, 601 aa, Mycobacterium tuberculosis CDC1551; identical to SEQ ID NO: 13541

SEQ ID NO: 19100 - DNA, 1641 bp, Mycobacterium tuberculosis CDC1551; identical to SEQ ID NO: 13542
  CDS (1)..(1641): transl_table=11

SEQ ID NO: 19101 - protein, 546 aa, Mycobacterium tuberculosis CDC1551; identical to SEQ ID NO: 13543

SEQ ID NO: 19102 - DNA, 1356 bp, Clostridium acetobutylicum ATCC 824; identical to SEQ ID NO: 13544
  CDS (1)..(1356): transl_table=11

SEQ ID NO: 19103 - protein, 451 aa, Clostridium acetobutylicum ATCC 824; identical to SEQ ID NO: 13545

SEQ ID NO: 19104 - DNA, 1785 bp, Agrobacterium tumefaciens str. C58; identical to SEQ ID NO: 13546
  CDS (1)..(1785): transl_table=11

SEQ ID NO: 19105 - protein, 594 aa, Agrobacterium tumefaciens str. C58; identical to SEQ ID NO: 13547

SEQ ID NO: 19106 - DNA, 1608 bp, Streptococcus pneumoniae R6; identical to SEQ ID NO: 13548
  CDS (1)..(1608): transl_table=11

SEQ ID NO: 19107 - protein, 535 aa, Streptococcus pneumoniae R6; identical to SEQ ID NO: 13549

SEQ ID NO: 19108 - DNA, 1764 bp, Streptococcus pneumoniae R6; identical to SEQ ID NO: 13550
  CDS (1)..(1764): transl_table=11

SEQ ID NO: 19109 - protein, 587 aa, Streptococcus pneumoniae R6; identical to SEQ ID NO: 13551

SEQ ID NO: 19110 - DNA, 1851 bp, Thermoplasma acidophilum DSM 1728; identical to SEQ ID NO: 13552
  CDS (1)..(1851): transl_table=11

SEQ ID NO: 19111 - protein, 616 aa, Thermoplasma acidophilum DSM 1728; identical to SEQ ID NO: 13553

SEQ ID NO: 19112 - DNA, 1527 bp, Synechocystis sp. PCC 6803; identical to SEQ ID NO: 13554
  CDS (1)..(1527): transl_table=11

SEQ ID NO: 19113 - protein, 508 aa, Synechocystis sp. PCC 6803; identical to SEQ ID NO: 13555

SEQ ID NO: 19114 - DNA, 1818 bp, Salmonella typhimurium LT2; identical to SEQ ID NO: 13556
  CDS (1)..(1818): transl_table=11

SEQ ID NO: 19115 - protein, 605 aa, Salmonella typhimurium LT2; identical to SEQ ID NO: 13557

SEQ ID NO: 19116 - DNA, 1662 bp, Listeria monocytogenes EGD-e; identical to SEQ ID NO: 13558
  CDS (1)..(1662): transl_table=11

SEQ ID NO: 19117 - protein, 553 aa, Listeria monocytogenes EGD-e; identical to SEQ ID NO: 13559

SEQ ID NO: 19118 - DNA, 1776 bp, Listeria monocytogenes EGD-e; identical to SEQ ID NO: 13560
  CDS (1)..(1776): transl_table=11

SEQ ID NO: 19119 - protein, 591 aa, Listeria monocytogenes EGD-e; identical to SEQ ID NO: 13561

SEQ ID NO: 19120 - DNA, 1467 bp, Nostoc sp. PCC 7120; identical to SEQ ID NO: 13562
  CDS (1)..(1467): transl_table=11

SEQ ID NO: 19121 - protein, 488 aa, Nostoc sp. PCC 7120; identical to SEQ ID NO: 13563

SEQ ID NO: 19122 - DNA, 3483 bp, Ralstonia solanacearum GMI1000; identical to SEQ ID NO: 13564
  CDS (1)..(3483): transl_table=11

SEQ ID NO: 19123 - protein, 1160 aa, Ralstonia solanacearum GMI1000; identical to SEQ ID NO: 13565

SEQ ID NO: 19124 - DNA, 1821 bp, Clostridium perfringens str. 13; identical to SEQ ID NO: 13566
  CDS (1)..(1821): transl_table=11

SEQ ID NO: 19125 - protein, 606 aa, Clostridium perfringens str. 13; identical to SEQ ID NO: 13567

SEQ ID NO: 19126 - DNA, 1665 bp, Clostridium perfringens str. 13; identical to SEQ ID NO: 13568
  CDS (1)..(1665): transl_table=11

SEQ ID NO: 19127 - protein, 554 aa, Clostridium perfringens str. 13; identical to SEQ ID NO: 13569

SEQ ID NO: 19128 - DNA, 1833 bp, Clostridium perfringens str. 13; identical to SEQ ID NO: 13570
  CDS (1)..(1833): transl_table=11

SEQ ID NO: 19129 - protein, 610 aa, Clostridium perfringens str. 13; identical to SEQ ID NO: 13571

SEQ ID NO: 19130 - DNA, 1938 bp, Pyrococcus furiosus DSM 3638; identical to SEQ ID NO: 13572
  CDS (1)..(1938): transl_table=11

SEQ ID NO: 19131 - protein, 645 aa, Pyrococcus furiosus DSM 3638; identical to SEQ ID NO: 13573

SEQ ID NO: 19132 - DNA, 1614 bp, Streptococcus pyogenes MGAS8232; identical to SEQ ID NO: 13574
  CDS (1)..(1614): transl_table=11

SEQ ID NO: 19133 - protein, 537 aa, Streptococcus pyogenes MGAS8232; identical to SEQ ID NO: 13575

SEQ ID NO: 19134 - DNA, 1725 bp, Thermoanaerobacter tengcongensis MB4; identical to SEQ ID NO: 13576
  CDS (1)..(1725): transl_table=11

SEQ ID NO: 19135 - protein, 574 aa, Thermoanaerobacter tengcongensis MB4; identical to SEQ ID NO: 13577

SEQ ID NO: 19136 - DNA, 1575 bp, Thermoanaerobacter tengcongensis MB4; identical to SEQ ID NO: 13578
  CDS (1)..(1575): transl_table=11

SEQ ID NO: 19137 - protein, 524 aa, Thermoanaerobacter tengcongensis MB4; identical to SEQ ID NO: 13579

SEQ ID NO: 19138 - DNA, 1719 bp, Streptomyces coelicolor A3(2); identical to SEQ ID NO: 13580
  CDS (1)..(1719)

SEQ ID NO: 19139 - protein, 572 aa, Streptomyces coelicolor A3(2); identical to SEQ ID NO: 13581

SEQ ID NO: 19140 - DNA, 3351 bp, Xanthomonas campestris pv. campestris str. ATCC 33913; identical to SEQ ID NO: 13582
  CDS (1)..(3351): transl_table=11

SEQ ID NO: 19141 - protein, 1116 aa, Xanthomonas campestris pv. campestris str. ATCC 33913; identical to SEQ ID NO: 13583

SEQ ID NO: 19142 - DNA, 1617 bp, Xanthomonas campestris pv. campestris str. ATCC 33913; identical to SEQ ID NO: 13584
  CDS (1)..(1617): transl_table=11

SEQ ID NO: 19143 - protein, 538 aa, Xanthomonas campestris pv. campestris str. ATCC 33913; identical to SEQ ID NO: 13585

SEQ ID NO: 19144 - DNA, 1617 bp, Xanthomonas axonopodis pv. citri str. 306; identical to SEQ ID NO: 13586
  CDS (1)..(1617): transl_table=11

SEQ ID NO: 19145 - protein, 538 aa, Xanthomonas axonopodis pv. citri str. 306; identical to SEQ ID NO: 13587

SEQ ID NO: 19146 - DNA, 3327 bp, Chlorobium tepidum TLS; identical to SEQ ID NO: 13588
  CDS (1)..(3327): transl_table=11

SEQ ID NO: 19147 - protein, 1108 aa, Chlorobium tepidum TLS; identical to SEQ ID NO: 13589

SEQ ID NO: 19148 - DNA, 1668 bp, Yersinia pestis KIM; identical to SEQ ID NO: 13590
  CDS (1)..(1668): transl_table=11

SEQ ID NO: 19149 - protein, 555 aa, Yersinia pestis KIM; identical to SEQ ID NO: 13591

SEQ ID NO: 19150 - DNA, 1830 bp, Yersinia pestis KIM; identical to SEQ ID NO: 13592
  CDS (1)..(1830): transl_table=11

SEQ ID NO: 19151 - protein, 609 aa, Yersinia pestis KIM; identical to SEQ ID NO: 13593

SEQ ID NO: 19152 - DNA, 1608 bp, Streptococcus agalactiae 2603V/R; identical to SEQ ID NO: 13594
  CDS (1)..(1608): transl_table=11

SEQ ID NO: 19153 - protein, 535 aa, Streptococcus agalactiae 2603V/R; identical to SEQ ID NO: 13595

SEQ ID NO: 19154 - DNA, 1497 bp, Oceanobacillus iheyensis HTE831; identical to SEQ ID NO: 13596
  CDS (1)..(1497): transl_table=11

SEQ ID NO: 19155 - protein, 498 aa, Oceanobacillus iheyensis HTE831; identical to SEQ ID NO: 13597

SEQ ID NO: 19156 - DNA, 1752 bp, Oceanobacillus iheyensis HTE831; identical to SEQ ID NO: 13598
  CDS (1)..(1752): transl_table=11

SEQ ID NO: 19157 - protein, 583 aa, Oceanobacillus iheyensis HTE831; identical to SEQ ID NO: 13599

SEQ ID NO: 19158 - DNA, 1398 bp, Bifidobacterium longum NCC2705; identical to SEQ ID NO: 13600
  CDS (1)..(1398): transl_table=11

SEQ ID NO: 19159 - protein, 465 aa, Bifidobacterium longum NCC2705; identical to SEQ ID NO: 13601

SEQ ID NO: 19160 - DNA, 1818 bp, Shigella flexneri 2a str. 301; identical to SEQ ID NO: 13602
  CDS (1)..(1818): transl_table=11

SEQ ID NO: 19161 - protein, 605 aa, Shigella flexneri 2a str. 301; identical to SEQ ID NO: 13603

SEQ ID NO: 19162 - DNA, 1746 bp, Leptospira interrogans serovar Lai str. 56601; identical to SEQ ID NO: 13604
  CDS (1)..(1746): transl_table=11

SEQ ID NO: 19163 - protein, 581 aa, Leptospira interrogans serovar Lai str. 56601; identical to SEQ ID NO: 13605

SEQ ID NO: 19164 - DNA, 1839 bp, Corynebacterium efficiens YS-314; identical to SEQ ID NO: 13606
  CDS (1)..(1839): transl_table=11

SEQ ID NO: 19165 - protein, 612 aa, Corynebacterium efficiens YS-314; identical to SEQ ID NO: 13607

SEQ ID NO: 19166 - DNA, 1839 bp, Vibrio vulnificus CMCP6; identical to SEQ ID NO: 13608
  CDS (1)..(1839): transl_table=11

SEQ ID NO: 19167 - protein, 612 aa, Vibrio vulnificus CMCP6; identical to SEQ ID NO: 13609

SEQ ID NO: 19168 - DNA, 2064 bp, Vibrio vulnificus CMCP6; identical to SEQ ID NO: 13610
  CDS (1)..(2064): transl_table=11

SEQ ID NO: 19169 - protein, 687 aa, Vibrio vulnificus CMCP6; identical to SEQ ID NO: 13611

SEQ ID NO: 19170 - DNA, 1464 bp, Bradyrhizobium japonicum USDA 110; identical to SEQ ID NO: 13612
  CDS (1)..(1464)

SEQ ID NO: 19171 - protein, 487 aa, Bradyrhizobium japonicum USDA 110; identical to SEQ ID NO: 13613

SEQ ID NO: 19172 - DNA, 1698 bp, Bradyrhizobium japonicum USDA 110; identical to SEQ ID NO: 13614
  CDS (1)..(1698)

SEQ ID NO: 19173 - protein, 565 aa, Bradyrhizobium japonicum USDA 110; identical to SEQ ID NO: 13615

SEQ ID NO: 19174 - DNA, 1626 bp, Lactobacillus plantarum WCFS1; identical to SEQ ID NO: 13616
  CDS (1)..(1626): transl_table=11

SEQ ID NO: 19175 - protein, 541 aa, Lactobacillus plantarum WCFS1; identical to SEQ ID NO: 13617

SEQ ID NO: 19176 - DNA, 1827 bp, Vibrio parahaemolyticus RIMD 2210633; identical to SEQ ID NO: 13618
  CDS (1)..(1827): transl_table=11

SEQ ID NO: 19177 - protein, 608 aa, Vibrio parahaemolyticus RIMD 2210633; identical to SEQ ID NO: 13619

SEQ ID NO: 19178 - DNA, 1818 bp, Salmonella enterica subsp. enterica serovar Typhi Ty2; identical to SEQ ID NO: 13620
  CDS (1)..(1818): transl_table=11

SEQ ID NO: 19179 - protein, 605 aa, Salmonella enterica subsp. enterica serovar Typhi Ty2; identical to SEQ ID NO: 13621

SEQ ID NO: 19180 - DNA, 2079 bp, Bacteroides thetaiotaomicron VPI-5482; identical to SEQ ID NO: 13622
  CDS (1)..(2079): transl_table=11

SEQ ID NO: 19181 - protein, 692 aa, Bacteroides thetaiotaomicron VPI-5482; identical to SEQ ID NO: 13623

SEQ ID NO: 19182 - DNA, 1854 bp, Bacteroides thetaiotaomicron VPI-5482; identical to SEQ ID NO: 13624
  CDS (1)..(1854): transl_table=11

SEQ ID NO: 19183 - protein, 617 aa, Bacteroides thetaiotaomicron VPI-5482; identical to SEQ ID NO: 13625

SEQ ID NO: 19184 - DNA, 1767 bp, Enterococcus faecalis V583; identical to SEQ ID NO: 13626
  CDS (1)..(1767): transl_table=11

SEQ ID NO: 19185 - protein, 588 aa, Enterococcus faecalis V583; identical to SEQ ID NO: 13627

SEQ ID NO: 19186 - DNA, 1614 bp, Enterococcus faecalis V583; identical to SEQ ID NO: 13628
  CDS (1)..(1614): transl_table=11

SEQ ID NO: 19187 - protein, 537 aa, Enterococcus faecalis V583; identical to SEQ ID NO: 13629

SEQ ID NO: 19188 - DNA, 1674 bp, Enterococcus faecalis V583; identical to SEQ ID NO: 13630
  CDS (1)..(1674): transl_table=11

SEQ ID NO: 19189 - protein, 557 aa, Enterococcus faecalis V583; identical to SEQ ID NO: 13631

SEQ ID NO: 19190 - DNA, 1719 bp, Streptomyces avermitilis MA-4680; identical to SEQ ID NO: 13632
  CDS (1)..(1719)

SEQ ID NO: 19191 - protein, 572 aa, Streptomyces avermitilis MA-4680; identical to SEQ ID NO: 13633

SEQ ID NO: 19192 - DNA, 1752 bp, Streptomyces avermitilis MA-4680; identical to SEQ ID NO: 13634
  CDS (1)..(1752)

SEQ ID NO: 19193 - protein, 583 aa, Streptomyces avermitilis MA-4680; identical to SEQ ID NO: 13635

SEQ ID NO: 19194 - DNA, 1665 bp, Bacillus anthracis str. Ames; identical to SEQ ID NO: 13636
  CDS (1)..(1665): transl_table=11

SEQ ID NO: 19195 - protein, 554 aa, Bacillus anthracis str. Ames; identical to SEQ ID NO: 13637

SEQ ID NO: 19196 - DNA, 1761 bp, Bacillus anthracis str. Ames; identical to SEQ ID NO: 13638
  CDS (1)..(1761): transl_table=11

SEQ ID NO: 19197 - protein, 586 aa, Bacillus anthracis str. Ames; identical to SEQ ID NO: 13639

SEQ ID NO: 19198 - DNA, 1641 bp, Mycobacterium bovis AF2122/97; identical to SEQ ID NO: 13640
  CDS (1)..(1641): transl_table=11

SEQ ID NO: 19199 - protein, 546 aa, Mycobacterium bovis AF2122/97; identical to SEQ ID NO: 13641

SEQ ID NO: 19200 - DNA, 1761 bp, Rhodopirellula baltica SH 1; identical to SEQ ID NO: 13642
  CDS (1)..(1761): transl_table=11

SEQ ID NO: 19201 - protein, 586 aa, Rhodopirellula baltica SH 1; identical to SEQ ID NO: 13643

SEQ ID NO: 19202 - DNA, 3342 bp, Bordetella pertussis Tohama I; identical to SEQ ID NO: 13644
  CDS (1)..(3342): transl_table=11

SEQ ID NO: 19203 - protein, 1113 aa, Bordetella pertussis Tohama I; identical to SEQ ID NO: 13645

SEQ ID NO: 19204 - DNA, 3342 bp, Bordetella bronchiseptica RB50; identical to SEQ ID NO: 13646
  CDS (1)..(3342)

SEQ ID NO: 19205 - protein, 1113 aa, Bordetella bronchiseptica RB50; identical to SEQ ID NO: 13647

SEQ ID NO: 19206 - DNA, 1452 bp, Prochlorococcus marinus str. MIT 9313; identical to SEQ ID NO: 13648
  CDS (1)..(1452): transl_table=11

SEQ ID NO: 19207 - protein, 483 aa, Prochlorococcus marinus str. MIT 9313; identical to SEQ ID NO: 13649

SEQ ID NO: 19208 - DNA, 1407 bp, Synechococcus sp. WH 8102; identical to SEQ ID NO: 13650
  CDS (1)..(1407): transl_table=11

SEQ ID NO: 19209 - protein, 468 aa, Synechococcus sp. WH 8102; identical to SEQ ID NO: 13651

SEQ ID NO: 19210 - DNA, 1662 bp, Synechococcus sp. WH 8102; identical to SEQ ID NO: 13652
  CDS (1)..(1662): transl_table=11

SEQ ID NO: 19211 - protein, 553 aa, Synechococcus sp. WH 8102; identical to SEQ ID NO: 13653

SEQ ID NO: 19212 - DNA, 1863 bp, Gloeobacter violaceus PCC 7421; identical to SEQ ID NO: 13654
  CDS (1)..(1863): transl_table=11

SEQ ID NO: 19213 - protein, 620 aa, Gloeobacter violaceus PCC 7421; identical to SEQ ID NO: 13655

SEQ ID NO: 19214 - DNA, 1443 bp, Gloeobacter violaceus PCC 7421; identical to SEQ ID NO: 13656
  CDS (1)..(1443): transl_table=11

SEQ ID NO: 19215 - protein, 480 aa, Gloeobacter violaceus PCC 7421; identical to SEQ ID NO: 13657

SEQ ID NO: 19216 - DNA, 1635 bp, Vibrio vulnificus YJ016; identical to SEQ ID NO: 13658
  CDS (1)..(1635): transl_table=11

SEQ ID NO: 19217 - protein, 544 aa, Vibrio vulnificus YJ016; identical to SEQ ID NO: 13659

SEQ ID NO: 19218 - DNA, 3303 bp, Rhodopseudomonas palustris CGA009; identical to SEQ ID NO: 13660
  CDS (1)..(3303): transl_table=11

SEQ ID NO: 19219 - protein, 1100 aa, Rhodopseudomonas palustris CGA009; identical to SEQ ID NO: 13661

SEQ ID NO: 19220 - DNA, 1617 bp, Rhodopseudomonas palustris CGA009; identical to SEQ ID NO: 13662
  CDS (1)..(1617): transl_table=11

SEQ ID NO: 19221 - protein, 538 aa, Rhodopseudomonas palustris CGA009; identical to SEQ ID NO: 13663

SEQ ID NO: 19222 - DNA, 3336 bp, Geobacter sulfurreducens PCA; identical to SEQ ID NO: 13664
  CDS (1)..(3336): transl_table=11

SEQ ID NO: 19223 - protein, 1111 aa, Geobacter sulfurreducens PCA; identical to SEQ ID NO: 13665

SEQ ID NO: 19224 - DNA, 1335 bp, Mycobacterium avium subsp. paratuberculosis str. k10; identical to SEQ ID NO: 13666
  CDS (1)..(1335): transl_table=11

SEQ ID NO: 19225 - protein, 444 aa, Mycobacterium avium subsp. paratuberculosis str. k10; identical to SEQ ID NO: 13667

SEQ ID NO: 19226 - DNA, 1773 bp, Mycobacterium avium subsp. paratuberculosis str. k10; identical to SEQ ID NO: 13668
  CDS (1)..(1773): transl_table=11

SEQ ID NO: 19227 - protein, 590 aa, Mycobacterium avium subsp. paratuberculosis str. k10; identical to SEQ ID NO: 13669

SEQ ID NO: 19228 - DNA, 1725 bp, Lactobacillus johnsonii NCC 533; identical to SEQ ID NO: 13670
  CDS (1)..(1725): transl_table=11

SEQ ID NO: 19229 - protein, 574 aa, Lactobacillus johnsonii NCC 533; identical to SEQ ID NO: 13671

SEQ ID NO: 19230 - DNA, 1668 bp, Lactobacillus johnsonii NCC 533; identical to SEQ ID NO: 13672
  CDS (1)..(1668): transl_table=11

SEQ ID NO: 19231 - protein, 555 aa, Lactobacillus johnsonii NCC 533; identical to SEQ ID NO: 13673

SEQ ID NO: 19232 - DNA, 1665 bp, Bacillus cereus ATCC 10987; identical to SEQ ID NO: 13674
  CDS (1)..(1665): transl_table=11

SEQ ID NO: 19233 - protein, 554 aa, Bacillus cereus ATCC 10987; identical to SEQ ID NO: 13675

SEQ ID NO: 19234 - DNA, 1710 bp, Anopheles gambiae str. PEST; identical to SEQ ID NO: 13676
  CDS (1)..(1710)

SEQ ID NO: 19235 - protein, 569 aa, Anopheles gambiae str. PEST; identical to SEQ ID NO: 13677

SEQ ID NO: 19236 - DNA, 1800 bp, Anopheles gambiae str. PEST; identical to SEQ ID NO: 13678
  CDS (1)..(1800)

SEQ ID NO: 19237 - protein, 599 aa, Anopheles gambiae str. PEST; identical to SEQ ID NO: 13679

SEQ ID NO: 19238 - DNA, 1509 bp, Anopheles gambiae str. PEST; identical to SEQ ID NO: 13680
  CDS (1)..(1509)

SEQ ID NO: 19239 - protein, 502 aa, Anopheles gambiae str. PEST; identical to SEQ ID NO: 13681

SEQ ID NO: 19240 - DNA, 1716 bp, Gibberella zeae PH-1; identical to SEQ ID NO: 13682
  CDS (1)..(1716)

SEQ ID NO: 19241 - protein, 571 aa, Gibberella zeae PH-1; identical to SEQ ID NO: 13683

SEQ ID NO: 19242 - DNA, 1635 bp, Leptospira interrogans serovar Copenhageni str. Fiocruz L1-130; identical to SEQ ID NO: 13684
  CDS (1)..(1635): transl_table=11

SEQ ID NO: 19243 - protein, 544 aa, Leptospira interrogans serovar Copenhageni str. Fiocruz L1-130; identical to SEQ ID NO: 13685

SEQ ID NO: 19244 - DNA, 1251 bp, Thermus thermophilus HB27; identical to SEQ ID NO: 13686
  CDS (1)..(1251): transl_table=11

SEQ ID NO: 19245 - protein, 416 aa, Thermus thermophilus HB27 [sequence omitted]

SEQ ID NO: 19246 - DNA, 1662 bp, Listeria monocytogenes str. 4b F2365; identical to SEQ ID NO: 13688
  CDS (1)..(1662): transl_table=11

SEQ ID NO: 19247 - protein, 553 aa, Listeria monocytogenes str. 4b F2365; identical to SEQ ID NO: 13689

SEQ ID NO: 19248 - DNA, 1533 bp, Listeria monocytogenes str. 4b F2365; identical to SEQ ID NO: 13690
  CDS (1)..(1533): transl_table=11

SEQ ID NO: 19249 - protein, 510 aa, Listeria monocytogenes str. 4b F2365; identical to SEQ ID NO: 13691

SEQ ID NO: 19250 - DNA, 1761 bp, Bacillus thuringiensis serovar konkukian str. 97-27; identical to SEQ ID NO: 13692
  CDS (1)..(1761): transl_table=11

SEQ ID NO: 19251 - protein, 586 aa, Bacillus thuringiensis serovar konkukian str. 97-27; identical to SEQ ID NO: 13693

SEQ ID NO: 19252 - DNA, 1710 bp, Leifsonia xyli subsp. xyli str. CTCB07; identical to SEQ ID NO: 13694
  CDS (1)..(1710): transl_table=11

SEQ ID NO: 19253 - protein, 569 aa, Leifsonia xyli subsp. xyli str. CTCB07; identical to SEQ ID NO: 13695

SEQ ID NO: 19254 - DNA, 1683 bp, Bacillus licheniformis ATCC 14580; identical to SEQ ID NO: 13696
  CDS (1)..(1683): transl_table=11

SEQ ID NO: 19255 - protein, 560 aa, Bacillus licheniformis ATCC 14580; identical to SEQ ID NO: 13697

SEQ ID NO: 19256 - DNA, 1764 bp, Bacillus licheniformis ATCC 14580; identical to SEQ ID NO: 13698
  CDS (1)..(1764): transl_table=11

SEQ ID NO: 19257 - protein, 587 aa, Bacillus licheniformis ATCC 14580; identical to SEQ ID NO: 13699

SEQ ID NO: 19258 - DNA, 1620 bp, Methylococcus capsulatus str. Bath; identical to SEQ ID NO: 13700
  CDS (1)..(1620): transl_table=11

SEQ ID NO: 19259 - protein, 539 aa, Methylococcus capsulatus str. Bath; identical to SEQ ID NO: 13701

SEQ ID NO: 19260 - DNA, 1866 bp, Photobacterium profundum SS9; identical to SEQ ID NO: 13702
  CDS (1)..(1866): transl_table=11

SEQ ID NO: 19261 - protein, 621 aa, Photobacterium profundum SS9; identical to SEQ ID NO: 13703

SEQ ID NO: 19262 - DNA, 1656 bp, Thermus thermophilus HB8; identical to SEQ ID NO: 13704
  CDS (1)..(1656): transl_table=11

SEQ ID NO: 19263 - protein, 551 aa, Thermus thermophilus HB8; identical to SEQ ID NO: 13705

SEQ ID NO: 19264 - DNA, 1767 bp, Geobacillus kaustophilus HTA426; identical to SEQ ID NO: 13706
  CDS (1)..(1767): transl_table=11

SEQ ID NO: 19265 - protein, 588 aa, Geobacillus kaustophilus HTA426; identical to SEQ ID NO: 13707

SEQ ID NO: 19266 - DNA, 1542 bp, Geobacillus kaustophilus HTA426; identical to SEQ ID NO: 13708
  CDS (1)..(1542): transl_table=11

SEQ ID NO: 19267 - protein, 513 aa, Geobacillus kaustophilus HTA426; identical to SEQ ID NO: 13709

SEQ ID NO: 19268 - DNA, 4983 bp, Geobacillus kaustophilus HTA426; identical to SEQ ID NO: 13710
  CDS (1)..(4983): transl_table=11

SEQ ID NO: 19269 - protein, 1660 aa, Geobacillus kaustophilus HTA426; identical to SEQ ID NO: 13711

SEQ ID NO: 19270 - DNA, 1689 bp, Azoarcus sp. EbN1; identical to SEQ ID NO: 13712
  CDS (1)..(1689): transl_table=11

SEQ ID NO: 19271 - protein, 562 aa, Azoarcus sp. EbN1; identical to SEQ ID NO: 13713

SEQ ID NO: 19272 - DNA, 1770 bp, Bacillus clausii KSM-K16; identical to SEQ ID NO: 13714
  CDS (1)..(1770): transl_table=11

SEQ ID NO: 19273 - protein, 589 aa, Bacillus clausii KSM-K16; identical to SEQ ID NO: 13715

SEQ ID NO: 19274 - DNA, 2298 bp, Thermococcus kodakarensis KOD1; identical to SEQ ID NO: 13716
  CDS (1)..(2298): transl_table=11

SEQ ID NO: 19275 - protein, 765 aa, Thermococcus kodakarensis KOD1; identical to SEQ ID NO: 13717

SEQ ID NO: 19276 - DNA, 2724 bp, Xanthomonas oryzae pv. oryzae KACC10331; identical to SEQ ID NO: 13718
  CDS (1)..(2724): transl_table=11

SEQ ID NO: 19277 - protein, 907 aa, Xanthomonas oryzae pv. oryzae KACC10331; identical to SEQ ID NO: 13719

SEQ ID NO: 19278 - DNA, 1260 bp, Vibrio fischeri ES114; identical to SEQ ID NO: 13720
  CDS (1)..(1260): transl_table=11

SEQ ID NO: 19279 - protein, 419 aa, Vibrio fischeri ES114; identical to SEQ ID NO: 13721

SEQ ID NO: 19280 - DNA, 1815 bp, Corynebacterium glutamicum ATCC 13032; identical to SEQ ID NO: 13722
  CDS (1)..(1815): transl_table=11

SEQ ID NO: 19281 - protein, 604 aa, Corynebacterium glutamicum ATCC 13032; identical to SEQ ID NO: 13723

SEQ ID NO: 19282 - DNA, 3327 bp, Pseudomonas syringae pv. syringae B728a; identical to SEQ ID NO: 13724
  CDS (1)..(3327)

SEQ ID NO: 19283 - protein, 1108 aa, Pseudomonas syringae pv. syringae B728a; identical to SEQ ID NO: 13725

SEQ ID NO: 19284 - DNA, 1659 bp, Lactobacillus gasseri; identical to SEQ ID NO: 13726
  CDS (1)..(1659)

SEQ ID NO: 19285 - protein, 552 aa, Lactobacillus gasseri; identical to SEQ ID NO: 13727

SEQ ID NO: 19286 - DNA, 1467 bp, Nostoc punctiforme PCC 73102; identical to SEQ ID NO: 13728
  CDS (1)..(1467)

SEQ ID NO: 19287 - protein, 488 aa, Nostoc punctiforme PCC 73102; identical to SEQ ID NO: 13729

SEQ ID NO: 19288 - DNA, 1674 bp, Nostoc punctiforme PCC 73102; identical to SEQ ID NO: 13730
  CDS (1)..(1674)

SEQ ID NO: 19289 - protein, 557 aa, Nostoc punctiforme PCC 73102; identical to SEQ ID NO: 13731

SEQ ID NO: 19290 - DNA, 1266 bp, Bifidobacterium longum DJO10A; identical to SEQ ID NO: 13732
  CDS (1)..(1266)

SEQ ID NO: 19291 - protein, 421 aa, Bifidobacterium longum DJO10A; identical to SEQ ID NO: 13733

SEQ ID NO: 19292 - DNA, 3333 bp, Desulfovibrio desulfuricans G20; identical to SEQ ID NO: 13734
  CDS (1)..(3333)

SEQ ID NO: 19293 - protein, 1110 aa, Desulfovibrio desulfuricans G20; identical to SEQ ID NO: 13735

SEQ ID NO: 19294 - DNA, 1467 bp, Anabaena variabilis ATCC 29413; identical to SEQ ID NO: 13736
  CDS (1)..(1467)

SEQ ID NO: 19295 - protein, 488 aa, Anabaena variabilis ATCC 29413; identical to SEQ ID NO: 13737

SEQ ID NO: 19296 - DNA, 3366 bp, Ralstonia eutropha JMP134; identical to SEQ ID NO: 13738
  CDS (1)..(3366)

SEQ ID NO: 19297 - protein, 1121 aa, Ralstonia eutropha JMP134; identical to SEQ ID NO: 13739

SEQ ID NO: 19298 - DNA, 2586 bp, Rhodobacter sphaeroides 2.4.1; identical to SEQ ID NO: 13740
  CDS (1)..(2586)

SEQ ID NO: 19299 - protein, 861 aa, Rhodobacter sphaeroides 2.4.1; identical to SEQ ID NO: 13741

SEQ ID NO: 19300 - DNA, 3417 bp, Burkholderia cepacia R18194; identical to SEQ ID NO: 13742
  CDS (1)..(3417)

SEQ ID NO: 19301 - protein, 1138 aa, Burkholderia cepacia R18194; identical to SEQ ID NO: 13743

SEQ ID NO: 19302 - DNA, 1776 bp, Listeria monocytogenes str. 4b H7858; identical to SEQ ID NO: 13744
  CDS (1)..(1776): transl_table=11

SEQ ID NO: 19303 - protein, 591 aa, Listeria monocytogenes str. 4b H7858; identical to SEQ ID NO: 13745

SEQ ID NO: 19304 - DNA, 1533 bp, Listeria monocytogenes str. 1/2a F6854; identical to SEQ ID NO: 13746
  CDS (1)..(1533): transl_table=11

SEQ ID NO: 19305 - protein, 510 aa, Listeria monocytogenes str. 1/2a F6854; identical to SEQ ID NO: 13747

SEQ ID NO: 19306 - DNA, 1662 bp, Listeria monocytogenes str. 1/2a F6854; identical to SEQ ID NO: 13748
  CDS (1)..(1662): transl_table=11

SEQ ID NO: 19307 - protein, 553 aa, Listeria monocytogenes str. 1/2a F6854; identical to SEQ ID NO: 13749

SEQ ID NO: 19308 - DNA, 3342 bp, Pseudomonas fluorescens PfO-1; identical to SEQ ID NO: 13750
  CDS (1)..(3342)

SEQ ID NO: 19309 - protein, 1113 aa, Pseudomonas fluorescens PfO-1; identical to SEQ ID NO: 13751

SEQ ID NO: 19310 - DNA, 1629 bp, Rhodospirillum rubrum; identical to SEQ ID NO: 13752
  CDS (1)..(1629)

SEQ ID NO: 19311 - protein, 542 aa, Rhodospirillum rubrum; identical to SEQ ID NO: 13753

SEQ ID NO: 19312 - DNA, 3303 bp, Rhodospirillum rubrum; identical to SEQ ID NO: 13754
  CDS (1)..(3303)

SEQ ID NO: 19313 - protein, 1100 aa, Rhodospirillum rubrum; identical to SEQ ID NO: 13755

SEQ ID NO: 19314 - DNA, 3465 bp, Burkholderia fungorum LB400; identical to SEQ ID NO: 13756
  CDS (1)..(3465)

SEQ ID NO: 19315 - protein, 1154 aa, Burkholderia fungorum LB400; identical to SEQ ID NO: 13757

SEQ ID NO: 19316 - DNA, 1821 bp, Thermobifida fusca; identical to SEQ ID NO: 13758
  CDS (1)..(1821)

SEQ ID NO: 19317 - protein, 606 aa, Thermobifida fusca; identical to SEQ ID NO: 13759

SEQ ID NO: 19318 - DNA, 1563 bp, Microbulbifer degradans 2-40; identical to SEQ ID NO: 13760
  CDS (1)..(1563)

SEQ ID NO: 19319 - protein, 520 aa, Microbulbifer degradans 2-40; identical to SEQ ID NO: 13761

SEQ ID NO: 19320 - DNA, 1671 bp, Oenococcus oeni PSU-1; identical to SEQ ID NO: 13762
  CDS (1)..(1671)

SEQ ID NO: 19321 - protein, 556 aa, Oenococcus oeni PSU-1; identical to SEQ ID NO: 13763

SEQ ID NO: 19322 - DNA, 1482 bp, Trichodesmium erythraeum IMS101; identical to SEQ ID NO: 13764
  CDS (1)..(1482)

SEQ ID NO: 19323 - protein, 493 aa, Trichodesmium erythraeum IMS101; identical to SEQ ID NO: 13765

SEQ ID NO: 19324 - DNA, 3288 bp, Thiobacillus denitrificans ATCC 25259; identical to SEQ ID NO: 13766
  CDS (1)..(3288)

SEQ ID NO: 19325 - protein, 1095 aa, Thiobacillus denitrificans ATCC 25259; identical to SEQ ID NO: 13767

SEQ ID NO: 19326 - DNA, 1815 bp, Chloroflexus aurantiacus; identical to SEQ ID NO: 13768
  CDS (1)..(1815)

SEQ ID NO: 19327 - protein, 604 aa, Chloroflexus aurantiacus; identical to SEQ ID NO: 13769

SEQ ID NO: 19328 - DNA, 4140 bp, Chloroflexus aurantiacus; identical to SEQ ID NO: 13770
  CDS (1)..(4140)

SEQ ID NO: 19329 - protein, 1379 aa, Chloroflexus aurantiacus; identical to SEQ ID NO: 13771

SEQ ID NO: 19330 - DNA, 3363 bp, Chloroflexus aurantiacus; identical to SEQ ID NO: 13772
  CDS (1)..(3363)

SEQ ID NO: 19331 - protein, 1120 aa, Chloroflexus aurantiacus; identical to SEQ ID NO: 13773

SEQ ID NO: 19332 - DNA, 1803 bp, Lactococcus lactis subsp. cremoris SK11; identical to SEQ ID NO: 13774
  CDS (1)..(1803)

SEQ ID NO: 19333 - protein, 600 aa, Lactococcus lactis subsp. cremoris SK11; identical to SEQ ID NO: 13775

SEQ ID NO: 19334 - DNA, 1755 bp, Lactococcus lactis subsp. cremoris SK11; identical to SEQ ID NO: 13776
  CDS (1)..(1755)

SEQ ID NO: 19335 - protein, 584 aa, Lactococcus lactis subsp. cremoris SK11; identical to SEQ ID NO: 13777

SEQ ID NO: 19336 - DNA, 1695 bp, Lactobacillus casei ATCC 334; identical to SEQ ID NO: 13778
  CDS (1)..(1695)

SEQ ID NO: 19337 - protein, 564 aa, Lactobacillus casei ATCC 334; identical to SEQ ID NO: 13779

SEQ ID NO: 19338 - DNA, 1779 bp, Lactobacillus casei ATCC 334; identical to SEQ ID NO: 13780
  CDS (1)..(1779)

SEQ ID NO: 19339 - protein, 592 aa, Lactobacillus casei ATCC 334; identical to SEQ ID NO: 13781

SEQ ID NO: 19340 - DNA, 1668 bp, Lactobacillus casei ATCC 334; identical to SEQ ID NO: 13782
  CDS (1)..(1668)

SEQ ID NO: 19341 - protein, 555 aa, Lactobacillus casei ATCC 334; identical to SEQ ID NO: 13783

SEQ ID NO: 19342 - DNA, 570 bp, Lactobacillus delbrueckii subsp. bulgaricus ATCC BAA-365; identical to SEQ ID NO: 13784
  CDS (1)..(570)

SEQ ID NO: 19343 - protein, 189 aa, Lactobacillus delbrueckii subsp. bulgaricus ATCC BAA-365; identical to SEQ ID NO: 13785

SEQ ID NO: 19344 - DNA, 1827 bp, Deinococcus geothermalis DSM 11300; identical to SEQ ID NO: 13786
  CDS (1)..(1827): transl_table=11

SEQ ID NO: 19345 - protein, 608 aa, Deinococcus geothermalis DSM 11300; identical to SEQ ID NO: 13787

SEQ ID NO: 19346 - DNA, 1491 bp, Deinococcus geothermalis DSM 11300; identical to SEQ ID NO: 13788
  CDS (1)..(1491): transl_table=11

SEQ ID NO: 19347 - protein, 496 aa, Deinococcus geothermalis DSM 11300; identical to SEQ ID NO: 13789

SEQ ID NO: 19348 - DNA, 2097 bp, Deinococcus geothermalis DSM 11300; identical to SEQ ID NO: 13790
  CDS (1)..(2097): transl_table=11

SEQ ID NO: 19349 - protein, 698 aa, Deinococcus geothermalis DSM 11300; identical to SEQ ID NO: 13791

SEQ ID NO: 19350 - DNA, 1662 bp, Anaeromyxobacter dehalogenans 2CP-C; identical to SEQ ID NO: 13792
  CDS (1)..(1662): transl_table=11

SEQ ID NO: 19351 - protein, 553 aa, Anaeromyxobacter dehalogenans 2CP-C; identical to SEQ ID NO: 13793

SEQ ID NO: 19352 - DNA, 1638 bp, Anaeromyxobacter dehalogenans 2CP-C; identical to SEQ ID NO: 13794
  CDS (1)..(1638): transl_table=11

SEQ ID NO: 19353 - protein, 545 aa, Anaeromyxobacter dehalogenans 2CP-C; identical to SEQ ID NO: 13795

SEQ ID NO: 19354 - DNA, 1602 bp, Anaeromyxobacter dehalogenans 2CP-C; identical to SEQ ID NO: 13796
  CDS (1)..(1602): transl_table=11

SEQ ID NO: 19355 - protein, 533 aa, Anaeromyxobacter dehalogenans 2CP-C; identical to SEQ ID NO: 13797

SEQ ID NO: 19356 - DNA, 1188 bp, Streptococcus pneumoniae TIGR4; identical to SEQ ID NO: 13798
  CDS (1)..(1188)

SEQ ID NO: 19357 - protein, 395 aa, Streptococcus pneumoniae TIGR4; identical to SEQ ID NO: 13799

SEQ ID NO: 19358 - DNA, 1407 bp, Arthrobacter sp. FB24; identical to SEQ ID NO: 13800
  CDS (1)..(1407): transl_table=11

SEQ ID NO: 19359 - protein, 468 aa, Arthrobacter sp. FB24; identical to SEQ ID NO: 13801

SEQ ID NO: 19360 - DNA, 1968 bp, Arthrobacter sp. FB24; identical to SEQ ID NO: 13802
  CDS (1)..(1968): transl_table=11

SEQ ID NO: 19361 - protein, 655 aa, Arthrobacter sp. FB24; identical to SEQ ID NO: 13803

SEQ ID NO: 19362 - DNA, 1797 bp, Arthrobacter sp. FB24; identical to SEQ ID NO: 13804
  CDS (1)..(1797): transl_table=11

SEQ ID NO: 19363 - protein, 598 aa, Arthrobacter sp. FB24; identical to SEQ ID NO: 13805

SEQ ID NO: 19364 - DNA, 3327 bp, Azotobacter vinelandii AvOP; identical to SEQ ID NO: 13806
  CDS (1)..(3327): transl_table=11

SEQ ID NO: 19365 - protein, 1108 aa, Azotobacter vinelandii AvOP; identical to SEQ ID NO: 13807

SEQ ID NO: 19366 - DNA, 3414 bp, Burkholderia vietnamiensis G4; identical to SEQ ID NO: 13808
  CDS (1)..(3414): transl_table=11

SEQ ID NO: 19367 - protein, 1137 aa, Burkholderia vietnamiensis G4; identical to SEQ ID NO: 13809

SEQ ID NO: 19368 - DNA, 3414 bp, Burkholderia cenocepacia HI2424; identical to SEQ ID NO: 13810
  CDS (1)..(3414): transl_table=11

SEQ ID NO: 19369 - protein, 1137 aa, Burkholderia cenocepacia HI2424; identical to SEQ ID NO: 13811

SEQ ID NO: 19370 - DNA, 1614 bp, Chromohalobacter salexigens DSM 3043; identical to SEQ ID NO: 13812
  CDS (1)..(1614): transl_table=11

SEQ ID NO: 19371 - protein, 537 aa, Chromohalobacter salexigens DSM 3043; identical to SEQ ID NO: 13813

SEQ ID NO: 19372 - DNA, 3396 bp, Burkholderia pseudomallei S13; identical to SEQ ID NO: 13814
  CDS (1)..(3396)

SEQ ID NO: 19373 - protein, 1131 aa, Burkholderia pseudomallei S13; identical to SEQ ID NO: 13815

SEQ ID NO: 19374 - DNA, 1728 bp, Clostridium thermocellum ATCC 27405; identical to SEQ ID NO: 13816
  CDS (1)..(1728): transl_table=11

SEQ ID NO: 19375 - protein, 575 aa, Clostridium thermocellum ATCC 27405; identical to SEQ ID NO: 13817

SEQ ID NO: 19376 - DNA, 1461 bp, Crocosphaera watsonii WH 8501; identical to SEQ ID NO: 13818
  CDS (1)..(1461): transl_table=11

SEQ ID NO: 19377 - protein, 486 aa, Crocosphaera watsonii WH 8501; identical to SEQ ID NO: 13819

SEQ ID NO: 19378 - DNA, 3318 bp, Chlorobium phaeobacteroides BS1; identical to SEQ ID NO: 13820
  CDS (1)..(3318): transl_table=11

SEQ ID NO: 19379 - protein, 1105 aa, Chlorobium phaeobacteroides BS1; identical to SEQ ID NO: 13821

SEQ ID NO: 19380 - DNA, 3339 bp, Geobacter metallireducens GS-15; identical to SEQ ID NO: 13822
  CDS (1)..(3339): transl_table=11

SEQ ID NO: 19381 - protein, 1112 aa, Geobacter metallireducens GS-15; identical to SEQ ID NO: 13823

SEQ ID NO: 19382 - DNA, 1785 bp, Exiguobacterium sp. 255-15; identical to SEQ ID NO: 13824
  CDS (1)..(1785): transl_table=11

SEQ ID NO: 19383 - protein, 594 aa, Exiguobacterium sp. 255-15; identical to SEQ ID NO: 13825

SEQ ID NO: 19384 - DNA, 1674 bp, Exiguobacterium sp. 255-15; identical to SEQ ID NO: 13826
  CDS (1)..(1674): transl_table=11

SEQ ID NO: 19385 - protein, 557 aa, Exiguobacterium sp. 255-15; identical to SEQ ID NO: 13827

SEQ ID NO: 19386 - DNA, 1611 bp, Exiguobacterium sp. 255-15; identical to SEQ ID NO: 13828
  CDS (1)..(1611): transl_table=11

SEQ ID NO: 19387 - protein, 536 aa, Exiguobacterium sp. 255-15; identical to SEQ ID NO: 13829

SEQ ID NO: 19388 - DNA, 1788 bp, Exiguobacterium sp. 255-15; identical to SEQ ID NO: 13830
  CDS (1)..(1788): transl_table=11

SEQ ID NO: 19389 - protein, 595 aa, Exiguobacterium sp. 255-15; identical to SEQ ID NO: 13831

SEQ ID NO: 19390 - DNA, 1803 bp, Frankia sp. CcI3; identical to SEQ ID NO: 13832
  CDS (1)..(1803): transl_table=11

SEQ ID NO: 19391 - protein, 600 aa, Frankia sp. CcI3; identical to SEQ ID NO: 13833

SEQ ID NO: 19392 - DNA, 3582 bp, Desulfitobacterium hafniense DCB-2; identical to SEQ ID NO: 13834
  CDS (1)..(3582): transl_table=11

SEQ ID NO: 19393 - protein, 1193 aa, Desulfitobacterium hafniense DCB-2; identical to SEQ ID NO: 13835

SEQ ID NO: 19394 - DNA, 1719 bp, Frankia sp. EAN1pec; identical to SEQ ID NO: 13836
  CDS (1)..(1719): transl_table=11

SEQ ID NO: 19395 - protein, 572 aa, Frankia sp. EAN1pec; identical to SEQ ID NO: 13837

SEQ ID NO: 19396 - DNA, 1761 bp, Moorella thermoacetica ATCC 39073; identical to SEQ ID NO: 13838
  CDS (1)..(1761): transl_table=11

SEQ ID NO: 19397 - protein, 586 aa, Moorella thermoacetica ATCC 39073; identical to SEQ ID NO: 13839

SEQ ID NO: 19398 - DNA, 1623 bp, Shewanella baltica OS155; identical to SEQ ID NO: 13840
  CDS (1)..(1623): transl_table=11

SEQ ID NO: 19399 - protein, 540 aa, Shewanella baltica OS155; identical to SEQ ID NO: 13841

SEQ ID NO: 19400 - DNA, 1635 bp, Shewanella amazonensis SB2B; identical to SEQ ID NO: 13842
  CDS (1)..(1635): transl_table=11

SEQ ID NO: 19401 - protein, 544 aa, Shewanella amazonensis SB2B; identical to SEQ ID NO: 13843

SEQ ID NO: 19402 - DNA, 3297 bp, Pelodictyon phaeoclathratiforme BU-1; identical to SEQ ID NO: 13844
  CDS (1)..(3297): transl_table=11

SEQ ID NO: 19403 - protein, 1098 aa, Pelodictyon phaeoclathratiforme BU-1; identical to SEQ ID NO: 13845

SEQ ID NO: 19404 - DNA, 3414 bp, Prosthecochloris aestuarii DSM 271; identical to SEQ ID NO: 13846
  CDS (1)..(3414): transl_table=11

SEQ ID NO: 19405 - protein, 1137 aa, Prosthecochloris aestuarii DSM 271; identical to SEQ ID NO: 13847

SEQ ID NO: 19406 - DNA, 1593 bp, Rubrobacter xylanophilus DSM 9941; identical to SEQ ID NO: 13848
  CDS (1)..(1593): transl_table=11

SEQ ID NO: 19407 - protein, 530 aa, Rubrobacter xylanophilus DSM 9941; identical to SEQ ID NO: 13849

SEQ ID NO: 19408 - DNA, 5328 bp, Rubrobacter xylanophilus DSM 9941; identical to SEQ ID NO: 13850
  CDS (1)..(5328): transl_table=11

SEQ ID NO: 19409 - protein, 1775 aa, Rubrobacter xylanophilus DSM 9941; identical to SEQ ID NO: 13851

SEQ ID NO: 19410 - DNA, 1755 bp, Mesorhizobium sp. BNC1; identical to SEQ ID NO: 13852
  CDS (1)..(1755): transl_table=11

SEQ ID NO: 19411 - protein, 584 aa, Mesorhizobium sp. BNC1; identical to SEQ ID NO: 13853

SEQ ID NO: 19412 - DNA, 3348 bp, Mesorhizobium sp. BNC1; identical to SEQ ID NO: 13854
  CDS (1)..(3348): transl_table=11

SEQ ID NO: 19413 - protein, 1115 aa, Mesorhizobium sp. BNC1; identical to SEQ ID NO: 13855

SEQ ID NO: 19414 - DNA, 1653 bp, Silicibacter sp. TM1040; identical to SEQ ID NO: 13856
  CDS (1)..(1653): transl_table=11

SEQ ID NO: 19415 - protein, 550 aa, Silicibacter sp. TM1040; identical to SEQ ID NO: 13857

SEQ ID NO: 19416 - DNA, 3267 bp, Nitrobacter hamburgensis X14; identical to SEQ ID NO: 13858
  CDS (1)..(3267): transl_table=11

SEQ ID NO: 19417 - protein, 1088 aa, Nitrobacter hamburgensis X14; identical to SEQ ID NO: 13859

SEQ ID NO: 19418 - DNA, 1926 bp, Shewanella denitrificans OS-217; identical to SEQ ID NO: 13860
  CDS (1)..(1926): transl_table=11

SEQ ID NO: 19419 - protein, 641 aa, Shewanella denitrificans OS-217; identical to SEQ ID NO: 13861

SEQ ID NO: 19420 - DNA, 1419 bp, Thermotoga neapolitana; identical to SEQ ID NO: 13862
  CDS (1)..(1419): transl_table=11

SEQ ID NO: 19421 - protein, 472 aa, Thermotoga neapolitana; identical to SEQ ID NO: 13863

SEQ ID NO: 19422 - DNA, 1701 bp, Bacteroides thetaiotaomicron; identical to SEQ ID NO: 13864
  CDS (1)..(1701): transl_table=11

SEQ ID NO: 19423 - protein, 566 aa, Bacteroides thetaiotaomicron; identical to SEQ ID NO: 13865

SEQ ID NO: 19424 - DNA, 3906 bp, Alicyclobacillus acidocaldarius; identical to SEQ ID NO: 13866
  CDS (1)..(3906): transl_table=11

SEQ ID NO: 19425 - protein, 1301 aa, Alicyclobacillus acidocaldarius; identical to SEQ ID NO: 13867

SEQ ID NO: 19426 - DNA, 1797 bp, Klebsiella oxytoca; identical to SEQ ID NO: 13868
  CDS (1)..(1797): transl_table=11

SEQ ID NO: 19427 - protein, 598 aa, Klebsiella oxytoca; identical to SEQ ID NO: 13869

SEQ ID NO: 19428 - DNA, 1581 bp, Bacillus sp; identical to SEQ ID NO: 13870
  CDS (1)..(1581): transl_table=11

SEQ ID NO: 19429 - protein, 526 aa, Bacillus sp; identical to SEQ ID NO: 13871

SEQ ID NO: 19430 - DNA, 1761 bp, Anoxybacillus flavithermus; identical to SEQ ID NO: 13872
  CDS (1)..(1761): transl_table=11

SEQ ID NO: 19431 - protein, 586 aa, Anoxybacillus flavithermus; identical to SEQ ID NO: 13873

SEQ ID NO: 19432 - DNA, 1749 bp, Thermoactinomyces thalpophilus; identical to SEQ ID NO: 13874
  CDS (1)..(1749): transl_table=11

SEQ ID NO: 19433 - protein, 582 aa, Thermoactinomyces thalpophilus; identical to SEQ ID NO: 13875

SEQ ID NO: 19434 - DNA, 1332 bp, Anaerobranca gottschalkii; identical to SEQ ID NO: 13876
  CDS (1)..(1332): transl_table=11

SEQ ID NO: 19435 - protein, 443 aa, Anaerobranca gottschalkii; identical to SEQ ID NO: 13877

SEQ ID NO: 19436 - DNA, 1740 bp, Aedes albopictus; identical to SEQ ID NO: 13878
  CDS (1)..(1740)

SEQ ID NO: 19437 - protein, 579 aa, Aedes albopictus; identical to SEQ ID NO: 13879

SEQ ID NO: 19438 - DNA, 1170 bp, Aeromonas hydrophila; identical to SEQ ID NO: 13880
  CDS (1)..(1170): n means a or g or c or t/u, s means g or c

SEQ ID NO: 19439 - protein, 389 aa, Aeromonas hydrophila; identical to SEQ ID NO: 13881
  Xaa in position 289 is unknown

SEQ ID NO: 19440 - DNA, 1449 bp, Thermoactinomyces vulgaris; identical to SEQ ID NO: 13882
  CDS (1)..(1449): transl_table=11

SEQ ID NO: 19441 - protein, 482 aa, Thermoactinomyces vulgaris; identical to SEQ ID NO: 13883

SEQ ID NO: 19442 - DNA, 1581 bp, Xanthomonas campestris; identical to SEQ ID NO: 13884
  CDS (1)..(1581): transl_table=11

SEQ ID NO: 19443 - protein, 526 aa, Xanthomonas campestris; identical to SEQ ID NO: 13885

SEQ ID NO: 19444 - DNA, 3309 bp, Rhodobacter sphaeroides f; identical to SEQ ID NO: 13886
  CDS (1)..(3309): transl_table=11

SEQ ID NO: 19445 - protein, 1102 aa, Rhodobacter sphaeroides f; identical to SEQ ID NO: 13887

SEQ ID NO: 19446 - DNA, 1548 bp, Ostreococcus tauri; identical to SEQ ID NO: 13888
  CDS (1)..(1548)

SEQ ID NO: 19447 - protein, 515 aa, Ostreococcus tauri; identical to SEQ ID NO: 13889

SEQ ID NO: 19448 - DNA, 1554 bp, uncultured bacterium; identical to SEQ ID NO: 13890
  CDS (1)..(1554)

SEQ ID NO: 19449 - protein, 517 aa, uncultured bacterium; identical to SEQ ID NO: 13891

SEQ ID NO: 19450 - DNA, 2628 bp, Chlamydomonas reinhardtii; identical to SEQ ID NO: 13892
  CDS (1)..(2628)

SEQ ID NO: 19451 - protein, 875 aa, Chlamydomonas reinhardtii; identical to SEQ ID NO: 13893

SEQ ID NO: 19452 - DNA, 1962 bp, Paenibacillus sp; identical to SEQ ID NO: 13894
  CDS (1)..(1962): transl_table=11

SEQ ID NO: 19453 - protein, 653 aa, Paenibacillus sp; identical to SEQ ID NO: 13895

SEQ ID NO: 19454 - DNA, 1548 bp, Halothermothrix orenii; identical to SEQ ID NO: 13896
  CDS (1)..(1548): transl_table=11

SEQ ID NO: 19455 - protein, 515 aa, Halothermothrix orenii; identical to SEQ ID NO: 13897

SEQ ID NO: 19456 - DNA, 1533 bp, Paenibacillus sp; identical to SEQ ID NO: 13898
  CDS (1)..(1533): transl_table=11

SEQ ID NO: 19457 - protein, 510 aa, Paenibacillus sp; identical to SEQ ID NO: 13899

SEQ ID NO: 19458 - DNA, 1767 bp, Bacillus stearothermophilus; identical to SEQ ID NO: 13900
  CDS (1)..(1767): transl_table=11

SEQ ID NO: 19459 - protein, 588 aa, Bacillus stearothermophilus; identical to SEQ ID NO: 13901

SEQ ID NO: 19460 - DNA, 6057 bp, Bacillus stearothermophilus; identical to SEQ ID NO: 13902
  CDS (1)..(6057): transl_table=11

SEQ ID NO: 19461 - protein, 2018 aa, Bacillus stearothermophilus; identical to SEQ ID NO: 13903

SEQ ID NO: 19462 - DNA, 1983 bp, Thermococcus sp; identical to SEQ ID NO: 13904
  CDS (1)..(1983): transl_table=11

SEQ ID NO: 19463 - protein, 660 aa, Thermococcus sp; identical to SEQ ID NO: 13905

SEQ ID NO: 19464 - DNA, 2181 bp, Thermococcus sp; identical to SEQ ID NO: 13906
  CDS (1)..(2181)

SEQ ID NO: 19465 - protein, 726 aa, Thermococcus sp; identical to SEQ ID NO: 13907

SEQ ID NO: 19466 - DNA, 2220 bp, Thermococcus sp; identical to SEQ ID NO: 13908
  CDS (1)..(2220): transl_table=11

SEQ ID NO: 19467 - protein, 739 aa, Thermococcus sp; identical to SEQ ID NO: 13909

SEQ ID NO: 19468 - DNA, 1737 bp, Alicyclobacillus acidocaldarius; identical to SEQ ID NO: 13910
  CDS (1)..(1737): transl_table=11

SEQ ID NO: 19469 - protein, 578 aa, Alicyclobacillus acidocaldarius; identical to SEQ ID NO: 13911

SEQ ID NO: 19470 - DNA, 1548 bp, Paenibacillus polymyxa; identical to SEQ ID NO: 13912
  CDS (1)..(1548): transl_table=11

SEQ ID NO: 19471 - protein, 515 aa, Paenibacillus polymyxa; identical to SEQ ID NO: 13913

SEQ ID NO: 19472 - DNA, 1689 bp, Dictyoglomus thermophilum; identical to SEQ ID NO: 13914
  CDS (1)..(1689): transl_table=11

SEQ ID NO: 19473 - protein, 562 aa, Dictyoglomus thermophilum; identical to SEQ ID NO: 13915

SEQ ID NO: 19474 - DNA, 1497 bp, Dictyoglomus thermophilum; identical to SEQ ID NO: 13916
  CDS (1)..(1497): transl_table=11

SEQ ID NO: 19475 - protein, 498 aa, Dictyoglomus thermophilum; identical to SEQ ID NO: 13917

SEQ ID NO: 19476 - DNA, 1242 bp, Triticum aestivum; identical to SEQ ID NO: 13918
  CDS (1)..(1242)

SEQ ID NO: 19477 - protein, 413 aa, Triticum aestivum; identical to SEQ ID NO: 13919

SEQ ID NO: 19478 - DNA, 1761 bp, Bacillus acidopullulyticus; identical to SEQ ID NO: 13920
  CDS (1)..(1761): transl_table=11

SEQ ID NO: 19479 - protein, 586 aa, Bacillus acidopullulyticus; identical to SEQ ID NO: 13921

SEQ ID NO: 19480 - DNA, 1563 bp, Bacillus megaterium; identical to SEQ ID NO: 13922
  CDS (1)..(1563): transl_table=11

SEQ ID NO: 19481 - protein, 520 aa, Bacillus megaterium; identical to SEQ ID NO: 13923

SEQ ID NO: 19482 - DNA, 4428 bp, Thermoanaerobacter thermohydrosulfuricus; identical to SEQ ID NO: 13924
  CDS (1)..(4428): transl_table=11

SEQ ID NO: 19483 - protein, 1475 aa, Thermoanaerobacter thermohydrosulfuricus; identical to SEQ ID NO: 13925

SEQ ID NO: 19484 - DNA, 1776 bp, Bacillus sphaericus; identical to SEQ ID NO: 13926
  CDS (1)..(1776): transl_table=11

SEQ ID NO: 19485 - protein, 591 aa, Bacillus sphaericus; identical to SEQ ID NO: 13927

SEQ ID NO: 19486 - DNA, 1725 bp, Thermoanaerobacter ethanolicus; identical to SEQ ID NO: 13928
  CDS (1)..(1725): transl_table=11

SEQ ID NO: 19487 - protein, 574 aa, Thermoanaerobacter ethanolicus; identical to SEQ ID NO: 13929

SEQ ID NO: 19488 - DNA, 1761 bp, Drosophila virilis; identical to SEQ ID NO: 13930
  CDS (1)..(1761)

SEQ ID NO: 19489 - protein, 586 aa, Drosophila virilis; identical to SEQ ID NO: 13931

SEQ ID NO: 19490 - DNA, 1329 bp, Thermotoga neapolitana; identical to SEQ ID NO: 13932
  CDS (1)..(1329): transl_table=11

SEQ ID NO: 19491 - protein, 442 aa, Thermotoga neapolitana; identical to SEQ ID NO: 13933

SEQ ID NO: 19492 - DNA, 2001 bp, Thermoactinomyces vulgaris; identical to SEQ ID NO: 13934
  CDS (1)..(2001): transl_table=11

SEQ ID NO: 19493 - protein, 666 aa, Thermoactinomyces vulgaris; identical to SEQ ID NO: 13935

SEQ ID NO: 19494 - DNA, 1758 bp, Thermoactinomyces vulgaris; identical to SEQ ID NO: 13936
  CDS (1)..(1758): transl_table=11

SEQ ID NO: 19495 - protein, 585 aa, Thermoactinomyces vulgaris; identical to SEQ ID NO: 13937

SEQ ID NO: 19496 - DNA, 24 bp, Artificial sequence
  (1)..(24): primer
atgatgttaaatgcatggcacctg

SEQ ID NO: 19497 - DNA, 24 bp, Artificial sequence
  (1)..(24): primer
ttagttcatccataccgtagccga

SEQ ID NO: 19498 - protein, 917 aa, Artificial sequence; identical to SEQ ID NO: 13940
  Variant (2)..(2): xaa in position 2 is any amino acid
  Variant (6)..(6): xaa in position 6 is any amino acid
  Variant (15)..(16): xaa in position 15 to 16 is any amino acid
  Variant (18)..(18): xaa in position 18 is any amino acid
  Variant (22)..(22): xaa in position 22 is any amino acid
  Variant (25)..(25): xaa in position 25 is any amino acid
  Variant (26)..(85): xaa in position 26 to 85 is any or no amino acid
  Variant (89)..(89): xaa in position 89 is any amino acid
  Variant (93)..(93): xaa in position 93 is any amino acid
  Variant (99)..(99): xaa in position 99 is any amino acid
  Variant (101)..(108): xaa in position 101 to 108 is any or no amino acid
  Variant (112)..(112): xaa in position 112 is any amino acid
  Variant (117)..(117): xaa in position 117 is any amino acid
  Variant (121)..(121): xaa in position 121 is any amino acid
  Variant (124)..(125): xaa in position 124 to 125 is any amino acid
  Variant (126)..(152): xaa in position 126 to 152 is any or no amino acid
  Variant (158)..(158): xaa in position 158 is any amino acid
  Variant (161)..(162): xaa in position 161 to 162 is any amino acid
  Variant (166)..(166): xaa in position 166 is any amino acid
  Variant (171)..(171): xaa in position 171 is any amino acid
  Variant (174)..(175): xaa in position 174 to 175 is any amino acid
  Variant (178)..(179): xaa in position 178 to 179 is any amino acid
  Variant (182)..(182): xaa in position 182 is any amino acid
  Variant (186)..(189): xaa in position 186 to 189 is any or no amino acid
  Variant (195)..(195): xaa in position 195 is any amino acid
  Variant (197)..(197): xaa in position 197 is any amino acid
  Variant (203)..(203): xaa in position 203 is any amino acid
  Variant (205)..(205): xaa in position 205 is any amino acid
  Variant (208)..(208): xaa in position 208 is any amino acid
  Variant (211)..(214): xaa in position 211 to 214 is any amino acid
  Variant (215)..(256): xaa in position 215 to 256 is any or no amino acid
  Variant (258)..(258): xaa in position 258 is any or no amino acid
  Variant (266)..(266): xaa in position 266 is any or no amino acid
  Variant (268)..(269): xaa in position 268 to 269 is any amino acid
  Variant (270)..(394): xaa in position 270 to 394 is any or no amino acid
  Variant (397)..(399): xaa in position 397 to 399 is any or no amino acid
  Variant (401)..(402): xaa in position 401 to 402 is any amino acid
  Variant (403)..(404): xaa in position 403 to 404 is any or no amino acid
  Variant (413)..(413): xaa in position 413 is any amino acid
  Variant (415)..(417): xaa in position 415 to 417 is any amino acid
  Variant (420)..(420): xaa in position 420 is any amino acid
  Variant (421)..(426): xaa in position 421 to 426 is any or no amino acid
  Variant (433)..(433): xaa in position 433 is any amino acid
  Variant (434)..(434): xaa in position 434 is any or no amino acid
  Variant (436)..(441): xaa in position 436 to 441 is any or no amino acid
  Variant (449)..(449): xaa in position 449 is any amino acid
  Variant (451)..(452): xaa in position 451 to 452 is any amino acid
  Variant (454)..(458): xaa in position 454 to 458 is any amino acid
  Variant (459)..(487): xaa in position 459 to 487 is any or no amino acid
  Variant (489)..(490): xaa in position 489 to 490 is any amino acid
  Variant (492)..(495): xaa in position 492 to 495 is any amino acid
  Variant (498)..(498): xaa in position 498 is any amino acid
  Variant (504)..(509): xaa in position 504 to 509 is any amino acid
  Variant (510)..(529): xaa in position 510 to 529 is any or no amino acid
  Variant (532)..(534): xaa in position 532 to 534 is any amino acid
  Variant (535)..(538): xaa in position 535 to 538 is any or no amino acid
  Variant (540)..(544): xaa in position 540 to 544 is any amino acid
  Variant (547)..(554): xaa in position 547 to 554 is any amino acid
  Variant (555)..(592): xaa in position 555 to 592 is any or no amino acid
  Variant (594)..(607): xaa in position 594 to 607 is any amino acid
  Variant (608)..(611): xaa in position 608 to 611 is any or no amino acid
  Variant (613)..(613): xaa in position 613 is any amino acid
  Variant (617)..(618): xaa in position 617 to 618 is any amino acid
  Variant (620)..(620): xaa in position 620 is any amino acid
  Variant (623)..(623): xaa in position 623 is any amino acid
  Variant (625)..(627): xaa in position 625 to 627 is any amino acid
  Variant (628)..(667): xaa in position 628 to 667 is any or no amino acid
  Variant (672)..(674): xaa in position 672 to 674 is any amino acid
  Variant (684)..(684): xaa in position 684 is any amino acid
  Variant (694)..(697): xaa in position 694 to 697 is any amino acid
  Variant (698)..(737): xaa in position 698 to 737 is any or no amino acid
  Variant (739)..(739): xaa in position 739 is any amino acid
  Variant (740)..(740): xaa in position 740 is any or no amino acid
  Variant (742)..(742): xaa in position 742 is any or no amino acid
  Variant (745)..(745): xaa in position 745 is any or no amino acid
  Variant (747)..(750): xaa in position 747 to 750 is any amino acid
  Variant (752)..(797): xaa in position 752 to 797 is any or no amino acid
  Variant (801)..(801): xaa in position 801 is any amino acid
  Variant (803)..(803): xaa in position 803 is any amino acid
  Variant (805)..(805): xaa in position 805 is any amino acid
  Variant (808)..(808): xaa in position 808 is any amino acid
  Variant (812)..(814): xaa in position 812 to 814 is any amino acid
  Variant (817)..(817): xaa in position 817 is any amino acid
  Variant (818)..(818): xaa in position 818 is any or no amino acid
  Variant (820)..(827): xaa in position 820 to 827 is any amino acid
  Variant (828)..(840): xaa in position 828 to 840 is any or no amino acid
  Variant (845)..(845): xaa in position 845 is any amino acid
  Variant (847)..(850): xaa in position 847 to 850 is any amino acid
  Variant (852)..(852): xaa in position 852 is any amino acid
  Variant (857)..(857): xaa in position 857 is any amino acid
  Variant (859)..(864): xaa in position 859 to 864 is any amino acid
  Variant (865)..(886): xaa in position 865 to 886 is any or no amino acid
  Variant (888)..(898): xaa in position 888 to 898 is any amino acid
  Variant (899)..(909): xaa in position 899 to 909 is any or no amino acid
  Variant (911)..(915): xaa in position 911 to 915 is any amino acid
  Variant (916)..(916): xaa in position 916 is any or no amino acid

SEQ ID NO: 19499 - protein, 8 aa, Artificial sequence
  Variant (2)..(2): xaa in position 2 is Glu or Gln
  Variant (3)..(3): xaa in position 3 is Ile, Leu or Val
  Variant (4)..(7): xaa in position 4 to 7 is any amino acid
YXXXXXXF

SEQ ID NO: 19500 - protein, 72 aa, Artificial sequence; identical to SEQ ID NO: 13942
  Variant (2)..(12): xaa in position 2 to 12 is any amino acid
  Variant (14)..(16): xaa in position 14 to 16 is any amino acid
  Variant (17)..(17): xaa in position 17 is Phe, Ile, Leu, Met or Val
  Variant (18)..(18): xaa in position 18 is Trp or Tyr
  Variant (19)..(19): xaa in position 19 is Phe, Ile, Leu, Met or Val
  Variant (20)..(20): xaa in position 20 is any amino acid
  Variant (22)..(30): xaa in position 22 to 30 is any amino acid
  Variant (31)..(31): xaa in position 31 is any or no amino acid
  Variant (33)..(35): xaa in position 33 to 35 is any amino acid
  Variant (36)..(36): xaa in position 36 is Asp, Glu, Asn or Thr
  Variant (37)..(39): xaa in position 37 to 39 is any amino acid
  Variant (40)..(40): xaa in position 40 is Phe, Ile, Leu or Val
  Variant (41)..(44): xaa in position 41 to 44 is any amino acid
  Variant (46)..(52): xaa in position 46 to 52 is any amino acid
  Variant (53)..(53): xaa in position 53 is Phe, Leu, Met or Val
  Variant (54)..(61): xaa in position 54 to 61 is any amino acid
  Variant (62)..(62): xaa in position 62 is Phe, Ile, Leu, Met or Val
  Variant (63)..(63): xaa in position 63 is any amino acid
  Variant (64)..(64): xaa in position 64 is Ile, Leu or Val
  Variant (65)..(66): xaa in position 65 to 66 is any amino acid
  Variant (67)..(67): xaa in position 67 is Asp or Glu
  Variant (68)..(71): xaa in position 68 to 71 is any amino acid

SEQ ID NO: 19501 - protein, 14 aa, Artificial sequence
  Variant (2)..(6): xaa in position 2 to 6 is any amino acid
  Variant (7)..(8): xaa in position 7 to 8 is any or no amino acid
  Variant (10)..(10): xaa in position 10 is Ala or Gly
  Variant (11)..(11): xaa in position 11 is any amino acid
  Variant (13)..(13): xaa in position 13 is Phe, Ile, Leu, Met or Val
WXXXXXXXDXXRXD

SEQ ID NO: 19502 - protein, 12 aa, Artificial sequence
  Variant (2)..(2): xaa in position 2 is any amino acid
  Variant (3)..(3): xaa in position 3 is Ala, Ile, Pro or Val
  Variant (4)..(5): xaa in position 4 to 5 is any amino acid
  Variant (7)..(7): xaa in position 7 is any amino acid
  Variant (9)..(9): xaa in position 9 is Asp, Glu, Gly, Asn, Gln, Ser or Thr
  Variant (11)..(11): xaa in position 11 is any amino acid
GXXXXYXGXEXG

SEQ ID NO: 19503 - DNA, 456 bp, Escherichia coli K12
  CDS (1)..(456): transl_table=11
atggagttaatggtcgttcatccacatattttctggctcagtctcggcggtttgctgctggcagccgagatgctgggcggaaatggttatttgttgtggagcggcgtggcagcggtgattaccggcctggtggtctggctggtgccgctgggttgggagtggcaaggggtaatgtttgccatcctgacgctgctcgccgcctggctgtggtggaaatggttgtcgcggcgggtgcgcgaacaaaagcacagcgatagtcatttaaaccagcgcgggcagcagctgattggccgacgttttgtgctggaatctccgctggtcaacgggcgcggtcatatgcgcgtcggtgacagttcatggcctgtcagcgccagcgaggatctcggtgcaggtacgcatgttgaagtcattgcgatagaagggataaccctacatatccgagccgtctcgtcttaa

SEQ ID NO: 19504 - protein, 151 aa, Escherichia coli K12
MELMVVHPHIFWLSLGGLLLAAEMLGGNGYLLWSGVAAVITGLVVWLVPLGWEWQGVMFAILTLLAAWLWWKWLSRRVREQKHSDSHLNQRGQQLIGRRFVLESPLVNGRGHMRVGDSSWPVSASEDLGAGTHVEVIAIEGITLHIRAVSS

SEQ ID NO: 19505 - DNA, 444 bp, Escherichia coli
  CDS (1)..(444): transl_table=11
atgttctggtttacgctgtttcttctttgtattgcccttgaaattataaccggaacgggatggttactcgtaatcagtcttggtgcattatcaagtgccattgttgactttttccttcctatatcacaagaagcaaatatatgcttctttgcgtcaataagcatactgacgtcgataattaagttcgtctatgacaaaaaacataagaaattagatacacccctggtgaacacaggacatacacgttttaaaggaaaagaatttactctcagtgacgatattgtgaacggcaaggggcaattacttattggtgatacattctggcctgttgagacgttacacgatgaaaactaccctgcgggaacaagagttattgttacagacatgcaaggaataactcttaaagtaatgaccatcgaagacaagagtgaaaacaaggaataa

SEQ ID NO: 19506 - protein, 147 aa, Escherichia coli
MFWFTLFLLCIALEIITGTGWLLVISLGALSSAIVDFFLPISQEANICFFASISILTSIIKFVYDKKHKKLDTPLVNTGHTRFKGKEFTLSDDIVNGKGQLLIGDTFWPVETLHDENYPAGTRVIVTDMQGITLKVMTIEDKSENKE

SEQ ID NO: 19507 - DNA, 465 bp, Mesorhizobium loti MAFF303099
  CDS (1)..(465): transl_table=11
atgttcgatcgcatcatttccgaactcggaccctggaactggatggttctgggcttcgtgctgctggtcatggaaatcatcgcgcctggcatcttcatgctgtggatcggcatcgccgcgctcatcatcggcgcggtgtcgctgctgatctgggatgcggcgatctggacctggcaggtccaggtccttgccttcctggcgctgtcgctggtttcagcctacgtcggcaagaaactcatgggcggacgcgaccagccgaccgaccagccgctgctcaaccggcgcggcgcccagatggtcggccgcatggcgacgcttgccgagccgatcaaggacggccgcggccgcatcaagctcggcgacacgctgtggcgcgtctccggccccgacctgcccgccggcacgcaggtgcgtgtgacaagtgccgcggatacggacctggaactgacggtggagcgcgtctga

SEQ ID NO: 19508 - protein, 154 aa, Mesorhizobium loti MAFF303099
MFDRIISELGPWNWMVLGFVLLVMEIIAPGIFMLWIGIAALIIGAVSLLIWDAAIWTWQVQVLAFLALSLVSAYVGKKLMGGRDQPTDQPLLNRRGAQMVGRMATLAEPIKDGRGRIKLGDTLWRVSGPDLPAGTQVRVTSAADTDLELTVERV

SEQ ID NO: 19509 - DNA, 423 bp, Thermotoga maritima MSB8
  CDS (1)..(423): transl_table=11
atggaagcctgggtgttctggcttgttctcggtgtgatccttatggttgcagaaattctcacacccacattcttcatattctggtttggagtgggtgcccttgccgcttctctggtgtcactctatcttggggtgtacgttcaaatcatagtctttgcagctgtatctatagtactcgtcttcctcacgagaaggttggttcagaactgggaatctccgagaaagatccatgttgaagagatcgctggaaaggtagctctcgttattgagacaatagataacagaaagggaactggccttgtgaagatcgatggagatgtgtggagagcgtacgcagaagacgacgatgaggtcatagagaaaggagaacacgtgaagataatgaaggtagaaggtgctcatgtggttgtaaaaagagtatga

SEQ ID NO: 19510 - protein, 140 aa, Thermotoga maritima MSB8
MEAWVFWLVLGVILMVAEILTPTFFIFWFGVGALAASLVSLYLGVYVQIIVFAAVSIVLVFLTRRLVQNWESPRKIHVEEIAGKVALVIETIDNRKGTGLVKIDGDVWRAYAEDDDEVIEKGEHVKIMKVEGAHVVVKRV

SEQ ID NO: 19511 - DNA, 570 bp, Vibrio cholerae O1 biovar eltor str. N16961
  CDS (1)..(570): transl_table=11
ttggtcaagcagagaatggtaagatcatcatgctgccacttgaagcaacaggcctcatgggttctgtcgctggaattgcagaaatgtttaaatcatcacaaaccactaagtaggtgccccgtggtagagctactctcacaattgaatttctggcattggttggccttgggcctacttctattagccgctgagctactcggcactgcaggttattttttgtggcttggcctatcagcactattagttggggtattgctggccgtaatgcctcttggttggcaactgcagtggctggcttttgcgagtttttctctggtcacgacttggctttggtggcgacgtcaatttagccgagataaaaagcaagatacagaacgcgaccttaaccagaaagaaaaacagttactcggacgtattattccgataactcaagataccccagcaggagagtttcaagtaacactgggtgatacggcttggacagcgcgctgcgatcagcagcttgcggctgggagccgtgtttctgtcgttgctgtggatgggattatcttagtcgtccaacctatctaa

SEQ ID NO: 19512 - protein, 189 aa, Vibrio cholerae O1 biovar eltor str. N16961
MVKQRMVRSSCCHLKQQASWVLSLELQKCLNHHKPLSRCPVVELLSQLNFWHWLALGLLLLAAELLGTAGYFLWLGLSALLVGVLLAVMPLGWQLQWLAFASFSLVTTWLWWRRQFSRDKKQDTERDLNQKEKQLLGRIIPITQDTPAGEFQVTLGDTAWTARCDQQLAAGSRVSVVAVDGIILVVQPI

SEQ ID NO: 19513 - DNA, 450 bp, Pasteurella multocida subsp. multocida str. Pm70
  CDS (1)..(450): transl_table=11
atggaatggttttccacttggagcctttggcattggcttattttaggttttgttttattaattgctgaattagtgatcccaggggtgtttttactttggtggggattagccgccattgtgattgctggtgtgatggcactgataccaagcttatcgttaaccgttttagctattagctatgcgattttagcgattattttgagtgtgtcatggtggaaatatcagcatggtcaagacaaaagtgatcagttacattcgtcattaaatcaacgtgatcacgcgatgctaggcacaagaggtactgtgcaagaaatcgcggctaatggcattggacgtgggcattttggcgatacgacgtggcgcattcaaggcacggatttacaggtcggtgatttagttgaagtgcaccaagtggatggtattacgttaaaagtgaaaaaagtgaattaa

SEQ ID NO: 19514 - protein, 149 aa, Pasteurella multocida subsp. multocida str. Pm70
MEWFSTWSLWHWLILGFVLLIAELVIPGVFLLWWGLAAIVIAGVMALIPSLSLTVLAISYAILAIILSVSWWKYQHGQDKSDQLHSSLNQRDHAMLGTRGTVQEIAANGIGRGHFGDTTWRIQGTDLQVGDLVEVHQVDGITLKVKKVN

SEQ ID NO: 19515 - DNA, 453 bp, Pseudomonas aeruginosa PAO1
  CDS (1)..(453): transl_table=11
atggaaatcctgctgctacgcctggacttctgggactggctggccttcggtaccgtcctcctgctcctggaaatcttcggtgccggcggctatctgctgcgggtcggcctcaccgccgcttgtgtcggtgcgctcggcgcgctcctgccgggactggcctggccttggcaggtagggctgttcgtcctgctctccgggctggtcgccgccttgcatcgacgccgtcgccgcaaggccggtagcgtcgaggaaacgccagggttgcagcgacgcggcgacgacctgttcggccgcacctttcccttgcaccgggcgatcgtcggcgggctcggcgagctgcgcgtcgaggacgcgtcgtggctggtcagcggtcccgacctgccgcgcggcgccctggtccgggtcaccggccaggacggcgccctgctgcacgtcgagcctgccgcgccctga

SEQ ID NO: 19516 - protein, 150 aa, Pseudomonas aeruginosa PAO1
MEILLLRLDFWDWLAFGTVLLLLEIFGAGGYLLRVGLTAACVGALGALLPGLAWPWQVGLFVLLSGLVAALHRRRRRKAGSVEETPGLQRRGDDLFGRTFPLHRAIVGGLGELRVEDASWLVSGPDLPRGALVRVTGQDGALLHVEPAAP

SEQ ID NO: 19517 - DNA, 480 bp, Deinococcus radiodurans R1
  CDS (1)..(480): transl_table=11
gtgcctgactggctccccacctggcaagcggtccacccctggcactggtgggtgttcggggcgctgctgctgattctggaaattctggcccccggcgtgtttttcgtgtggctcgcgctctcggctttcggcgtgggcctcctgaccttcgtgttgccctttctggacgtgccggggcagttgctgctctttgcgggcctgagcgtggccgccgtgtggctgggccgccgctacgtgtcgcgcctcgtcctcggcggcagtgagggcgagcagctcaacaccggcgctcagcgcctcatcgggcgcaccgtcaccgtcgtgacccccatcgaacacggtgtgggccgcgtccgggtgggcgacagcgactggcgggcgcgggggccggagctgcccgccggcaccccggtgcgaattgtcggcgtggaaggcgccactctggtcgtgcaggaagaaaagcggctggtggaggcgggttaa

SEQ ID NO: 19518 - protein, 159 aa, Deinococcus radiodurans R1
MPDWLPTWQAVHPWHWWVFGALLLILEILAPGVFFVWLALSAFGVGLLTFVLPFLDVPGQLLLFAGLSVAAVWLGRRYVSRLVLGGSEGEQLNTGAQRLIGRTVTVVTPIEHGVGRVRVGDSDWRARGPELPAGTPVRIVGVEGATLVVQEEKRLVEAG

SEQ ID NO: 19519 - DNA, 435 bp, Xylella fastidiosa 9a5c
  CDS (1)..(435): transl_table=11
atgatgcgctggaatgctatgggatgggcagccgccgcactgctattgctcgctgccgaaacactgatacctggagcgttcatgctgtggatggggattgcagcaacagctgtgttcgtcggcgtgctgctgctcccggatacttcactgctactgcaaatgttcgcttttgttgttcttagcttcgtttcaatctatctctaccggacttggttccgccgtgtcgatcatgacagtgaccatccgctgctaaatcgccgtgctgatcagctagtcggtcgtgtcatcatccttgatcacgctatcgttgacggcaacgctcgaatcaaaatagacgacacattttgggatatcactggtcctgatttacccatcggcactcaaatccggatcgttgctttagatggcgcaacactcaaggtacaccccacttaa

SEQ ID NO: 19520 - protein, 144 aa, Xylella fastidiosa 9a5c
MMRWNAMGWAAAALLLLAAETLIPGAFMLWMGIAATAVFVGVLLLPDTSLLLQMFAFVVLSFVSIYLYRTWFRRVDHDSDHPLLNRRADQLVGRVIILDHAIVDGNARIKIDDTFWDITGPDLPIGTQIRIVALDGATLKVHPT

SEQ ID NO: 19521 - DNA, 456 bp, Sinorhizobium meliloti 1021
  CDS (1)..(456): transl_table=11
atgatcacgcgcatcatcctcgaactcggcccctggagctggtgggtactcggcctcctgctgctggcggcggagctgatcctgcccggcgtattcctcgtgtggatcgcactcgccgcgctcgtcaccggggccctctcgcttttcttctgggaggcgccgttctggagctggcaggtgcagttcgtcgccttcgccttgctttcggtcgcctccgtccttatcgggcggcgcttcgtctcctcttccgccgagagcgacgagccgctgctcaacaggcgcggcgaaagcctggtcggacggacggcagtgctcgagcagccgatcgcggaaggccgcggacgcgtccggctcgacgacacgacctggtccgtcgaaggccccgaccttccggtcggcgcacgcgttcgcatcgtcgcgagcagcggccgccacctgacggtcgagcagatctga

SEQ ID NO: 19522 - protein, 151 aa, Sinorhizobium meliloti 1021
MITRIILELGPWSWWVLGLLLLAAELILPGVFLVWIALAALVTGALSLFFWEAPFWSWQVQFVAFALLSVASVLIGRRFVSSSAESDEPLLNRRGESLVGRTAVLEQPIAEGRGRVRLDDTTWSVEGPDLPVGARVRIVASSGRHLTVEQI

SEQ ID NO: 19523 - DNA, 465 bp, Caulobacter crescentus CB15
  CDS (1)..(465): transl_table=11
gtgatggacgcgatcgccggcttccacgcccttcatccgttctggctgtggctggccgtggcggccgccttcctggccgtcgaggtcgccaccggcacgggctggcttctgtggccggccgccagcgcctttgtcgtcggggtcatcgcgcaactgctgccgaccagtttcgtgatcgagcttgggctgttcgcggcgctggcgatcgcctcgacctatctggccaagcgctttctgcgaccggtgctggaggcgtccgggccggatctgaacgatccgatgcagcggctgatcggtcagcggggccaggtgctgtcgaccttcgagcaggggcgcggccgcgtcttcatcgacggcaaggactgggcggccgagaccgacgagccgatcccggcgatcagccaggaagtcgtggtggtcggcgtggacggcgcgatcctgaaggtgcgcaagatcccgacctga

SEQ ID NO: 19524 - protein, 154 aa, Caulobacter crescentus CB15
MMDAIAGFHALHPFWLWLAVAAAFLAVEVATGTGWLLWPAASAFVVGVIAQLLPTSFVIELGLFAALAIASTYLAKRFLRPVLEASGPDLNDPMQRLIGQRGQVLSTFEQGRGRVFIDGKDWAAETDEPIPAISQEVVVVGVDGAILKVRKIPT

SEQ ID NO: 19525 - DNA, 465 bp, Agrobacterium tumefaciens str. C58
  CDS (1)..(465): transl_table=11
atgttgcaacggcttgccactgagctgggaccctggagctggtggatcgtcggcttcgtgctgctggccgccgaactcatcgcgcccggcgtcttcctgatatggatcgggcttgccgcacttgtcatcggcgtggtttcgctgtttttctgggaagcggcattctgggcgtggcaattgcagctggtgctgtttgccgcactttccgtggtgttcgccctgctcggccggagatatttcggccgaaaccacgcgacaagcgacgagcccttcctgaaccagcgcgaagcaagccttgtcggccgcaccgcaactctgcaggaaccaatcgtcgagggtcgaggtcggataaggctggatgatacctggtggccggtgaatggcgaagacctgccggccggaacccgcgtcaggattgcctcggcacgcgggcgcacgctgacaatcgaaccgatagatcggtaa

SEQ ID NO: 19526 - protein, 154 aa, Agrobacterium tumefaciens str. C58
MLQRLATELGPWSWWIVGFVLLAAELIAPGVFLIWIGLAALVIGVVSLFFWEAAFWAWQLQLVLFAALSVVFALLGRRYFGRNHATSDEPFLNQREASLVGRTATLQEPIVEGRGRIRLDDTWWPVNGEDLPAGTRVRIASARGRTLTIEPIDR

SEQ ID NO: 19527 - DNA, 417 bp, Xanthomonas axonopodis pv. citri str. 306
  CDS (1)..(417): transl_table=11
atgcgctgggacgtggcggtctggggcagtgctggcgctgctgctgattgcggcccagaccctggtgcgtgtgcgttcctgctgtggatggggatcgctgccgcagcggtgtgcttattggtgccggtgttgccggacatcgcgttgctgtggcagatcgtggcgcttgtgctgctcagcttcgtcttggtgcaggtgtatcgcacctggtttcgcggcaagggctcccagagcgatcgcccgctactcgatcggcgtgccgagcagttgatcggccgttgcgtgccgctcgatcaggccatccacgatggtcgcgtccgcgccaaggtcgatgatgcgttctgggtggtggccggcccggacctgcctgctggcacttcggcacgccggtgcgcatcgtcggcgtcgatggcatga

SEQ ID NO: 19528 - protein, 138 aa, Xanthomonas axonopodis pv. citri str. 306
MRWDVAVWGSAGAAADCGPDPGACAFLLWMGIAAAAVCLLVPVLPDIALLWQIVALVLLSFVLVQVYRTWFRGKGSQSDRPLLDRRAEQLIGRCVPLDQAIHDGRVRAKVDDAFWVVAGPDLPAGTSARRCASSASMA

SEQ ID NO: 19529 - DNA, 468 bp, Brucella suis 1330
  CDS (1)..(468): transl_table=11
atgattcccgaattcctgtttcaacttggcatctggaactggctcgttttcgggctgatcctgctcatcctggaaattctggcgcccggctttttcttcatctggttcggccttgccgcgcttgtcacaggcgcgctggccttccttctgtcgtccaccgccggttttggctggcagttgcaaacagttatctttctggtgctggcaattgtcttcacgcttgccgggcgccgttttttcggctcaaaaagcaatgatacgggcgaacccctgctcaaccgccgcggcgaacagctcgtcggccagcgtgccacgctgacggaacccatcgtcaatggccatggccgcatccacatcaacgatacaacatggcgcgtgaaaggcccggaccttcccgccggaacggaaatccgcatcgtggccttcgatccggtgtcgttggagatagaggtcggtttaggggaatag

SEQ ID NO: 19530 - protein, 155 aa, Brucella suis 1330
MIPEFLFQLGIWNWLVFGLILLILEILAPGFFFIWFGLAALVTGALAFLLSSTAGFGWQLQTVIFLVLAIVFTLAGRRFFGSKSNDTGEPLLNRRGEQLVGQRATLTEPIVNGHGRIHINDTTWRVKGPDLPAGTEIRIVAFDPVSLEIEVGLGE

SEQ ID NO: 19531 - DNA, 432 bp, Pseudomonas putida KT2440
  CDS (1)..(432): transl_table=11
atgcaatggtggatctggctggtcttcggcattgcgctgatcctgcttgaactggtcctcccgacgttcttcatactctggttcggcatcggcgccgtgctggtctcgcttatctcgctcgccgcacccagcctgcaactggacatgcaggtcctgctgtgggtactgctgtcgtcggccaccaccgtgctgtggttcaaagtgttccggcgcaagcagccggatgtgcgctggaccgccgacagcgtgatcggcgaagtgggcctgctgaccgctcccgtgtcggagttccagaaaggccgcgtacgcttccagaagccgatcctcggcaacgaagagtggacctgcgtcgccgatagccagatcgccgccggcgagcgggtacgcctgaccgccatcgaggggaacaccgcccgcgttatccgggcctga

SEQ ID NO: 19532 - protein, 143 aa, Pseudomonas putida KT2440
MQWWIWLVFGIALILLELVLPTFFILWFGIGAVLVSLISLAAPSLQLDMQVLLWVLLSSATTVLWFKVFRRKQPDVRWTADSVIGEVGLLTAPVSEFQKGRVRFQKPILGNEEWTCVADSQIAAGERVRLTAIEGNTARVIRA

SEQ ID NO: 19533 - DNA, 453 bp, Vibrio vulnificus CMCP6
  CDS (1)..(453): transl_table=11
gtgattgagttattagatggcatcaatcactggcattggctagctctcgggctagccttattggcagtggaattgttgggcaccgcaggttactttctttggcttggtttgtcggctttactggttggtctgttgctgtctcttatccctatgagttggcaactgcagtggagcgcgttcgcagtgttctcactcgtgacgacttggctttggtggcgcaaacagcttgcaaaagatcagcaagatgattcatcacgcgatcttaatcagaagcaaaaacaactggttggccaagaaattattctaaaagaggatatccatgctggcatgaatcgaattcaagtggcagacaccacttggtcagcacattccgatattgatattccagcaggcagtaaaattaaaattatcgccttagatggaattgtgttgaaggttgaagtgagcgcttag

SEQ ID NO: 19534 - protein, 150 aa, Vibrio vulnificus CMCP6
MIELLDGINHWHWLALGLALLAVELLGTAGYFLWLGLSALLVGLLLSLIPMSWQLQWSAFAVFSLVTTWLWWRKQLAKDQQDDSSRDLNQKQKQLVGQEIILKEDIHAGMNRIQVADTTWSAHSDIDIPAGSKIKIIALDGIVLKVEVSA

SEQ ID NO: 19535 - DNA, 444 bp, Bradyrhizobium japonicum USDA 110
  CDS (1)..(444): transl_table=11
atgaccgacacgttcgtatcgctcggcacctggaactggctgatctttgccttcatcctgatggcgctggagacgatcgcaccgggcgtattcctgttctggctcgggctcgccgctttgctggtgggcctgatctcgttcgccgttcatctgtcctggcagactcagctcgtgatgttcgcgatcttcgctgccgccgccgtgccggtgtggcggcggctcgcccggccgaggcccgatgcaagcgcaagccccttcctcaacaagcgcaccgaggcgctgctcggccgtgagttcacgctggagaagccgatcgtcgacggcaacggcaccatgcgcatcggcgacacggtctggcgcgtcgcaggtcccgatacgccggccgggacgcgcgtgaaggtggtgcaggtggacggcgtgaatctgacggtagcggtggcgtag

SEQ ID NO: 19536 - protein, 147 aa, Bradyrhizobium japonicum USDA 110
MTDTFVSLGTWNWLIFAFILMALETIAPGVFLFWLGLAALLVGLISFAVHLSWQTQLVMFAIFAAAAVPVWRRLARPRPDASASPFLNKRTEALLGREFTLEKPIVDGNGTMRIGDTVWRVAGPDTPAGTRVKVVQVDGVNLTVAVA

SEQ ID NO: 19537 - DNA, 435 bp, Xylella fastidiosa Temecula1
  CDS (1)..(435): transl_table=11
gtgatgcgctgggatgctatgggatgggcagctgccgcactgctattgctcgctgccgaaacactgatacctggagcgttcatgctatggatggggattgcagcagcagctgtgttcgtcggcgtgctgctgctcccggatatttcactgctactgcaaatgttcgcttttgttgttcttagcttcgtttcaatctatctctaccggacttggttccgccatatcgatcatgacagtgaccatccgctgctaaatcgccgtgctgatcagctagtcggtcgtatcatcatccttgatcacgctatcgttgacggcaacgctcgaatcaaaatagacgacacattttgggatatcactggtcctgatttacccatcggcactcaaatccggatcgttgctttagatggcacaacactcaaggtacaccccacttaa

SEQ ID NO: 19538 - protein, 144 aa, Xylella fastidiosa Temecula1
MMRWDAMGWAAAALLLLAAETLIPGAFMLWMGIAAAAVFVGVLLLPDISLLLQMFAFVVLSFVSIYLYRTWFRHIDHDSDHPLLNRRADQLVGRIIILDHAIVDGNARIKIDDTFWDITGPDLPIGTQIRIVALDGTTLKVHPT

SEQ ID NO: 19539 - DNA, 462 bp, Vibrio parahaemolyticus RIMD 2210633
  CDS (1)..(462): transl_table=11
atggacttgttcaacctgcttgatggcataacattttggcactggcttgcattcggctttgtgctgcttgccgttgagctacttggtacagcgggttactttctgtggttggggttatcggcgttattagtgggagcgttattggcagtgctccctttcggctggcaacttcaatggttatctttcgcgactttcagtttgctgacaacttggttatggtggcgacgccagtggtcaagagacaaacaagatgatcaaacaagagatctcaaccaaaagtacaagcagttgattggccgcagcgtgatacttgaggaagatttttcaattgggttaaacagaattcgcatcgccgataccacctggtctgcacagtgtgagcaaaatatccgagctggtactcgtgtaaaaatcgtcgcgatcgatggaataatcctcattgtggagcctatttctgagtaa

SEQ ID NO: 19540 - protein, 153 aa, Vibrio parahaemolyticus RIMD 2210633
MDLFNLLDGITFWHWLAFGFVLLAVELLGTAGYFLWLGLSALLVGALLAVLPFGWQLQWLSFATFSLLTTWLWWRRQWSRDKQDDQTRDLNQKYKQLIGRSVILEEDFSIGLNRIRIADTTWSAQCEQNIRAGTRVKIVAIDGIILIVEPISE

SEQ ID NO: 19541 - DNA, 429 bp, Bacillus cereus ATCC 14579
  CDS (1)..(429): transl_table=11
atggctgcttgggtaatttggtttataatagctggtattttatttatcgcggaaatgttgtcgattacattttacatgctttggcttggaattggagctgttgtcggaggtcttattgctttgtttgctcctgatgcactactgttacaagttactgttggtgcaattgtaagtttaactttgacattctttacgaaaagaatttcaaaaaactttcgagaagcaaaaggttttactgatacagtagatatgcttgttggtaaaagagggattgttatgcaagcgattacaaatgaagcgaatggtattgtgaaggtggatggagatacttggacagctattgcagattcttcaattgatgctggagaaaaagtcgttgttataaagaggcatagtactatattacaagtgaaaaaggagagtgaataa

SEQ ID NO: 19542 - protein, 142 aa, Bacillus cereus ATCC 14579
MAAWVIWFIIAGILFIAEMLSITFYMLWLGIGAVVGGLIALFAPDALLLQVTVGAIVSLTLTFFTKRISKNFREAKGFTDTVDMLVGKRGIVMQAITNEANGIVKVDGDTWTAIADSSIDAGEKVVVIKRHSTILQVKKESE

SEQ ID NO: 19543 - DNA, 444 bp, Prochlorococcus marinus str. MIT 9313
  CDS (1)..(444): transl_table=11
ttgccttcgcccacctggattcctctgatctggctcgccgtagctggcctactcctagccattgagctggctcaaccgagcttcgatggcctgatgttcgcagcgcttggggccttagtggtatcgattttggctgcaatcactcccatgccactgattttgcagatgatcttctttctgctgatcacggttttagggactctctggctgactcgttggtcagcccgccgcaaccccagtccagatgggcttcgccaacgcgaggatatcgccgaagtgctgacgccaatcaaagctggaggagatgggcgtgtgcgttggcatgggcaaagctgggccgccagttcgatcgacctggagactccaataaacgccggtgatcaggtcgtggtaatgggccgtgaaggcacacaactacaggttctgccactgccgcgtcgctga

SEQ ID NO: 19544 - protein, 147 aa, Prochlorococcus marinus str. MIT 9313
MPSPTWIPLIWLAVAGLLLAIELAQPSFDGLMFAALGALVVSILAAITPMPLILQMIFFLLITVLGTLWLTRWSARRNPSPDGLRQREDIAEVLTPIKAGGDGRVRWHGQSWAASSIDLETPINAGDQVVVMGREGTQLQVLPLPRR

SEQ ID NO: 19545 - DNA, 456 bp, Photorhabdus luminescens subsp. laumondii TTO1
  CDS (1)..(456): transl_table=11
atgattgcacagattgcggcgcaaactccttggctctggttctctttcggcggcttactgttaattgcagagcttctgggaactggcggctatctgttatggacgggcatagccgctatcgttgttgcgtttgtcacctggctgctaccaggaatagattgggaatggcaaggcattttgtttgccactctgacgctgctttctgcaatgctatggcgctactggttacgtcgccgcccatcaaaaggcggcgataccctgaaccagaaagagcaccagctcatcggtatccgagccaaactgactaccgatactgaaaatggttacagccgggtcaagctagctgatggaagctggcgagttcactgtaatagtgaactaccagcccacaccgaagtagaagtgatcgctgttgatggcattaccctgaaagtaaaaccggtcagttctcagtga

SEQ ID NO: 19546 - protein, 151 aa, Photorhabdus luminescens subsp. laumondii TTO1
MIAQIAAQTPWLWFSFGGLLLIAELLGTGGYLLWTGIAAIVVAFVTWLLPGIDWEWQGILFATLTLLSAMLWRYWLRRRPSKGGDTLNQKEHQLIGIRAKLTTDTENGYSRVKLADGSWRVHCNSELPAHTEVEVIAVDGITLKVKPVSSQ

SEQ ID NO: 19547 - DNA, 459 bp, Vibrio vulnificus YJ016
  CDS (1)..(459): transl_table=11
gtgattgagttactagatggcatcaatcactggcattggctagctctcgggctagccttattggcagtggaactgttgggcaccgcaggttactttctttggcttggtttgtcggctttactggttggtctgttattgtctcttatccctatgagttggcaactgcagtggagcgcatttgcagtgttctcactcgtgacgacttggctttggtggcgcagacagcttgcaaaagatcagcaagatgattcatcacgcgatcttaatcagaagcaaaaacaactggttggccaagaaattattctaaaagaggatatccatgccggcatgaatcgaattcaagtggcagacacgacttggtcagcacattccgatagtgatattccggcaggcagtaaaattaaaattatcgccttagatggaattgtgttgaaggtagaagtacaggctacgccataa

SEQ ID NO: 19548 - protein, 152 aa, Vibrio vulnificus YJ016
MIELLDGINHWHWLALGLALLAVELLGTAGYFLWLGLSALLVGLLLSLIPMSWQLQWSAFAVFSLVTTWLWWRRQLAKDQQDDSSRDLNQKQKQLVGQEIILKEDIHAGMNRIQVADTTWSAHSDSDIPAGSKIKIIALDGIVLKVEVQATP

SEQ ID NO: 19549 - DNA, 450 bp, Rhodopseudomonas palustris CGA009
  CDS (1)..(450): transl_table=11
atgaccgcgatactcaccgcgctcggcgcctggaactggctgatcctcggtctggtgctgatggcgctggagctgctggcgcctggcgtgtttctgttctggctcggcctcgcggcgctgctggtcggcgtgctggcgctgctgctggagccgggatggcagttgcaaatcctgctgttcggcctgttcgcggccgccgccgtgccgctgtggcggcggatggcgcgcggcggcgacgtcgaggtgcatgccaccaacccgttcctcaaccgccgcaccgatgctctggtggggcgggagttcaccctggagaagccgatcgagggcggcgtcggaacggtgcggatcgacgatacggtctggcgtgtgtccggccccgacacccccgccggcagccgcattcgtatcgttgcggcggatggcgtgacgctgacggtggcggcgctgtag

SEQ ID NO: 19550 - protein, 149 aa, Rhodopseudomonas palustris CGA009
MTAILTALGAWNWLILGLVLMALELLAPGVFLFWLGLAALLVGVLALLLEPGWQLQILLFGLFAAAAVPLWRRMARGGDVEVHATNPFLNRRTDALVGREFTLEKPIEGGVGTVRIDDTVWRVSGPDTPAGSRIRIVAADGVTLTVAAL

SEQ ID NO: 19551 - DNA, 429 bp, Bacillus cereus ATCC 10987
  CDS (1)..(429): transl_table=11
atggctgcttgggtaatttggtttataatagctggtattttatttattgcggaaatgctgtcgattacattttacatgctttggcttggaattggagctgttgtcggaggtcttattgctttgtttgttcctgaagcactactgttacaagttgttgctggcgcgattgtaagtttaacattgactttctttacaaaaagaatatcaaaaaactttcgggaagcaaaaggttttactgatacagtagatatgcttgcaggtaaaaaagggattgttatgcaagcgattacaaatgaagcgaacggcattgtgaaagtggatggagatacttggacagctattgcagatgatccaattgatgccggagaaaaagttattgttataaagaggcatagtactatattacaagtaaaaaaggagagtgaataa

SEQ ID NO: 19552 - protein, 142 aa, Bacillus cereus ATCC 10987
MAAWVIWFIIAGILFIAEMLSITFYMLWLGIGAVVGGLIALFVPEALLLQVVAGAIVSLTLTFFTKRISKNFREAKGFTDTVDMLAGKKGIVMQAITNEANGIVKVDGDTWTAIADDPIDAGEKVIVIKRHSTILQVKKESE

SEQ ID NO: 19553 - DNA, 429 bp, Bacillus anthracis str. Sterne
  CDS (1)..(429): transl_table=11
atggctgcttgggtaatttggtttatcatagctggtattttatttattgcggaaatgctgtcgattacgttttacatgctttggcttggaattggagctgttgtcggaggtcttattgctttatttgcccctgaagcactactattacaagttgttgctggtgcgattgtaagtttaacattgactttctttacgaaaagaatatcaaaaaactttcgagaagcaaaaggttttactgatacagtagatatgttggtcggtaaaaaagggattgtcatgcaagcgattacaaaagaaacgaatggtattgtgaaggtggatggagatacttggacagctgttgcagatgctccaattgatactggagaaaaagttgttgttataaagagaaatagtactatattacaagtgaaaaaggagagtgaataa

SEQ ID NO: 19554 - protein, 142 aa, Bacillus anthracis str. Sterne
MAAWVIWFIIAGILFIAEMLSITFYMLWLGIGAVVGGLIALFAPEALLLQVVAGAIVSLTLTFFTKRISKNFREAKGFTDTVDMLVGKKGIVMQAITKETNGIVKVDGDTWTAVADAPIDTGEKVVVIKRNSTILQVKKESE

SEQ ID NO: 19555 - DNA, 429 bp, Bacillus thuringiensis serovar konkukian str. 97-27
  CDS (1)..(429): transl_table=11
atggctgcatgggtaatttggtttatcatagctggtattttatttattgcagaaatgttgtcgattacattttacatgctttggcttggaattggagctgttgtcggaggtcttattgctttatttgcccctgaagcactactattacaagttgttgctggtgcgattgtaagtttaacattgactttctttacgaaaagaatatcaaaaaactttcgagaagcaaaaggttttactgatacagtagatatgttggtcggtaaaaaagggattgtcatgcaagcgattacaaacgaaacgaatggtattgtgaaggtggatggagatacttggacagctgttgcagatgctccaattgatactggagaaaaagttgttgttataaagagaaatagtactatattacaagtgaaaaaggagagtgaataa

SEQ ID NO: 19556 - protein, 142 aa, Bacillus thuringiensis serovar konkukian str. 97-27
MAAWVIWFIIAGILFIAEMLSITFYMLWLGIGAVVGGLIALFAPEALLLQVVAGAIVSLTLTFFTKRISKNFREAKGFTDTVDMLVGKKGIVMQAITNETNGIVKVDGDTWTAVADAPIDTGEKVVVIKRNSTILQVKKESE

SEQ ID NO: 19557 - DNA, 471 bp, Acinetobacter sp. ADP1
  CDS (1)..(471): transl_table=11
atggaatttattttagaaccgtggcattggttcgttctaggtatattactcatgctctccgagttggtcattactgcttttgctgcactttggttcggcattgcagccattatggtgagcgttttactttggctttttccaatgatgggaatcaccacacaggtcatcatgtggattatcctgtccgtactttgtacgctcttatggtttaaatttatcaaaccactttctatcgacaaaaccaaagcaggattatctcgcgaagccacgatcggacagattggtatggtgattcgtgtcggtctatcacatgagcaaattgttgtaaggtttgcattgcctgtactgggtgcagatgaatggaactgtcgcagccttgctcctgtggaagttggtgatcgtgtctgtgtcgtcgatatcatgggcaatgatctggttgtccagccccatatcccaataaacaataaatga

SEQ ID NO: 19558 - protein, 156 aa, Acinetobacter sp. ADP1
MEFILEPWHWFVLGILLMLSELVITAFAALWFGIAAIMVSVLLWLFPMMGITTQVIMWIILSVLCTLLWFKFIKPLSIDKTKAGLSREATIGQIGMVIRVGLSHEQIVVRFALPVLGADEWNCRSLAPVEVGDRVCVVDIMGNDLVVQPHIPINNK

SEQ ID NO: 19559 - DNA, 456 bp, Erwinia carotovora subsp. atroseptica SCRI1043
  CDS (1)..(456): transl_table=11
atgggcattgaactggtgatggaaaatgcacactggttctggctatcgctcggcggtctgctgttggccgccgaaatgctgggtggcagtggctatttgctgtggagcggcctatcggcggtattggttgggctgttaacgtggatcatgccgctgggttggccatggcagggaacgattttcgccatcctgacgatcgtcacggcgctgctctggtggtattggctgcgtaaacgaacgctgtcgcgtccaccgtcgacgctcaaccaacgcggacaacagctggttggcctgcgtgccaccgtgtcagaatcggtgactaacggttttggtcgggtaaacatcggtgacagcagttggcgcgtgaaatcagaacaggatctgcctgctggcacgcatgttgaagtgattgccgttgacggcatcacgctgcatgtgcgctcaattgagcgctaa

SEQ ID NO: 19560 - protein, 151 aa, Erwinia carotovora subsp. atroseptica SCRI1043
MGIELVMENAHWFWLSLGGLLLAAEMLGGSGYLLWSGLSAVLVGLLTWIMPLGWPWQGTIFAILTIVTALLWWYWLRKRTLSRPPSTLNQRGQQLVGLRATVSESVTNGFGRVNIGDSSWRVKSEQDLPAGTHVEVIAVDGITLHVRSIER

SEQ ID NO: 19561 - DNA, 468 bp, Propionibacterium acnes KPA171202
  CDS (1)..(468): transl_table=11
gtgttggaatctttcggggaacatcgctggttgctgtgggcggtggcgtccgctgtgctggcgtgcacggagatgctaagcggagaatttaccctgctcatgctcgctgccggtgcgggagcaggagcaatcaccgcagcgatcgttccaggaatgtggttactgcaggtcatcgtcgctgctgtggtggcagctttattgcttaccgtgctgcgcccaacgttgttgcgccgggtgcgtgaggctccgggatatcggtcagctttggataaactagtcggttctgacggcgttgctacgagcgacatcacagatggccacggtcaggtcaaggtggacggtgaagagtggtcggcacgtgccctggaacccgggtcgactatcgctgccggggagaaaattgaggtgtacgagatcgatggtgcgacgctcgtggtatatccagttttcaggagtctgagttcctga

SEQ ID NO: 19562 - protein, 155 aa, Propionibacterium acnes KPA171202
MLESFGEHRWLLWAVASAVLACTEMLSGEFTLLMLAAGAGAGAITAAIVPGMWLLQVIVAAVVAALLLTVLRPTLLRRVREAPGYRSALDKLVGSDGVATSDITDGHGQVKVDGEEWSARALEPGSTIAAGEKIEVYEIDGATLVVYPVFRSLSS

SEQ ID NO: 19563 - DNA, 492 bp, Desulfotalea psychrophila LSv54
  CDS (1)..(492): transl_table=11
gtgccaatctttaacctttctaacaggcttttgcctgttgtttatatgcctttgaggttatttatggaatttatagattcgggtcttttttggctggtaataggcggtatgcttcttcttatggggcttgccactccaggattggtgctttttttctttgctgtcggggctactagtgtagcagcattaaattggctctatccggtcaatatggtttggcaattggtgatctttctgttgctctccctctttcttcttggttcctataggaaaatttttaagggaagtttttttgcaggtgatgaggtggatgaggtcgtggtcgaggtgggtgcacgtggggaagttgtagcccttattgcccctcctgccgtcggcagggtaaagattttggatcatgtttggcaggccacggccgatatttttatcgaagaggggcagactgtttatgtggtgaggcgtgatggtcccgttctgcacgtaggtaaataa

SEQ ID NO: 19564 - protein, 163 aa, Desulfotalea psychrophila LSv54
MPIFNLSNRLLPVVYMPLRLFMEFIDSGLFWLVIGGMLLLMGLATPGLVLFFFAVGATSVAALNWLYPVNMVWQLVIFLLLSLFLLGSYRKIFKGSFFAGDEVDEVVVEVGARGEVVALIAPPAVGRVKILDHVWQATADIFIEEGQTVYVVRRDGPVLHVGK

SEQ ID NO: 19565 - DNA, 462 bp, Desulfotalea psychrophila LSv54
  CDS (1)..(462): transl_table=11
ttggttaaaaacatgactctttcctattcgctaatatggtttcttgtgggtgttctctttttaatcgtggagttgctcctgccaggcttcattctgatttttttcacagctggatgctggattgccggtttaacagcctggttaacagacatcggcttacccacccagatattaatcttcatcatctcctccctgctttttctcttttccctgcgcaggtattgtctaaaaaccttcaaagggagcactcgtgatgatcacgaagacccatatattaactcaaaaattggcaagacggcactggtaaccaaggaaatatcagcaaatacgcctggcgaaatcaaggtaatggggagtttctggagagctgttgccgatgaaagcatcgaagagggacaatctgttttagttacaagccaggaatcagaagacggacttaccttcagagtcaaaaaattataa

SEQ ID NO: 19566 - protein, 153 aa, Desulfotalea psychrophila LSv54
MVKNMTLSYSLIWFLVGVLFLIVELLLPGFILIFFTAGCWIAGLTAWLTDIGLPTQILIFIISSLLFLFSLRRYCLKTFKGSTRDDHEDPYINSKIGKTALVTKEISANTPGEIKVMGSFWRAVADESIEEGQSVLVTSQESEDGLTFRVKKL

SEQ ID NO: 19567 - DNA, 450 bp, Yersinia pseudotuberculosis IP 32953
  CDS (1)..(450): transl_table=11
atgctggaggaaattgcagtaaatccaaattggttttggctatcacttggcgggctattattggccgctgagatgctgggagcgagtggctatctgttgtggagcggtattgccgccgtccttgttggcgttctggtatggctgttcccctttagctgggaaatgcaaggcgtgctgttctccattctgactgtcgtgtctgctttcctatggtggtattggttgagtaaacgcactaaaccgcaacctgccatgcttaaccaacgtaatcatcaactgcttggcatacgggcaacactgaccgagccaacggttgatggctatggccggatgaaggtcggtgacagcagttggcgaatttactgcgctaccgagcttaacccaggaactgaagttgaagtgattttggtagaaggcaataccttgcatgtccgtgccgttaatcgctag

SEQ ID NO: 19568 - protein, 149 aa, Yersinia pseudotuberculosis IP 32953
MLEEIAVNPNWFWLSLGGLLLAAEMLGASGYLLWSGIAAVLVGVLVWLFPFSWEMQGVLFSILTVVSAFLWWYWLSKRTKPQPAMLNQRNHQLLGIRATLTEPTVDGYGRMKVGDSSWRIYCATELNPGTEVEVILVEGNTLHVRAVNR

SEQ ID NO: 19569 - DNA, 429 bp, Bacillus cereus E33L
  CDS (1)..(429): transl_table=11
atggctgcttgggtaatttggtttataatagctggtattttatttattgcggaaatgctgtcgattacattttacatgctttggcttggaattggagctgttgtcggaggtcttattgctttgtttgttcctgaagcactactgttacaagttgttgctggtgcgattgtaagtttaacattgactttctttacgaaaagaatatcaaaaaactttcgggaagcaaaaggttttactgatacagtagatatgcttgcaggtaaaaaagggattgttatgcaagcgattacaaatgaggcgaacggcattgtgaaagtggatggagatacttggacagctattgcagataatccaattgatgccggagaaaaagttattgttataaagagacatagtacgatattacaagtaaaaaaggagagtgaataa

SEQ ID NO: 19570 - protein, 142 aa, Bacillus cereus E33L
MAAWVIWFIIAGILFIAEMLSITFYMLWLGIGAVVGGLIALFVPEALLLQVVAGAIVSLTLTFFTKRISKNFREAKGFTDTVDMLAGKKGIVMQAITNEANGIVKVDGDTWTAIADNPIDAGEKVIVIKRHSTILQVKKESE

SEQ ID NO: 19571 - DNA, 453 bp, Mannheimia succiniciproducens MBEL55E
  CDS (1)..(453): transl_table=11
atggattggttattcgcttggtctgtgtggcactggctcattttaggttttttattgcttatcggggagattctgatccccggtatttttctgctctggtggggaatatccgctatcattatggcggcgattatggcattattcaccactttaactcttaccgtattgggcatttcttatgcggtattagccttgctgttaagtttggtttggtggaaatatcaacataataaagataaaagtgacgaagcccgttcggtgctgaatcaacgaaaccacgccatgatcggcgcaatcggcgccgtacaggaaattgctttaaacggcgtcggacggggttattttggtgataccacttggcgcattcaaggaaaagaattgaaagtgggcgatcgtattgaagttttaaaggtacggggtataacccttattgtacgtaaattaggaaattaa

SEQ ID NO: 19572 - protein, 150 aa, Mannheimia succiniciproducens MBEL55E
MDWLFAWSVWHWLILGFLLLIGEILIPGIFLLWWGISAIIMAAIMALFTTLTLTVLGISYAVLALLLSLVWWKYQHNKDKSDEARSVLNQRNHAMIGAIGAVQEIALNGVGRGYFGDTTWRIQGKELKVGDRIEVLKVRGITLIVRKLGN

SEQ ID NO: 19573 - DNA, 444 bp, Methylococcus capsulatus str. Bath
  CDS (1)..(444): transl_table=11
atgaccgggttcagcctggttttctggcactggtggacgctgggtgccctgttgctgatcctcgagctcctcctcccggggatgtatttcctctggatggcggaagcagcgctgctgacgggtgcggtactctggctgctccccgggctggggtgggaaatccagctgctggtgttttccgtcctttctctggccagcatcttcgtcttcgaaaaattcatcggccgcaaacccatcgtttccgatcggcctttgctcaaccgccgggcggcgcaatacatcgggcgaaccctgatgttggagcagcccatcgtcaatggtatggggaaaatccgtatcgacgactcgatttggcgggtgcatggggatgattgccccgccggtaccaaaatcagggtgtgtgacgtggacggcgtcattctgaaggtcgagcgggtcgcttga

SEQ ID NO: 19574 - protein, 147 aa, Methylococcus capsulatus str. Bath
MTGFSLVFWHWWTLGALLLILELLLPGMYFLWMAEAALLTGAVLWLLPGLGWEIQLLVFSVLSLASIFVFEKFIGRKPIVSDRPLLNRRAAQYIGRTLMLEQPIVNGMGKIRIDDSIWRVHGDDCPAGTKIRVCDVDGVILKVERVA

SEQ ID NO: 19575 - DNA, 459 bp, Photobacterium profundum SS9
  CDS (1)..(459): transl_table=11
atgatagccctacttgaacagatgaacttctggcattgggtagcatttggtttagccttgctactactggaattactcggaactgctgggtacttgctttggttgggtgtctctgctgttcttgttggattactcttgtcgtttctaccactgagctggccattgcaatggctaacgtttgcggttttctcgttatttacaatgtggttgtggtggcgttaccaacacaaaaaagaccgcattgaagatgaagggcgcacactcaataagcgttcagaacaattaatagggcaggtctccgtgttagacgagcccttagctgctggaacagggcgaatgaggttaggtgatacaacatggcttgtacgaaccgatgttgctttagaagccggtgtactcgtagaggttattgatgttgatggcatcatgttaattattcagcctaaagtgcaaaaataa

SEQ ID NO: 19576 - protein, 152 aa, Photobacterium profundum SS9
MIALLEQMNFWHWVAFGLALLLLELLGTAGYLLWLGVSAVLVGLLLSFLPLSWPLQWLTFAVFSLFTMWLWWRYQHKKDRIEDEGRTLNKRSEQLIGQVSVLDEPLAAGTGRMRLGDTTWLVRTDVALEAGVLVEVIDVDGIMLIIQPKVQK

SEQ ID NO: 19577 - DNA, 453 bp, Salmonella enterica subsp. enterica serovar Paratyphi A str. ATCC
  CDS (1)..(453): transl_table=11
atgatagcgatgattctggtacatccgcatatcttctggcttagcctcggcggcctgttgttggctgcggaaatgctcggcggtaacggctatttgctgtggagcggcgtggcggcagtgattaccggcttaaccgtctggctcttaccgctcggctgggaatggcagggcgtgctgtttgcggccttaacgttactggcggcctggctttggtggcgctggctggcgcgtcgcgtgcgggaacaaaagccgaccgacagccgccttaaccaacgcggacaacaactgataggccgccggtttatgcttgatgccgcgttagtgaacggacggggtcatatgcgtgtcggcgacagctcgtggccggtatgcgctgacgaagacctgcgcgcaggtacgcatgtcgaagtgatcgccgtggaaggcatcaccttacgcattcgtgccgtttaa

SEQ ID NO: 19578 - protein, 150 aa, Salmonella enterica subsp. enterica serovar Paratyphi A str. ATCC
MIAMILVHPHIFWLSLGGLLLAAEMLGGNGYLLWSGVAAVITGLTVWLLPLGWEWQGVLFAALTLLAAWLWWRWLARRVREQKPTDSRLNQRGQQLIGRRFMLDAALVNGRGHMRVGDSSWPVCADEDLRAGTHVEVIAVEGITLRIRAV

SEQ ID NO: 19579 - DNA, 579 bp, Xanthomonas oryzae pv. oryzae KACC10331
  CDS (1)..(579): transl_table=11
atgcgctgggatgtggcggtctgggcagtgctggcgctgctgctgattgcggccgagaccttggtgccgggtgccttcctgctgtggatggggatcgctgccgcagtggtgtgcgtgttggtgctggtgttgccggacatcgcgttgctggtgcagatcgtggcgttcgtggtgctcagcttcgtctcggtgcaggtgtatcgcacctggtgtcgcggcaagggccgtgagagcgatcgcccgttgctcaatcgacgtgccgagcaggtgatcggccgtcgcgtgttgctcgatcaggccatcgacgatggtcgcgggcgcgtcaaggtcgacgatgcgttctgggtggtcgccggtcccgatctgccggccggcacgccggtgcgcatcgtcggtgtcgatggcagaccttgctggtgcagccggtcagctgacgtccgcgggcagggcacatgttgcgctgccaatgtccgcattgttgcagcgcggcgtagcatcgcgctgcgtcactgttctccaatcagcgtaatcgcgctgctgcgcgcacgccgttccccaggcgcggcaggacggggataa

SEQ ID NO: 19580 - protein, 192 aa, Xanthomonas oryzae pv. oryzae KACC10331
MRWDVAVWAVLALLLIAAETLVPGAFLLWMGIAAAVVCVLVLVLPDIALLVQIVAFVVLSFVSVQVYRTWCRGKGRESDRPLLNRRAEQVIGRRVLLDQAIDDGRGRVKVDDAFWVVAGPDLPAGTPVRIVGVDGRPCWCSRSADVRGQGTCCAANVRIVAARRSIALRHCSPISVIALLRARRSPGAAGRG

SEQ ID NO: 19581 - DNA, 453 bp, Vibrio fischeri ES114
  CDS (1)..(453): transl_table=11
atggagttttttgaacagatgaatcattggcactggttgactttagggttgttactacttgctggtgaattattaggaactgcgggctattttttgtggatagggctatcagcggtggctgttggagcgctatatgccgtgataccacttagttggcaaatgcagtggatcagttttgctgttttttcactctttacgacttggttgtggtggcgatatcaacataaaaaagacataagttcagatgcaaaaagagcgcttaatcaaaaagataagcaactaattggtcaaacatctcgtttggaagaagatattcatgcaggttcttgtcgaattgtattaggtgatactacatggtccgctaaaagtgccgttgatatagaaaagggaacgctagttcgtgtggtttctgttgacggtattattttgacgattgaaccagtaaaaaaataa

SEQ ID NO: 19582 - protein, 150 aa, Vibrio fischeri ES114
MEFFEQMNHWHWLTLGLLLLAGELLGTAGYFLWIGLSAVAVGALYAVIPLSWQMQWISFAVFSLFTTWLWWRYQHKKDISSDAKRALNQKDKQLIGQTSRLEEDIHAGSCRIVLGDTTWSAKSAVDIEKGTLVRVVSVDGIILTIEPVKK

SEQ ID NO: 19583 - DNA, 453 bp, Salmonella enterica subsp. enterica serovar Choleraesuis str
  CDS (1)..(453): transl_table=11
atgatagcgatgattctggtacatccgcatatcttctggcttagcctcggcggcctgttgttggctgcggaaatgctcggcggtaacggctatttgctgtggagcggcgtggcggcagtgattaccggcttaaccgtctggctcttaccgctcggctgggaatggcagggcgtgctgtttgcggccttaacgttgctggcagcctggctttggtggcgctggctggcgcgtcgcgtgcgggagcagaagccgaccgacagccgccttaaccaacgcggacaacaactggtaggccgccgatttatgcttgatgccgcgttagttaacggacggggtcatatgcgtgtcggcgacagctcgtggccggtatgcgctgacgaagacctgcgcgcaggtacgcatgtcgaagtgatcgccgtggaaggcatcaccttacgcattcgtgccgtttaa

SEQ ID NO: 19584 - protein, 150 aa, Salmonella enterica subsp. enterica serovar Choleraesuis str
MIAMILVHPHIFWLSLGGLLLAAEMLGGNGYLLWSGVAAVITGLTVWLLPLGWEWQGVLFAALTLLAAWLWWRWLARRVREQKPTDSRLNQRGQQLVGRRFMLDAALVNGRGHMRVGDSSWPVCADEDLRAGTHVEVIAVEGITLRIRAV

SEQ ID NO: 19585 - DNA, 468 bp, Brucella abortus biovar 1 str. 9-941
  CDS (1)..(468): transl_table=11
atgattcccgaattcctgtttcaacttggcatctggaactggctcgttttcgggctgatcctgctcatcctggaaattctggcgcccggctttttcttcatctggttcggccttgccgcgcttgtcataggcgcgctggccttccttctgtcgtccaccgccggttttggctggcagttgcaaacagttatctttctggtgctggcaattgtcttcacgcttgccgggcgccgttttttcggctcaaaaagcaatgatacgggcgaacccctgctcaaccgccgcggcgaacagctcgtcggccagcgtgccacgctgacggaacccatcgtcaatggccatggccgcatccacatcaacgatacaacatggcgcgtgaaaggcccggaccttcccgccggaacggaaatccgcatcgtggccttcgatccggtgtcgttggagatagaggtcggtttaggggaatag

SEQ ID NO: 19586 - protein, 155 aa, Brucella abortus biovar 1 str. 9-941
MIPEFLFQLGIWNWLVFGLILLILEILAPGFFFIWFGLAALVIGALAFLLSSTAGFGWQLQTVIFLVLAIVFTLAGRRFFGSKSNDTGEPLLNRRGEQLVGQRATLTEPIVNGHGRIHINDTTWRVKGPDLPAGTEIRIVAFDPVSLEIEVGLGE

SEQ ID NO: 19587 - DNA, 435 bp, Xanthomonas campestris pv. campestris str. 8004
  CDS (1)..(435): transl_table=11
atgcgctgggacgtggtcgcctgggcagtgctggccctgctgttgatcgccgccgagacgctggcgcccggcgcgtttctgctgtggatgggcatcgcggccgcagcggtgtgcgtgctggtgctggccgtgcccggcacctcggtactgttgcagatcgtggcattcgtggtgctcagcttcgtggccatccaggtgtatcgcacctggttccgcggcaagggccggcagagtgatcggcccttgctcaaccggcgcgccgaacagttgatcggccgcagtgtgctgctggatcaggcgatcgttgacggacgtggccgcgctaaggtggacgatgcgttctgggtagtgagtggcccggatcttcccgccggtgcgctggtgcgcatcgttgcggtcgacggcatgaccctgcaggtgcagcccaacacctga

SEQ ID NO: 19588 - protein, 144 aa, Xanthomonas campestris pv. campestris str. 8004
MRWDVVAWAVLALLLIAAETLAPGAFLLWMGIAAAAVCVLVLAVPGTSVLLQIVAFVVLSFVAIQVYRTWFRGKGRQSDRPLLNRRAEQLIGRSVLLDQAIVDGRGRAKVDDAFWVVSGPDLPAGALVRIVAVDGMTLQVQPNT

SEQ ID NO: 19589 - DNA, 450 bp, Pseudomonas fluorescens Pf-5
  CDS (1)..(450): transl_table=11
atgttggcatttgtgcaagctctatcgttctgggactggctggcccttggcaccatcctgctgatcttcgaagtattcggggccggcggctacctgctgtggatcggcctcgcagccgccatagtcggggtcctgacctttctcattcccggcctctcatgggaggtgcagttcctcctgttcggcctgctgtcggtgctcaccgcactgtattggtggcgccgccagcgcagcgtggtacgccccagcgatcagccgaacctcaacctgcgcggccaggagctgatcggcaagacctttgtggtgcaccaggcgattgtcgacggccgcgggcggatcaaggtggccgacggcgtgtggatcgccaagggggccgacgcccccgtgggcgcccgggttcgggtggtgggccaggaaggcgcaatcctgttggtcgaaaaccttgactga

SEQ ID NO: 19590 - protein, 149 aa, Pseudomonas fluorescens Pf-5
MLAFVQALSFWDWLALGTILLIFEVFGAGGYLLWIGLAAAIVGVLTFLIPGLSWEVQFLLFGLLSVLTALYWWRRQRSVVRPSDQPNLNLRGQELIGKTFVVHQAIVDGRGRIKVADGVWIAKGADAPVGARVRVVGQEGAILLVENLD

SEQ ID NO: 19591 - DNA, 498 bp, Psychrobacter arcticum 273-4
  CDS (1)..(498): transl_table=11
atgatggagacgctttggatgatagaaccttggcattggctggtattgggctttttgttattgattgtcgagatgtttgtgccaacctttgctagcctttggtttggtgctgctgccatcatagtggctgcgcttacatggctgttgcctatctctatctccgtacaaattattatctggttactcctctccgctatattcttgctggcatggtttaaatttatcaaacctttatctgtagatcgtaccaaagcaggacttggtggcagtgtgatcgtcggtgaaacaggtatgattattgtgcagccacaggcagatagagcaggtatggtacgttttagtgtccctattgtgggtgccgctgaatggatgtgccgtacccgtggtgagcaagtggcagtcggtgatcgagtggtggtgacagatatcattggtaatgagctgattgtgagtagtatgaattcaagaacggctgtgagccaaaatacgcccgtataa

SEQ ID NO: 19592 - protein, 165 aa, Psychrobacter arcticum 273-4
MMETLWMIEPWHWLVLGFLLLIVEMFVPTFASLWFGAAAIIVAALTWLLPISISVQIIIWLLLSAIFLLAWFKFIKPLSVDRTKAGLGGSVIVGETGMIIVQPQADRAGMVRFSVPIVGAAEWMCRTRGEQVAVGDRVVVTDIIGNELIVSSMNSRTAVSQNTPV

SEQ ID NO: 19593 - DNA, 441 bp, Dechloromonas aromatica RCB
  CDS (1)..(441): transl_table=11
atgcatcctgaatggtggcactgggttgtcggcggcatcgtgctggttctcgccgaactgatcatcccctcgttcttcatcgtctggtttggtttgggcgccctgctcgtcggacttctggccctggctttcgacctctcgctgactgcccagctggcgacctggaccattgcttcgctggccatggtcgtgctgtggttccgcgtcttcaagcaaagtttcgtcaagacccgctcgggtacggccgatggtgaggccatcggcgaaatcggtctgctggtcagtgccgtcgctcctttcgagcgcggcaaggttcgttttcaacggccgatcctcggctccgaggaatgggtttgcctgtcggacaccgccatcgcggcgggcgagcgggtcaaggtgacggccgtcgagggtagtttcgtcaaggtcagcaaggcttag

SEQ ID NO: 19594 - protein, 146 aa, Dechloromonas aromatica RCB
MHPEWWHWVVGGIVLVLAELIIPSFFIVWFGLGALLVGLLALAFDLSLTAQLATWTIASLAMVVLWFRVFKQSFVKTRSGTADGEAIGEIGLLVSAVAPFERGKVRFQRPILGSEEWVCLSDTAIAAGERVKVTAVEGSFVKVSKA

SEQ ID NO: 19595 - DNA, 444 bp, Haemophilus somnus 129PT
  CDS (1)..(444)
atggaatggtttgacgcttggacattttggcattggctgattttaggttttttattattgattgcagagataattgttccgggcgtttttttattatggtggggtttagccgctattattgtttcaatgatcaccatcattattgatttatctctgactatacagtgcgttatttatggcatcttagcaatagtgttgagtgtcgcatggtggaaatatcaacatactaaagatgaaaaagatcaggcaaattcttctttaaaccggcgagatcacgccatgttgggatgtcgaggtaaggttgaagtgatagccgaaaatggcattggtcgaggtgtttttggcgataccacttggcgtattcaaggtaaagggttgcaacaaggggatattattgaagttcaagctgtgaatggaattacgttgattgttcaaaaaaaataa

SEQ ID NO: 19596 - protein, 147 aa, Haemophilus somnus 129PT
MEWFDAWTFWHWLILGFLLLIAEIIVPGVFLLWWGLAAIIVSMITIIIDLSLTIQCVIYGILAIVLSVAWWKYQHTKDEKDQANSSLNRRDHAMLGCRGKVEVIAENGIGRGVFGDTTWRIQGKGLQQGDIIEVQAVNGITLIVQKK

SEQ ID NO: 19597 - DNA, 444 bp, Haemophilus somnus 2336
  CDS (1)..(444)
atggaatggtttgacgcttggacattttggcattggctgattttaggttttttattattgattgcagagataattgttccaggcgtttttttattatggtggggtttagccgctattattgtttcaatgatcaccatcattattgatttatctctgactatacagtgcgttatttatggcatcttagcaatagtgttgagtgtcgcatggtggaaatatcaacatactaaagatgaaaaagatcaggcaaattcttctttaaaccggcgagatcacgccatgttgggatgtctaggtaaggttgaagtgatagccgaaaatggcattggtcgaggtgtttttggcgataccacttggcgtattcaaggtaaagggttgcaacaaggggatattattgaagttcaagctgtgaatggaattacgttgatcgttcaaaaaaaataa

SEQ ID NO: 19598 - protein, 147 aa, Haemophilus somnus 2336
MEWFDAWTFWHWLILGFLLLIAEIIVPGVFLLWWGLAAIIVSMITIIIDLSLTIQCVIYGILAIVLSVAWWKYQHTKDEKDQANSSLNRRDHAMLGCLGKVEVIAENGIGRGVFGDTTWRIQGKGLQQGDIIEVQAVNGITLIVQKK

SEQ ID NO: 19599 - DNA, 453 bp, Pseudomonas aeruginosa UCBPP-PA14
  CDS (1)..(453)
atggaaatcctgctgctacgcctggacttctgggactggctggccttcggtaccgtcctcctgctcctggaaatcttcggtgccggcggctatctgctgcgggtcggcctcaccgccgcttgtgtcggtgcgctcggcgcgctcctgccgggactggcctggccctggcaggtagggctgttcgtcctgctctccgggctggtcgccgccttgcatcgacgccgtcgccgcaaggccggtagcgtcgaggaaacgccagggttgcagcgacgcggcgacgacctgttcggccgcacctttcccttgcaccgggcgatcgtcggcgggctcggcgagctgcgcgtcgaggacgcgttatggctggtcagcggtcccgacctgccgcgcggcgccctggtccgggtcaccggccaggacggcgccctgctgcacgtcgagcctgccgctccctga

SEQ ID NO: 19600 - protein, 150 aa, Pseudomonas aeruginosa UCBPP-PA14
MEILLLRLDFWDWLAFGTVLLLLEIFGAGGYLLRVGLTAACVGALGALLPGLAWPWQVGLFVLLSGLVAALHRRRRRKAGSVEETPGLQRRGDDLFGRTFPLHRAIVGGLGELRVEDALWLVSGPDLPRGALVRVTGQDGALLHVEPAAP

SEQ ID NO: 19601 - DNA, 495 bp, Psychrobacter sp. 273-4
  CDS (1)..(495)
atggagacgctttggatgatagaaccttggcattggctggtattgggctttttgttattgattgtcgagatgtttgtgccaacctttgctagcctttggtttggtgctgctgccatcatagtggctgcgcttacatggctgttgcctatctctatctccgtacaaattattatctggttactcctctccgctatattcttgctggcatggtttaaatttatcaaacctttatctgtagatcgtaccaaagcaggacttggtggcagtgtgatcgtcggtgaaacaggtatgattattgtgcagccacaggcagatagagcaggtatggtacgttttagtgtccctattgtgggtgccgctgaatggatgtgccgtacccgtggtgagcaagtggcagtcggtgatcgagtggtggtgacagatatcattggtaatgagctgattgtgagtagtatgaattcaagaacggctgtgagccaaaatacgcccgtataa

SEQ ID NO: 19602 - protein, 164 aa, Psychrobacter sp. 273-4
METLWMIEPWHWLVLGFLLLIVEMFVPTFASLWFGAAAIIVAALTWLLPISISVQIIIWLLLSAIFLLAWFKFIKPLSVDRTKAGLGGSVIVGETGMIIVQPQADRAGMVRFSVPIVGAAEWMCRTRGEQVAVGDRVVVTDIIGNELIVSSMNSRTAVSQNTPV

SEQ ID NO: 19603 - DNA, 471 bp, Erythrobacter litoralis HTCC2594
  CDS (1)..(471): transl_table=11
atgttcgacggcatcgaaccctattgggtatgggtgatcatcgggctggtgctggccgccctcgagatcctcgtacccggcgtctacctcatctggctggccgtggcggcgctgctcaccggcctgctgactttcgtgttcgatccgggcctgccgctgcagatcgtcaacttcgtcttcatcgccctgatcgccgctttcagcgccaagcgaatcctgcgcgatcgcccgatcgccagcgccgatccgctgatgaacaagcgcggcggacggctggtcggcgagacggcaatcgtggtgcaggccttcgaaggcggcaccggccgtatccatatcggcgacggcgactggctggccaagggcgtcgatctcgaaatcggcgagcgtgtgcgcgtcaccggccatgaaggcgcgatcctgctggtcgaaccgatgaacctgatcgaaaacacgccgcgcggcgagagctga

SEQ ID NO: 19604 - protein, 156 aa, Erythrobacter litoralis HTCC2594
MFDGIEPYWVWVIIGLVLAALEILVPGVYLIWLAVAALLTGLLTFVFDPGLPLQIVNFVFIALIAAFSAKRILRDRPIASADPLMNKRGGRLVGETAIVVQAFEGGTGRIHIGDGDWLAKGVDLEIGERVRVTGHEGAILLVEPMNLIENTPRGES

SEQ ID NO: 19605 - DNA, 447 bp, Sphingopyxis alaskensis RB2256
  CDS (1)..(447): transl_table=11
atgcccgactggctgaccaatatggagccgcattgggcgtggctgtcgctcggcgtgctgcttgccgccgccgaaatcgttgcgccgggcttcttcctcatctggatcggcgctgcggcgatcgtcaccggggtcatcgcctgggttgtgccgctcagcgtccctttccagctcggcatttttgccctgctgtccttcgtcgcgctctatggcgggcgccgctggctccggatgaacccgatcacgacgaccgacccccacctcaaccagcgcggcggccgcctcgtcggcgaggtgctgacggtgacgaaggcgatcgaggacggccgcggccgcgtgcgtgtcggcgatggcgaatggccggtgcgcggccccgacgccgccgagggcgcgaaggtgcgcgtggtgagcgccgacggcggggtgctggtggtcgagctggcgtaa

SEQ ID NO: 19606 - protein, 148 aa, Sphingopyxis alaskensis RB2256
MPDWLTNMEPHWAWLSLGVLLAAAEIVAPGFFLIWIGAAAIVTGVIAWVVPLSVPFQLGIFALLSFVALYGGRRWLRMNPITTTDPHLNQRGGRLVGEVLTVTKAIEDGRGRVRVGDGEWPVRGPDAAEGAKVRVVSADGGVLVVELA

SEQ ID NO: 19607 - DNA, 447 bp, Magnetococcus sp. MC-1
  CDS (1)..(447): transl_table=11
atgacactgtttgctgatattgccccccattgggcgtgggcgattgtggggttggtgctgattgggctggagatgtttgtctggagcacttttttgctgtggatgggtctttcggcttttgtagtgggggccattttttacgttgctccagattttccttgggcgtggtcggtggtgctctatggggttttatccctggtcgccatctatttggggcgcaaactgtttaagcctgcccaagcggatgacccagacgccttaaatgagcgtggtcagcgcatggtggggcagagctatgtggtggctgaagcgattgtgcatggccgtggcaaggtgcgggtgggggattccctctggctggcccagggggcggattgtccagcgggtacggtggtcacggtgacgtcggttaaaagcaccacccttatggtaacgttagcggagtag

SEQ ID NO: 19608 - protein, 148 aa, Magnetococcus sp. MC-1
MTLFADIAPHWAWAIVGLVLIGLEMFVWSTFLLWMGLSAFVVGAIFYVAPDFPWAWSVVLYGVLSLVAIYLGRKLFKPAQADDPDALNERGQRMVGQSYVVAEAIVHGRGKVRVGDSLWLAQGADCPAGTVVTVTSVKSTTLMVTLAE

SEQ ID NO: 19609 - DNA, 462 bp, Mesorhizobium sp. BNC1
  CDS (1)..(462): transl_table=11
atgctgatgagttttctcaccgatctcgggccgtggaactggatgctcctcggctttatccttcttgtgcttgagatcatcctcccaggggtcttcctgctctggataggcatcgcagcggtcctcaccggagcgctatcgctgcagctatgggacgtaagcttctggacctggcaggtgcaggtgctggttttcctcgccctatcgcttgtttccgcctttatcggcaagcgcgtgaccgatgcgcgccgcgaagaggacacggacgagcctctgctcaaccgccgggcggaacagctcgtcggccgcacagccgcccttgaagagccgatcagcggcggttacggccgcattcgcctgggcgacaccacgtggcgcgtgaccgggcccgacctgccggctggcacccgtgttcgcgtcgtctcggcgagaggcggcgatttacacgtggaaaaggaatag

SEQ ID NO: 19610 - protein, 153 aa, Mesorhizobium sp. BNC1
MLMSFLTDLGPWNWMLLGFILLVLEIILPGVFLLWIGIAAVLTGALSLQLWDVSFWTWQVQVLVFLALSLVSAFIGKRVTDARREEDTDEPLLNRRAEQLVGRTAALEEPISGGYGRIRLGDTTWRVTGPDLPAGTRVRVVSARGGDLHVEKE

SEQ ID NO: 19611 - DNA, 417 bp, Xylella fastidiosa Dixon
  CDS (1)..(417): transl_table=11
atgggatgggccgccgccgcactgctattgctcgctgccgaaacactgatacctggagcgttcatgctatggatggggattgcagcagcagctatgttcgtcggcgtgctgctgctcccggatacttcactgctactgcaaatgttcgcttttgttgttcttagcttcgtttcaatctatctctaccggacttggttccgcagtgtcgatcatgacagtgaccatccgctgctaaatcgccgtgctgatcagctagtcggtcgtatcatcatccttgatcacgctatcgttgacggcaacgctcgaatcaaaatagacgacacattttgggatatcactggtcctgatttacccatcggcactcaaatccgtatcgttgctttagatggcgcaacactcaaggtacaccccacttaa

SEQ ID NO: 19612 - protein, 138 aa, Xylella fastidiosa Dixon
MGWAAAALLLLAAETLIPGAFMLWMGIAAAAMFVGVLLLPDTSLLLQMFAFVVLSFVSIYLYRTWFRSVDHDSDHPLLNRRADQLVGRIIILDHAIVDGNARIKIDDTFWDITGPDLPIGTQIRIVALDGATLKVHPT

SEQ ID NO: 19613 - DNA, 498 bp, Psychrobacter cryohalolentis K5
  CDS (1)..(498): transl_table=11
atgatggagactctttggatgattgaaccttggcattggctagtattaggcttttcgctgctgatagtcgagatgtttgtgccaacctttgctagcctttggtttggtgccgctgctatcatagtggctgcgcttgcatggcttctgcctgtttcggtatccgtacaaatcattatctggttactcctctccgccatctttttgctggcatggtttaagtttatcaaacctttatcggttgatcgtactaaagcaggacttggtggcagtgtgatcgttggtgaaacaggtatgattattgcgcagccgcagccagatagggcgggcatggtgcgttttaatgtgcctattgtgggtgccactgaatggatgtgccgtactcgaggtgagcaagtggcagtcggtgatcgagtagtggtaacagatatcgttggtaacgagctgattgtgagtagcatgacatcgaaggcagctgtgaaccaaaatatgcgcgtataa

SEQ ID NO: 19614 - protein, 165 aa, Psychrobacter cryohalolentis K5
MMETLWMIEPWHWLVLGFSLLIVEMFVPTFASLWFGAAAIIVAALAWLLPVSVSVQIIIWLLLSAIFLLAWFKFIKPLSVDRTKAGLGGSVIVGETGMIIAQPQPDRAGMVRFNVPIVGATEWMCRTRGEQVAVGDRVVVTDIVGNELIVSSMTSKAAVNQNMRV

SEQ ID NO: 19615 - DNA, 417 bp, Xylella fastidiosa Ann-1
  CDS (1)..(417): transl_table=11
atgggatgggcagctgccgcactgctattgctcgctgccgaaacactgatacctggagcgttcatgctatggatggggattgcagcagcagctgtgttcgtcggcgtgctgctgctcccggatacttcactgctactgcaaatgttcgcttttgttgttcttagcttcgtttcaatctatctctaccggacttggttccgccgtgtcgatcatgacagtgaccatccgctgctaaatcgccgtgctgatcagctagtcggtcgtatcatcatccttgatcacgctatcgttgacggcaacgctcgaatcaaaatagacgacacattttgggatatcactggtcctgatttacccatcggcactcaaatccggatcgttgctttagatggcacaacactcaaggtacaccccacttaa

SEQ ID NO: 19616 - protein, 138 aa, Xylella fastidiosa Ann-1
MGWAAAALLLLAAETLIPGAFMLWMGIAAAAVFVGVLLLPDTSLLLQMFAFVVLSFVSIYLYRTWFRRVDHDSDHPLLNRRADQLVGRIIILDHAIVDGNARIKIDDTFWDITGPDLPIGTQIRIVALDGTTLKVHPT

SEQ ID NO: 19617 - DNA, 447 bp, Nitrobacter winogradskyi Nb
  CDS (1)..(447)
atgatcgacctgttggcgtcgctgggaaactggaactggctgatcctgggtctcgttctggtgggtcttgaactgctgacgccgggtgtcttcctgttctggctcggactggcggcatttctggtcggcgcgctgtcgttcgtggtggatccgacgtggcaaacgcaactcctgatgtttgccgtgttcgcggccgctgcggtgccgttatggcgtcggatggcgcgtcgggagtcgagcggcgccgccagcccgttcctcaaccggcgcgccgaagcgttggttggccgcgtgttcacgctggagaggccgatcgtggacgggacgggcacggtgcggatcgacgacacgatctggcgggtcgcgggaccggatgcgccagcggggagccgggtgaaagtcgtgaaggcggacggcgcgagcctcaccgtggccacggagccgtag

SEQ ID NO: 19618 - protein, 148 aa, Nitrobacter winogradskyi Nb
MIDLLASLGNWNWLILGLVLVGLELLTPGVFLFWLGLAAFLVGALSFVVDPTWQTQLLMFAVFAAAAVPLWRRMARRESSGAASPFLNRRAEALVGRVFTLERPIVDGTGTVRIDDTIWRVAGPDAPAGSRVKVVKADGASLTVATEP

SEQ ID NO: 19619 - DNA, 438 bp, uncultured bacterium 578
  CDS (1)..(438)
atggaaatgatatttgaaaatttaaactatatgcattggctcgtccttggtcttgctctagtaattattgaactctttttatggtcagtatttctgctctggattggggcttcagcaatcaccgtaagtattattttctatcttgcttctagcacctctggtgctatgcagttgctgatttttgttttaatatcaatatctgtaacctatttggcaatgaaatactaccccattaagacggttgatgacgagctcaataataaggctaagtcacatattggtaaagagtgtgaggtaatgtcaattaaaaatggtattgctaaggttcagataggcaagtcactttggtttgcaaagggtttagatcttaatgttggtcaaatagttcaaattgttgatgttgagtcttcaacgtttattgtcaagccatccaagtag

SEQ ID NO: 19620 - protein, 145 aa, uncultured bacterium 578
MEMIFENLNYMHWLVLGLALVIIELFLWSVFLLWIGASAITVSIIFYLASSTSGAMQLLIFVLISISVTYLAMKYYPIKTVDDELNNKAKSHIGKECEVMSIKNGIAKVQIGKSLWFAKGLDLNVGQIVQIVDVESSTFIVKPSK

SEQ ID NO: 19621 - DNA, 24 bp, Artificial sequence
  (1)..(24): primer
atggagttaatggtcgttcatcca

SEQ ID NO: 19622 - DNA, 23 bp, Artificial sequence
  (1)..(23): primer
ttaagacgagacggctcggatat

SEQ ID NO: 19623 - protein, 147 aa, Artificial sequence
  Variant (2)..(4): xaa in position 2 to 4 is any amino acid
  Variant (6)..(6): xaa in position 6 is any amino acid
  Variant (10)..(11): xaa in position 10 to 11 is any amino acid
  Variant (14)..(18): xaa in position 14 to 18 is any amino acid
  Variant (20)..(20): xaa in position 20 is any amino acid
  Variant (21)..(21): xaa in position 21 is any or no amino acid
  Variant (24)..(24): xaa in position 24 is any amino acid
  Variant (27)..(27): xaa in position 27 is any amino acid
  Variant (29)..(33): xaa in position 29 to 33 is any amino acid
  Variant (35)..(42): xaa in position 35 to 42 is any amino acid
  Variant (43)..(48): xaa in position 43 to 48 is any or no amino acid
  Variant (50)..(52): xaa in position 50 to 52 is any amino acid
  Variant (54)..(55): xaa in position 54 to 55 is any amino acid
  Variant (58)..(81): xaa in position 58 to 81 is any amino acid
  Variant (82)..(90): xaa in position 82 to 90 is any or no amino acid
  Variant (94)..(97): xaa in position 94 to 97 is any amino acid
  Variant (99)..(102): xaa in position 99 to 102 is any amino acid
  Variant (103)..(106): xaa in position 103 to 106 is any or no amino acid
  Variant (108)..(112): xaa in position 108 to 112 is any amino acid
  Variant (114)..(117): xaa in position 114 to 117 is any amino acid
  Variant (119)..(124): xaa in position 119 to 124 is any amino acid
  Variant (125)..(128): xaa in position 125 to 128 is any or no amino acid
  Variant (130)..(131): xaa in position 130 to 131 is any amino acid
  Variant (133)..(134): xaa in position 133 to 134 is any amino acid
  Variant (136)..(136): xaa in position 136 is any amino acid
  Variant (138)..(141): xaa in position 138 to 141 is any amino acid
  Variant (143)..(144): xaa in position 143 to 144 is any amino acid
  Variant (146)..(146): xaa in position 146 is any amino acid
WXXXGXLLLXXELXXXXXFXXLWXGLXAXXXXXLXXXXXXXXXXXXXXQXXXFXXLSXXXXXXXXXXXXXXXXXXXXXXXXXXXXXXXXXLVGXXXXLXXXXXXXXGXXXXXVXXXXWXXXXXXXXXXLXXGXXVXVXXXXGXXLXV

SEQ ID NO: 19624 - protein, 29 aa, Artificial sequence
  Variant (2)..(7): xaa in position 2 to 7 is any amino acid
  Variant (8)..(9): xaa in position 8 to 9 is any or no amino acid
  Variant (11)..(11): xaa in position 11 is any amino acid
  Variant (12)..(13): xaa in position 12 to 13 is any or no amino acid
  Variant (15)..(15): xaa in position 15 is any amino acid
  Variant (16)..(16): xaa in position 16 is Phe, Ile, Leu or Val
  Variant (17)..(18): xaa in position 17 to 18 is any amino acid
  Variant (19)..(19): xaa in position 19 is Ala, Gly, Asn, Ser or Thr
  Variant (20)..(22): xaa in position 20 to 22 is any amino acid
  Variant (23)..(23): xaa in position 23 is Phe, Ile, Leu or Val
  Variant (25)..(25): xaa in position 25 is any amino acid
  Variant (26)..(26): xaa in position 26 is Ala or Gly
  Variant (27)..(27): xaa in position 27 is Ala, Ile, Leu or Val
  Variant (28)..(28): xaa in position 28 is Ala, Gly or Ser
WXXXXXXXXLXXXEXXXXXXXXXWXXXXA

SEQ ID NO: 19625 - protein, 29 aa, Artificial sequence
  Variant (2)..(5): xaa in position 2 to 5 is any amino acid
  Variant (6)..(6): xaa in position 6 is Ala, Ile, Leu or Val
  Variant (7)..(12): xaa in position 7 to 12 is any amino acid
  Variant (14)..(19): xaa in position 14 to 19 is any amino acid
  Variant (20)..(20): xaa in position 20 is any or no amino acid
  Variant (22)..(22): xaa in position 22 is any amino acid
  Variant (23)..(24): xaa in position 23 to 24 is any or no amino acid
  Variant (26)..(26): xaa in position 26 is any amino acid
  Variant (27)..(27): xaa in position 27 is Ala, Ile or Val
  Variant (28)..(28): xaa in position 28 is any amino acid
  Variant (29)..(29): xaa in position 29 is Ala, Cys, Gly, Ser or Thr
GXXXXXXXXXXXGXXXXXXXDXXXWXXXX

SEQ ID NO: 19626 - DNA, 1242 bp, Escherichia coli K12
  CDS (1)..(1242): transl_table=11
gtgtctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccgagcatctctatcgcgactgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgtgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatctaa

SEQ ID NO: 19627 - protein, 413 aa, Escherichia coli K12
MSKRRVVVTGLGMLSPVGNTVESTWKALLAGQSGISLIDHFDTSAYATKFAGLVKDFNCEDIISRKEQRKMDAFIQYGIVAGVQAMQDSGLEITEENATRIGAAIGSGIGGLGLIEENHTSLMNGGPRKISPFFVPSTIVNMVAGHLTIMYGLRGPSISIATACTSGVHNIGHAARIIAYGDADVMVAGGAEKASTPLGVGGFGAARALSTRNDNPQAASRPWDKERDGFVLGDGAGMLVLEEYEHAKKRGAKIYAELVGFGMSSDAYHMTSPPENGAGAALAMANALRDAGIEASQIGYVNAHGTSTPAGDKAEAQAVKTIFGEAASRVLVSSTKSMTGHLLGAAGAVESIYSILALRDQAVPPTINLDNPDEGCDLDFVPHEARQVSGMEYTLCNSFGFGGTNGSLIFKKI

SEQ ID NO: 19628 - DNA, 1212 bp, Caenorhabditis elegans
  CDS (1)..(1212)
atgcaccgtgttgttataacagggatgggtgcaatttcaccattcggtgttaccgttaatgcactacgaaacggtttgaacgagggaagaagtggcttgaaatacgatgaaattctcaaatttgtcgtcggtgcagttcctggagaacgggtggaagatcggtggagcactggacaacaaagagaaatgagtaaagcgagcatgttcgtgttagctgcatcagaagaagcattgaaacaggcaaaagctgaagatgtcgatcacaatgaaacattagttaatattggaacatgtatgtcagatctagaacatattggagaaactgcacaaaaagtgtcggaaggacaatcgagaagggtgtcaccatactttgttccgcgaattttgaataatcttccagctggatatgttgcaatgaaatataaaatgcgtggaggagtagaatcaacatcaactgcatgtgccactggacttcattgcattggaaactcatttcgatctattcgatacggagattctcgacgagctctggcaggagctgtagaatgtgctctcaatccaattgctctagctggttttgatagaatgagagcattggcaagaggtgatcaaccaaatattagtagacctttcgataagaaaagagctggatttgtaatgagtgaaggtgttggattagtatttatggaacgactagaagatgcacaggcacgtggagcacagattttagctgaagttgttggatatggaatatcatctgattgttatcatatttctacacctgatccatctgcaattggtgcagttctttcaatgaacagagcgataggaaatgcacatttggagccgaaagatattggatatgtaaatgctcatgcaacatcaacaccaaatggggatagtgtagaagcagaagctgtacgacaagtatttccagaacaaaatattgcagtgagcagtgtcaaaggacatattggacatcttcttggtgcagctggatcagttgaagcaattgcaacgatttttgcaatgaatgatgatgttttaccagcgaatcgaaatttagaagaaactgatgaaggaaatggattgaatcttctccgcgaaaatcaaaaatggtctgatgtttccggaaataaatcgcgaatctcaatttgtaattcatttggattcggtgccacaaatgctagtcttattttgaaacagttttga

SEQ ID NO: 19629 - protein, 403 aa, Caenorhabditis elegans
MHRVVITGMGAISPFGVTVNALRNGLNEGRSGLKYDEILKFVVGAVPGERVEDRWSTGQQREMSKASMFVLAASEEALKQAKAEDVDHNETLVNIGTCMSDLEHIGETAQKVSEGQSRRVSPYFVPRILNNLPAGYVAMKYKMRGGVESTSTACATGLHCIGNSFRSIRYGDSRRALAGAVECALNPIALAGFDRMRALARGDQPNISRPFDKKRAGFVMSEGVGLVFMERLEDAQARGAQILAEVVGYGISSDCYHISTPDPSAIGAVLSMNRAIGNAHLEPKDIGYVNAHATSTPNGDSVEAEAVRQVFPEQNIAVSSVKGHIGHLLGAAGSVEAIATIFAMNDDVLPANRNLEETDEGNGLNLLRENQKWSDVSGNKSRISICNSFGFGATNASLILKQF

SEQ ID NO: 19630 - DNA, 1329 bp, Saccharomyces cerevisiae
  CDS (1)..(1329)
atgtcaagaagagtggttatcacaggattgggctgtgtaacgccgttgggaagatcattaagtgagtcatgggggaatctgctctcttccaaaaatggactcacaccaatcacatctttgcccaactataatgaggactacaaactcagagaaaaaagtatcccatcaacgataacagtggggaagattccagagaattttcaaaacgaaaattcagccatcaataaactgctgttcactagccaggatgagagaagaacctcaagctttatcaagctagcactacgtacaacttatgaagcgcttcacaatgctggtctcttgaacccaaatgatataaccatcaatacatctctgtgcaatctggatcactttggttgcctgataggttctggtataggatccattcaagacatataccaaacttctctacaattccataacgacaataaaagaataaatccatatttcgtccctaaaatccttacaaatatggcagctggtaatgtttccatcaagtttaaccttagaggattatcccatagtgtttccacagcatgcgcaacaggtaataactccattggcgatgcattcaattttattcggttaggcatgcaagacatctgtgtcgccggtgcaagtgaaacgagtttgcatccgttaagtttagcaggtttcatcagagcaaagtcgattactacaaacgggatctctagaccctttgatacacaacgttctggattcgtacttggtgaaggatgcggaatgattgtcatggaatcgctagaacatgctcaaaagagaaatgcaaacataatttctgagctcgtgggctatggtttaagcagtgatgcctgccatattacctcccctcctgctgatggaaatggtgccaaaagagcaatagagatggctctaaaaatggctagattagaaccaactgatgttgactacgtcaatgcacatgctacatcaactttactaggcgataaagcagagtgtctggcagtagcctcagcactcttaccaggaagatccaaaagcaagccactgtacatatccagtaacaaaggtgcaattggccatcttttaggtgcacgtggcgccgtagaaagtatatttacaatttgttccttgaaggatgataagatgccgcataccttaaacctggacaatgttctgactctagaaaataacgaggccgataagctacatttcataagagacaaacctattgtgggagctaatccgaagtacgcattatgcaacagcttcggatttggaggagttaacacatctcttctcttcaagaaatgggaagggagttaa

SEQ ID NO: 19631 - protein, 442 aa, Saccharomyces cerevisiae
MSRRVVITGLGCVTPLGRSLSESWGNLLSSKNGLTPITSLPNYNEDYKLREKSIPSTITVGKIPENFQNENSAINKLLFTSQDERRTSSFIKLALRTTYEALHNAGLLNPNDITINTSLCNLDHFGCLIGSGIGSIQDIYQTSLQFHNDNKRINPYFVPKILTNMAAGNVSIKFNLRGLSHSVSTACATGNNSIGDAFNFIRLGMQDICVAGASETSLHPLSLAGFIRAKSITTNGISRPFDTQRSGFVLGEGCGMIVMESLEHAQKRNANIISELVGYGLSSDACHITSPPADGNGAKRAIEMALKMARLEPTDVDYVNAHATSTLLGDKAECLAVASALLPGRSKSKPLYISSNKGAIGHLLGARGAVESIFTICSLKDDKMPHTLNLDNVLTLENNEADKLHFIRDKPIVGANPKYALCNSFGFGGVNTSLLFKKWEGS

SEQ ID NO: 19632 - DNA, 1380 bp, Homo sapiens
  CDS (1)..(1380)
atgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaaggtcagttcaatgaacaaaactttgtgtccaaatcagatatcaagtccatgtcttctcccaccatcatggccattggggctgcagaattagccatgaaggattctggctggcatcctcagtcagaagctgatcaagtggctactggtgttgcaattggcatgggaatgattcctcttgaagttgtttctgaaactgctttgaattttcagacaaaaggttacaataaagttagcccattttttgtccctaagattctggtcaatatggcagcaggccaggtcagcattcgatataaactcaagggcccaaatcatgcagtatccacagcctgtaccacaggagctcatgctgtgggagactcatttagatttatagcccatggtgatgctgatgtgatggtggctggaggtacagattcttgtattagccctttatctcttgctgggttttccagagcccgggctctgagcacaaactcagatcccaagttggcatgtcgaccatttcatccaaagagagatggttttgtaatgggagaaggtgcagctgtgctggtgctggaagaatatgaacatgctgttcaaagaagagcccggatctatgcagaagttttgggctatggactctcaggtgatgctggtcacataactgcccctgatcctgaaggagaaggtgccttaaggtgtatggctgctgctttaaaagatgcaggtgtgcagcctgaggagatatcctatatcaatgcacatgctacttccacaccattgggagatgctgctgaaaacaaagctatcaaacatctcttcaaagaccatgcatatgcccttgcagtttcctcaactaagggagcaacaggacatctgctgggagctgcaggggcagtcgaggcagcttttaccacattagcttgttattatcaaaaactaccacctactttaaacctggattgttcggaaccagaatttgatctcaactatgttccactaaaggcacaggaatggaaaactgagaaaagatttattggcctcaccaattcctttggttttggtggtactaatgcaacactttgtattgctggactgtag

SEQ ID NO: 19633 - protein, 459 aa, Homo sapiens
MSNCLQNFLKITSTRLLCSRLCQQLRSKRKFFGTVPISRLHRRVVITGIGLVTPLGVGTHLVWDRLIGGESGIVSLVGEEYKSIPCSVAAYVPRGSDEGQFNEQNFVSKSDIKSMSSPTIMAIGAAELAMKDSGWHPQSEADQVATGVAIGMGMIPLEVVSETALNFQTKGYNKVSPFFVPKILVNMAAGQVSIRYKLKGPNHAVSTACTTGAHAVGDSFRFIAHGDADVMVAGGTDSCISPLSLAGFSRARALSTNSDPKLACRPFHPKRDGFVMGEGAAVLVLEEYEHAVQRRARIYAEVLGYGLSGDAGHITAPDPEGEGALRCMAAALKDAGVQPEEISYINAHATSTPLGDAAENKAIKHLFKDHAYALAVSSTKGATGHLLGAAGAVEAAFTTLACYYQKLPPTLNLDCSEPEFDLNYVPLKAQEWKTEKRFIGLTNSFGFGGTNATLCIAGL

SEQ ID NO: 19634 - DNA, 1380 bp, Mus musculus
  CDS (1)..(1380)
atgttgtcaaaatgcttgcaacattttctaaaagccacaatctcccatccatatccagcgtcatattcttggttaataagcaaacacagattttatggaactgtgccagcagccatgttgcgcagacgagttgtcatcacaggcattggcctagtgacaccacttggcgttgggactcaactagtttgggatcggcttctccgaggagaaagtggaattgtttctgtggttggtgatgagtacaagaatatcccttgcagtgtagctgcttatgtaccaagaggtccacatgaaggtcagtttaatgaagaaaactttgtgtccaaatcagatgccaagtccatgtcttcttccaccatcatggctgttggggcagcagagttggccctgaaagactccggctggcatccgaaacgagaagcagatcaggtggctactggcgttgccattggcatgggcatggttcctcttgaagttatttctgaaactgctttgctgtttcagaccaaaggttataataaagtcagcccattctttgtccctaagattctgatcaatatggctgcaggccaggttagcattcgctacaaactcaagggccccaatcactcagtgtccacagcctgcaccacaggtgcacatgctgtgggagactcctttagattcatagcccatggtgacgcagatgtgatggtggctgggggcacagactcttgcattagtccattatctctcgctgggttttccagagcccgggctctgagctcaaacccagatcctaagctagcctgccggccgtttcatccagagagagatggttttgtcatgggtgagggagctgctgtgctggtgctggaagaacatgagcatgctgttcagagaggagctcggatctacgcagaaattttgggttatggactctcgggtgatgccggtcacataactgcccccgatcccgaaggagaaggtgctttaagatgcatggctgctgctgtaaaagatgcaggcgtatcacctgagcagatatcctatgtcaacgcacatgccacttccacaccactgggtgatgccgctgagaacagagccatcaagaggctctttagggaccatgcttgtgcccttgccatatcctccacgaagggagccactgggcatcttctgggtgctgcaggggcagttgaggcaacttttactgcactggcttgttaccaccagaaactcccaccaactttaaacctggattgtacagagcctgaatttgatctcaattatgttccactggagtcacaggaatggaaagctgagggtcggtgtattggactcaccaattcctttgggtttggtggtactaatgcaactctttgtattgctggcatgtaa

SEQ ID NO: 19635 - protein, 459 aa, Mus musculus [sequence omitted]

SEQ ID NO: 19636 - DNA, 1302 bp, Mesorhizobium loti MAFF303099
  CDS (1)..(1302): transl_table=11
atgcgacggattgttgttacaggcatgggagcggtcacgcccctagctgccaatgtcgaagcgtcatggtcgcgtctgctggccggtcgttcgggcatccgtaggcttccggacgatgtggtgggagacctgccggcgaagattggcggcgtggtgccctccttggatgaagatccgggcgctggtttcgatcctgatggcatcctggctgcgaaggatcagcgcagggtagatcggtttattctctttgcgctggcggcggcggaagaggcgcttgcacaggcgaaatggaagcctgccttggagacggatcgcctgcgcacagcaacgattatcgcttcaggggtcggcggattccccgccatcaccgaggcggtgcgcacggtcgatctgcgtggcgcccgccgcctgtcgcccttcacggtgccgtccttcctggtgaacctcgcagcgggccacatctcgatccgtcatggcttcaaaggcccattgggcgcaccagtgacagcgtgcgcggccggcatccaggcgatcggcgacgccgcccgtctcatccgcgcgaacgaggctgatattgccgtgtgcgggggcacggaagcatgcatgaacaccgtcagtctcggtgggtttgctgccgcacgctccctttcaaccggcttcaattgggcgccggctcaagcctcacgtcccttcgacatttcgcgggacggcttcgtcatgggcgaaggcgccggcgtgctggtcatcgaggcgttgggccacgcgctggcgcgcggcgcaaaaccgctcgccgagctcgtcggctacggaacgacggccgatgcttatcacgtcacttctggtcccgaggacggcggcggtgcgcgccgggccatggagatcgcgattgcgcaagcagggatttcaccgagcgaggttcgtcatctcaatgcacatgcgacctccacgccagtcggcgacctgggtgaaatcgaagcgatcaagagcgtattcgggcgcgatttagcgatagctgtcagcgcaacgaaatccgcgaccgggcacctgctgggcgcggccggcgggcttggtgccatcttctcgatcctggcgatcagggaccaggtggcaccgccgacactcaatttgagcgcacccgatccggccgccgacggcatcgacttcgtcgcaaacgagccccggccaatggagatggaatacgcaatctccaatggcttcggttttggcggcgtgaatgccagcgccttgttcaggcgctggatcgccccggcggcccgacgcgagcgccaggggcagtcatga

SEQ ID NO: 19637 - protein, 433 aa, Mesorhizobium loti MAFF303099
MRRIVVTGMGAVTPLAANVEASWSRLLAGRSGIRRLPDDVVGDLPAKIGGVVPSLDEDPGAGFDPDGILAAKDQRRVDRFILFALAAAEEALAQAKWKPALETDRLRTATIIASGVGGFPAITEAVRTVDLRGARRLSPFTVPSFLVNLAAGHISIRHGFKGPLGAPVTACAAGIQAIGDAARLIRANEADIAVCGGTEACMNTVSLGGFAAARSLSTGFNWAPAQASRPFDISRDGFVMGEGAGVLVIEALGHALARGAKPLAELVGYGTTADAYHVTSGPEDGGGARRAMEIAIAQAGISPSEVRHLNAHATSTPVGDLGEIEAIKSVFGRDLAIAVSATKSATGHLLGAAGGLGAIFSILAIRDQVAPPTLNLSAPDPAADGIDFVANEPRPMEMEYAISNGFGFGGVNASALFRRWIAPAARRERQGQS

SEQ ID NO: 19638 - DNA, 1263 bp, Mesorhizobium loti MAFF303099
  CDS (1)..(1263): transl_table=11
atgaggcgtgtcgtcgtcacgggccttgggttgttgtcgccattcggcatgggcttcgagcacagctggaaggaacttctgaccggccgcagcgcggccaagcgcatcaccgagttcgaggtggaggatcttgcctgcaagatcgcccacgtcgttccgcgtggtgacggcagcaatgccaccttcaatcctgaatccgtgctcgagccgaaggaattgcgcaagatcggtgacttcatcctgtacgggattgccgccgccgacgaagcgctgaaggattccggctgggagcccaagacccacgaggagcaatgcgccaccggcgtgctcatcggttccggcattggcggcatcgagggcatcgccgagaacgcgatgatcctcaaggaacgcggtccgcgccgcatcagccccttcttcatcccgggccagatcatcaatctcgtctccggccaggtttcgatccggcacgggctgaaaggtccgaaccatgccgtcgtcacggcctgctcgaccggcgcgcatgccattggcgatgcggcccggctgatcatgtggggcgatgccgacgtcatggtcgccggtggcgcggaggcgccggtgaccagactttcgatcgccggcttcgccgcctgccgggcgctgtcgaccgagcgcaatgacacgccgcagacggcgtcgcgtccctatgaccgtgaccgcgacggcttcgtcatgggcgagggcgccggtgttgtggtgctggaagaactcgagcacgccaaggcgcgcggcgccaagatttatgccgaggtgaccggctacggcctcaccggcgatgcctatcacatcaccgcaccggccgaagacggcgatggcgctttccgttgcatgaccgcggcgttgaaccgggccaagcttacgcccgccgatgtcgactacatcaacgcgcatggcacctcgaccatggccgacacgatcgaactcggcgctgtcgagcggcttgtcggcaacgccgcgtcgaagatttcgatgtcgtcgaccaagtcgtcgatcggccatctccttggtgcagcgggagccgccgaagcgatcttttcgatccttgcgatcagggacaatgtcgcgccggcgaccatcaacctcgacaatccagagcgcgaaaccgcgatcgacctggtgccgaacaagcctcgctcccgccagatcgacgttgcgctctccaattccttcggcttcggcggcacaaacgcatcgcttgtgttccagcgctacaatggctga

SEQ ID NO: 19639 - protein, 420 aa, Mesorhizobium loti MAFF303099
MRRVVVTGLGLLSPFGMGFEHSWKELLTGRSAAKRITEFEVEDLACKIAHVVPRGDGSNATFNPESVLEPKELRKIGDFILYGIAAADEALKDSGWEPKTHEEQCATGVLIGSGIGGIEGIAENAMILKERGPRRISPFFIPGQIINLVSGQVSIRHGLKGPNHAVVTACSTGAHAIGDAARLIMWGDADVMVAGGAEAPVTRLSIAGFAACRALSTERNDTPQTASRPYDRDRDGFVMGEGAGVVVLEELEHAKARGAKIYAEVTGYGLTGDAYHITAPAEDGDGAFRCMTAALNRAKLTPADVDYINAHGTSTMADTIELGAVERLVGNAASKISMSSTKSSIGHLLGAAGAAEAIFSILAIRDNVAPATINLDNPERETAIDLVPNKPRSRQIDVALSNSFGFGGTNASLVFQRYNG

SEQ ID NO: 19640 - DNA, 1245 bp, Clostridium acetobutylicum ATCC 824
  CDS (1)..(1245): transl_table=11
atgaggagagtcgttattacaggttatggtgttatttcgtcttccggtaatgatgtggatactttttggagtaacattgtcaatggaatatcgggaataagagaaataactgatccctcgttttcgaatattgcatctcgcattgccggatatataaatgattttaacccctatgaatatttcgataaaagagaaataaggcactatgacttatacactcaatatgcatttgcggcagcaaagcaagctattgacaatgcaaatgttaaggaaggtaactttgacacaagtcgtgttggtatttatgttggctctggaataggaggtattagcacagtactaaatagccataaggcttatttggagaagggtacacgccatgtgtcaccattcatgattcctatgatgattagcaacatggcttctggtgttatagcaataaaaactggatttaaagggccgagtttttctccggtgtccgcgtgtgcaacggctaatcaagctatcggagaagcatttttaagtatacggcatggatatacagatgcgattattgcaggtggctcagaagcccctattaatacgcttgcgttttcaggtttcgcaaatatgaaagctatgtcaactaataatgccaatccaaccgaggccagccgtccattcgataaactccgagatggatttgttatgtctgaaggtgccggtattctattcttagaagaattaacacatgccaaaagacgtggagcaaaaatattgggtgaaattattggatatggttctactacagacgcttaccatattacttcgccagactaccatggcgcggcacgggctatggagatggcactggagatggcggatatttcggcctctcagattgactatataaacgcccatgccacaggaacaaaaggtggagataaatctgaaaccaacgcaataaaagccgtatttaaggaaaacgtgaagaaactcaaaataagtgcaactaagtcaatgacaggacatttatttggagctgctggtggtattgaagccattattacactgaaagctttagaatacggcattatacctcctacaatcaatctgaaaaatgttgatgaagaatgtgaccttgattatgttcccaacaaagcgattaaacatgatagcaacttcgcgatttccaacggttttggctttggaggtcacaatgcttctcttctcttcaaaaaatggaatccagctatggaatattaa

SEQ ID NO: 19641 - protein, 414 aa, Clostridium acetobutylicum ATCC 824
MRRVVITGYGVISSSGNDVDTFWSNIVNGISGIREITDPSFSNIASRIAGYINDFNPYEYFDKREIRHYDLYTQYAFAAAKQAIDNANVKEGNFDTSRVGIYVGSGIGGISTVLNSHKAYLEKGTRHVSPFMIPMMISNMASGVIAIKTGFKGPSFSPVSACATANQAIGEAFLSIRHGYTDAIIAGGSEAPINTLAFSGFANMKAMSTNNANPTEASRPFDKLRDGFVMSEGAGILFLEELTHAKRRGAKILGEIIGYGSTTDAYHITSPDYHGAARAMEMALEMADISASQIDYINAHATGTKGGDKSETNAIKAVFKENVKKLKISATKSMTGHLFGAAGGIEAIITLKALEYGIIPPTINLKNVDEECDLDYVPNKAIKHDSNFAISNGFGFGGHNASLLFKKWNPAMEY

SEQ ID NO: 19642 - DNA, 1239 bp, Helicobacter pylori 26695
  CDS (1)..(1239): transl_table=11
gtgcgtcggattgtagtaactggaatgggaatgatcaattcgctaggtttaaataaagaagattcttttttagcgatcgctaaaggggaatgcggtatcaaacacatagaaagttttgatgcgagcgcgtttcctgtgcgtattgctggagaaatcactgactttgaccctacagaggtgatgaatcccaaagatgttaaaaaggcgggtcgtttcattcaattagccttgaaagccacaagagaggcgatgaaagatagtgggattttagacgctcacaatagatgccctgaagaattggcaaatcgcatgggcgtaagctctggctctgggattggcgggttaggcaatattgaagcgaattccattttttgttttgaaaaaggccctagaaaagtcaatccctttttcatcacttctgcgttagtgaatatgattggtggtttcacttccattgagtttggcattaaagggcctaatctctctagcgtaacggcttgtgcagcaggcactcatgccattattgaagccgttaaaaccattttgcttaatggggctgataaaatgctagtcgtgggagcggaatccaccatttgtcctgtagggattggggggtttgcgagcattaaagccctttctacaaggaatgatgatcctaaaaaagcttcaagaccttttgataaggatcgcaatggctttgtgatgggcgaaggcgctggggctttggtgcttgaagaatacgagagcgcgaaaagaagaggggcaaaaatttatgcagaatttgccgggtatggcgagagtggcgatgctaaccatatcacagccccagcccctgagggcgaaggggcttttagagccatgaagatggctttagaaatggcgaaagtggaaataggctatgtgaacgctcatgggactagcacgcattataacgatctatatgaaagcatcgctctaaaaaatgtgtttggttctaaagaaaaagtccctcctgtcagctccactaaagggcagattgggcattgcttgggtgctgcgggcgcgttagaagccgttatttctatcatggccatgaatcaaggaatcttacctcctaccatcaatcaagaaatgcctgacccagaatgcgatttggattatatccctaatgcggccagagaaaagcgagtggatgcagtgatgagtaactcatttggttttggtggcactaatggtgttgtgattttcaaaaaagcctag

SEQ ID NO: 19643 - protein, 412 aa, Helicobacter pylori 26695
MRRIVVTGMGMINSLGLNKEDSFLAIAKGECGIKHIESFDASAFPVRIAGEITDFDPTEVMNPKDVKKAGRFIQLALKATREAMKDSGILDAHNRCPEELANRMGVSSGSGIGGLGNIEANSIFCFEKGPRKVNPFFITSALVNMIGGFTSIEFGIKGPNLSSVTACAAGTHAIIEAVKTILLNGADKMLVVGAESTICPVGIGGFASIKALSTRNDDPKKASRPFDKDRNGFVMGEGAGALVLEEYESAKRRGAKIYAEFAGYGESGDANHITAPAPEGEGAFRAMKMALEMAKVEIGYVNAHGTSTHYNDLYESIALKNVFGSKEKVPPVSSTKGQIGHCLGAAGALEAVISIMAMNQGILPPTINQEMPDPECDLDYIPNAAREKRVDAVMSNSFGFGGTNGVVIFKKA

SEQ ID NO: 19644 - DNA, 1248 bp, Aquifex aeolicus VF5
  CDS (1)..(1248): transl_table=11
atgaagagaagagttgttatcaccggcatcggggcggttacgccccttggaacaggcgtaaagaagttctgggaaaaccttgtaaagggtgtaagcggtgttgattacataaagagctttaaccccgacgaatacggaatacccgtaaagatagcggcggaagtaaaggactttaatccagaagactttatggataaaaaagaggcgagaaaagcctcccgctttgtccagtttgcaatagctgcggtaaaggaagcccttgaagacagcggactccttgaaagtgagtacgacccttacagagtaggggtaattatagggacaggaattggcggtctcaaggatatagaagatcagactttaatccttaaagaaaagggagcgagaagggtatctccctttttcataccctacggcatatccaacatggcttcggggcttgtggccataaagtggggctttaaaggtccaaattactgcgtgacttccgcctgtgctacgggaaaccacgctataggagacgccttcagactcattcaaaagggtgatatagacattgctatagcgggaggaacggaagctgcgataacccccctcggtgttgcgggatttgcatccatgaaggcactctctacgaggaacgacgagccccagaaagcttcaagaccctttgacagggacagggacggcttcgtaatgggagaaggagcaggaatactgattttggaagaatacgagagggcaaaggcaaggggtgcgaagatatacgctgaactcgtgggctacggtgcaaccgacgacgcttaccacataacttccccccacgagtgcggtgagggagcttacgagtgcatgaggttagcactggaagacgctggaattaaacccgaagaggtggattacataaacgcccacggaacatcaacaccgctcaacgacaaaacagagacgatggcgataaagcagctcttcggagaacacgcatacaaacttaaaatttcttcaaacaagtccatgatagggcacctgctcggagccgcagcggctgtggaagctgtagcaacgataaaaaccatagaaactggagtgatacctcctaccattaacctggaaaaccccgatccagagtgtgatctggactacgttccaaacaaagccgtggaataccccgtaagggttgcactttctaacgcctttggttttggaggaactaacgcaacgctagtgttcagaaaaatagaagaatga

SEQ ID NO: 19645 - protein, 415 aa, Aquifex aeolicus VF5
MKRRVVITGIGAVTPLGTGVKKFWENLVKGVSGVDYIKSFNPDEYGIPVKIAAEVKDFNPEDFMDKKEARKASRFVQFAIAAVKEALEDSGLLESEYDPYRVGVIIGTGIGGLKDIEDQTLILKEKGARRVSPFFIPYGISNMASGLVAIKWGFKGPNYCVTSACATGNHAIGDAFRLIQKGDIDIAIAGGTEAAITPLGVAGFASMKALSTRNDEPQKASRPFDRDRDGFVMGEGAGILILEEYERAKARGAKIYAELVGYGATDDAYHITSPHECGEGAYECMRLALEDAGIKPEEVDYINAHGTSTPLNDKTETMAIKQLFGEHAYKLKISSNKSMIGHLLGAAAAVEAVATIKTIETGVIPPTINLENPDPECDLDYVPNKAVEYPVRVALSNAFGFGGTNATLVFRKIEE

SEQ ID NO: 19646 - DNA, 1257 bp, Chlamydia trachomatis D/UW-3/CX
  CDS (1)..(1257): transl_table=11
atgaacaaaaaacgtgtagtcgttacaggaatggggatcgtctcctgccttgggaatgaagtagaatctttctatgatagcctattggcgggaattagtggagtgcgaacaatcacgtcttttccctgcgatgattatgctacgcgttttgctggctggatagaagaatttaactcagagccttacttagataaaaaacaagctagacgagttgatccttttattacttatgcagttgtagctgcaaagaaggcaatagctatgtcccgttgggatcaagatactcttcccgcagattctcatcgttgtggggtgattattggttctggaatgggaggattacgaaccctggatgaggggattgaaaaactatcggctggaaatagaaaattatctccattctttattccttacatcattacgaatatggctccggctttaatcgcaatggattatgggttaatgggacctaattattctatttcaacagcctgtgcaacagcaaactactgtattgatgccgcttatcaacacctcattgagggtcgagcagatgttatcgtttgtggaggaactgaagcggctattaaccgtgttggtttagctggatttattgcgaatcgcgcattgtcagaaagaaatgatgctccagaacaagcttcgcgcccttgggatagggatcgagacggttttgttttgggggagggtgcaggaattcttgttttggaaacccttgataatgctttgaaaagaggggctccgatttttgcggaggtacttggcacatatacaacgtgcgatgcttttcatattactgctcctagagatgatggcgaaggaatcactgcctgtatattgggagccttgaataaggctgggattcctaaagaacgggtgaattatattaatgcacacggaacgtcgacgcctctaggggatctatcagaggtattggctttgaagaaagcttttggaagccacgtcaaaaacttgcgaatgaattcaacgaagtcgttgatagggcactgcttgggagctgcaggaggagtagaagctgttgcaaccattcaagccatccagactgggaagttgcacccaacaatcaatgtagaaaatccgatagcagaaatagaagaattcgatgtggttgcgaacaaagctcaagattgggatgtcgatgtagctatgtcaaattcttttggttttggcggacacaattcaacgatattattttcgaggtatgaaccttcattatga

SEQ ID NO: 19647 - protein, 418 aa, Chlamydia trachomatis D/UW-3/CX
MNKKRVVVTGMGIVSCLGNEVESFYDSLLAGISGVRTITSFPCDDYATRFAGWIEEFNSEPYLDKKQARRVDPFITYAVVAAKKAIAMSRWDQDTLPADSHRCGVIIGSGMGGLRTLDEGIEKLSAGNRKLSPFFIPYIITNMAPALIAMDYGLMGPNYSISTACATANYCIDAAYQHLIEGRADVIVCGGTEAAINRVGLAGFIANRALSERNDAPEQASRPWDRDRDGFVLGEGAGILVLETLDNALKRGAPIFAEVLGTYTTCDAFHITAPRDDGEGITACILGALNKAGIPKERVNYINAHGTSTPLGDLSEVLALKKAFGSHVKNLRMNSTKSLIGHCLGAAGGVEAVATIQAIQTGKLHPTINVENPIAEIEEFDVVANKAQDWDVDVAMSNSFGFGGHNSTILFSRYEPSL

SEQ ID NO: 19648 - DNA, 1281 bp, Rickettsia prowazekii str. Madrid E
  CDS (1)..(1281): transl_table=11
atgtcaaatcaaaacataaataaaagagtagttattactgggcttggacttgttacgcctgttgggcttaatgttagctcaacttggaaaaatattgtaggcggagtaagtggtataaaaactattacagaatttgacacttctaaacttgcgtgtaaaattgctggcgttatagataattctgagcaaaatggatttaaactagaaaattttacacaagcagatgatattaatagactaagtaaaatggataaatttatccattacggaatcgcagccgcaaccgaagcagttgaagatagcggctggttacccaaagatgaaaaatctcgtgatagaaccggcctgatattaggttcaggaatcggtggacttaaaatgattgaagatacctctattaaactttataaagaaaataacggcaaagttagccctttctttattccggcatcattaattaaccttttatctggtcttgtttctataaaatacggttttagtggcccgaatcaagcagcagtgacagcttgctctacaggcgcacatgctataggtgatgctatgcgtatgataaaacatggttatgccgatgttatgatcgcaggcggtgcagaggctccagttacacctgtcggaattgcaggttttgttgctgctagagcattatgtactaaatataacgataatcctgaaaaagcctcaagaccttgggataaagatcgaagtggttttgtgatgggtgagggagcaggcattgtagtcttagaagaatatgagcatgcaataaatcgtggagctaaaatttattgtgaagttataggatacggctctacaggtgatgcataccatatgacagctccacatcctaaaggtagaggagcttatagagcaatgagtgaagcattacaagatgctgatataactcctagtatgattgattatattaatgcacatggtacttctactcctcttggagacatgatcgaattagacgctacacaaaaattatttttagaatcgaatcccaaaattctaatgtcttctactaaatcatcaataggacatttgcttggtgcagcaggaagtgttgagtttatattttcagttcttacaattcgagatcagattgcaccaccaaccttaaacttagaaaaccctatagatgatgttaagatagatttagtaaaattcaaagctagagaaactgtaatagattacgtattatctaattcttttggcttcggcggtactaatgctagcttagtaattaagaagatttag

SEQ ID NO: 19649 - protein, 426 aa, Rickettsia prowazekii str. Madrid E
MSNQNINKRVVITGLGLVTPVGLNVSSTWKNIVGGVSGIKTITEFDTSKLACKIAGVIDNSEQNGFKLENFTQADDINRLSKMDKFIHYGIAAATEAVEDSGWLPKDEKSRDRTGLILGSGIGGLKMIEDTSIKLYKENNGKVSPFFIPASLINLLSGLVSIKYGFSGPNQAAVTACSTGAHAIGDAMRMIKHGYADVMIAGGAEAPVTPVGIAGFVAARALCTKYNDNPEKASRPWDKDRSGFVMGEGAGIVVLEEYEHAINRGAKIYCEVIGYGSTGDAYHMTAPHPKGRGAYRAMSEALQDADITPSMIDYINAHGTSTPLGDMIELDATQKLFLESNPKILMSSTKSSIGHLLGAAGSVEFIFSVLTIRDQIAPPTLNLENPIDDVKIDLVKFKARETVIDYVLSNSFGFGGTNASLVIKKI

SEQ ID NO: 19650 - DNA, 1239 bp, Helicobacter pylori J99
  CDS (1)..(1239): transl_table=11
gtgcgtcggattgtagtaactggaatgggaatgatcaattcgctaggtttaaataaagaagattcttttttagcgatcgctaaaggggaatgcggtatcaaaaacatagaaagttttgatgcgaatgcgtttcctgtgcgtatcgctggagaaatcactgactttgaccctacagaggtgatgaatcccaaagatgttaaaaaggcgggtcgtttcattcaattagccttgaaagccacaagagaggcgatgaaagatagtgggattttagacgctcacaatagatgccctgaagaattggcaaatcgcatgggtgtaagttctggctctgggattggcgggttaggcaatattgaagcgaattctattttttgttttgaaaaaggccctagaaaagtcaatccctttttcatcacttctgcgttagtgaacatgattggaggtttcacttccattgagtttggcattaaagggcctaacctctctagcgtaacggcttgtgcagcaggcactcatgcgattattgaagccgttaaaaccattttgctcaatggggctgatagaatgctggtcgtgggagcggaatccaccatttgtcctgtagggattggagggtttgcgagcattaaagccctttctacaaggaatgatgatcctaaaaaagcttcaagaccttttgataaggatcgcaatggctttgtgatgggcgaaggcgctggggctttagtgcttgaagaatacgagagcgcgaaaaaaagaggggctaaaatttatgcagaatttgccgggtatggcgagagcggcgatgctaaccacatcacagccccagcccctgagggtgaaggggcttttagagccatgaaaatggctttagaaatggcgaaagtggaagtaggctatgtgaacgcccatgggacaagcacgcattataacgattggtatgaaagcattgcgttaaaaaatgtgtttggctctaaagaaaaagtccctcctgttagctccactaaagggcagattgggcattgcttgggtgctgcgggcgcgttagaagccgttatttctatcatggccatgaatcaagggatcttacctcctaccattaatcaagaaacgcctgacccagaatgcgatctggattatatccctaatacagccagagaaaagcaagtgaatgcggtgatgagtaactcatttggttttggtggcactaatggtgttgtgattttcaaaaaagcctag

SEQ ID NO: 19651 - protein, 412 aa, Helicobacter pylori J99
MRRIVVTGMGMINSLGLNKEDSFLAIAKGECGIKNIESFDANAFPVRIAGEITDFDPTEVMNPKDVKKAGRFIQLALKATREAMKDSGILDAHNRCPEELANRMGVSSGSGIGGLGNIEANSIFCFEKGPRKVNPFFITSALVNMIGGFTSIEFGIKGPNLSSVTACAAGTHAIIEAVKTILLNGADRMLVVGAESTICPVGIGGFASIKALSTRNDDPKKASRPFDKDRNGFVMGEGAGALVLEEYESAKKRGAKIYAEFAGYGESGDANHITAPAPEGEGAFRAMKMALEMAKVEVGYVNAHGTSTHYNDWYESIALKNVFGSKEKVPPVSSTKGQIGHCLGAAGALEAVISIMAMNQGILPPTINQETPDPECDLDYIPNTAREKQVNAVMSNSFGFGGTNGVVIFKKA

SEQ ID NO: 19652 - DNA, 1239 bp, Thermotoga maritima MSB8
  CDS (1)..(1239): transl_table=11
ttgaagcgggtagttatcacgggtatgggtatcgtgagtccctttggtgttggaaaagagagaaatttagaaggacttagagaaactaaagtaacgatagatcgaatatcttcttttgatgcttctaaccttcccgtccagatcgccgcagaggtgagagatttcaaaccggaggagtacataaatccgaaactggtcaggagaacagaccgtttcgttcacttcgctctggtcagcgcgaaagaagctgtggaagacgccggtataaacttcgaaccgtacgccgacaggacagccaccatcataggatccggcatgggaggatttctgacgctcgacagcgagaacaacaaattcctgagtcagggtccaagcagagtcagtccgttcctgattccgatgatcctcatcgatatggcttccggtgtcgttgcaatggaatacggactgaaaggaccgaacttctcttctgtaagcgcctgtgcttcatccctccacgcggtagctctcggtgctctcctcataagacacggatacgcggatgtggcagtcgtcgggggaaccgaggcaacgattgctccacttcccatcaccgggtttgccaacatgagagcactctcaaggaggaacgacgatccaaagcgtgcttctcgtccgttcgataaagacagagacggctttgtgatgggtgaaggcggtgcggttctcatactcgaagccgaggaagtggcaaaatcgagaggagcgaaaattctcgcggagatcaagggagtgggtatgacggacgacgcgtaccacttcagtgctccagatccagagggcagaggggcagcagaagccatgaaactcgccctgaaagaatccagtctggctgtcgaagacatcgactacgtgagctgtcacgccacaagcacaccagcaggtgatgaagcggaactcaaagcgataaagaaagtccttggagaacacgtaaagaacgtcgccataaactcttcgaaagcccttataggacatctccttggtgccgccggtgcttccgaactcgttcttgccatccttcagatgcagaactctttcgtccacggcatgccgaaccttgacaatccgatcgacgaagcgaaaggaaccggccttgtcggtaaagaacccgttcagatggagatcaaaaacttcataaagaactcctttggtttcggcgggcacaacgtgtccatcgtggtggggaggtatgaatcatga

SEQ ID NO: 19653 - protein, 412 aa, Thermotoga maritima MSB8
MKRVVITGMGIVSPFGVGKERNLEGLRETKVTIDRISSFDASNLPVQIAAEVRDFKPEEYINPKLVRRTDRFVHFALVSAKEAVEDAGINFEPYADRTATIIGSGMGGFLTLDSENNKFLSQGPSRVSPFLIPMILIDMASGVVAMEYGLKGPNFSSVSACASSLHAVALGALLIRHGYADVAVVGGTEATIAPLPITGFANMRALSRRNDDPKRASRPFDKDRDGFVMGEGGAVLILEAEEVAKSRGAKILAEIKGVGMTDDAYHFSAPDPEGRGAAEAMKLALKESSLAVEDIDYVSCHATSTPAGDEAELKAIKKVLGEHVKNVAINSSKALIGHLLGAAGASELVLAILQMQNSFVHGMPNLDNPIDEAKGTGLVGKEPVQMEIKNFIKNSFGFGGHNVSIVVGRYES

SEQ ID NO: 19654 - DNA, 1245 bp, Vibrio cholerae O1 biovar eltor str. N16961
  CDS (1)..(1245): transl_table=11
gtgtccaagcgtcgcgttgttgtcactggcatgggtatgttgtcaccggtaggcaacactgtagagtcatcttggaaagccttgttggccggccaaagcggcatcgtcaacattgagcacttcgacactaccaatttttctactcgtttcgcaggcctggtaaaaggttttgactgcgaacagtacatgtcaaaaaaagatgctcgcaaaatggatttgtttatccagtatggtatcgctgcgggcattcaggctttggaagattcaggcctagaagttaatgaagaaaatgctgcgcgtattggcgttgcgattggttcgggtatcggcggccttgagctgattgaaaccggacatcaagctttaatcgagaaaggcccacgtaaggttagccctttcttcgttccctcaactattgtcaacatgattgccggtaacttgtctatcatgcgtggcttacgtggtcccaatattgcgatctctaccgcctgtaccacgggcttgcacaatatcggccatgcagcacgtatgattgcttacggtgatgcggatgcgatggttgcaggtggtgcagaaaaagcgtcaacgccactgggcatggcgggttttggtgcggcgaaagcactctcaactcgtaatgatgaaccgcaaaaagcgtctcgtccttgggataaagaccgtgatggtttcgtgctcggtgacggtgccggcatcatggtgcttgaagagtacgaacacgcgaaagcgcgtggcgcgaaaatttacgcagaagtggttggcttcggtatgtcaggtgatgcttatcatatgacttcaccgagtgaagacggctctggcggtgcgctggcgatggaagcggccatgcgtgatgcaggcgtgactggtgagcagattggttatgttaatgctcacggtacatctacccctgcgggcgatgtggctgaagtgaaaggcattaaacgtgcgttgggtgaagcagggactaagcaagttctggtttcttctaccaagtccatgacgggtcacttattaggtgctgcaggttctgtcgaagcgatcatcactgtgatgtctttggtggatcaaatggttccaccgaccatcaatctggataatcctgaagaaggtttgggtgtcgatttagtaccgcatgttgcccgtaaagttgagagtatggaatacgccatgtgtaactcgtttggctttggtggtactaacggtagcttgattttcaagcgcatgtaa

SEQ ID NO: 19655 - protein, 414 aa, Vibrio cholerae O1 biovar eltor str. N16961
MSKRRVVVTGMGMLSPVGNTVESSWKALLAGQSGIVNIEHFDTTNFSTRFAGLVKGFDCEQYMSKKDARKMDLFIQYGIAAGIQALEDSGLEVNEENAARIGVAIGSGIGGLELIETGHQALIEKGPRKVSPFFVPSTIVNMIAGNLSIMRGLRGPNIAISTACTTGLHNIGHAARMIAYGDADAMVAGGAEKASTPLGMAGFGAAKALSTRNDEPQKASRPWDKDRDGFVLGDGAGIMVLEEYEHAKARGAKIYAEVVGFGMSGDAYHMTSPSEDGSGGALAMEAAMRDAGVTGEQIGYVNAHGTSTPAGDVAEVKGIKRALGEAGTKQVLVSSTKSMTGHLLGAAGSVEAIITVMSLVDQMVPPTINLDNPEEGLGVDLVPHVARKVESMEYAMCNSFGFGGTNGSLIFKRM

SEQ ID NO: 19656 - DNA, 1236 bp, Bacillus halodurans C-125
  CDS (1)..(1236): transl_table=11
atgaatagacgtgtagttgttacggggatcggtgcagtgacaccacttggaaatacggcagaggaaacgtgggaaaaagccattgccggccaatctggggttggtctgttaacgcgtgtcgaagctgctgatttcccgatgaaagtagctgctgaagtaaaagaatttgatccgacaacgcatattgaccgaaaagaagcacggaaaatggaccgttttacgcaatttgcggtcgcttctgcattaatggcgttgaaggatgctgaccttgagatcacagaagacattgcaccacgagtcggggtctggattggctctggcatcggtgggatggaaacatacgaaaatcaatttagaatgtttatcgaaaaaggataccgtcgggtcagtccgtttttcgttccaatgatgattcctgatatggcttctggacaagtgtcaattataacaggtgccagaggaatcaactcttgctctgtaaccgcttgtgcatcaggagctaactcgataggtgatgcgtttaaagtcatccaacggggagatgctgatgtgatgattactgggggcgcagaggctccgatcacgaatatggctgttgctggttttagtatggcgaaggcgatttcaacaagcgaagatccaaacacggcgtcacgtccatttgatgcgaatcgagatggctttgttatgggagaaggctctggaattctcattcttgagtctctggaatctgctgaaaagcgtggggcgaagatttatgctgagattgtcggatatggcgcaacaggcgatgcttatcacgtgacacagcccgctccagaaggagaaggagcggcccgtgcgatgaagcaagccatcgaggatgcaggattgacgccagaagacattcaatacatgaacgctcatggaacgagcacgtattacaatgataaatacgaaacactagcagctaaacaagtgttcggtgaccatgtgaacaatttggctattagttcgacgaagtcaatgactggtcatttgctcggtgcagcaggcgctgtagaagcaatcttttcggtgaaggcgattgaagaggggattattcctccaacgattaactatgaaacgccagacccagattgtgatttggactatgttccaaatgaagctagaaagcagggcgtgaatgctgtattaagtaactcattaggctttggtggacataacgccaccctcgtctttaaaaaatatcaatag

SEQ ID NO: 19657 - protein, 411 aa, Bacillus halodurans C-125
MNRRVVVTGIGAVTPLGNTAEETWEKAIAGQSGVGLLTRVEAADFPMKVAAEVKEFDPTTHIDRKEARKMDRFTQFAVASALMALKDADLEITEDIAPRVGVWIGSGIGGMETYENQFRMFIEKGYRRVSPFFVPMMIPDMASGQVSIITGARGINSCSVTACASGANSIGDAFKVIQRGDADVMITGGAEAPITNMAVAGFSMAKAISTSEDPNTASRPFDANRDGFVMGEGSGILILESLESAEKRGAKIYAEIVGYGATGDAYHVTQPAPEGEGAARAMKQAIEDAGLTPEDIQYMNAHGTSTYYNDKYETLAAKQVFGDHVNNLAISSTKSMTGHLLGAAGAVEAIFSVKAIEEGIIPPTINYETPDPDCDLDYVPNEARKQGVNAVLSNSLGFGGHNATLVFKKYQ

SEQ ID NO: 19658 - DNA, 1221 bp, Pasteurella multocida subsp. multocida str. Pm70
  CDS (1)..(1221): transl_table=11
atgaaaagagcggttattactgggtttggtattatttcgagtattggcaacaataaagacgaagtattagcatcgttaaaagctggcaaatcaggtatcgaagtgatgcccgagtttgttgagattggcatgcgtagtcatgtggccggcacggttaaattaaatccaagtgagctgattgatcgtaaaatatatcgttttatgggggatgcggcagcttatgcttatctttcgatgaaagaggcgattgaagatgcaggtttgacagaagatcaagtatcgaacgatcgtactggcttggtgattggtgcgggaactggttcagcccataaccaattaatcgcctgtgatgcggtgcgtggtcctcgtggtgtgaaagcggtaggaccttatgcggtcactaaaacgatggcatccagtgtttcagcttgtttagcaacaccttacaaaattcgtggtgtgaactacagtattagttcagcttgtgcaacatcagcccattgtattggtcatgcgcttgagttaattcaattaggtaaacaagatattgtgtttgcgggtggcgcagaagaattatcttgggaatgtgcaactgagtttgatgcgatgggtgcggtatcgacaaaatacaacgataccccagaaaaagcgtcacgcgcttatgatgcgaaccgtgatggtttcgtcatcgcaggtggtggtgcagtggttgttgttgaagaattagagcatgctcttgcacgtggtgcgaaaatttatgctgaaatcgttggctatggcgctacatcagacggttatgacatggtggcgccaagtggtgaaggcgcggagcgttgtatgagacaagccatggcgacggttgatacaccaattgattacattaacgtccatggtacttctacaccagtaggagatgtgaaagagttaggtgcgattaaaaatgtttttggtgataaagtgccagctatctcatcaacgaaatcgatgaccggtcactctttaggtgcagcgggtgcgcacgaagcgatttacacgttattaatgttagacaatgattttattgcgccaagtatcaatatcgaaactctcgatgagaatgcaaaaggctgtaacattgtgaccgaaactgttgaaaatgccggcttgaaaactgtgatgtcaaatagctttggttttggtggaacaaacgcagcgttaattttcaaaaagtatcaagcataa

SEQ ID NO: 19659 - protein, 406 aa, Pasteurella multocida subsp. multocida str. Pm70
MKRAVITGFGIISSIGNNKDEVLASLKAGKSGIEVMPEFVEIGMRSHVAGTVKLNPSELIDRKIYRFMGDAAAYAYLSMKEAIEDAGLTEDQVSNDRTGLVIGAGTGSAHNQLIACDAVRGPRGVKAVGPYAVTKTMASSVSACLATPYKIRGVNYSISSACATSAHCIGHALELIQLGKQDIVFAGGAEELSWECATEFDAMGAVSTKYNDTPEKASRAYDANRDGFVIAGGGAVVVVEELEHALARGAKIYAEIVGYGATSDGYDMVAPSGEGAERCMRQAMATVDTPIDYINVHGTSTPVGDVKELGAIKNVFGDKVPAISSTKSMTGHSLGAAGAHEAIYTLLMLDNDFIAPSINIETLDENAKGCNIVTETVENAGLKTVMSNSFGFGGTNAALIFKKYQA

SEQ ID NO: 19660 - DNA, 1269 bp, Pseudomonas aeruginosa PAO1
  CDS (1)..(1269): transl_table=11
atgagcaaacgtatcgtcgtcaccggcatgggcgcggtcagcccgctgggctgcggagtcgaacccatatggcaacgcctgctggccgggcaatcgggcatcgccacgctcccggcggagctgatcggcgacctgcccatcagcatcggcggccaggtccccgaccgtgcccgggacccgcaggccggcttcgatcccgacctgctgctggccgccaaggaacaacgcaagatggaccgcttcatcctcttcgccctggccgccgcgcaagaggccctggcgcaggccggctgggcgccgcagagcgccgaggcgcaggagcgcacggcgaccgtcatcgcctccggggtgggcggcttccatgccatcgccgaagcggtgcggaccaccgacggcaaggggccgcgacgcctgtcgcccttcaccatcccgtcctttctctgcaacatggcggccgcccatgtgtcgatccgccatggcttcaagggaccgctgggcgccccggtgaccgcctgcgcggcgggcgtgcaagccatcggcgacgcggcgcggatgatccgcgcgggagaggtcgacgtggcgctctgcggcggcgcggaagcgaccatccaccgggtcagcctggccggcttcgccgccgcgcgcgccctgtccagcgatttcaacgacagccccgaacgcgcctcgcgccccttcgaccaggcccgcgacggcttcgtcatgggcgaaggcgccggcctactggtcatcgaggaactggagcacgccctggcgcgcggcgccaggcccatcgccgagctggtgggctacggcaccagcgccgacgcctaccacatgaccgccgggccggaagatggcagcggtgcccgccgggccatgcagcaggcgctgcgccaggccggcgtggaagcggccgcggtgcaacacctgaatgcccacgccacctccacccaggtaggcgacaagggcgaactggccgccatcaaggccgtgttcggcgccggcagcgggctcgccatcagcgcgaccaaatccgccaccggccacctcctgggcgccgccggcggcatcgaggcgatcttcacggtcctggcactgcgcgaccagctcgcccccgccacgctcaacctggaaacgcccgacaccgacgccgagggcctcgacctggttcgcggcgaagcccggcgctggccgatggaacacgcgctgtccaatggcttcggcttcggcggggtgaatgccagcctgttgttccggcgctgggtgtag

SEQ ID NO: 19661 - protein, 422 aa, Pseudomonas aeruginosa PAO1
MSKRIVVTGMGAVSPLGCGVEPIWQRLLAGQSGIATLPAELIGDLPISIGGQVPDRARDPQAGFDPDLLLAAKEQRKMDRFILFALAAAQEALAQAGWAPQSAEAQERTATVIASGVGGFHAIAEAVRTTDGKGPRRLSPFTIPSFLCNMAAAHVSIRHGFKGPLGAPVTACAAGVQAIGDAARMIRAGEVDVALCGGAEATIHRVSLAGFAAARALSSDFNDSPERASRPFDQARDGFVMGEGAGLLVIEELEHALARGARPIAELVGYGTSADAYHMTAGPEDGSGARRAMQQALRQAGVEAAAVQHLNAHATSTQVGDKGELAAIKAVFGAGSGLAISATKSATGHLLGAAGGIEAIFTVLALRDQLAPATLNLETPDTDAEGLDLVRGEARRWPMEHALSNGFGFGGVNASLLFRRWV

SEQ ID NO: 19662 - DNA, 1245 bp, Pseudomonas aeruginosa PAO1
  CDS (1)..(1245): transl_table=11
gtgtcgcgtagacgcgtcgtcattactggcatgggcatgctgtcgccgctgggcctggatgtcccgagcagttgggaaggtattctcgccggtcgcagcgggatcgccccgatcgagcatatggacctgtccgcctattccacccgcttcggtggttcggtcaagggtttcaatgtcgaggaatacctgtccgccaaggaagcccgcaagctcgacctgttcatccagtacggtctcgccgccagcttccaggccgttcgcgattccggcctggaggtcaccgacgccaatcgtgagcgtatcggcgtatccatgggttccggtatcggcggcctgaccaatatcgagaacaactgccgatccctgttcgagcaggggccgcggcgcatctcgccgttcttcgtgcccggttcgatcatcaacatggtttccggcttcctgtcgatccacctgggtctgcaggggcccaactacgccctcaccaccgcctgcaccaccggtacccacagcattggcatggctgctcgcaacatcgcctatggcgaggccgacgtgatggtcgccggcggttccgaaatggctgcctgcggtctcggcctgggtggtttcggcgcggctcgcgcgctctccactcgcaacgacgagccgacccgtgccagccgtccgtgggaccgggatcgcgacggcttcgtcctgtccgacggttccggcgccctggtgctcgaagaactggagcacgcccgtgcccgcggcgcgcggatctatgccgagctggttggcttcggcatgagcggcgacgccttccacatgaccgcgccgccggaagacggcgccggtgccgcccgctgcatgaagaacgcgctgcgcgatgccggcctggatcctcgtcaggtcgattacatcaacgcccatggcacctccaccccggccggcgacatcgccgagatcgccgcggtgaagagcgtgttcggcgagcatgcccatgcgctgtcgatgagttcgaccaagtcgatgaccggccacctgttaggtgccgccggtgcggtggaggcgatcttcagcgtgctggccctgcgcgaccaggtcgccccgccgaccatcaacctggacaacccggacgaaggttgcgacctcgacctggtggcccatgaagccaagccgcgcaagatcgacgtggccctgtcgaactcgttcggtttcggcgggaccaacggcaccctggtgttccgcaggttcgccgactga

SEQ ID NO: 19663 - protein, 414 aa, Pseudomonas aeruginosa PAO1
MSRRRVVITGMGMLSPLGLDVPSSWEGILAGRSGIAPIEHMDLSAYSTRFGGSVKGFNVEEYLSAKEARKLDLFIQYGLAASFQAVRDSGLEVTDANRERIGVSMGSGIGGLTNIENNCRSLFEQGPRRISPFFVPGSIINMVSGFLSIHLGLQGPNYALTTACTTGTHSIGMAARNIAYGEADVMVAGGSEMAACGLGLGGFGAARALSTRNDEPTRASRPWDRDRDGFVLSDGSGALVLEELEHARARGARIYAELVGFGMSGDAFHMTAPPEDGAGAARCMKNALRDAGLDPRQVDYINAHGTSTPAGDIAEIAAVKSVFGEHAHALSMSSTKSMTGHLLGAAGAVEAIFSVLALRDQVAPPTINLDNPDEGCDLDLVAHEAKPRKIDVALSNSFGFGGTNGTLVFRRFAD

SEQ ID NO: 19664 - DNA, 1230 bp, Lactococcus lactis subsp. lactis Il1403
  CDS (1)..(1230): transl_table=11
atgacaaatagagttgttatctctggttatggtgtagttagtgcaattggaaatagcccagaagaattttggaacaatcttaaagctggtaaaactggaattggtccaatcactcactttgatgctgaagcaacagggatttctgttgcagcagaagtaaaagaatttccatttgataaatatttccagaaaaaagatgcacgacgcatggatactttctcactttatgcggtttatgcagcacttgatgcaatggaaatgtctggtattacagaagaaaatactaattttgaccgtttgggctgtatcatggcttctgggattggtggacttgaacaatcacaaaaaaattcacaagcaattgtcgctaaaggccctcgtaaaggggtagcaccactctacgttccacttgctattgctaatatggcaactggtaacgttgctttacgtacaggtgctcgtggggtttcgcgtgctgaagtaacggcttgtgcggctggtgctaattcaattggttcagctttccgtgaaatcaaacatggttacgctgatgcaatgattgctggtggtgctgaagcggctatttgtgaacttggaattgcaggttttgctaatttgactgctttgactaaagaaactgaccctgaaaaagcatgtattccattcgataaaaatcgttcaggatttgtaatgggcgaaggttctggtgtattgattttggaaagccttgaacatgcacaagctcgtggcgctaatatcttggctgagattgttggatacggaaatacaaatgatgctttccatatgacaactccttcaggagtgggtgctgaaaatgcgattaaattggctttggaagaagctggtgcaagtccagctgatgttgattacgttaatgcacacggaacttcaacacatgccaatgaagaaactgaaagcaaagcaattcacaatgtaattggcgataaagcttatgtttcatctacaaaagcattgcacggtcatgcacttggtgcaacaggtgcaattgaagcagtggcaactgttcaagcacttttgaatcaatatgcaccagtaaatgctggaacaactgaacttgatgaaggaatgacaattaatgttgttcttggtgaaggtaaacctgctgatattaatcttgcattgtcgcaagactttggtttcggtggacacaatgctgtattggcattcaagaaatggactggagagtaa

SEQ ID NO: 19665 - protein, 409 aa, Lactococcus lactis subsp. lactis Il1403
MTNRVVISGYGVVSAIGNSPEEFWNNLKAGKTGIGPITHFDAEATGISVAAEVKEFPFDKYFQKKDARRMDTFSLYAVYAALDAMEMSGITEENTNFDRLGCIMASGIGGLEQSQKNSQAIVAKGPRKGVAPLYVPLAIANMATGNVALRTGARGVSRAEVTACAAGANSIGSAFREIKHGYADAMIAGGAEAAICELGIAGFANLTALTKETDPEKACIPFDKNRSGFVMGEGSGVLILESLEHAQARGANILAEIVGYGNTNDAFHMTTPSGVGAENAIKLALEEAGASPADVDYVNAHGTSTHANEETESKAIHNVIGDKAYVSSTKALHGHALGATGAIEAVATVQALLNQYAPVNAGTTELDEGMTINVVLGEGKPADINLALSQDFGFGGHNAVLAFKKWTGE

SEQ ID NO: 19666 - DNA, 1248 bp, Neisseria meningitidis MC58
  CDS (1)..(1248): transl_table=11
atgagtcagagaagagtagtcattacaggcttaggtcaggtttcccctgtcggcaacactgtcgcagaggcttgggacaccctgctcaccggcaaaagcggcatcggcgcgattacccgctttgacacatccgacatcaacagccgtgtcgccggcgaggtgcgcggtttcgacatcggacaatacatcagcgcgaaagaagcgcgccggatggacgtattcatccactacggcattgccgccgcattgcaggcaatcgccgattcgggtttggacgatgtggaaaacctcgacaaagaccgcatcggcgtgaacatcggttccggcatcggcggactgcccggcatcgaggtcaccggcaaagccgtaatcgaaggcggcgcgcgcaaaatcaaccctttctttatccccggttctctgattaatctgatttccggacacgttaccatcctcaaaggctaccgcggcccgagctacgggatggtttccgcctgcaccaccggcgcgcacgccatcggcgattccctccgtatgattaaatacggcgacgcggacataatggttgccggcggcgcggaaggcgcaatcagcactttgggcgtgggcggttttgccgcgatgaaagccctctccacccgcaacgacgaccccgccaccgcttcccgtccgtgggacaaaggccgcgacggcttcgttatcggcgaaggcgcgggcatattggtgttggaagaattggaacacgccaaaaaacgcggcgcgaaaatctacgccgaaatcgtcggcttcggcatgagttccgatgcttaccatatcaccgcgccgaacgaagaaggccccgcccttgccgttacccgcgcgctgaaagatgccggcatcaatcccgaagacgtggattacgtcaacgcgcacggcacgtccacccccttgggcgatgccaacgaaaccaaagccctcaaacgcgcgttcggcgaacacgcctacaaaaccgtcgtcagctcgaccaaatccatgaccggccacctgctcggcgcggcgggcggcgtggaggccgtgtacagcattttggcgatacacgacggcaaaatcccgccgaccatcaacatttttgaacaagacgttgaagccggctgcgatttggactactgcgccaacgaagcgcgcgacgcggaaatcgacgttgccatttccaactccttcggcttcggcggcaccaacggcacgctggtcttcaaacgcttcaaaggctga

SEQ ID NO: 19667 - protein, 415 aa, Neisseria meningitidis MC58
MSQRRVVITGLGQVSPVGNTVAEAWDTLLTGKSGIGAITRFDTSDINSRVAGEVRGFDIGQYISAKEARRMDVFIHYGIAAALQAIADSGLDDVENLDKDRIGVNIGSGIGGLPGIEVTGKAVIEGGARKINPFFIPGSLINLISGHVTILKGYRGPSYGMVSACTTGAHAIGDSLRMIKYGDADIMVAGGAEGAISTLGVGGFAAMKALSTRNDDPATASRPWDKGRDGFVIGEGAGILVLEELEHAKKRGAKIYAEIVGFGMSSDAYHITAPNEEGPALAVTRALKDAGINPEDVDYVNAHGTSTPLGDANETKALKRAFGEHAYKTVVSSTKSMTGHLLGAAGGVEAVYSILAIHDGKIPPTINIFEQDVEAGCDLDYCANEARDAEIDVAISNSFGFGGTNGTLVFKRFKG

SEQ ID NO: 19668 - DNA, 1215 bp, Campylobacter jejuni subsp. jejuni NCTC 11168
  CDS (1)..(1215): transl_table=11
ttgaaaagagttgtagttacaggtattggtatgatcaatgcccttggtttagataaagaaagttcatttaaagcaatttgcaatggagaaagcggagtaaataaaattactctttttgatgctacggactttcctgttcaaattgcagctgaagttaaaaattttgatccattagaggttgttgatggcaaagaagtaaaaaaaattgaccgtttcatacaacttggaattaaagcagcaagagaagcaatgcaggatgctggatttagtgaagaattagataaagaagaatttggcattgtttcggcttctggtattggaggtttgcctaacatagaaaaaaattccattatttgttccgagcgaggtccgcgtaaaatttccccttttttcataccttcagcacttgtaaatatgttaggaggtttgatttctatagagcatggacttaaagggccaaatatttcttgtgttacagcttgtgcagcaggaactcatgctataggagaagcttataaaagtatagctttgggaaatgctaaaaagatgttagtcataggtgcagaagctgcgatttgtcctgtgggtataggtggttttgcttcaatgaaagctttatcaactagaaatgaagatccacagcatgcttcaagaccatttgacaaagaaagagatggttttgtcatgggagaaggtgctggagctttagtttttgaggaatatgaagaggctaaaaaacgcggtgctacgatttatgctgaattaattggatttggagaaagtgcagatgcgcatcatattacttcaccaactttagatgggcctttaagggctatgaaaaaagctttaaatatggcagggaatccaaaggtagattatatcaatgcacatggaacttcaacccctgtaaatgacaaaaatgaaacagcagcaattaaagagctttttggcaataatatcccgcttataagttccaccaaaggacaaacaggtcattgcttgggtgctgcaggtgcaattgaagcagttgttagtgttatggttttaagagatggggtagttccacctacaatcaatcagcttgtaaaagatgatgaatgtgatcttgattatattccaaatatatcaagaaaagtagatttaaaagtggtgatgagtaattcttttggttttggtggcacaaatggctgtgttgtatttaaaaaagtagattaa

SEQ ID NO: 19669 - protein, 404 aa, Campylobacter jejuni subsp. jejuni NCTC 11168
MKRVVVTGIGMINALGLDKESSFKAICNGESGVNKITLFDATDFPVQIAAEVKNFDPLEVVDGKEVKKIDRFIQLGIKAAREAMQDAGFSEELDKEEFGIVSASGIGGLPNIEKNSIICSERGPRKISPFFIPSALVNMLGGLISIEHGLKGPNISCVTACAAGTHAIGEAYKSIALGNAKKMLVIGAEAAICPVGIGGFASMKALSTRNEDPQHASRPFDKERDGFVMGEGAGALVFEEYEEAKKRGATIYAELIGFGESADAHHITSPTLDGPLRAMKKALNMAGNPKVDYINAHGTSTPVNDKNETAAIKELFGNNIPLISSTKGQTGHCLGAAGAIEAVVSVMVLRDGVVPPTINQLVKDDECDLDYIPNISRKVDLKVVMSNSFGFGGTNGCVVFKKVD

SEQ ID NO: 19670 - DNA, 1248 bp, Neisseria meningitidis Z2491
  CDS (1)..(1248): transl_table=11
atgagtcagagaagagtagtcattacaggcttaggtcaggtttcccctgtcggcaacactgtcgcagaggcttgggacaccctgctcgccggcaaaagcggcatcggcgcgattacccgctttgacgcatccgacatcaacagccgtgtcgccggcgaagtgcgcggtttcgacatcggacaatacatcagcgcgaaagaagcgcgccggatggacgtattcatccactacggcattgccgccgcattgcaggcaatcgccgattcgggtttggacgatgtggaaaacctcgacaaagaccgcatcggcgtgaacatcggttccggcatcggcggactgcccagcatcgaggtcaccggcaaagccgtaatcgaaggcggcgcgcgcaaaatcaaccctttctttatccccggttcgctgatcaacctgatttccggacacgttaccatcctcaaaggctaccgcggcccgagctacgggatggtttccgcctgtaccaccggcgcgcacgccatcggcaattccgcccgactgatcaaatacggcgacgcggacataatggttgccggcggcgcggaaggcgcaatcagcactttgggcgtgggcggttttgccgcgatgaaagccctctccacccgcaacgacgaccccgccaccgcttcccgtccgtgggacaaaggccgcgacggcttcgttatcggcgaaggcgcgggcatattggtgttggaagaattggaacacgccaaaaaacgcggcgcgaaaatctacgccgaaatcgtcggcttcggcatgagttccgatgcttaccatatcaccgcgccgaacgaagaaggccccgcccttgccgttacccgcgcgctgaaagatgccggcatcaatcccgaagacgtggattacgtcaacgcgcacggcacgtccacccccttgggcgatgccaacgaaaccaaagccctcaaacgcgcgttcggcgaacacgcctacaaaaccgtcgtcagctcgaccaaatccatgaccggccacctgctcggcgcggcgggcggcgtggaggccgtgtacagcattttggcgatacacgacggcaaaatcccgccgaccatcaacatttttgaacaagacgttgaagccggctgcgatttggactactgcgccaacgaagcgcgcgacgcggaaatcgacgttgccatttccaactccttcggcttcggcggcaccaacggcacgctggtcttcaaacgcttcaaaggctga

SEQ ID NO: 19671 - protein, 415 aa, Neisseria meningitidis Z2491
MSQRRVVITGLGQVSPVGNTVAEAWDTLLAGKSGIGAITRFDASDINSRVAGEVRGFDIGQYISAKEARRMDVFIHYGIAAALQAIADSGLDDVENLDKDRIGVNIGSGIGGLPSIEVTGKAVIEGGARKINPFFIPGSLINLISGHVTILKGYRGPSYGMVSACTTGAHAIGNSARLIKYGDADIMVAGGAEGAISTLGVGGFAAMKALSTRNDDPATASRPWDKGRDGFVIGEGAGILVLEELEHAKKRGAKIYAEIVGFGMSSDAYHITAPNEEGPALAVTRALKDAGINPEDVDYVNAHGTSTPLGDANETKALKRAFGEHAYKTVVSSTKSMTGHLLGAAGGVEAVYSILAIHDGKIPPTINIFEQDVEAGCDLDYCANEARDAEIDVAISNSFGFGGTNGTLVFKRFKG

SEQ ID NO: 19672 - DNA, 1287 bp, Deinococcus radiodurans R1
  CDS (1)..(1287): transl_table=11
atgtgggctttcaatgttcaatttgggacttcaaaaggagacgacatgatttctggactcaaacgggtcgttatcaccggcctcggcccggtcacgcccatcggcgtcggggcaaaggcctacgccgaggcgcagcgggccggcaaaaacggcatcgggccgatcacgcgcttcgacgccaaagacacggcgagcaaaatcgcgggcgaagtgcacgacagcctcgacgatttcgtggatccccgcgaggcccgcaaactcgaccgctacaccctgctggccctgagcgccgccgaactcgcggtgcgcgacagtggcctgagcgccgaggacctgcgcggcgagcgcaccggcacgctggtcggcagcggcatcggcggcatgaagaccttcgaggaccaggcccgcgtgtacgtggagcgcggcgctggacgcatttcacccatgttcatccctatgcagattgccaacatggcgaccggccacatcgccatgcgctacggcgcaatggggccgagcagcaccgtcgtcaccgcctgcgccaccggcaccggggcgattggcgaagcggcccgttacatccaactcggcctggccgacgtgatgctcgcgggcggcgcggaggcctccattacggcgatggcggtgggcggcttttccaacatgaaggcgctctcgacccgcaacgacgaccccgagcacgccagccggcccttttctgccacccgcgacggcttcgtgctcagcgagggcgcgggcgtggtggtcctcgaagaatacgagcacgccaaagcccgcggcgcgaccatctacgccgaagtcgccgggtttggcgtgagtgccgacgcctaccacatcaccatgccagccccgcagggcgcgggcgcgcagctcgccatgaaaatggccctgcacacggcgggcgtgaaccccgagcaggtggggtacatcaacgcgcacggcaccagcacccatttcaacgacctgcacgagacgcaggccattcagcacgtgtttggcgaccacgcggcgcagctcgcggtcagctccaccaagtccatgaccgggcacctgctcggcgcagcgggcgcgattgaagcgattgccgtggcgcaggccctcgccgacgggctgctgccccccaccatcaacctgaccgaccccgaccccgagctgcccctcgacttcatccccgagggcgcccgcgagcggcaggtggactacgcgctgagcaactcgttcgccttcggtggacagaacgcggcgctgctgctgggacgggtctga

SEQ ID NO: 19673 - protein, 428 aa, Deinococcus radiodurans R1
MWAFNVQFGTSKGDDMISGLKRVVITGLGPVTPIGVGAKAYAEAQRAGKNGIGPITRFDAKDTASKIAGEVHDSLDDFVDPREARKLDRYTLLALSAAELAVRDSGLSAEDLRGERTGTLVGSGIGGMKTFEDQARVYVERGAGRISPMFIPMQIANMATGHIAMRYGAMGPSSTVVTACATGTGAIGEAARYIQLGLADVMLAGGAEASITAMAVGGFSNMKALSTRNDDPEHASRPFSATRDGFVLSEGAGVVVLEEYEHAKARGATIYAEVAGFGVSADAYHITMPAPQGAGAQLAMKMALHTAGVNPEQVGYINAHGTSTHFNDLHETQAIQHVFGDHAAQLAVSSTKSMTGHLLGAAGAIEAIAVAQALADGLLPPTINLTDPDPELPLDFIPEGARERQVDYALSNSFAFGGQNAALLLGRV

SEQ ID NO: 19674 - DNA, 1257 bp, Chlamydia muridarum Nigg
  CDS (1)..(1257): transl_table=11
atgaacaaaaaacgtgtagtcgttacgggaatggggatagtctcctgccttgggaatgaagtagaatctttctatgatagcctgttggctggaattagtggggtgcggacaatcacatctttcccctgcgatgattatgctacgcgttttgcaggttggatagaggaatttaactcggagccttatttagataaaaaacaagctcgacgagtagacccttttattacatatgctgttgtggctgcaaagaaagcaatagctatgtctcgttgggatcaagagactcttcctgcgaatcctcatcgttgcggagtgatcattggatctgggatgggggggcttcggacccttgatgaggggatcgaaaaattatcagcagggaatagaaaactgtctccattctttattccttatatcattactaatatggctcctgccttgatcgctatggattatggtttaatggggccaaactattctatttcaacagcctgtgcaacggccaactattgtattgatgctgcttatcaacatctcgttgaagggcgtgcggatgtcatcgtttgtggagggactgaggctgccattaatcgtgttggcttggctggatttattgctaatcgcgcattgtcggaaagaaatgatgctcctgaacaggcatcgcgtccctgggaccgggatcgggatggttttgtgctaggagaaggggctggcgtcctggtcttagaaaccctggataatgctttaaaaagaggggctccaatttttgctgaagtgcttggaacctatacaacgtgcgacgcttttcatattactgctcctagagatgatggtgaaggaatcactgcctgtatactaggagctttgaataaagctggtattcctaaagaacgggtgaattacattaatgcgcacggaacttccactccattaggagatctgtcagaggtattggctttgaaaaaggcttttggaagtcatatcaaaaacttgcgcatgaattcgaccaagtctttgatagggcactgcttaggagctgcaggtggggtagaagctgttgcgactattcaagccattcagacagggaagttgcacccaacaatcaatatagaaaatcctatagcagaaatagaagagtttgatgtagttgcgaataaatcccaggattgggatgtggatgttgctatgtcgaattcctttggtttcggcggacataattcaacgatattattttcgaggtatgaaccttcattatga

SEQ ID NO: 19675 - protein, 418 aa, Chlamydia muridarum Nigg
MNKKRVVVTGMGIVSCLGNEVESFYDSLLAGISGVRTITSFPCDDYATRFAGWIEEFNSEPYLDKKQARRVDPFITYAVVAAKKAIAMSRWDQETLPANPHRCGVIIGSGMGGLRTLDEGIEKLSAGNRKLSPFFIPYIITNMAPALIAMDYGLMGPNYSISTACATANYCIDAAYQHLVEGRADVIVCGGTEAAINRVGLAGFIANRALSERNDAPEQASRPWDRDRDGFVLGEGAGVLVLETLDNALKRGAPIFAEVLGTYTTCDAFHITAPRDDGEGITACILGALNKAGIPKERVNYINAHGTSTPLGDLSEVLALKKAFGSHIKNLRMNSTKSLIGHCLGAAGGVEAVATIQAIQTGKLHPTINIENPIAEIEEFDVVANKSQDWDVDVAMSNSFGFGGHNSTILFSRYEPSL

SEQ ID NO: 19676 - DNA, 1236 bp, Xylella fastidiosa 9a5c
  CDS (1)..(1236): transl_table=11
atgaatcgtcgggttgtcgttactgggatggggatggtgtcgccattgggcaatgatttgaccacaagttgggatggcatcgttcacggacgttcgggtatcgctcccatcgtccagattgatgcttctaagttatccacgcagattgctggcgaaatcaagggattcgatccaatgaagttcgtatccgcaaaggatgcgaagaaaatggattcgttcatttactatggtataggcgcagcgtttatggcgctggatgatgcaggtttggagattaatgagatcaatgctgagcgtgttggtgccttgatcggttctggtattggtggcgtgtttggtattgaggaacagaccatcaagttctatgaggggggcgtacgcaagatatcccctttctatgtgccatcgacgatcatcaacatgctgccaggacagttgagtgttttgaaaggcttgaaaggcccgacgttctctgcggtatctgcctgcgcgacttcaaaccactccattggtatggcaatgcgcatgatccagtatggtgatgctgatgtcatgttggctggtggttctgagcgcgcttcttcgccaactgcgattggtggcttttgtgcgatgagggcgatgtctacgcgtaacgatgatccaaccggcgcttcgcggccgtgggacaaggggcgcgatggctttgtgcttggtgatggtgccggcattctagtgctggaagagtatgagtatgctaaagcgcgaggcgcacgcatctatgctgaattggctggtttcggcgccacttccgatgccttccacatgacgatgccggtcgaggatggtgaaggtgcagcgcgttgtatgcgcatagcgttgcaggatgcgaaggttactccggagcaaattgattatctcaatgcacacggtacctcaactcctttgggcgatctgtgcgaaaccaacgcgatcaagacggtattaggagatcatgcctacaaagtgatggttagctcgaccaaatcaatgaccggacatctactcggtgcggccggtggtgtggaagcaattttctcagtgatggcgttgcatactggcatcgttccgccgacgattaatctcgaagaaccagacgaaggctgtgatcttgattacgtgccgcatgtggcgcgtgaggccaaactggatgtggtggtttcaaacggttttggtttcggtggtactaacggcacattagtgttcaagcgtatatga

SEQ ID NO: 19677 - protein, 411 aa, Xylella fastidiosa 9a5c
MNRRVVVTGMGMVSPLGNDLTTSWDGIVHGRSGIAPIVQIDASKLSTQIAGEIKGFDPMKFVSAKDAKKMDSFIYYGIGAAFMALDDAGLEINEINAERVGALIGSGIGGVFGIEEQTIKFYEGGVRKISPFYVPSTIINMLPGQLSVLKGLKGPTFSAVSACATSNHSIGMAMRMIQYGDADVMLAGGSERASSPTAIGGFCAMRAMSTRNDDPTGASRPWDKGRDGFVLGDGAGILVLEEYEYAKARGARIYAELAGFGATSDAFHMTMPVEDGEGAARCMRIALQDAKVTPEQIDYLNAHGTSTPLGDLCETNAIKTVLGDHAYKVMVSSTKSMTGHLLGAAGGVEAIFSVMALHTGIVPPTINLEEPDEGCDLDYVPHVAREAKLDVVVSNGFGFGGTNGTLVFKRI

SEQ ID NO: 19678 - DNA, 1236 bp, Streptococcus pneumoniae TIGR4
  CDS (1)..(1236): transl_table=11
atgaaactaaatcgagtagtggtaacaggttatggagtaacatctccaatcggaaatacaccagaagaattttggaatagtttagcaactgggaaaatcggcattggtggcattacaaaatttgatcatagtgactttgatgtgcataatgcggcagaaatccaagattttccgttcgataaatactttgtaaaaaaagataccaaccgttttgataactattctttatatgccttgtatgcagcccaagaggctgtaaatcatgccaatcttgatgtagaggctcttaatagggatcgttttggtgttatcgttgcatctggtattggtggaatcaaggaaattgaagatcaggtacttcgccttcatgaaaaaggacccaaacgtgtcaaaccaatgactcttccaaaagctttaccaaatatggcttctgggaatgtagccatgcgttttggtgcaaacggtgtttgtaaatctatcaatactgcctgctcttcatcaaatgatgcgattggggatgccttccgctccattaagtttggtttccaagatgtgatgttggtgggaggaacagaagcttctatcacaccttttgccatcgctggtttccaagccttaacagctctctctactacagaggatccaactcgtgcttcgatcccatttgataaggatcgcaatgggtttgttatgggtgaaggttcagggatgttggttctagaaagtcttgaacacgctgaaaaacgtggagctactatcctggctgaagtggttggttacggaaatacttgtgatgcctaccacatgacttctccacatccagaaggtcagggagctatcaaggccatcaaactagccttggaagaagctgagatttctccagagcaagtagcctatgtcaatgctcacggaacgtcaactcctgccaatgaaaaaggagaaagtggtgctatcgtagctgttcttggtaaggaagtacctgtatcatcaaccaagtcttttacaggacatttgctgggggctgcgggtgcagtagaagctatcgtcaccatcgaagctatgcgtcataactttgtaccaatgacagctgggacaagtgaagtatcagattatatcgaagctaatgtcgtttatggacaaggcttggagaaagaaattccatacgctatttcaaatacttttggttttggaggccacaatgcagttcttgctttcaaacgttgggagaatagataa

SEQ ID NO: 19679 - protein, 411 aa, Streptococcus pneumoniae TIGR4
MKLNRVVVTGYGVTSPIGNTPEEFWNSLATGKIGIGGITKFDHSDFDVHNAAEIQDFPFDKYFVKKDTNRFDNYSLYALYAAQEAVNHANLDVEALNRDRFGVIVASGIGGIKEIEDQVLRLHEKGPKRVKPMTLPKALPNMASGNVAMRFGANGVCKSINTACSSSNDAIGDAFRSIKFGFQDVMLVGGTEASITPFAIAGFQALTALSTTEDPTRASIPFDKDRNGFVMGEGSGMLVLESLEHAEKRGATILAEVVGYGNTCDAYHMTSPHPEGQGAIKAIKLALEEAEISPEQVAYVNAHGTSTPANEKGESGAIVAVLGKEVPVSSTKSFTGHLLGAAGAVEAIVTIEAMRHNFVPMTAGTSEVSDYIEANVVYGQGLEKEIPYAISNTFGFGGHNAVLAFKRWENR

SEQ ID NO: 19680 - DNA, 1236 bp, Clostridium acetobutylicum ATCC 824
  CDS (1)..(1236): transl_table=11
atgaataggagagttgttataacaggaattggagcagtaacacctgttggaaataacgctgacagcttttggtgctcaatcaaagaaggaaaatgtggtatagataaaataaaagcttttgatgcaacagattttaaggtgaagttagcagcagaagttaaggattttaccccagaagattttattgacaaaagagaagctaatagaatggatagattctcacaatttgcaatagtagcagcagatgaagcaataaaggattcaaagcttgatcttgaaagtatagataaaaatagatttggagttatagtaggttcaggtataggcggtattggtactatagagaaacaggatgaaaagcttattacaaaaggaccaggcagagtatcaccaatgactataccaatgattattgcaaatatggcatctggaaatttagctataagatatggagcaaaggggatatgcacaactatagtaacagcatgtgcttcggctaataattccataggagagtcttttagaaacataaaatttggatattcagatgtaatgataagtggtggtagcgaagcaggaataactccgctttcacttgcaggttttgcatctatgaaggctgttacaaaaagtgaagaccctaaaagagcatctattccatttgataaggatagaagtggttttgtaatgggcgaaggttcaggaattgttatccttgaagaattagaacatgcacttaaaagaggagctaaaatatatgctgaaatagtaggttatggagcaacttgtgatgcatatcatataacttcaccagcaccaaatggcgagggcggagctagagcaatgaaacttgcaatggaagaggacaatgtaagaccagaagatatttcgtatataaatgctcatggaacaagtacagcttataatgatagttttgaaactcaagctataaaaactgttttaggagaatatgcatataaggttcctgtaagttcaacaaaatcaatgacaggtcatttacttggtgcagggggagcagtagaagcaatcatatgtgctaaggctatagaagaaggatttattccaccaactattggatacaaagaagcagatcctgaatgtgaccttgattatgtaccgaacgaaggaagaaacgcagaagttaattatgtgttatccaattcacttggttttggcggacataatgctacacttttgtttaaaaaatataaataa

SEQ ID NO: 19681 - protein, 411 aa, Clostridium acetobutylicum ATCC 824
MNRRVVITGIGAVTPVGNNADSFWCSIKEGKCGIDKIKAFDATDFKVKLAAEVKDFTPEDFIDKREANRMDRFSQFAIVAADEAIKDSKLDLESIDKNRFGVIVGSGIGGIGTIEKQDEKLITKGPGRVSPMTIPMIIANMASGNLAIRYGAKGICTTIVTACASANNSIGESFRNIKFGYSDVMISGGSEAGITPLSLAGFASMKAVTKSEDPKRASIPFDKDRSGFVMGEGSGIVILEELEHALKRGAKIYAEIVGYGATCDAYHITSPAPNGEGGARAMKLAMEEDNVRPEDISYINAHGTSTAYNDSFETQAIKTVLGEYAYKVPVSSTKSMTGHLLGAGGAVEAIICAKAIEEGFIPPTIGYKEADPECDLDYVPNEGRNAEVNYVLSNSLGFGGHNATLLFKKYK

SEQ ID NO: 19682 - DNA, 1329 bp, Agrobacterium tumefaciens str. C58
  CDS (1)..(1329): transl_table=11
gtgctatcccatggtgcccggtgttgcagaaagaccgatgatttggataagggcggagcattggcgatgaggcgtgtcgttatcaccggtaccggcatggtatctcctcttggatgcggaacggaagtgacctgggagcggctgttggccggccagaatggtgcccgtctcgtgactgaattcgaggtcgaagacctgcccgcaaagatcgcctgccgcattcccgtcggcgacggctccaacggcaccttcaatgccgatgactggatggagcccaaggaacaacgcaaggtcgatcctttcattctctacggcatggctgccgccgacatggcgcttgccgacgcaaactggcatccggaaacggacgacgaccagatcgctaccggcgttctgatcggctccggcattggcggtctggaaggcattgtcgaggcgggttacacgctgcgcgacaagggcccacgccgcatttctccattcttcattcccggccgtctgatcaacctcgtatccggtcaggtttccattcgccacaagctgcgtggaccgaatcattccgtggtaacggcctgctcgaccggcgcacacgctatcggcgacgccgcccgactgatcgcgcttggcgatgccgaggtcatggtcgccggtggtgccgaatcgccggtctgccgcatttcgctcgccggatttgccgcctgcaaggcgctctccacccagcacaatgacgatccgcaaaaggcctcgcgcccctatgatcgcgaccgcgacggtttcgtcatgggcgagggtgccggcatcgttgttctcgaagaactcgaacacgccaaggcgcgcggcgcgaagatttacgccgaagtcgtcggttatggcctgtccggcgatgccttccacatcacggcgccgtccgaggatggcgacggtgcgtatcgctgcatgtccatggcgctgaagcgcgctggcctcacgcctgacgatatcgactatatcaacgcccacggcacctccaccatggccgacacgatcgagcttggcgcggtcgaacgtctggtcggcgaatctgctccgaagatttccatgtcttccaccaagtcggccaccggccatcttctcggcgctgccggcgcaatcgaggcgattttcgcgacgcttgcgatccgcgacaatatcgttccgccgacgctcaacctcgacaatcccgatgtcgagacgaagatagacctcgtgccgcacaaggcccgcaagcggcaggtcaatgtggcgctttcgaattccttcggtttcggcggcaccaacgcatcgctcgtgctgcgtcgttacgaagcataa

SEQ ID NO: 19683 - protein, 442 aa, Agrobacterium tumefaciens str. C58
MLSHGARCCRKTDDLDKGGALAMRRVVITGTGMVSPLGCGTEVTWERLLAGQNGARLVTEFEVEDLPAKIACRIPVGDGSNGTFNADDWMEPKEQRKVDPFILYGMAAADMALADANWHPETDDDQIATGVLIGSGIGGLEGIVEAGYTLRDKGPRRISPFFIPGRLINLVSGQVSIRHKLRGPNHSVVTACSTGAHAIGDAARLIALGDAEVMVAGGAESPVCRISLAGFAACKALSTQHNDDPQKASRPYDRDRDGFVMGEGAGIVVLEELEHAKARGAKIYAEVVGYGLSGDAFHITAPSEDGDGAYRCMSMALKRAGLTPDDIDYINAHGTSTMADTIELGAVERLVGESAPKISMSSTKSATGHLLGAAGAIEAIFATLAIRDNIVPPTLNLDNPDVETKIDLVPHKARKRQVNVALSNSFGFGGTNASLVLRRYEA

SEQ ID NO: 19684 - DNA, 1383 bp, Agrobacterium tumefaciens str. C58
  CDS (1)..(1383): transl_table=11
atgtctggagaaatgatcctgaccctgttctcggtcgggacgccgaaggcatgcctattttatcgtgaagacaggtggaaacagatgcgtcgtatcgttgtaacaggaatgggagccgtcagccctcttggcgcgaatgtggatatctcatggtcgcggctccttgctggccaaagcgggatccggcgactgaccgacgatgtcgtcggagatcttcctgcgaaagtgggaggcgttgtcccttctctcgccgaagacccagaaagaggattcgatccggacaggatcattgcacccaaggatcagcgcaaggtcgaccgcttcatcatcttcgcgctggcggcggcggaagaagcgctcgtgcaggcaaactggaagccggtctcgaatgaagacaggttgcgaaccgcgacaatcatcgcatccggcatcggcggtttccctgccatcacggaagccgtgcgaaccgttgatcaacgcggtgtacgccgcctctctcccttcacgataccgtcgttcctcgtcaatctcgcagccgggcaagtctcgatccgccacggtttcaaaggtccgctgggagcacccgtaacggcgtgtgctgccggcgttcaggcgatcggcgacgctgcacggcttatccggtccaatgaagccgacattgcggtttgcggtggaacggaagcttgcatgaacatcgtcagcctcggcggcttcgcggcggcaaggtcgctttccaccggtttcaacgagacgccgaccaaggcgtcgcgtcccttcgataccgcgcgtgacggcttcgtcatgggtgaaggcgcgggcgtactcgtcatcgaggcactcagccacgctctcgcccgcggagccaccccgattgccgaactcgttggatacggcacgacagccgacgcccaccacatcacgtcaggccccgaggatggaagtggggcacgcagggccatggagattgccatcgcgcaagcgggcatcgcccctcatgagattggtcatctgaacgcgcatgcgacatcgacgccggttggggacctcggagaaatcagggccatcaagagtgtgtttgggcaacgaaagtcggttgctgtcagtgggaccaagtcggcgacggggcacctgcttggcgcggccggcgggctggaagccatcttcacgattctagcgctcaaaaatcggatcgcccctccgacactgaacctgaacgcgccggatacggaatcggacgggatcgattttgttgcaaacctggcacgatccctggacgctgaatatgccatatccaacggcttcggttttggcggcgtcaatgccagcgttcttttccgacgttggccaaaggcaagcaatagcgggatatcctccgtgcgctga

SEQ ID NO: 19685 - protein, 460 aa, Agrobacterium tumefaciens str. C58
MSGEMILTLFSVGTPKACLFYREDRWKQMRRIVVTGMGAVSPLGANVDISWSRLLAGQSGIRRLTDDVVGDLPAKVGGVVPSLAEDPERGFDPDRIIAPKDQRKVDRFIIFALAAAEEALVQANWKPVSNEDRLRTATIIASGIGGFPAITEAVRTVDQRGVRRLSPFTIPSFLVNLAAGQVSIRHGFKGPLGAPVTACAAGVQAIGDAARLIRSNEADIAVCGGTEACMNIVSLGGFAAARSLSTGFNETPTKASRPFDTARDGFVMGEGAGVLVIEALSHALARGATPIAELVGYGTTADAHHITSGPEDGSGARRAMEIAIAQAGIAPHEIGHLNAHATSTPVGDLGEIRAIKSVFGQRKSVAVSGTKSATGHLLGAAGGLEAIFTILALKNRIAPPTLNLNAPDTESDGIDFVANLARSLDAEYAISNGFGFGGVNASVLFRRWPKASNSGISSVR

SEQ ID NO: 19686 - DNA, 1245 bp, Streptococcus pneumoniae R6
  CDS (1)..(1245): transl_table=11
gtgaaaagaatgaaactaaatcgagtagtggtaacaggttatggagtaacatctccaatcggaaatacaccagaagaattttggaatagtttagcaactgggaaaatcggcattggtggcattacaaaatttgatcatagtgactttgatgtgcataatgcggcagaaatccaagattttccgttcgataaatactttgtaaaaaaagataccaaccgttttgataactattctttatatgccttgtatgcagcccaagaggctgtaaaccatgccaatcttgatgtagaggctcttaatagggatcgttttggtgttatcgttgcatctggtattggtggaatcaaggaaattgaagatcaggtacttcgccttcatgaaaaaggacccaaacgtgtcaaaccaatgactcttccaaaagctttaccaaatatggcttctgggaatgtagccatgcgttttggtgcaaacggtgtttgtaaatctatcaatactgcctgctcttcatcaaatgatgcgattggggatgccttccgctccattaagtttggtttccaagatgtgatgttggtgggaggaacagaagcttctatcacaccttttgccatcgctggtttccaagccttaacagctctctctactacagaggatccaactcgtgcttcgatcccatttgataaggatcgcaatgggtttgttatgggtgaaggttcagggatgttggttctagaaagtcttgaacacgctgaaaaacgtggagctactatcctggctgaagtggttggttacggaaatacttgtgatgcctaccacatgacttctccacatccagaaggtcagggagctatcaaggccatcaaactagccttggaagaagctgagatttctccagagcaagtagcctatgttaatgctcacggaacgtcaactcctgccaatgaaaaaggagaaagtggtgctatcgtagctgttcttggtaaggaagtacctgtatcatcaaccaagtcttttacaggacatttgctgggggctgcgggtgcagtagaagctatcgtcaccatcgaagctatgcgtcataactttgtaccaatgacagctgggacaagtgaagtatcagattatatcgaagctaatgtcgtttatggacaaggtttggagaaagaaattccatacgctatttcaaatacttttggttttggaggccacaatgcagttcttgctttcaaacgttgggagaatagataa

SEQ ID NO: 19687 - protein, 414 aa, Streptococcus pneumoniae R6
MKRMKLNRVVVTGYGVTSPIGNTPEEFWNSLATGKIGIGGITKFDHSDFDVHNAAEIQDFPFDKYFVKKDTNRFDNYSLYALYAAQEAVNHANLDVEALNRDRFGVIVASGIGGIKEIEDQVLRLHEKGPKRVKPMTLPKALPNMASGNVAMRFGANGVCKSINTACSSSNDAIGDAFRSIKFGFQDVMLVGGTEASITPFAIAGFQALTALSTTEDPTRASIPFDKDRNGFVMGEGSGMLVLESLEHAEKRGATILAEVVGYGNTCDAYHMTSPHPEGQGAIKAIKLALEEAEISPEQVAYVNAHGTSTPANEKGESGAIVAVLGKEVPVSSTKSFTGHLLGAAGAVEAIVTIEAMRHNFVPMTAGTSEVSDYIEANVVYGQGLEKEIPYAISNTFGFGGHNAVLAFKRWENR

SEQ ID NO: 19688 - DNA, 1287 bp, Rickettsia conorii str. Malish 7
  CDS (1)..(1287): transl_table=11
atgtcgaatcaaagagtaaataaaagagtagttattaccggacttggacttgttactcctgttgggcttaatgttagctcatcttggaaaaatattgtagatggagtaagcggtataaaaactattacagaatttgacacttctaaacttgcgtgtaaaattgccggacttatagataactctgagaaagatggatttaaacttgaaaatttcatacaagcagatgacattaatagactaagtaaaatggataaatttatccattacggagtagcggccgcaaccgaagcagttgaagatagcggctggttacccgacgatgaaaaatctcgtgatagaaccggcttgatattaggttcaggaatcggtgggcttaaaatgatcgaagatacctctatcaaactttatcaagaaaataacggcaaagttagtcctttctttatccccgcttcattaattaatcttttatccggtcttgtttctataaaatacggttttagcggtccaaaccaaacggcagtaacagcttgctctacaggggcacatgctataggcgatgctatgcgtatgataaagcacggctatgccgatgttatgatcgcaggcggtgcggaagctccagttacacctgtcggagttgcaggtttcgttgctgctagagcattatgtactaaatataacgataatcctaaaaaagcctcaagaccttgggataaagaccgcagcggctttgttatgggtgaaggagcaggcgttgtagtcttagaagaatatgagcatgccttaaatcgaggggctaaagtttacggtgaagttataggatacggctctacaggtgacgcctatcatatgacagctccacatcctgaaggtagaggagcttatagagcgatgagagacgcaatgctagatgcaactatcacgcccgatatgattgattatattaatgcacacggtacttctactacacttggtgatggaatagaattagcagccgtacaaaaattatttttagaagcgaatcccaaagttttaatgtcttctactaaatcatcaataggacatttgcttggtgcggcaggaagtgttgagtttatcttttcagctcttgcaattagagaccagattgcaccgccaaccttaaacttagatacccctatggatgaggtgaatatagatttagttgcacttaaagctaagaaaactaagatagattacgtgctttccaactcgttcggattcggtggtactaatgctagtttagtgattaagagtatactcgtttaa

SEQ ID NO: 19689 - protein, 428 aa, Rickettsia conorii str. Malish 7
MSNQRVNKRVVITGLGLVTPVGLNVSSSWKNIVDGVSGIKTITEFDTSKLACKIAGLIDNSEKDGFKLENFIQADDINRLSKMDKFIHYGVAAATEAVEDSGWLPDDEKSRDRTGLILGSGIGGLKMIEDTSIKLYQENNGKVSPFFIPASLINLLSGLVSIKYGFSGPNQTAVTACSTGAHAIGDAMRMIKHGYADVMIAGGAEAPVTPVGVAGFVAARALCTKYNDNPKKASRPWDKDRSGFVMGEGAGVVVLEEYEHALNRGAKVYGEVIGYGSTGDAYHMTAPHPEGRGAYRAMRDAMLDATITPDMIDYINAHGTSTTLGDGIELAAVQKLFLEANPKVLMSSTKSSIGHLLGAAGSVEFIFSALAIRDQIAPPTLNLDTPMDEVNIDLVALKAKKTKIDYVLSNSFGFGGTNASLVIKSILV

SEQ ID NO: 19690 - DNA, 1245 bp, Staphylococcus aureus subsp. aureus Mu50
  CDS (1)..(1245): transl_table=11
atgagtcaaaataaaagagtagttattacaggtatgggagccctttctccaatcggtaatgatgtcaaaacaacatgggagaatgctctaaaaggcgtaaatggtatcgataaaattacacgtatcgatactgaaccttatagcgttcacttagcaggagaacttaaaaactttaatattgaagatcatatcgacaaaaaagaagcgcgtcgtatggatagatttactcaatatgcaattgtagcagctagagaggctgttaaagatgcgcaattagatatcaatgataatactgcagatcgaatcggtgtatggattggttctggtatcggtggtatggaaacatttgaaattgcacataaacaattaatggataaaggcccaagacgtgtgagtccatttttcgtaccaatgttaattcctgatatggcaactgggcaagtatcaattgacttaggtgcaaaaggaccaaatggtgcaacagttacagcatgtgcaacaggtacaaactcaatcggagaagcatttaaaattgtgcaacgcggtgatgcagatgcaatgattactggtggtacggaagctccaatcactcatatggcaattgcaggtttcagtgcaagtcgagcgctttctacaaatgatgacattgaaacagcatgtcgtccattccaagaaggtagagacggttttgttatgggtgaaggtgctggtattttagtaatcgaatctttagaatcagcacaagctcgaggtgccaatatttatgctgagatagttggctatggtactacaggtgatgcttatcatattacagcgccagctccagaaggtgaaggcggttctagagcaatgcaagcagctatggatgatgctggtattgaacctaaagatgtacaatacttaaatgcccatggtacaagtactcctgttggtgacttaaatgaagttaaagctattaaaaatacatttggtgaagcagctaaacacttaaaagttagctcaacaaaatcaatgactggtcacttacttggtgcaacaggtggaattgaagcaatcttctcagcgctttcaattaaagactctaaagtcgcaccgacaatacatgcggtaacaccagacccagaatgtgatttggatattgttccaaatgaagcgcaagaccttgatattacttatgcaatgagtaatagcttaggattcggtggacataacgcagtattagtattcaagaaatttgaagcataa

SEQ ID NO: 19691 - protein, 414 aa, Staphylococcus aureus subsp. aureus Mu50
MSQNKRVVITGMGALSPIGNDVKTTWENALKGVNGIDKITRIDTEPYSVHLAGELKNFNIEDHIDKKEARRMDRFTQYAIVAAREAVKDAQLDINDNTADRIGVWIGSGIGGMETFEIAHKQLMDKGPRRVSPFFVPMLIPDMATGQVSIDLGAKGPNGATVTACATGTNSIGEAFKIVQRGDADAMITGGTEAPITHMAIAGFSASRALSTNDDIETACRPFQEGRDGFVMGEGAGILVIESLESAQARGANIYAEIVGYGTTGDAYHITAPAPEGEGGSRAMQAAMDDAGIEPKDVQYLNAHGTSTPVGDLNEVKAIKNTFGEAAKHLKVSSTKSMTGHLLGATGGIEAIFSALSIKDSKVAPTIHAVTPDPECDLDIVPNEAQDLDITYAMSNSLGFGGHNAVLVFKKFEA

SEQ ID NO: 19692 - DNA, 1242 bp, Bacillus subtilis subsp. subtilis str. 168
  CDS (1)..(1242): transl_table=11
atgactaaaaaaagagtagttgttacaggacttggagcattatctccacttggcaacgacgtcgatacaagttggaataacgcaatcaacggtgtgtccggaatcggtccgatcactcgtgttgacgctgaagaatatccggcaaaagttgccgctgaattaaaagattttaatgttgaagattatatggataaaaaagaagccagaaaaatggaccgctttacacaatatgcggttgtggctgcgaaaatggcggttgaagatgcagatcttaacattaccgatgagatcgcgccgagagtcggtgtttgggtaggctccggtatcggaggacttgaaacactagagtctcaatttgaaatcttcttaacaaaaggcccaagacgggtaagcccgtttttcgtgccaatgatgattcctgacatggcgacaggccagatttctattgcattaggagcaaaaggggtgaactcttgtacggttacagcatgtgctacaggaacgaactccatcggtgacgcgtttaaggttattcagcgcggtgatgcagacgtgatggtcacaggcggaacagaagcgccgctgacaagaatgtcattcgccggctttagtgccaacaaagcgctgtctactaatccagatccgaaaacagcgagccgcccgtttgataaaaaccgtgatggctttgtcatgggggaaggtgcagggattatcgttcttgaagaacttgagcatgccctggcccgcggcgctaaaatttacggagaaattgtcggctacggctcaaccggagacgcttatcatatcacagcgccggcccaagacggtgaaggcggagcgagagcgatgcaagaagccattaaagatgcaggcattgcacctgaagaaattgattacatcaatgctcacgggacaagcacgtattacaacgacaaatacgaaacaatggcgattaagaccgtttttggcgagcatgcgcataaacttgcggtaagctctacaaaatcgatgacaggccacctcttaggagcagccggcggtattgaagccattttctctatcctggccattaaagaaggcgtgattccgccgacaatcaatattcaaacacctgacgaagaatgtgatttggattatgtgcctgatgaagcccgcagacaggaacttaattatgttctcagcaactcattaggattcggcggacacaacgcaacattaatctttaaaaaatatcaatcataa

SEQ ID NO: 19693 - protein, 413 aa, Bacillus subtilis subsp. subtilis str. 168
MTKKRVVVTGLGALSPLGNDVDTSWNNAINGVSGIGPITRVDAEEYPAKVAAELKDFNVEDYMDKKEARKMDRFTQYAVVAAKMAVEDADLNITDEIAPRVGVWVGSGIGGLETLESQFEIFLTKGPRRVSPFFVPMMIPDMATGQISIALGAKGVNSCTVTACATGTNSIGDAFKVIQRGDADVMVTGGTEAPLTRMSFAGFSANKALSTNPDPKTASRPFDKNRDGFVMGEGAGIIVLEELEHALARGAKIYGEIVGYGSTGDAYHITAPAQDGEGGARAMQEAIKDAGIAPEEIDYINAHGTSTYYNDKYETMAIKTVFGEHAHKLAVSSTKSMTGHLLGAAGGIEAIFSILAIKEGVIPPTINIQTPDEECDLDYVPDEARRQELNYVLSNSLGFGGHNATLIFKKYQS

SEQ ID NO: 19694 - DNA, 1281 bp, Caulobacter crescentus CB15
  CDS (1)..(1281): transl_table=11
atgcgtagagtcgtcgtcacgggtatcggcctgttgaccccgctcggccaaggtgtcgacatcacctggaagaacatcctcgccggcaagtccggcgcgaaccgcatcagcgcgttcgaccccaccgactattcgtgccaggtcgcctgcgaggtgccgcgcgtcgatggtcgcggcggcggcggcccggatgtcgaaggctcgttcgatcctgaccagaccatgagcccgcgcgatcagaagcgcgtcgatgacttcatcctgtacggcgtcgccgccgccgatgaggccatcaaggattcgggctgggttccggaaaccgacgaggacaagtggcgcacgggcgtcatcctgggctcgggcatcggcggtctgtcgaccatcgccgacacggcgctggagcttgaggccaagggcccgcgacgcgtcagcccgttctttatctcgtcagccctgatcaacctgatctcgggtcaggtctcgatcaagtacggcttcaagggcccgaaccacgcggtcgtgaccgcctgcgccaccggtgcccatgcgatcggcgacgccgcgcgcctgatcaagtatggcgacgccgacgtgatggtggccggcggggccgaggcggccgtctgcaaggtcggcatcgccggtttccaggcctgccgcgccgtggccaccgcgttcaacgacacgcccgagaaggcctcgcgcccgtacgacaaggaccgcgacggcttcgtcatgggcgagggcgcgggcgttctggtgctggaagagtacgaacacgccaaggcgcgcggcgccaagatctatgctgaagtcgcaggctatggcctgtcgggcgacgcctaccacatcaccgccccgtcggaagacggcgagggtggcgcgcgggccctggccgccgccgtgcgtgacgcgggcctgaagccctcggacatcaactatgtcaatgctcacggcacctcgaccatggctgacggcatcgaggctaaggcggtcgagcggttcctcggcgatcacgccaagaacgtcgtcatgtcctcgaccaagtcgatgacgggccaccttctgggcgcggccggcgcgatcgaggcggcgttctcgatcctggcgatccgcgatcagatcgccccgccgaccatcaacctcgacaatcccgatgtcgaggtcgcgatgaatctcgccccgcacaaggccgtgccgatgaagatcgatgtggccgtgtccaacagcttcggcttcggcggcaccaacgcctccgtcgtgttcaagaaggtctcgtga

SEQ ID NO: 19695 - protein, 426 aa, Caulobacter crescentus CB15
MRRVVVTGIGLLTPLGQGVDITWKNILAGKSGANRISAFDPTDYSCQVACEVPRVDGRGGGGPDVEGSFDPDQTMSPRDQKRVDDFILYGVAAADEAIKDSGWVPETDEDKWRTGVILGSGIGGLSTIADTALELEAKGPRRVSPFFISSALINLISGQVSIKYGFKGPNHAVVTACATGAHAIGDAARLIKYGDADVMVAGGAEAAVCKVGIAGFQACRAVATAFNDTPEKASRPYDKDRDGFVMGEGAGVLVLEEYEHAKARGAKIYAEVAGYGLSGDAYHITAPSEDGEGGARALAAAVRDAGLKPSDINYVNAHGTSTMADGIEAKAVERFLGDHAKNVVMSSTKSMTGHLLGAAGAIEAAFSILAIRDQIAPPTINLDNPDVEVAMNLAPHKAVPMKIDVAVSNSFGFGGTNASVVFKKVS

SEQ ID NO: 19696 - DNA, 1251 bp, Chlamydophila pneumoniae AR39
  CDS (1)..(1251): transl_table=11
atgagtaaaaaacgcgtagttgttacaggattcggtgttgtatcttgcctcggtaatgaagtagataccttttacgataatcttcttgccggtgtcagcggcgtacggccaattacatcctttccttgtgaggattatgccactcgttttgccggctggatcccagaattcaatcccgagccttatgtagataaaaagcaagcacgtcgtgtcgacccctttattacctatgccatggtagctgctaagaaagcgatcgctatgtcacgttgggataaagaccatctgccttccgatcccgtgcgttgtggagtgattgtcggctctggaatgggtgggctctctaccctagaccaagggatggaaagactcttagttattcataaaaaattatctcccttctttattccttatatcattacaaatatggccccagcacttattgctatggactttggtttgatgggccccaattattctatatcaactgcatgtgctacaggaaattattgtattgatgccgcctaccaacatttagtatctgggcgcgctgatatgatcatctgtggtggtacggaagctgcagtgaaccgtattggtttagagggttttattgctaatcgtgctctctctgagagaaacgatgctccagatcaagcttcacgtccttgggatagagatcgtgatggctttgtcttaggagaaggagcaggaattcttgttttagaaaccctagagagtgctctacgtcgcgatgctcctatttttgctgagatgttaggaagctatgttacatgcgatgccttccatattaccgctcctagagatgacggtgaggggattactgcatgcgtgcttggtgctttaaattccgcaggaattcctaaagaacgtgtcaactatgtgaatgctcacggaacgtcgactccattaggggatctttctgaagttctagctgttaaaaaggcttttggctcccatgtacgaaatctccgcatgaactccactaaatcattgatagggcattgtcttggagctgctggaggtgttgaagccgtcgttgcaattcaagctatccttacgggaaagcttcatcctacgattaatttggataaccctatcgcagaaattgaagactttgatgtagttgcaaataaagctcaagactgggatattgatgtagcgatgtccaactcatttggttttggtggacataattcaacgatattattctcgaggtatgtaccctag

SEQ ID NO: 19697 - protein, 416 aa, Chlamydophila pneumoniae AR39
MSKKRVVVTGFGVVSCLGNEVDTFYDNLLAGVSGVRPITSFPCEDYATRFAGWIPEFNPEPYVDKKQARRVDPFITYAMVAAKKAIAMSRWDKDHLPSDPVRCGVIVGSGMGGLSTLDQGMERLLVIHKKLSPFFIPYIITNMAPALIAMDFGLMGPNYSISTACATGNYCIDAAYQHLVSGRADMIICGGTEAAVNRIGLEGFIANRALSERNDAPDQASRPWDRDRDGFVLGEGAGILVLETLESALRRDAPIFAEMLGSYVTCDAFHITAPRDDGEGITACVLGALNSAGIPKERVNYVNAHGTSTPLGDLSEVLAVKKAFGSHVRNLRMNSTKSLIGHCLGAAGGVEAVVAIQAILTGKLHPTINLDNPIAEIEDFDVVANKAQDWDIDVAMSNSFGFGGHNSTILFSRYVP

SEQ ID NO: 19698 - DNA, 1242 bp, Listeria monocytogenes EGD-e
  CDS (1)..(1242): transl_table=11
atggataagagaagagtagttgttactggtgttggagctgttacacctattggaaacgatgcggaaacttcttgggaaaacgcaaaaaaaggtgttaatggtgttgcaaaaatgacaagacttaatccggatgactttccggttaaaattgcagcagagttaaaagattttgatgtagaaaaatatctagagaaaaaagaagctcgtaaaatggaccgttttacgcattatgcaattgcaagtgctgaaatggctgtacaagactctggtttagttattgatgattccaatgcaaaccgcgttggtgtttggattggttcaggaattggcggaatggaaactttcgaaacacaatatgaaattttcttaaatcgtggacatcgtcgagttagtccgtttttcgtacctatgatgattccagatatgggttcaggccaagtttctattcgttttggagctaaaggcattaactctacaacagttacagcttgtgcaacagcaacaaactcaatcggcgacgcgtttaaagttattgagcgtggggatgctgatgcaatgattactggtggagcagaagcaccaatcactaaaatgtcacttgcaggatttactgctaataaagctttgtcattaaatccagatccagaaactgcttgtcgtccatttgataaagaccgtgatggttttattattggcgaaggagcaggtatcgttattttagaagaatacgaacatgcaaaagcacgtggggcaaaaatttacgctgaaatcgttggttacggtgcaacaggagatgcttaccacattactgctccagcaccaaacggcgaaggtgctgctcgcgcaatgaaaatggcgattgatgatgctgggcttactcctgataaagtagattacattaatgcccacggaacaagtacaccatacaatgatgaatacgaaacacaagctattaaaactgtctttggagagcatgcgaaaaaattagcgattagttctactaagtcaatgacaggacatactttaggtgcgtctggcgggatagaagctattttcgcgcttttgactattcgtgataatattattgcaccaacgattcatttgaaaaaccaagatgaagtttgtgacttggattatgttccaaatgaagcacgtgaagcaaatgtaaatgttgtaatttctaactcttttggctttggtggtcataatgcgactttagtatttaaaagaatagaagactaa

SEQ ID NO: 19699 - protein, 413 aa, Listeria monocytogenes EGD-e
MDKRRVVVTGVGAVTPIGNDAETSWENAKKGVNGVAKMTRLNPDDFPVKIAAELKDFDVEKYLEKKEARKMDRFTHYAIASAEMAVQDSGLVIDDSNANRVGVWIGSGIGGMETFETQYEIFLNRGHRRVSPFFVPMMIPDMGSGQVSIRFGAKGINSTTVTACATATNSIGDAFKVIERGDADAMITGGAEAPITKMSLAGFTANKALSLNPDPETACRPFDKDRDGFIIGEGAGIVILEEYEHAKARGAKIYAEIVGYGATGDAYHITAPAPNGEGAARAMKMAIDDAGLTPDKVDYINAHGTSTPYNDEYETQAIKTVFGEHAKKLAISSTKSMTGHTLGASGGIEAIFALLTIRDNIIAPTIHLKNQDEVCDLDYVPNEAREANVNVVISNSFGFGGHNATLVFKRIED

SEQ ID NO: 19700 - DNA, 1242 bp, Listeria innocua Clip11262
  CDS (1)..(1242): transl_table=11
atggatagaagaagagtagttgttactggtattggagcagttacaccaattgggaatgatgcagaaacttcgtgggaaaacgcaaaaaaaggtgtcaatggtgttgcagaaatgacaagacttaatccggatgactttccggttaaaattgcagcagaattaaaagactttgatgtagaaaaatatttagagaaaaaagaagctcgtaaaatggaccgtttcacccattatgccattgcaagtgctgaaatggctgtgcaagattctggtttaattattgatgattccaatgccactcgtgttggtgtatggattggatccggtatcggtggaatggaaacattcgaaacacaatatgaagttttcctaaatcgtggacatcgtcgtgttagtccgttctttgtaccaatgatgattccggatatgggttcaggacaagtttcgattcgttttggagcaaaaggaattaactctactacagtaacagcatgtgcgactgcaaccaactctatcggtgacgcatttaaagttatcgaacgcggggatgcagatgcaatgattactggtggagcagaggcgccaattacaaaaatgtcactagcaggatttacagcaaataaagctttatcattaaacccagacccagaaacagcatgtcgtccatttgataaagaccgtgatggttttattattggtgaaggtgctggggttgtaattttagaagaatatgaacatgcaaaagctcgtggtgctaaaatttatgcagaagttgttggttacggtgcaacaggtgatgcatatcatattactgcaccagcgccaaatggtgaaggcgctgcacgtgcaatgaaaatggcgattgacgatgcgggacttactcctgacaaagttgactacattaacgcgcacggaacaagtactccttacaatgatgaatacgaaacacaagcgattaaaactgtgttcggtgagcatgcgaagaaattggctattagctctaccaaatcaatgacaggacatactttaggtgcatcaggtggtattgaagctatttttgctttattaagtattcgtgataatattatcgcgccaacaatccacttggaaaatcaagatgaagtttgtgacttggactatgttccaaacaaagctcgtgaagcagaagtaaatgtcgtaatgtctaactcttttggcttcggtggccacaatgcgacactagtattcaaaagaatagaagactaa

SEQ ID NO: 19701 - protein, 413 aa, Listeria innocua Clip11262
MDRRRVVVTGIGAVTPIGNDAETSWENAKKGVNGVAEMTRLNPDDFPVKIAAELKDFDVEKYLEKKEARKMDRFTHYAIASAEMAVQDSGLIIDDSNATRVGVWIGSGIGGMETFETQYEVFLNRGHRRVSPFFVPMMIPDMGSGQVSIRFGAKGINSTTVTACATATNSIGDAFKVIERGDADAMITGGAEAPITKMSLAGFTANKALSLNPDPETACRPFDKDRDGFIIGEGAGVVILEEYEHAKARGAKIYAEVVGYGATGDAYHITAPAPNGEGAARAMKMAIDDAGLTPDKVDYINAHGTSTPYNDEYETQAIKTVFGEHAKKLAISSTKSMTGHTLGASGGIEAIFALLSIRDNIIAPTIHLENQDEVCDLDYVPNKAREAEVNVVMSNSFGFGGHNATLVFKRIED

SEQ ID NO: 19702 - DNA, 1251 bp, Nostoc sp. PCC 7120
  CDS (1)..(1251): transl_table=11
atgacagattataatcgtaaacgcgttgttgtcacgggtgttggcgcgattacacctattggtaacacagcctctgaatattgggaaggattgttaagcggacgcaatggcattgactacatcacccactttgatgcgtctagccatgattgtcggattgctggtgaagtgaaaaacttcgacccccatgagtacttggagcgcaaagaagccaagcgcatggatcggttttcccaatttgcagttgcagcagccaaacaagcacttgtggattcccagttagtcattaatgaactgaacgccgaacaagtgggggttattattggttctggggtaggcggactcaaggtcatggaagaccagcaaaccatctatctcaaccgggggcctgatcgctgtagtcccttcatgattcccatgatgatcgccaacatggcggctggactgacagcaattcacactggtgccaaagggccaaataactgtactgtcaccgcttgcgccgcaggctctaatgcgatcggcgacgctttccgcctagtccaaggtggttatgcccaagccatgatttgtggtggggctgaggcagcaattacaccattaggtgtggctgggtttgcggctgcaagggcgttatcaactcgcaatgatgacccagctcatgcttgtcgtccctttgaccgcgatcgcgatggatttgtcatgggtgaaggtgcgggaattctcattctggaagagctgcaacacgccataagtcgcggcgctcgcatttatgccgaaatcgttggttatggtatgacttgcgatgcctaccacatgacatccccagtccctggcggcgaaggagcctccagagccatccaactggcactcaaagacgcaaacatcaccccagaacaagttagctacattaatgctcacggtaccagcacctcagcaaacgataccaccgaaaccgcagcgattaaacgagcgctaggagaccatgcttataaaatagcagtcagctccaccaaatcgatgacaggtcatcttttgggtggttctggcggtattgaagctgtagccacagtgttggcaactgctcatgaccaaattccacctacaattaatattgaaaaccttgacccagattgtgacctagattacgtgcctgactctagtcgcgctcacaaagtccaggtagcattgtctaattcttttggatttggtggtcataatgtcacactagctttcaaaaagtacgtgtga

SEQ ID NO: 19703 - protein, 416 aa, Nostoc sp. PCC 7120
MTDYNRKRVVVTGVGAITPIGNTASEYWEGLLSGRNGIDYITHFDASSHDCRIAGEVKNFDPHEYLERKEAKRMDRFSQFAVAAAKQALVDSQLVINELNAEQVGVIIGSGVGGLKVMEDQQTIYLNRGPDRCSPFMIPMMIANMAAGLTAIHTGAKGPNNCTVTACAAGSNAIGDAFRLVQGGYAQAMICGGAEAAITPLGVAGFAAARALSTRNDDPAHACRPFDRDRDGFVMGEGAGILILEELQHAISRGARIYAEIVGYGMTCDAYHMTSPVPGGEGASRAIQLALKDANITPEQVSYINAHGTSTSANDTTETAAIKRALGDHAYKIAVSSTKSMTGHLLGGSGGIEAVATVLATAHDQIPPTINIENLDPDCDLDYVPDSSRAHKVQVALSNSFGFGGHNVTLAFKKYV

SEQ ID NO: 19704 - DNA, 1233 bp, Ralstonia solanacearum GMI1000
  CDS (1)..(1233): transl_table=11
gtgagccgtcgtcgcgtagtcgttaccggcctggggctggtctctccggtaggaaactcggtcgccgaagggtgggccaatctggtcgctggcaagtccggcatcgccaccgtcaccaaattcgatccgtctaacttggccgtgcacttcgccggcgaagtgaagggcttcaacgtcgaggagtacctctcggccaaggatgctcgccagatggataccttcatccattacggcattgccgctggggtgcaggcactcaaggacagcggcctggaggtgaacgaggccaacgccgagcgtgcaggcgtgctggtcggctccggcatcggtggcctgccgatgatcgaagacacccattccacgtacgtcgaacgcggtccgcgccggatttcgccgttcttcgtgccggggtcgatcatcaacatgatctcggggcacctcagcatcatgcatggcctgaaggggccgaacctggcggcggtcacggcttgcacgaccgggctgcacagcatcgggttggcggcgcgcctgattcaggcgggcgatgccgacgtgatgctggcgggtggcgccgagtcgacggtctcgccgctcggcatcggcggcttcgcagcagcgcgcgcgctgtcgacccgcaacgacgatccggccaccgcgtcccgtccgtgggacaaggatcgcgacggcttcgtgctgggcgagggtgcaggcgtgatggtgctggaagagtacgagtccgccaaggcgcgcggagccaggatctacgcggagctcgtgggcttcggcatgagcggtgacgcttatcacatgactgcgcccaacatggatggtccgcgccgctgcatgctcaatgcgctgcgcgatgccggcatcaacaccgaccaggtgcagtacctgaacgcgcacggcacgtccaccccgctgggcgacaagaatgaatccgacgccatcaaggcggcttttggcgagcacgcccgcaaggtcgtcgtgaactccaccaagtccatgaccggccatctgctgggcggcgcgggcggcctggagtcggtgttctcggtgttggcgctccaccatcaggtgtcgccgccgaccatcaatattttcaaccaggatcccgagtgcgatctcgattactgcgccaatacggcgcgtgacatgaagatcgacgtggccgtgaagaacaacttcggctttggcgggaccaacggcacgctggtgttccgacgcctgtga

SEQ ID NO: 19705 - protein, 410 aa, Ralstonia solanacearum GMI1000
MSRRRVVVTGLGLVSPVGNSVAEGWANLVAGKSGIATVTKFDPSNLAVHFAGEVKGFNVEEYLSAKDARQMDTFIHYGIAAGVQALKDSGLEVNEANAERAGVLVGSGIGGLPMIEDTHSTYVERGPRRISPFFVPGSIINMISGHLSIMHGLKGPNLAAVTACTTGLHSIGLAARLIQAGDADVMLAGGAESTVSPLGIGGFAAARALSTRNDDPATASRPWDKDRDGFVLGEGAGVMVLEEYESAKARGARIYAELVGFGMSGDAYHMTAPNMDGPRRCMLNALRDAGINTDQVQYLNAHGTSTPLGDKNESDAIKAAFGEHARKVVVNSTKSMTGHLLGGAGGLESVFSVLALHHQVSPPTINIFNQDPECDLDYCANTARDMKIDVAVKNNFGFGGTNGTLVFRRL

SEQ ID NO: 19706 - DNA, 1263 bp, Agrobacterium tumefaciens str. C58
  CDS (1)..(1263): transl_table=11
atgaggcgtgtcgttatcaccggtaccggcatggtatctcctcttggatgcggaacggaagtgacctgggagcggctgttggccggccagaatggtgcccgtctcgtgactgaattcgaggtcgaagacctgcccgcaaagatcgcctgccgcattcccgtcggcgacggctccaacggcaccttcaatgccgatgactggatggagcccaaggaacaacgcaaggtcgatcctttcattctctacggcatggctgccgccgacatggcgcttgccgacgcaaactggcatccggaaacggacgacgaccagatcgctaccggcgttctgatcggctccggcattggcggtctggaaggcattgtcgaggcgggttacacgctgcgcgacaagggcccacgccgcatttctccattcttcattcccggccgtctgatcaacctcgtatccggtcaggtttccattcgccacaagctgcgtggaccgaatcattccgtggtaacggcctgctcgaccggcgcacacgctatcggcgacgccgcccgactgatcgcgcttggcgatgccgaggtcatggtcgccggtggtgccgaatcgccggtctgccgcatttcgctcgccggatttgccgcctgcaaggcgctctccacccagcacaatgacgatccgcaaaaggcctcgcgcccctatgatcgcgaccgcgacggtttcgtcatgggcgagggtgccggcatcgttgttctcgaagaactcgaacacgccaaggcgcgcggcgcgaagatttacgccgaagtcgtcggttatggcctgtccggcgatgccttccacatcacggcgccgtccgaggatggcgacggtgcgtatcgctgcatgtccatggcgctgaagcgcgctggcctcacgcctgacgatatcgactatatcaacgcccacggcacctccaccatggccgacacgatcgagcttggcgcggtcgaacgtctggtcggcgaatctgctccgaagatttccatgtcttccaccaagtcggccaccggccatcttctcggcgctgccggcgcaatcgaggcgattttcgcgacgcttgcgatccgcgacaatatcgttccgccgacgctcaacctcgacaatcccgatgtcgagacgaagatagacctcgtgccgcacaaggcccgcaagcggcaggtcaatgtggcgctttcgaattccttcggtttcggcggcaccaacgcatcgctcgtgctgcgtcgttacgaagcataa

SEQ ID NO: 19707 - protein, 420 aa, Agrobacterium tumefaciens str. C58
MRRVVITGTGMVSPLGCGTEVTWERLLAGQNGARLVTEFEVEDLPAKIACRIPVGDGSNGTFNADDWMEPKEQRKVDPFILYGMAAADMALADANWHPETDDDQIATGVLIGSGIGGLEGIVEAGYTLRDKGPRRISPFFIPGRLINLVSGQVSIRHKLRGPNHSVVTACSTGAHAIGDAARLIALGDAEVMVAGGAESPVCRISLAGFAACKALSTQHNDDPQKASRPYDRDRDGFVMGEGAGIVVLEELEHAKARGAKIYAEVVGYGLSGDAFHITAPSEDGDGAYRCMSMALKRAGLTPDDIDYINAHGTSTMADTIELGAVERLVGESAPKISMSSTKSATGHLLGAAGAIEAIFATLAIRDNIVPPTLNLDNPDVETKIDLVPHKARKRQVNVALSNSFGFGGTNASLVLRRYEA

SEQ ID NO: 19708 - DNA, 1299 bp, Agrobacterium tumefaciens str. C58
  CDS (1)..(1299): transl_table=11
atgcgtcgtatcgttgtaacaggaatgggagccgtcagccctcttggcgcgaatgtggatatctcatggtcgcggctccttgctggccaaagcgggatccggcgactgaccgacgatgtcgtcggagatcttcctgcgaaagtgggaggcgttgtcccttctctcgccgaagacccagaaagaggattcgatccggacaggatcattgcacccaaggatcagcgcaaggtcgaccgcttcatcatcttcgcgctggcggcggcggaagaagcgctcgtgcaggcaaactggaagccggtctcgaatgaagacaggttgcgaaccgcgacaatcatcgcatccggcatcggcggtttccctgccatcacggaagccgtgcgaaccgttgatcaacgcggtgtacgccgcctctctcccttcacgataccgtcgttcctcgtcaatctcgcagccgggcaagtctcgatccgccacggtttcaaaggtccgctgggagcacccgtaacggcgtgtgctgccggcgttcaggcgatcggcgacgctgcacggcttatccggtccaatgaagccgacattgcggtttgcggtggaacggaagcttgcatgaacatcgtcagcctcggcggcttcgcggcggcaaggtcgctttccaccggtttcaacgagacgccgaccaaggcgtcgcgtcccttcgataccgcgcgtgacggcttcgtcatgggtgaaggcgcgggcgtactcgtcatcgaggcactcagccacgctctcgcccgcggagccaccccgattgccgaactcgttggatacggcacgacagccgacgcccaccacatcacgtcaggccccgaggatggaagtggggcacgcagggccatggagattgccatcgcgcaagcgggcatcgcccctcatgagattggtcatctgaacgcgcatgcgacatcgacgccggttggggacctcggagaaatcagggccatcaagagtgtgtttgggcaacgaaagtcggttgctgtcagtgggaccaagtcggcgacggggcacctgcttggcgcggccggcgggctggaagccatcttcacgattctagcgctcaaaaatcggatcgcccctccgacactgaacctgaacgcgccggatacggaatcggacgggatcgattttgttgcaaacctggcacgatccctggacgctgaatatgccatatccaacggcttcggttttggcggcgtcaatgccagcgttcttttccgacgttggccaaaggcaagcaatagcgggatatcctccgtgcgctga

SEQ ID NO: 19709 - protein, 432 aa, Agrobacterium tumefaciens str. C58
MRRIVVTGMGAVSPLGANVDISWSRLLAGQSGIRRLTDDVVGDLPAKVGGVVPSLAEDPERGFDPDRIIAPKDQRKVDRFIIFALAAAEEALVQANWKPVSNEDRLRTATIIASGIGGFPAITEAVRTVDQRGVRRLSPFTIPSFLVNLAAGQVSIRHGFKGPLGAPVTACAAGVQAIGDAARLIRSNEADIAVCGGTEACMNIVSLGGFAAARSLSTGFNETPTKASRPFDTARDGFVMGEGAGVLVIEALSHALARGATPIAELVGYGTTADAHHITSGPEDGSGARRAMEIAIAQAGIAPHEIGHLNAHATSTPVGDLGEIRAIKSVFGQRKSVAVSGTKSATGHLLGAAGGLEAIFTILALKNRIAPPTLNLNAPDTESDGIDFVANLARSLDAEYAISNGFGFGGVNASVLFRRWPKASNSGISSVR

SEQ ID NO: 19710 - DNA, 1242 bp, Clostridium perfringens str. 13
  CDS (1)..(1242): transl_table=11
atggaaaacagagttgttataacgggattgggagcaattacaccaattggaaacaatgtaaatgaattttggaccaatgctaaaaaaggtgtttgtggaattgatgaaataactttatttgatgctagtgattataaagttaaaattgcaggagaagttaaaaactttaaagcagaggattttatagataaaaaggaagctaagcgtttagatagatttactcattttgctcttgcagctacagaagaggcaatgaaggatgctaaattagacttaaaggatgaaaatgtagatcaaaatagagtaggtgttatagttggttcaggaataggtggatatggtaccttagaagcacaatttgatgttttattaactaaaggaccaaatagagtttcaccttttgcaattccatcaggaataataaacttagttgctggaaatattgctattaagtatggggcaaaaggagtatgtgaatcactagttactgcctgcgctacaggggtaagctctataggggcagcttatagaagtataaaacatggatattcagatatagttatatcaggtggatcagaagcttctataactagagctgccattgcaggatttactaatcttaaggcattaaatactaataatgatcctaaaagagcttcaatacctttcgataaagaaagatctggattcgttatgggagaaggcgctggaatattaatattagaaagtttagagagtgctcaaaaaagaggtgctagaatctatggagaaattataggatatggtgcaacttgtgatgcatatcatataacttcacctgatccagaaggtgatggagctaagagagctatagaagcagctatagaagaaggaaaaataaataaggatgaaatttcatatataaatgcacatggaacaagtactcctttaaacgataaatttgaaactttagctattaaaggatgttttggtgaaaaagcttatgatataccagtttcatcaacaaaatcaatgactggtcatttattaggtgcagctggagctatagaatcagtaatatgtgttaaagctttagaagaaggatttattccaccaacaataggatataaagttcctgatgaagattgtgatttagattatgttgtaaatgaaggtagagaattagaattaaattatgtaatcaataacgcattaggttttggtggtcataacgcatcattattatttaaaaagtgggattag

SEQ ID NO: 19711 - protein, 413 aa, Clostridium perfringens str. 13
MENRVVITGLGAITPIGNNVNEFWTNAKKGVCGIDEITLFDASDYKVKIAGEVKNFKAEDFIDKKEAKRLDRFTHFALAATEEAMKDAKLDLKDENVDQNRVGVIVGSGIGGYGTLEAQFDVLLTKGPNRVSPFAIPSGIINLVAGNIAIKYGAKGVCESLVTACATGVSSIGAAYRSIKHGYSDIVISGGSEASITRAAIAGFTNLKALNTNNDPKRASIPFDKERSGFVMGEGAGILILESLESAQKRGARIYGEIIGYGATCDAYHITSPDPEGDGAKRAIEAAIEEGKINKDEISYINAHGTSTPLNDKFETLAIKGCFGEKAYDIPVSSTKSMTGHLLGAAGAIESVICVKALEEGFIPPTIGYKVPDEDCDLDYVVNEGRELELNYVINNALGFGGHNASLLFKKWD

SEQ ID NO: 19712 - DNA, 1281 bp, Schizosaccharomyces pombe 972h-
  CDS (1)..(1281)
atgaaacgtgtggtaataactggactgggggccgtaacccctctaggcaatggagttaaaaccaattggcgaaatctaattcaaggaaaatcaggtatcgtatctcttaaaggatttcctgagtatgagcaaataccaagcaaagttgctggagtgataccaaggggaaaagaaaaggaagagtggaatgtattagactacgttgaccaagggaaattacgtgaagtagctacttttacccagttagctctcacttctgcagctgaagcattaaaagatgcaaggtggattgacatagatgaacaagaaaagctagcaacgggagtttgctttggaactggcataggaaatcttgacgatgctttaaatgaaaacggtgtattaaataaggctggaataagaaaagtttcaccgagggtcatttctaaaatactaattaatatgccagcagggtatatttcacaaagatatggttttactgccttaaatcacacaacaactacagcatgtgcagcaggttgtcatgctataggagatgccttcaattttataaagcttggacatgcagatgttattattgccggtggttctgaatcctgtattaatccgctaaccgttgctggtttttcaaaagcaagaagcttgtcaaccaagttcaacgataatccaaaagcggcctcaagaccgtttgatgcaaatcgtgatggatttgtaattggagaaggctccgctgccttagtccttgaggaattggagcatgccaaaaatcgaaatgctcatatatatgctgaaatagtcggttatggtttggcatctgattcatatcatattacagctccaaatccaaatggggatgctgcttactatgctatgaagcgttccttaaaacaagctggtctttctgcaagtcaattggattatatcaatgctcatgcaacttcaaccaagcttggagatgtagcagaaagcatagcgattactaggttactttgtgatgtgaaccggaatcctgaggcatttcctgtatctagtagcaaaggctctattggccatcttttaggagcagcaggtgcaatcgaatctgtctatacggtcttgactgtccaaaagggcgtcttaccccctacgttaaatttcgaatactctgatattcctcagcagtttcagtgcgattatgtgccgaatgtggctaaagagagccgcattaatgttgctttgtcaaacagctttggatttggtggtaccaatgcgtctttatgctttaagaaattcttacagtaa

SEQ ID NO: 19713 - protein, 426 aa, Schizosaccharomyces pombe 972h-
MKRVVITGLGAVTPLGNGVKTNWRNLIQGKSGIVSLKGFPEYEQIPSKVAGVIPRGKEKEEWNVLDYVDQGKLREVATFTQLALTSAAEALKDARWIDIDEQEKLATGVCFGTGIGNLDDALNENGVLNKAGIRKVSPRVISKILINMPAGYISQRYGFTALNHTTTTACAAGCHAIGDAFNFIKLGHADVIIAGGSESCINPLTVAGFSKARSLSTKFNDNPKAASRPFDANRDGFVIGEGSAALVLEELEHAKNRNAHIYAEIVGYGLASDSYHITAPNPNGDAAYYAMKRSLKQAGLSASQLDYINAHATSTKLGDVAESIAITRLLCDVNRNPEAFPVSSSKGSIGHLLGAAGAIESVYTVLTVQKGVLPPTLNFEYSDIPQQFQCDYVPNVAKESRINVALSNSFGFGGTNASLCFKKFLQ

SEQ ID NO: 19714 - DNA, 1242 bp, Fusobacterium nucleatum subsp. nucleatum ATCC 25586
  CDS (1)..(1242): transl_table=11
atgaaaagagttgttgtaacaggattaggacttatttcttcattaggaataggtttagaagaaagttggaaaaaacttatagatggtgaaacaggaatagatttaataacttcttatgatacaacagaccaaccagttagaatagctggggaagtaaaaggttttgaaccaactgattatggaatagaaaaaaaagaagttaaaaaattagcaaggaatactcaatttgctttaatagccacaaaaatggctttggaagatgctaattttaaaatagatgaaactaatgcagatgatgtaggagttcttgtatcagctggtgttggtggaattgaaataatggaagaacaatataagaatatgttggaaaagggacctaaaagaatatctcctttcacaattccagcaatgatagaaaatatggcagctggaaacatagctatatactatggagcaaaaggacctaataaatcaatagttactgcttgtgcatcaggaactcactcaataggagacggttttgatttaattcgtcatggtagagcaaaagctatgatagttggaggaacagaagcaagtgtaactaaattctgtataaattcatttgctaatatgaaagctctttcaactagaaatgaaactcctaaaacagcttcaagaccattttcaaaagatagagatggttttgtaatgggagaaggagcgggaatcttaatattagaagaattagaaagtgctttagcaagaggagcaaaaatatatgcagaaatggtaggatatggagaaacttgtgatgcaaatcatatcactgcaccaatagaaactggagaaggagcaacaaaagctatgagagctgcattaaaagatgcaaatattcctcttgaagatgtgacatatataaatgctcatggaacttcaactcctacaaatgatgttgtagaaacaagagcaataaaagcactatttggtgataaagcaaaagacttatatatctcttctacaaagggagcaactggacatggactaggagctgctggaggaattgaaggagtaattattgcaaaagcaatagcagatggaataatacctcctacaatcaatttacatgaaacagaagaagaatgtgatttaaactatgtacctaacaaagctataaagacagatgtaaaagtagcaatgtctaactcactaggttttggaggacataactcagttattgttatgaaaaaatttgaaaaataa

SEQ ID NO: 19715 - protein, 413 aa, Fusobacterium nucleatum subsp. nucleatum ATCC 25586
MKRVVVTGLGLISSLGIGLEESWKKLIDGETGIDLITSYDTTDQPVRIAGEVKGFEPTDYGIEKKEVKKLARNTQFALIATKMALEDANFKIDETNADDVGVLVSAGVGGIEIMEEQYKNMLEKGPKRISPFTIPAMIENMAAGNIAIYYGAKGPNKSIVTACASGTHSIGDGFDLIRHGRAKAMIVGGTEASVTKFCINSFANMKALSTRNETPKTASRPFSKDRDGFVMGEGAGILILEELESALARGAKIYAEMVGYGETCDANHITAPIETGEGATKAMRAALKDANIPLEDVTYINAHGTSTPTNDVVETRAIKALFGDKAKDLYISSTKGATGHGLGAAGGIEGVIIAKAIADGIIPPTINLHETEEECDLNYVPNKAIKTDVKVAMSNSLGFGGHNSVIVMKKFEK

SEQ ID NO: 19716 - DNA, 1230 bp, Thermoanaerobacter tengcongensis MB4
  CDS (1)..(1230): transl_table=11
atgaacagagtagttgtaacaggattgggagtaatcagccctttaggcaacactgttgaaaagttctggaattcactgataaatggagaaaatggaataggacttgtcaccaaatttgatacctctgaatttcccacaaaagtggctgctgaagtgaaagactttgaccctactttatacatagacaaaaaagaagccagaagaatggataggtttatacagtttgctgtggcaagcacaaaacttgcactggaggatgcggggattgaacttgacaaagtagacttaaatagatttggagtgatttacgggacaggcatagggggaattgagacctttgaaaatcagatgaaagtgatgtacgaaaaaggccccagcaaagtaagtccctttttcatccctatgatgatagccaatatggcagctgggcagatagccataacctttggccttaagggaatcaatgagactatagtaaatgcatgtgcttccagcactaacgccataggagaagcttttaaagccattcaaagaggagatgcagatttaatagtgactggaggtacagaagctgcgataactcccatgtcctttgcaggtttttgcgctatgaaagctatgtccacaaatcctgacccttccactgcttcaaggccctttgatttgaatagagatggatttgttatgggagaagggtctgctacgttgattctggagtcattggaacatgctcaaaaaagaggggcgaagatatacgcagagataatagggtatggcgctacagatgatgcttaccacataacagctccagctccagaaggggaaggggcagcgagagcgatggaagcagcccttaaagacggaaaagtaagttatgatatggtagactacatcaatgcccatggaacctctacagagtacaacgataagttcgaaactatggcaataaagaaagttttcaaagaccacgcttataagctctgcgtaagctctaataagtccatgttgggacatttgttaggagcagcaggggcagtagaagctgtagctacggtgctgaccataactcacgggatagtgcctccaaccattaattaccagactcccgatccagagtgcgatttaaactacgttccaaacaaggcaatagaaagggaagtgaattacgccatttctaactcttttggttttggcggacacaatgctactttgctctttaaaaaattttga

SEQ ID NO: 19717 - protein, 409 aa, Thermoanaerobacter tengcongensis MB4
MNRVVVTGLGVISPLGNTVEKFWNSLINGENGIGLVTKFDTSEFPTKVAAEVKDFDPTLYIDKKEARRMDRFIQFAVASTKLALEDAGIELDKVDLNRFGVIYGTGIGGIETFENQMKVMYEKGPSKVSPFFIPMMIANMAAGQIAITFGLKGINETIVNACASSTNAIGEAFKAIQRGDADLIVTGGTEAAITPMSFAGFCAMKAMSTNPDPSTASRPFDLNRDGFVMGEGSATLILESLEHAQKRGAKIYAEIIGYGATDDAYHITAPAPEGEGAARAMEAALKDGKVSYDMVDYINAHGTSTEYNDKFETMAIKKVFKDHAYKLCVSSNKSMLGHLLGAAGAVEAVATVLTITHGIVPPTINYQTPDPECDLNYVPNKAIEREVNYAISNSFGFGGHNATLLFKKF

SEQ ID NO: 19718 - DNA, 1287 bp, Streptomyces coelicolor A3(2)
  CDS (1)..(1287): transl_table=11
gtgagtccacgacacgcggccggcccggcccccggggagcgggccgccgtcgtcacggggctggggctgaccacctcgctgggcggcgacgtcccctccacctggcgggccctgctggacggcgggtgcggcgtcgaacgcgtcgacttcggcgagccggccgggcccgcacaggtgtacctcgcggccccggccgcggtcgaccccgggacggtcctgtcgtccgccaaggcggcgcactgcgaccgctcggcgcagttcgccctcgtggccgcccgcgaggccgttcgcgacgcggggttccccgacccgtccgcgctcgccggggacgggtcgcgggtggccgtggtcgtcggggtggggctgggcggcctcaccagcgtcctggagcaggaccaccgcctgcggacgcagggcgcggggcgggtgagcccgcgcaccatcccggtcatgctgcccaaccacgcggccgccgaagtggggctcatggtgggcgcgaaggccggggtgcacgcgcccgtcagtgcctgcgccgccggtgccgaggccctcgcccaggccctcggcatgatccgggacggccgcgcggacatcgtggtcgcgggcggcaccgaggccgcgctgcatccgctggtcctggccgggttcgcgcggctgcgggccctctcccggcgccacgacgatcccaagggggcctccaggcccttcgacgccgaccgggacggcttcgtgatgggggagggcgccggcatgctcgtggtcgagagcgccgcgcacgccgccgcccgcggcgcccgcgtccacggccggctcaccggggcgggcatcaccaacgacagccaccacgtggcccagccggcgcccggcggtccgggctgcgcggcggccgtcgacgccgcactgcgcgacgcggggctcgtgccggagcagatccagcacgtcaacgcccacgccaccgccacaccgctcggcgacctcggcgaggcgcaggcgctgcacagcgtcttcgccaagggcgtggacgacgtcacggtcagcgccaccaagggggccttcggacacaccctcggtgccgccggagccatcgaggccgtcctcaccgtcctcgccctgcgggacagaacggcaccgccggcctgcagcctcgaacgggtcgaccccgagatcggcctgaacgtcgtcggccgcgacccggcgacactgccctgcgggcccctcgcggccgtcagcacgagcatgggcttcggcgggcacaacgtcgcgctcgccttcgccgacgcctcatga

SEQ ID NO: 19719 - protein, 428 aa, Streptomyces coelicolor A3(2)
MSPRHAAGPAPGERAAVVTGLGLTTSLGGDVPSTWRALLDGGCGVERVDFGEPAGPAQVYLAAPAAVDPGTVLSSAKAAHCDRSAQFALVAAREAVRDAGFPDPSALAGDGSRVAVVVGVGLGGLTSVLEQDHRLRTQGAGRVSPRTIPVMLPNHAAAEVGLMVGAKAGVHAPVSACAAGAEALAQALGMIRDGRADIVVAGGTEAALHPLVLAGFARLRALSRRHDDPKGASRPFDADRDGFVMGEGAGMLVVESAAHAAARGARVHGRLTGAGITNDSHHVAQPAPGGPGCAAAVDAALRDAGLVPEQIQHVNAHATATPLGDLGEAQALHSVFAKGVDDVTVSATKGAFGHTLGAAGAIEAVLTVLALRDRTAPPACSLERVDPEIGLNVVGRDPATLPCGPLAAVSTSMGFGGHNVALAFADAS

SEQ ID NO: 19720 - DNA, 1269 bp, Streptomyces coelicolor A3(2)
  CDS (1)..(1269): transl_table=11
gtgaccggcgcccgtcccgacgtcgccgtcaccgggatcggcctggtcactccggccggcaccggccgcgaggccacctgggacggcgtgtgcgcgggccgccccaccgcccggcacgtccccgaactcaagggcctcccggtcgacttcgcctgcctcgtaccggacttctcccctcgtgatcacgtccccggctcacgcccctggcagtacgaccgcttcacccagttcgccctccacgccgccctggaggcggtctccgacgccggtctggacccggccgactgggacggggaccgcgtcgcggtggtcttcggcagctcggccggcggcaccggcaccatgctggaccagcaccgcaaactgctggaactgggcacggcacgcgtctcaccgctgctgctgccgatgttcctgcccaacatggccaccggacagctcaccatccacctgcgggcccggggcccggcgctgtgcacggtcaccgcctgcgcctccggcgccaccgccatcggcaccgccctgcaactcctgcgctccggggcctgcgacatcgccgtcgcgggcgcctccgacgcggtcgtacagcccctctgggtcaccggcttcgaccggatgggcgcgctgtcccggcgcggcgacgacccgcgggccgcctcccggcccttcgacaccgcccgggacggcttcgtcatggcggagggcggtgcggccctggtcctggagccggcgagtgcggcccgggcccgcggacgccccggctacgccctgctggcgggctacggggcatcgtccgacgcccaccaccccgtggcacccgaccccgagagcaagggcgccgccctcgccgtgcggcgggccctcgacgacgccggcgcccgccccgcggacgtgcagcacatcaacgcgcacggcaccagcacgccgctcaacgacgccgccgaggcccgtctgatccgccgcctcttccctcaccagccctccgtgacctcggtcaagggcaccctcggccacctgctcggcgcggccggagcggtcgaagcggcgatcaccgccctgtccgtggcccacggccgggtgccgcccgtggccaacctggagaagcaggaaggagacgccgagatcaacgccgtcaccggcaccagccgggcgcagcccgtcgacctcgccctgagccattccttcggcttcggcggccacaacgccgtactcgccttcagaagctgccccaccgaaccggcccgggagccggccgctccttcaccgtga

SEQ ID NO: 19721 - protein, 422 aa, Streptomyces coelicolor A3(2)
MTGARPDVAVTGIGLVTPAGTGREATWDGVCAGRPTARHVPELKGLPVDFACLVPDFSPRDHVPGSRPWQYDRFTQFALHAALEAVSDAGLDPADWDGDRVAVVFGSSAGGTGTMLDQHRKLLELGTARVSPLLLPMFLPNMATGQLTIHLRARGPALCTVTACASGATAIGTALQLLRSGACDIAVAGASDAVVQPLWVTGFDRMGALSRRGDDPRAASRPFDTARDGFVMAEGGAALVLEPASAARARGRPGYALLAGYGASSDAHHPVAPDPESKGAALAVRRALDDAGARPADVQHINAHGTSTPLNDAAEARLIRRLFPHQPSVTSVKGTLGHLLGAAGAVEAAITALSVAHGRVPPVANLEKQEGDAEINAVTGTSRAQPVDLALSHSFGFGGHNAVLAFRSCPTEPAREPAAPSP

SEQ ID NO: 19722 - DNA, 1290 bp, Streptomyces coelicolor A3(2)
  CDS (1)..(1290): transl_table=11
gtgagctcgaccaatcgcaccgtggtcgtcaccggtatcggcgcaaccacaccgctgggtggcgacgcagcctcgacctgggagggtctggtcgccggcaggtccggcgtccggcccctggagcaggagtgggccgccgaccaggcggtccgtatcgccgcgccggccgccgtcgacccctccgaggtcatcccgcggccgcaggcccgccgcctggaccgctcggcgcagttcgcgctgatcgcggcgcaggaggcctggaaggacgccgggtacgccggcaaggcgggcgagagccccgccgaggacggcgcggcccacgtcgaccccgaccggctcggtgcggtcatcgcctccggcatcggcggcgtgaccacgctgctcgaccagtacgacgtgctgaaggagaagggcgtccgccgcgtctccccgcacaccgtccccatgctgatgccgaacggtccctccgccaacgtcggcctggccgtgggcgcccgcgcgggcgtgcacaccccggtctcggcctgcgcgtcgggcgccgaggccatcggctacgccatcgagatgatccgcaccggccgcgccgacgtcgtcgtcgcgggtggcacggaggcggcgatccacccgctgcccatcgccgcgttcggcaacatgatggcgatgtccaagaacaacgacgacccgcagggcgcctcccgccccttcgacacggcgcgcgacggcttcgtcctcggcgagggcgccggcgtcctggtcctggagtccgccgagcacgccgccgcgcgcggcgcccgcgtctacgcggaggcggtcggccagggcatctccgccgacagccacgacatcgtgcagccggagccggagggccgcggcatctccgccgccctgcagaacctgctggacggcaacgacctggacccggccgagatcgtgcacgtcaacgcgcacgccacctcgacgccggccggtgacatcgccgagctgaaggcgctgcgcaaggtcctcggcgacgacgtcgaccacatggcggtctccggcaccaagtcgatgaccggtcacctgctcggtggcgcgggcggcgtggagtccgtggcgaccgtgctcgcgctgtaccaccgggtggcgccgccgaccatcaacgtcgagaacctcgacccggaggccgaggccaacgcggacatcgtccgcggggaggcccgcaagctcccggtggagggccgtatcgccgcgctgaacgactcgttcggcttcggcgggcacaacgtggtgctcgcgttccggtcggtctga

SEQ ID NO: 19723 - protein, 429 aa, Streptomyces coelicolor A3(2)
MSSTNRTVVVTGIGATTPLGGDAASTWEGLVAGRSGVRPLEQEWAADQAVRIAAPAAVDPSEVIPRPQARRLDRSAQFALIAAQEAWKDAGYAGKAGESPAEDGAAHVDPDRLGAVIASGIGGVTTLLDQYDVLKEKGVRRVSPHTVPMLMPNGPSANVGLAVGARAGVHTPVSACASGAEAIGYAIEMIRTGRADVVVAGGTEAAIHPLPIAAFGNMMAMSKNNDDPQGASRPFDTARDGFVLGEGAGVLVLESAEHAAARGARVYAEAVGQGISADSHDIVQPEPEGRGISAALQNLLDGNDLDPAEIVHVNAHATSTPAGDIAELKALRKVLGDDVDHMAVSGTKSMTGHLLGGAGGVESVATVLALYHRVAPPTINVENLDPEAEANADIVRGEARKLPVEGRIAALNDSFGFGGHNVVLAFRSV

SEQ ID NO: 19724 - DNA, 1224 bp, Streptomyces coelicolor A3(2)
  CDS (1)..(1224): transl_table=11
atgaccgacccctccctcgccgtgaccgggctgggtctggtgaccgcggccggcatgggcgtcgacgccacctgggagggggtgttgcgcggccggtcggcgggcgccagggacgagcggctcgccggactgcccgtggacatcgcctgtgcggtgccgggcctgcaaccggcgcgtcacgtggaccggcgcagcgtcctgatccacgaccgcttcgtccagctggcgatcgtggccgcccgggaggccgtggccgacgccggactcgacccgctgacctgggacggcgcccgggtgggcgtggtcgtcggctgcgggctcggcggggtgacgacgtgggagacccagcaccggcgcctgctggagcgcggccccgaagcggtgtccgcgctcctggtgccgatgctggtgcccaacatggcggccgggcacctcgcgatggacctgcgtgcgctgggcccgaacctggtgacggcgaccgcctgcgcctcgggcggcaccgcgctgggcaccgcggcccggctgctgcgggacgggacgtgcgacatcgtcgtggccggtggcaccgaggcgggcgtcagccccctcatggtcaccggtttcgcgcagatgggcgcgctgtcgcgccgggtcgacgatccggcggcggcgtccaggcccttcgacgccgaccgggacggcttcgtgatcggtgagggcagcggcatgctcgtcctggagcgcgcggcggacgccgaggcgcgcggcgcgacggtgcgcgcgcggctgctgggccacggcgcgtcggcggacgcccaccacgtcaccgcgcccgacccggagggcgccggcgccctgcgggcgatggaggcggccctcgcccaggcgggcgtcaccggccgcgacatcgaccacgtgaacgcgcacggcacctcgaccccgctcaacgacgcggtggaggccgcggtgctgggccggctgctgggcgaccgggcgaccgtgacctcggccaagggcgtcctcgggcacacgctgggcgccgccggtgcgatcgaggcggcgctgaccgtgctcagcatcgagcgctccaccgttcccccgaccgcgaacctgcgacggcgggacccggccgtcgacctggacgtggtcgccgacgctccgcgggagcagaaggtggagctggcgatgagcaactccttcggcttcggcgggcagaacgcggtcctggtcttcgcctccccgtga

SEQ ID NO: 19725 - protein, 407 aa, Streptomyces coelicolor A3(2)
MTDPSLAVTGLGLVTAAGMGVDATWEGVLRGRSAGARDERLAGLPVDIACAVPGLQPARHVDRRSVLIHDRFVQLAIVAAREAVADAGLDPLTWDGARVGVVVGCGLGGVTTWETQHRRLLERGPEAVSALLVPMLVPNMAAGHLAMDLRALGPNLVTATACASGGTALGTAARLLRDGTCDIVVAGGTEAGVSPLMVTGFAQMGALSRRVDDPAAASRPFDADRDGFVIGEGSGMLVLERAADAEARGATVRARLLGHGASADAHHVTAPDPEGAGALRAMEAALAQAGVTGRDIDHVNAHGTSTPLNDAVEAAVLGRLLGDRATVTSAKGVLGHTLGAAGAIEAALTVLSIERSTVPPTANLRRRDPAVDLDVVADAPREQKVELAMSNSFGFGGQNAVLVFASP

SEQ ID NO: 19726 - DNA, 1236 bp, Xanthomonas axonopodis pv. citri str. 306
  CDS (1)..(1236): transl_table=11
atgagtcgtcgtgttgtcgttaccggcatgggcatggtgtcgccgctgggcaatgatctggccaccagctgggacggaatcgtccacggccgctcaggcattggcccgatcacgcagatcgatgcctcgcagttcaccaccaagatcgccggtgaaatcaagaatttcgaccccacgctttttgtgtccgccaaggacgtcaagaagatggattcgttcatccactacggtgtcggcgcctcgttcatggcgctggacgattccggactggaaatcgacgaaagcaatgccgaacgcgtgggcgccattctcggctccggcatcggcgggctgctcggcattgaagagcagaccatcaaattccatgagggcggcgcgcgcaagatttcgccgttctatgtgcccagcaccatcatcaacatgctgcccggccaggtgagcctgatcaaaggcctgaaaggcccgacgttctcggctgtatcggcctgcgccacatccaaccattcgatcggcaccgcgatgcgcatgatccagcacggcgatgccgatgtgatgctggctggcggtgccgagcgcggttcgtcgccgagttcggtgggcggcttttgtgcgatgaaagcgatgtccacccgtaacgacgacccggccggcgcgtcgcggccgtgggacaagcagcgcgatggcttcgtgctgggcgacggcgccggcgtgctggtgctggaggagtacgaacacgccaaggcgcgtggcgcacgcatctatgccgagctggtcggcttcggcgccagttccgatgcgtttcacatgaccgcccccagcgaagacggcgagggcgcggcgcgcagcatggcggcagcgatgcgcgacgccaagctcaaccccgagcagatcggctacctcaacgcgcacggcacctccacgccgctgggcgatctggccgaaacgatggcgatgaagcgcgcgctgggcgatcacgcctacaagaccatggtgagctcgaccaagtcgatgacggggcatctgctcggcgcggccggcggtgtggaagcgatcttctcggtgatggcgctgcacaccggcatcatcccgccgaccatcaacctggaagagccaagcgaaggctgcgacctggattacgtgccgaacgtggcgcgccaggtgcaggtggatgcggtgatgtccaacggcttcggctttggcggcaccaacggcacgctggtgttcaagcgcgtttga

SEQ ID NO: 19727 - protein, 411 aa, Xanthomonas axonopodis pv. citri str. 306
MSRRVVVTGMGMVSPLGNDLATSWDGIVHGRSGIGPITQIDASQFTTKIAGEIKNFDPTLFVSAKDVKKMDSFIHYGVGASFMALDDSGLEIDESNAERVGAILGSGIGGLLGIEEQTIKFHEGGARKISPFYVPSTIINMLPGQVSLIKGLKGPTFSAVSACATSNHSIGTAMRMIQHGDADVMLAGGAERGSSPSSVGGFCAMKAMSTRNDDPAGASRPWDKQRDGFVLGDGAGVLVLEEYEHAKARGARIYAELVGFGASSDAFHMTAPSEDGEGAARSMAAAMRDAKLNPEQIGYLNAHGTSTPLGDLAETMAMKRALGDHAYKTMVSSTKSMTGHLLGAAGGVEAIFSVMALHTGIIPPTINLEEPSEGCDLDYVPNVARQVQVDAVMSNGFGFGGTNGTLVFKRV

SEQ ID NO: 19728 - DNA, 1317 bp, Drosophila melanogaster
  CDS (1)..(1317)
atgcgagttttaggaaagtgcactgttttggtcaggcaaacccgcagcttatccacgccatctgggcgccgcagagtggtggtcacgggaagtggcgcagtcactccgctgggcaacaatggaccggattcttggcgacgcatcctggccggcgagtcggcaatttctcggctgagtgcggagtttaagggcttgccctgccaggttgcggctcaaatcccgagggaaaacctacagctggatcaacacctgaccaagtcggacattaagctgatgagccccgccacgcagcttgccgtattggcggctgaggaggccttgtcaaccggaaagctgtgccccaagcaattgagcgaggaggagcttgagcggttcggagtgtgcgtgggcatgggcatgttcgaccttgcagaggtctatggcgcctggaaccagctgcaacgaggttacaacagagtaagcccctttttcgtgcccaggctgctgcccagtatggcgtgtggtcacataagcatgcgacatggcttaagaggacctaaccactcggtgtccacggcctgcgccacaggtgcccatgccctgggcgatgccatgcgcttcattcgcagcggagatgccgacttgatgctggcggggagtggtgaggcctgcatagatccgctctccatcgctggattttgcagactgcgggctctgagcaccgcattcaacgataatccggcggttgcgtccagaccgtttgacaagtcccgggatggcttcgtgatgggcgagggcgcagctgtgctcttgctggaagaactggagcacgcccgcgctcggggagctcccattctagctgagattctgggctacggcttgtccggcgatgcctatcacataacgtcgcccagcgatgacggcgccggagccactcttgccatgaagcgggccatacaagatgctgggattgcaccagaggatgttacgtatgtaaatgcccacgcaacctccacgcccaccggggatcgcattgagtcacacgctataggtcgtgttttcggggcgcacactccgcaggtgagggtctcctccaccaagggagcacatggccacctgctgggctcctctggcaacctggaagcgctctttgtggtgctcgcctgcgcgaataacaagctgccgccctccatcaacattgagcacctcgatgtggacgtcaatgtggtcacgaaagctactgattggtcggcggaccaaaagcggcgtgttgccctcaagaattccttcggctttggaggaaccaatgcctccctctgcattgctagctacatttaa

SEQ ID NO: 19729 - protein, 438 aa, Drosophila melanogaster
MRVLGKCTVLVRQTRSLSTPSGRRRVVVTGSGAVTPLGNNGPDSWRRILAGESAISRLSAEFKGLPCQVAAQIPRENLQLDQHLTKSDIKLMSPATQLAVLAAEEALSTGKLCPKQLSEEELERFGVCVGMGMFDLAEVYGAWNQLQRGYNRVSPFFVPRLLPSMACGHISMRHGLRGPNHSVSTACATGAHALGDAMRFIRSGDADLMLAGSGEACIDPLSIAGFCRLRALSTAFNDNPAVASRPFDKSRDGFVMGEGAAVLLLEELEHARARGAPILAEILGYGLSGDAYHITSPSDDGAGATLAMKRAIQDAGIAPEDVTYVNAHATSTPTGDRIESHAIGRVFGAHTPQVRVSSTKGAHGHLLGSSGNLEALFVVLACANNKLPPSINIEHLDVDVNVVTKATDWSADQKRRVALKNSFGFGGTNASLCIASYI

SEQ ID NO: 19730 - DNA, 1242 bp, Chlorobium tepidum TLS
  CDS (1)..(1242): transl_table=11
atgaaaagagtcgtcgtcaccggaatcggggttctgtcgccaatcggcctttcggctggggcattctggaacgccctcatggagggaaaaagcggcgctgcaccgatcacctatttcgatacgaccaatttcgcgaccaccttcgcctgcgagctcaagaatttcaaggccgatgagtacatcgaccggaaatccgcggatcgcatggatccatactgtcagtacggcgttatctctgccgaacaggcgctgaaagattccgggcttgacctgaccgcgatcgatccgaccaggatcggcgtcgtgcacggctcgggcatcggcggcatgacggtctacgaccagcagtttcgccagtatctggaacgcggcccccgcagggtcagcccgttcttcattccgatgctcattcccgacatcgccgccggacagatttcgatccgcaacggtctgatggggccaaactatgcgacagcatccgcctgcgcgacctccctgcacgctatcatggacgccgtcatgctcctgcagatgggcatggccgactacatggtctgcggcggctcggaagcaccgatcacgcagatgagcgtggctggcttcaactcggccaaagcgctctcgacccgcaacgacgctccgacaaaagcctcacgcccgtacgatgtggatcgcgacggtttcgtcatgggtgaaggcgccggttcgctggtgatcgaaacctacgagtcggctgtgaagcgcggcgcaaaaatctacgcagagatcgtcggcatgggcgcgtctgccgatgcgtatcacctcaccgctccgcacccggagggtcttggcgcttgcagcgcgatgaccaccgccctgaacatggcgggcatcaccccggacaagatcgactacatcaacacccacggcaccgccacgccgcttggcgatctggcggaaatcaaggcaatcaagaaggtgttcggcgagcacgcatcaaaactcagcatcagctcgaccaagtcgatgaccggtcacctgcttggtgcggcgggcgtggtcgaatcgatcgcctgcatccttgcgctgcagaaccagaccgttcctccaaccatcaacctcgacaatgtcgatcccgagatcgatgtggatgtgacgccgaacgtcccgaaacagcgctcgattgagtatgcgctgaacaacggtttcggattcggcgggcacaacggctgcctgatcttcaggaaggctccggccgcctga

SEQ ID NO: 19731 - protein, 413 aa, Chlorobium tepidum TLS
MKRVVVTGIGVLSPIGLSAGAFWNALMEGKSGAAPITYFDTTNFATTFACELKNFKADEYIDRKSADRMDPYCQYGVISAEQALKDSGLDLTAIDPTRIGVVHGSGIGGMTVYDQQFRQYLERGPRRVSPFFIPMLIPDIAAGQISIRNGLMGPNYATASACATSLHAIMDAVMLLQMGMADYMVCGGSEAPITQMSVAGFNSAKALSTRNDAPTKASRPYDVDRDGFVMGEGAGSLVIETYESAVKRGAKIYAEIVGMGASADAYHLTAPHPEGLGACSAMTTALNMAGITPDKIDYINTHGTATPLGDLAEIKAIKKVFGEHASKLSISSTKSMTGHLLGAAGVVESIACILALQNQTVPPTINLDNVDPEIDVDVTPNVPKQRSIEYALNNGFGFGGHNGCLIFRKAPAA

SEQ ID NO: 19732 - DNA, 1029 bp, Yersinia pestis KIM
  CDS (1)..(1029): transl_table=11
ttgggccgttggtggagatataagtggatcacttttcatccgtcgttgacacatgcggataacacagagaaacaagagcgtaccgcgacaatcataggcgcgggtattggtggttttccggccattgcccatgcagtgcggacttccgacagccgtgggccaaaacgcctctcaccgtttactgtcccttcattcttagtgaatttggccgctggccatgtttctatcaaacatcattttaaaggcccgattggcgcaccagtcactgcctgtgctgccggtgtacaggcaatcggtgacgccgtgcggatgatccgcaacaatgaagcagatgttgccctgtgcggtggcgcagaagccgtgatcgataccgtgagtctggccggttttgctgccgctcgtgcgttatcaacacactttaatagcacaccagaaaaagcctcccgccccttcgacactgcccgtgacggttttgtgatgggagaaggtgctggtttactgattattgaggagttggagcatgctttagccagaggcgcgaagccactagcagaaatagtcggctatggtaccagtgccgatgcttaccatatgacctctggcgctgaggatggcgacggggcctatcgcgccatgaaaatcgctttgcgtcaggccggtattacgcccgagcaagttcagcatctgaatgcccacgcgacctcaacaccggtaggtgatctcggtgaaattaatgccattaaacatttgtttggcgagagtaatgcgttagcgattacctcaacaaaatccgccacagggcacctgttgggcgctgctggtgggctggaaaccattttcactgtactggcattgcgtgatcaaatcgtgcccgcaacgttgaatctggaaaatccagatcctgcagccaagggactcaacattattgcaggtaacgcacaacctcatgacatgacgtatgccctttccaatggttttggctttgctggggtgaacgcaagtatcttactgaaacgctgggtggactaa

SEQ ID NO: 19733 - protein, 342 aa, Yersinia pestis KIM
MGRWWRYKWITFHPSLTHADNTEKQERTATIIGAGIGGFPAIAHAVRTSDSRGPKRLSPFTVPSFLVNLAAGHVSIKHHFKGPIGAPVTACAAGVQAIGDAVRMIRNNEADVALCGGAEAVIDTVSLAGFAAARALSTHFNSTPEKASRPFDTARDGFVMGEGAGLLIIEELEHALARGAKPLAEIVGYGTSADAYHMTSGAEDGDGAYRAMKIALRQAGITPEQVQHLNAHATSTPVGDLGEINAIKHLFGESNALAITSTKSATGHLLGAAGGLETIFTVLALRDQIVPATLNLENPDPAAKGLNIIAGNAQPHDMTYALSNGFGFAGVNASILLKRWVD

SEQ ID NO: 19734 - DNA, 1263 bp, Thermosynechococcus elongatus BP-1
  CDS (1)..(1263): transl_table=11
atggcaaaggcgcatcaaaaacgggtcgttgtcaccgggatgggggcgattacccccctcggcaacacccttgcggagtattgggaaggattaatggccggtcgcaacggcattgattacatcacggcttttgatgccagtcgtcatgactgccgcattgcggctgaggtgcgtggctttgatcccaccctctacatggatcgcaaagatgccaagcgcatggatcgctttgctcaatttgccgtggccgccagtaagcaagcccttgcggatgcccaattgaccattgacgagggcaatgccactgacattggcatcattattgggactggtgtggggggtctaaaggtgatggaggatcagcaggaggtctatctcactagggggcccgatcgctgtagtccttttatgatcccaatgatgattgccaatatggccgcaggactcaccgccattcacaccggtgccaagggccccaattcctgttcggtaaccgcctgtgcagcaggttccaatgccattggcgatgccttccgcatggtgcaacacggttacgccaaggcgatgatctgtggtgggacagaggcggcgattactcccctatcggtggctggttttgcggcagctcgtgccctttccacccgcaatgatgacccccaccatgccagccgtccctttgacctcaaccgcgatggctttgtccttggggaaggggcaggcatcttgatcctggaagaattggagtttgcccttgcccggggagcacgcatctatgcggaaatggtgggctacggcttgacctgtgatgcctaccacatgactgctccctcaccggggggagaaggggcggcccgtgccattgaagcctgcctcaaggatgcgcagattgctccggatcaggtgagctatatcaacgcccacggtaccagtacccccgccaacgacagtacggaaactgccgccattaaacgtgcccttggcgaagaaaatgcgcgtcgcgttcccgtgagttcgacaaaatccatgacaggacacctgctggggggatcaggggggatcgaggcgatcgcgacggtaatggccatagcccacgatcgcatcccccctacaattaacttggagcaaccggatcccgcctgcgatctggactatgttccccatcagagccgggcctgtccggtgacggtggctttgtccaactcctttggctttggtgggcacaacgtcacgttggccttccgcaagtttactcccgacctttaa

SEQ ID NO: 19735 - protein, 420 aa, Thermosynechococcus elongatus BP-1
MAKAHQKRVVVTGMGAITPLGNTLAEYWEGLMAGRNGIDYITAFDASRHDCRIAAEVRGFDPTLYMDRKDAKRMDRFAQFAVAASKQALADAQLTIDEGNATDIGIIIGTGVGGLKVMEDQQEVYLTRGPDRCSPFMIPMMIANMAAGLTAIHTGAKGPNSCSVTACAAGSNAIGDAFRMVQHGYAKAMICGGTEAAITPLSVAGFAAARALSTRNDDPHHASRPFDLNRDGFVLGEGAGILILEELEFALARGARIYAEMVGYGLTCDAYHMTAPSPGGEGAARAIEACLKDAQIAPDQVSYINAHGTSTPANDSTETAAIKRALGEENARRVPVSSTKSMTGHLLGGSGGIEAIATVMAIAHDRIPPTINLEQPDPACDLDYVPHQSRACPVTVALSNSFGFGGHNVTLAFRKFTPDL

SEQ ID NO: 19736 - DNA, 1233 bp, Streptococcus agalactiae 2603V/R
  CDS (1)..(1233): transl_table=11
atgacattacagcgagtagtagtaacaggttacggtgtaacctcacctattggaaacacaccagaagaattttggaatagtcttaaagaaggaaatgttggtattggacctatcactaaatttgattcaagtgatttcatggtcaaaaatgctgctgaaattcatgattttccatttgataaatattttgtcaaaaaagatctgaacagatttgatatgtattccctttatgccttatatgcttcaagtgaagctattcaacatgctaatttaaatttagatgaaattgatgcagatcgatttggtgtcatcgttgcatcaggtattggagggattcaagagattgaagaacaagtgattcgtcttcatgaaaaagggccaaaacgcgtaaaaccaatgacgcttccaaaagctctaccaaatatggcagctggaaatgttgcgatgaggttaggcgctcatggtgtatgtaaatcaattaatacagcttgtgcttcttctaatgatgctattggagatgctttccgtaatataaaatttggtattcaagatattatggtagtcggtggtgcagaagctgctattacaaaatttgccattgctggattccaaagtcttacagcattatcaacaactgaagatccatcaagagcatctattccatttgataaagatcgcaatggatttatcatgggagaaggttctggaatgttggtcttagaaagtttagaacacgctgaaaaacgaggagctactattcttgcagaagttgttggttatggtaacacttgtgacgcatatcatatgacttcaccacatccagaaggtttaggagccactaaagctattcaacttgcactggttgaagctaatattaaacctgaagaagttaactatgtaaatgctcatggaacttcaacacctgctaacgaaaaaggagagagtcaagctattgttgctgcacttgggacagacgttccagtttcttcgactaaatcttttactggtcatcttttgggtgccgcgggagctgttgaggcaattgcaactattgaagcgatacgtcatagttatgttccaatgactgctggaacgacagaattatcagaagatattacagcgaatgttatttttggtcaagggcaagacgctgatattcgttatgccatttcaaatacatttggttttggaggacacaatgcagttctggccttcaaacgctgggaggattaa

SEQ ID NO: 19737 - protein, 410 aa, Streptococcus agalactiae 2603V/R
MTLQRVVVTGYGVTSPIGNTPEEFWNSLKEGNVGIGPITKFDSSDFMVKNAAEIHDFPFDKYFVKKDLNRFDMYSLYALYASSEAIQHANLNLDEIDADRFGVIVASGIGGIQEIEEQVIRLHEKGPKRVKPMTLPKALPNMAAGNVAMRLGAHGVCKSINTACASSNDAIGDAFRNIKFGIQDIMVVGGAEAAITKFAIAGFQSLTALSTTEDPSRASIPFDKDRNGFIMGEGSGMLVLESLEHAEKRGATILAEVVGYGNTCDAYHMTSPHPEGLGATKAIQLALVEANIKPEEVNYVNAHGTSTPANEKGESQAIVAALGTDVPVSSTKSFTGHLLGAAGAVEAIATIEAIRHSYVPMTAGTTELSEDITANVIFGQGQDADIRYAISNTFGFGGHNAVLAFKRWED

SEQ ID NO: 19738 - DNA, 1239 bp, Oceanobacillus iheyensis HTE831
  CDS (1)..(1239): transl_table=11
ttgaataagcgagttgttattacgggactaggagcattaagcccagtgggcaataatgtagatgaaatgtgggaaagtgttacgacaggaaaatcaggaatagattttgttacaaaggtggataaagatttatttccagcaaaggtagcggcagaagtgaaaaactttgatcctacactgtatatggataaaaaagacgcacgtaaaatggatccatttacacaatatgcagttgctgctgctaaaatggctgtagaagatgctaatttaaccattaatgaagcgaacgctgaacgagtaggtgtatggattggatctggtattggtggtatgaagacttgggaagaccaacataccaagttcatggagaaaggcgcaaaacgcgtaagtcctttctttgtaccgatgatgattccagatatggctgctggtcaggtttcgattcaattaggagcgaagggaattaattcttgttcggttacagcatgtgcatctggtgccaattctatcggtgatgctttcaaggctattcagcgtggagatgcagatattatgatttcgggcggtacagaggctccgatatcagatatggcattcgctggattctcttcttcaaaagcgttatctacaaatgaggatccacaaaaagcaagtagaccttttgataaaaatcgtaacggatttgttatgggagaaggagcagggatcttgatattagagtctttagaatctgccctgcaaagagatgcgacgatttatggagagatagtaggatatggtgccactggagacgcttatcatatcactgcgcctgcagagaatggcgagggtgcaacccgagcaatgcaaatagcgttaaaagatgctaatctagaaccttcggatgtacagtatgtgaatgctcatggaacaagcacagatttaaatgataaatatgagacgcaagcaatcaaagctgtatttggtgaccatgcaagtgatttagcaatttcgtctacgaagtcgatgactggccacttattaggagctgctggtggaattgaagcggtaatatctattaaagcaattcaagatagtataattccgccgacgattaattatgaaacgcctgatccagattgtgatttggattatgtaccaaatgaagcaagaaaacaaacagtagatgcggtggtaagtaattcattaggttttggcggacataacgttgccttggtatttaaaaaatttgtgaaataa

SEQ ID NO: 19739 - protein, 412 aa, Oceanobacillus iheyensis HTE831
MNKRVVITGLGALSPVGNNVDEMWESVTTGKSGIDFVTKVDKDLFPAKVAAEVKNFDPTLYMDKKDARKMDPFTQYAVAAAKMAVEDANLTINEANAERVGVWIGSGIGGMKTWEDQHTKFMEKGAKRVSPFFVPMMIPDMAAGQVSIQLGAKGINSCSVTACASGANSIGDAFKAIQRGDADIMISGGTEAPISDMAFAGFSSSKALSTNEDPQKASRPFDKNRNGFVMGEGAGILILESLESALQRDATIYGEIVGYGATGDAYHITAPAENGEGATRAMQIALKDANLEPSDVQYVNAHGTSTDLNDKYETQAIKAVFGDHASDLAISSTKSMTGHLLGAAGGIEAVISIKAIQDSIIPPTINYETPDPDCDLDYVPNEARKQTVDAVVSNSLGFGGHNVALVFKKFVK

SEQ ID NO: 19740 - DNA, 1263 bp, Brucella suis 1330
  CDS (1)..(1263): transl_table=11
atgaggcgtgtcgtcatcaccggtctcggtctggtgtcaccgctcgcaagcggtgtggaagagacttggaagcggcttcttgccggtgaaagcggggctcgccgcgttacggaattcgaggtggacgatctggcctgccagattgcctgccgcattcccgttggcgatggcacgaacggtacgttcaatcccgacctgcatatggacccgaaggaacagcgcaaggtcgatcctttcatcgtttatgccgtcggtgcagccgatcaggctctggatgatgccggctggcacccggaaaatgatgaggatcaggtccgcaccggcgttcttatcggttcgggcatcggcggcatcgaaggcattgtcgaggcgggctacacgctgcgcgacaagggcccgcgccgtatttcgcccttcttcattccgggccgtctcatcaatctggcctccggccatgtgtcgatcaagcacaagctgcgcgggccgaaccactcggtcgtcacggcctgtgcaaccggcacgcacgctattggcgatgccgcccgcctcattgctttcggcgatgcggatgtgatggttgccggtggcacggaatcgccggtgagccgcatttcgcttgctggctttgccgcctgcaaggcgctttccaccaagcgcaatgacgatccgaccgccgcttcacgtccttatgacgaggatcgtgacggcttcgtcatgggcgaaggcgctggcattgtggtgcttgaagagctggaacacgctttggcgcgcggtgcgaagatttatgccgaagtcatcggctatggcatgtcgggcgatgccttccatatcacggccccgaccgagagcggtgagggcgcacagcgctgcatggtggcggctctcaagcgtgccgggatcgtgccggacgagatcgactatatcaatgcgcatggcacgtccaccatggccgatacgatcgagcttggcgcggtggagcgcgtggtgggtgaggcggctgcgaagatttcgatgtcttccaccaaatcatccatcggccacctgttgggtgcggcaggggctgccgaagcgatcttctccacgctggccattcgcgacaatatcgcgcctgccacactcaatctggacaatccggcggcgcagaccaggatcgatctcgtgccgcacaagccgcgcgaacgcaagatcgatgtggcgctgtcgaattcgttcggtttcggtggcaccaatgcatcgctggtgctgcgccgctacacggcctga

SEQ ID NO: 19741 - protein, 420 aa, Brucella suis 1330
MRRVVITGLGLVSPLASGVEETWKRLLAGESGARRVTEFEVDDLACQIACRIPVGDGTNGTFNPDLHMDPKEQRKVDPFIVYAVGAADQALDDAGWHPENDEDQVRTGVLIGSGIGGIEGIVEAGYTLRDKGPRRISPFFIPGRLINLASGHVSIKHKLRGPNHSVVTACATGTHAIGDAARLIAFGDADVMVAGGTESPVSRISLAGFAACKALSTKRNDDPTAASRPYDEDRDGFVMGEGAGIVVLEELEHALARGAKIYAEVIGYGMSGDAFHITAPTESGEGAQRCMVAALKRAGIVPDEIDYINAHGTSTMADTIELGAVERVVGEAAAKISMSSTKSSIGHLLGAAGAAEAIFSTLAIRDNIAPATLNLDNPAAQTRIDLVPHKPRERKIDVALSNSFGFGGTNASLVLRRYTA

SEQ ID NO: 19742 - DNA, 1425 bp, Plasmodium falciparum 3D7
  CDS (1)..(1425)
atgaatattagatgtagaaaagaaaaaaaaaaaaaaaaaaaaaaaaacattaatcatgttaacagtaaaaggtatgccttcattaaaaggggtatacctggaatatccaagaattattttaaaggtttcaagttgtacaattcgagagaaatgaaaaatctttgtgaaacttctagagtggtgtgcacaggtgtaggggtagtaactggattagggattggcatagaacatttttggaataatattataaatggatatacatcaatagataaaattacaaaatttgatataaccggtatgtcatgtggtattggtagtgaaataaagaaaagcgattttaatcctagtgattattacacaaataaaaaagatgttaatcgtaatgatgattgtactcattatgcagtcgcagccacacgtttagctttagacgatgcaaaactaaatttggaaaaattagacaaagataaaacaggtactatcataggtagtggcataggtggactaagatttttagaaaaagaaatgaaaacaatgtatgaaaaaggacataaaagaataacaccatatttaatacctgcaatgatagcaaatactccatctggatatgtatctatcgaaaacaatattagagggatctctcttggtatgttaagtgcatgtgctacgtctggtaacacaataggtgaagcctatagatatataaaatataaagagtatgatgttatgatatgtggtggaactgaagctagtataactcctataagttttgctggattcaattcattaaaggctttatgtacaggttataacgataatccaaaaaaaggttgtagacccttcgatttaaaaagaagtggtttcgttatgggagaaggttcaggcatcttaattctagaatcatacgaacatgcaataaaaagaaatgcaccaatatatggagaaattatttcatattcttcagaatgtgatgcataccatattactgcaccagaacctaatgggaaaggtttaacaaattctattcataaagcattaaaaaatgcaaatataaacataaatgacgttaaatatattaatgcacatggtacttcaacaaatttaaatgataaaatagaaaccaaggtttttaaaaatgttttcaaagatcatgcatacaaattatatatatcatcaactaaaagtatgacaggacattgtataggtgctgctggagctatagaatctattgtatgtcttaaaactatgcaaacaaatattataccacctactattaattatgaatataaggacccagattgtgatctaaattatacacctaataaatatattcatgcaaaggaaaatattgatatatctctcaatacaaatttgggatttggaggccataacacagcattacttttcaaaaaaattgtaaagtga

SEQ ID NO: 19743 - protein, 474 aa, Plasmodium falciparum 3D7
MNIRCRKEKKKKKKKNINHVNSKRYAFIKRGIPGISKNYFKGFKLYNSREMKNLCETSRVVCTGVGVVTGLGIGIEHFWNNIINGYTSIDKITKFDITGMSCGIGSEIKKSDFNPSDYYTNKKDVNRNDDCTHYAVAATRLALDDAKLNLEKLDKDKTGTIIGSGIGGLRFLEKEMKTMYEKGHKRITPYLIPAMIANTPSGYVSIENNIRGISLGMLSACATSGNTIGEAYRYIKYKEYDVMICGGTEASITPISFAGFNSLKALCTGYNDNPKKGCRPFDLKRSGFVMGEGSGILILESYEHAIKRNAPIYGEIISYSSECDAYHITAPEPNGKGLTNSIHKALKNANININDVKYINAHGTSTNLNDKIETKVFKNVFKDHAYKLYISSTKSMTGHCIGAAGAIESIVCLKTMQTNIIPPTINYEYKDPDCDLNYTPNKYIHAKENIDISLNTNLGFGGHNTALLFKKIVK

SEQ ID NO: 19744 - DNA, 1239 bp, Shewanella oneidensis MR-1
  CDS (1)..(1239): transl_table=11
gtgtctaaacgtcgtgtagtggtaaccggtttagggttagtaacgcccgtgggcaatactgtcgacacaacttggaaagccctgctttcgggtaagagtgggattgcgcccataaccaaatttgatgccagcgaattcaccactcgtttcagtggttctgtaaaagatttcgatgttgagcagtacttaaccaaaaaagacgcccgcaaaatggacctctttattcagtatggtatggctgcaggcatccaagctatccaagactcaggtctggatatgagcaaagtaaacccaggccgcgttggtaccgctatcggtgctggtatgggtggaatgtggttgattgagcaaaatcacagtgcgttaatgaacggtggtccacgtaaaatttcgcctttcttcgtgccgagcaccatcattaatatgattgcaggccatttatcgattatgtacggaatgacaggccctaactttgccgtcactaccgcctgtacaaccggtgtgcataatatcggttttgcggcgcgcaccatcgcctatggtgatgctgacgtaatggttgccggtggggcggaagatgtcacgtgcccattaggtgtaggtggttttggtgcagcaaaagccctctcaactcgcaatgatgatccaactgcagcgagccgtccatgggataaagaccgtgatggttttgtgatcggtgatggcgctggtgtaatggtgatggaagaatacgagcacgctaaagcgcgcggtgcgaccatttatggtgaactcgttggctttggtatgagcggtgatgctttccatatgacctcgccaccaagtgatggtgcgggtgccgcagcggctatggtcaatgccgttaatgatgctaagctaccacttgagaaaattggctatatcaatgcccatggcacttcaacccccgcaggtgataaagcggaagcggcggcggttaagtcggtctttggtgatcacgcttataatctgcttgtgagttcgactaagtcgatgacgggtcacctattaggtgctgcgggcgcggtggaggcgattttcactttattggcactacgtgaccaagcggtaccaccgaccattaacctcgataatcctgacgaagggtgtgatttagactttgtggcacacactgcccgcgatgtgaagttagattacgctctatgtaactccttcggctttggtggaactaacggttcattactgtttaagaaagtctaa

SEQ ID NO: 19745 - protein, 412 aa, Shewanella oneidensis MR-1
MSKRRVVVTGLGLVTPVGNTVDTTWKALLSGKSGIAPITKFDASEFTTRFSGSVKDFDVEQYLTKKDARKMDLFIQYGMAAGIQAIQDSGLDMSKVNPGRVGTAIGAGMGGMWLIEQNHSALMNGGPRKISPFFVPSTIINMIAGHLSIMYGMTGPNFAVTTACTTGVHNIGFAARTIAYGDADVMVAGGAEDVTCPLGVGGFGAAKALSTRNDDPTAASRPWDKDRDGFVIGDGAGVMVMEEYEHAKARGATIYGELVGFGMSGDAFHMTSPPSDGAGAAAAMVNAVNDAKLPLEKIGYINAHGTSTPAGDKAEAAAVKSVFGDHAYNLLVSSTKSMTGHLLGAAGAVEAIFTLLALRDQAVPPTINLDNPDEGCDLDFVAHTARDVKLDYALCNSFGFGGTNGSLLFKKV

SEQ ID NO: 19746 - DNA, 1233 bp, Streptococcus mutans UA159
  CDS (1)..(1233): transl_table=11
atgacattaaaaagagttgtagtgacaggttacggcgtaacatcgccaatcggacatacaccagaagatttttggaatagtcttcatgatggtaaaatcggtattaaaccaattactaagtttgatgcttcagaaattcctgttttcaatgcaggcgaaattcaagattttccatttgataaatactttgttaaaaaagataaaaatcgtatggatacttactctctttatgccatttatgcagccatggaagctattgaaaatgctgcacttgacatggcacaagaaattcgtgatcgtgttggtgttattgtatcctcaggtattggtggtttacaagaattagaagatcaaatcattcgtatgcatgagcgtggcatgaaacgcattaaaccaatgtttatccctaaagctctgtctaacatgggagctggaaatattgccctcaagattggcgcacaaggagtctgcaaatctattactacagcttgtgcttcagctaatgatgctattggtgaagctttccgtgaaattaaatacggttttcatgatgtgattcttgcaggtggttcagaagcatccattactaagattggtattggtggtttcaacgctttgactgctctttctacaacagaggatccagcgcgttcagctattccatttgataaagatcgcaatggttttgtcatgggtgaaggtgctgccgttcttattctggaaagtcttgaacatgctcaaaaacgtggggctaggattttggcagaggttgttggttatggaagtaactgtgatgcctaccatatgacaacaccgactcctgatggttcgggtgctgctaaggctattaaattagcaattaatgaagcaggtatctcaccagaggaagtcaattatgttaatgctcatggtacatcaacacaggccaatgaaaaaggagaaagcaaggcaatcgttgctgttttaggtaaagatgtacctgtctcttctacaaaatcattcacaggccatcttcttggtgctgctggcggtgttgaggctattgccactattgaagcaattcgtaatcattttgtacctatgacagctggcactaaggaactttcagaagatattgaagcgaatgttgtttatggtcaaggtcaagaagcagttatcaaatatgctatctcaaatacctttggatttggcggacacaatgccgttcttgcctttaagcgttgggaggattaa

SEQ ID NO: 19747 - protein, 410 aa, Streptococcus mutans UA159
MTLKRVVVTGYGVTSPIGHTPEDFWNSLHDGKIGIKPITKFDASEIPVFNAGEIQDFPFDKYFVKKDKNRMDTYSLYAIYAAMEAIENAALDMAQEIRDRVGVIVSSGIGGLQELEDQIIRMHERGMKRIKPMFIPKALSNMGAGNIALKIGAQGVCKSITTACASANDAIGEAFREIKYGFHDVILAGGSEASITKIGIGGFNALTALSTTEDPARSAIPFDKDRNGFVMGEGAAVLILESLEHAQKRGARILAEVVGYGSNCDAYHMTTPTPDGSGAAKAIKLAINEAGISPEEVNYVNAHGTSTQANEKGESKAIVAVLGKDVPVSSTKSFTGHLLGAAGGVEAIATIEAIRNHFVPMTAGTKELSEDIEANVVYGQGQEAVIKYAISNTFGFGGHNAVLAFKRWED

SEQ ID NO: 19748 - DNA, 1245 bp, Pseudomonas putida KT2440
  CDS (1)..(1245): transl_table=11
gtgtcgcgtagacgcgtcgtggtcaccggtatgggtatgctgtcgccactgggtaccgatgtaccgagcacctggcagggcattctggctggccgcagtggcatcggtccgatcgaacacacggacctgtctgcctactccacccgttttggcggctcggtgaaaggcttcgaggttgagcagtacctgtcggccaaagaggcccgcaagctcgacctgttcatccagtacggcctggcggctggtttccaggccgtgcgtaatgccggcctggaggtcaccgatgccaaccgcgagcgtattggcgtggccatgggctcgggtatcggtggtttgaccaacatcgaagaaaccagccgcaccctgcacgattcagggccgcgccgcatttcgccgttcttcgtgccgggttcgatcatcaacatgatctccggtttcctgtcgatccacctgggtctgcaagggccgaactatgccatcgccactgcgtgcaccactggcacccattgcatcggcatggccgcgcgcaatatcgcctacggtgaggctgacgtgatgatcgccggtggcgccgaaatggccgcttgtggtctgggcatgggcggttttggcgcttcgcgcgcactgtctacccgcaacgatgaacccagccgggccagccgcccgtgggacaagggtcgtgacggctttgtattgtccgacggtgccggagccctggtgctcgaggagctggagcacgccaaggcccgcggtgcgactatctatgccgagctggttggctttggcatgagcggcgacgcctaccacatgacctcgccacccgactctggcgagggcgctgcccgctgcatggccaacgccttgcgcgatgccggtatccagccggaagaagtcagctacatcaacgcccacggcacttctaccccggcgggcgatgtggccgaagtggcggcgatcaagcgcgtgttcggcgagcatgcctacaagctggcggtcagctcgaccaagtcgatgaccggtcacttgctgggcgccgcgggcgcggtggaggcgatcttcagcgtgctggccatcaatagccagatggccccgccgaccatcaacctggacgagccggacgaggggtgtgacctcgacttcgttccccaccaggcgcgcagcatgccgatcgacgtggtgctgtccaactcgttcggctttggcggcaccaacggctcgctggtattccgccggtttgccggctga

SEQ ID NO: 19749 - protein, 414 aa, Pseudomonas putida KT2440
MSRRRVVVTGMGMLSPLGTDVPSTWQGILAGRSGIGPIEHTDLSAYSTRFGGSVKGFEVEQYLSAKEARKLDLFIQYGLAAGFQAVRNAGLEVTDANRERIGVAMGSGIGGLTNIEETSRTLHDSGPRRISPFFVPGSIINMISGFLSIHLGLQGPNYAIATACTTGTHCIGMAARNIAYGEADVMIAGGAEMAACGLGMGGFGASRALSTRNDEPSRASRPWDKGRDGFVLSDGAGALVLEELEHAKARGATIYAELVGFGMSGDAYHMTSPPDSGEGAARCMANALRDAGIQPEEVSYINAHGTSTPAGDVAEVAAIKRVFGEHAYKLAVSSTKSMTGHLLGAAGAVEAIFSVLAINSQMAPPTINLDEPDEGCDLDFVPHQARSMPIDVVLSNSFGFGGTNGSLVFRRFAG

SEQ ID NO: 19750 - DNA, 1314 bp, Pseudomonas putida KT2440
  CDS (1)..(1314): transl_table=11
atgatccaacgagaggtcgaaatgactcacaacgttaatcaaaagcgcatcgtggtgaccggcaccggcgttgtcagcccgctgggctgcggcgtaaaggaagtctggcggcgattgctggctgggcagtccgggattcgcgcgcttgctggcgatgtcgtcgaaggcactggcgtgtcagtgggcggcagcgtgcccacattggccgaggatgcagtggcaggctatcaacccgagcgggtcatccacgccaaggaacgcaagaagatggatcggttcatcgagtttgcgctggtagcagcggatgaagcattgcagcaagccggctggaatcccgagcgtcaggctgaacgcgcgcgcaccgccaccatcatcgcatcaggcgtcggtggcttcggcgccatcgcagaggcggtgcgcaccactgacgcacgtggccctcgcaagttgtcgcccttcacggcgccatcgttcctggccaatatggcagcgggtcatgtctccatacgctatggcttcgaaggcccacttggggcacccgtcacagcctgcgctgcgggggtgcaggccattggcgacgccgctcggctcatcagaagcggcgaagcggatatcgcgatctgcggtggcgccgaggcggcaattgatcgtgtgacgctaggctgctttgcggctgcacgagcgctcagcacgggcttttcggatagccctgagcaagcctcccgtcctttcgatagccaacgggacgggtttgtcatggctgaaggggctggcttgctggtgatcgagtcgctggaacatgcgctggcccgtggcgccaagccgctggccgagctggtcggctacggaacgagcgctgatgcctatcatctgaccgctggccccgaagacggaagcggtgccaggcgcgccatgcaactcgcgctgcaacaggcgtcgatagcgcctggggacgtggaccatatcaatgcgcatgcgacttcgacccaggttggcgacaagggtgaacttgcagcaattcgcgccgtattcggtagcggcagcggcgtggcgattacatcgaccaaatcggccaccggccacctcctgggggcggcaggcggtgtcgaagccattttcacggtgttggcgctgcaagatcagatcgttccacccacgctcaacctgactcaggtcgatgatgctgcgcttggccttgacctggttgcacgaatagcccgtgaaatgcccatcgaatatgccttgtccaacggtttcggattcggtggtgtgaacgccagcgtactgttccgccgctgggaggccaacgtatga

SEQ ID NO: 19751 - protein, 437 aa, Pseudomonas putida KT2440
MIQREVEMTHNVNQKRIVVTGTGVVSPLGCGVKEVWRRLLAGQSGIRALAGDVVEGTGVSVGGSVPTLAEDAVAGYQPERVIHAKERKKMDRFIEFALVAADEALQQAGWNPERQAERARTATIIASGVGGFGAIAEAVRTTDARGPRKLSPFTAPSFLANMAAGHVSIRYGFEGPLGAPVTACAAGVQAIGDAARLIRSGEADIAICGGAEAAIDRVTLGCFAAARALSTGFSDSPEQASRPFDSQRDGFVMAEGAGLLVIESLEHALARGAKPLAELVGYGTSADAYHLTAGPEDGSGARRAMQLALQQASIAPGDVDHINAHATSTQVGDKGELAAIRAVFGSGSGVAITSTKSATGHLLGAAGGVEAIFTVLALQDQIVPPTLNLTQVDDAALGLDLVARIAREMPIEYALSNGFGFGGVNASVLFRRWEANV

SEQ ID NO: 19752 - DNA, 1263 bp, Vibrio vulnificus CMCP6
  CDS (1)..(1263): transl_table=11
gtgtccaagcgtcgtgtagttgtcactggcatgggtatgttgtcaccggttggcaacaccgtagcagaatcctggaaatccctgcttgaaggcaaaagtggtatcgtcaatatcgaacatttcgatgcaactaacttctctacccgtttcgccggtttggtaaaagacttcaactgcgaagaatacatgtctaaaaaagatgcacgtaaaatggatctcttcatccagtacggcattgcagcaggtattcaggctttagacgattcaggtcttgaaattacggatgaaaacgcacaccgcgttggtgttgcgatcggctctggtatcggcggtcttgatcttattgaagcaggccacaccgctttagttgaaaaaggcccacgtaaagttagcccattcttcgttccttcaactattgtaaacatggttgcaggtaatctatctatcatgcgtggcatgcgcggtccgaacatcgcgatttctacggcatgtactactggtctgcataacatcggccatgcagcgcgaatgatcgcttacggcgatgctgatgctatggttgctggtggtgctgagaaagcatcaacaccgcttggtatggctggctttggtgcggcgaaagctctttctactcgtaacgatgaaccacaaaaagcgtctcgtccttgggacaaagatcgcgatggtttcgtattaggcgatggtgctggcatcatggtacttgaagagtacgaacatgcaaaagcacgtggcgcaaaaatttacgctgagctggttggctttggtatgtcgggtgatgcttatcacatgacttcaccaagcgaagacggctctggtggcgctctagcgatggaagcggcaatgcgtgacgcaggtattgttggtacacaagtgggttatgtgaacgctcacggtacatcaacaccagcaggcgatgtggctgaaattaaaggcgtaaaacgtgctcttggtgaagagggcgcaaaacaagttaaagtatcttcaacaaaatctatgaccggccacctacttggtgccgcaggctctgttgaagcgatcattacaccgtgttgtcgctggttgatcagatcgttccaccaaccattaacctggataatccagaagaaggtttggatatcgatcttgttccacatactgcgaagaaagtggatatggaatacgcgatctgtaactcattcggcttcggtggaacaaacggctcactcgtatttaagaaaatctaacactcatttaggtttctga

SEQ ID NO: 19753 - protein, 420 aa, Vibrio vulnificus CMCP6
MSKRRVVVTGMGMLSPVGNTVAESWKSLLEGKSGIVNIEHFDATNFSTRFAGLVKDFNCEEYMSKKDARKMDLFIQYGIAAGIQALDDSGLEITDENAHRVGVAIGSGIGGLDLIEAGHTALVEKGPRKVSPFFVPSTIVNMVAGNLSIMRGMRGPNIAISTACTTGLHNIGHAARMIAYGDADAMVAGGAEKASTPLGMAGFGAAKALSTRNDEPQKASRPWDKDRDGFVLGDGAGIMVLEEYEHAKARGAKIYAELVGFGMSGDAYHMTSPSEDGSGGALAMEAAMRDAGIVGTQVGYVNAHGTSTPAGDVAEIKGVKRALGEEGAKQVKVSSTKSMTGHLLGAAGSVEAIITPCCRWLIRSFHQPLTWIIQKKVWISILFHILRRKWIWNTRSVTHSASVEQTAHSYLRKSNTHLGF

SEQ ID NO: 19754 - DNA, 1263 bp, Bradyrhizobium japonicum USDA 110
  CDS (1)..(1263): transl_table=11
atgcgtcgtatcgtcgtgacgggaatgggcgcggtgtcgccgctcgcctgcggtgtcgaactgtcctggcgccggctgctggcaggccaaagcgggctgcgtcccctgcccgaatgggcgcaggcgctccccgcgcgcatcgcgggcctcgtgcccgacaaggccggcgatgcggacggcggcttcgatcccgcgcaggccgccgcgccgaaagaccagcgcaagatggaccgcttcatcctgttcgcgctgctcgccaccgccgaagcggtcgcacaggccggatggacaccgcaggacgcgagcgcgctggaacggaccgcgacggtcatcggctccggcgtcggcggctttccggcgatggcggaggcagtgcgcatcaccgagcagcgcggcgtgcgccggctctcgccattcacgatcccctcgttcctcgccaatctcgccgccggccacgtctcgatcaaatacggctacaagggaccgctgggaacgccggtcacggcctgcgccgccagcgtccaggcgatcggcgatgccgcgcgcatgatccgcgccggcgaggccgatgtggcgatctgcggcggcgcggaggcctgcatcgacatcgtcagcctcggcggcttcgccgcggcgcgcgcgctgtcgagctccttcaacgaggagccgaggcgcgcctcgcgcccgttcgatcgcgaccgcgacggcttcgtcatgggcgaaggcgccggcatcctggtgatcgagacgctcgagcatgcgctggcgcgcggcgcgacaccgatcgcggagatcgtcggatacggcacgacggcggacgcctaccacatgacgtcggggccgcccgatggcgacggcgcgcgccgcgccatggagatcacactgcggcaggcgcggcttgagcccggcgaattgcagcacctgaacgcgcatgcgacgtcgacgcccgccggtgacgaaagcgagcttggcgcgatcggcgcgctgttcggccgtagccgcagcatcgcggtgagcgcgaccaaatcggccaccggccatctgctcggcgccgccggcgggctggaggcgatcttcaccgtgctcgccttgcgcgatcaggtcgcgccgccgacgctcaatttcgagaaccccgacgcgagcgctgatggcatcgacatcgtctcaggtagcgcgcggccgatgccgatgcggcacgccatctccaacggatttggcttcggcggggtgaatgcctgcgtgatcttccgccggatggactaa

SEQ ID NO: 19755 - protein, 420 aa, Bradyrhizobium japonicum USDA 110
MRRIVVTGMGAVSPLACGVELSWRRLLAGQSGLRPLPEWAQALPARIAGLVPDKAGDADGGFDPAQAAAPKDQRKMDRFILFALLATAEAVAQAGWTPQDASALERTATVIGSGVGGFPAMAEAVRITEQRGVRRLSPFTIPSFLANLAAGHVSIKYGYKGPLGTPVTACAASVQAIGDAARMIRAGEADVAICGGAEACIDIVSLGGFAAARALSSSFNEEPRRASRPFDRDRDGFVMGEGAGILVIETLEHALARGATPIAEIVGYGTTADAYHMTSGPPDGDGARRAMEITLRQARLEPGELQHLNAHATSTPAGDESELGAIGALFGRSRSIAVSATKSATGHLLGAAGGLEAIFTVLALRDQVAPPTLNFENPDASADGIDIVSGSARPMPMRHAISNGFGFGGVNACVIFRRMD

SEQ ID NO: 19756 - DNA, 1266 bp, Bradyrhizobium japonicum USDA 110
  CDS (1)..(1266): transl_table=11
atgaggcgggttgtcgtcacgggtctcggcatggtctcgccactcggctgtggcgtcgagccgacctggaaacgcatcctcaacggcgaaagcggtgcgcgcaggatcgagagcttcgatgtctccgatcttcagaccaagatcgcctgcacggtggtgcgcggcgacgggtcgaacgacaccttcaatcccgacaagtggatggagccgaaggaccagcgcaaggtcgacgacttcatcatcttcggcatggccgcagccggccaggcgctcgacgatgccaactggcatcccgaaaccgaagaggacaagtgtgcgaccggcaccatgatcgggtccggcatcggcggccttaacggcatcgcggaaaccgccatcctgctgaaggagcgcggaccgcgccgggtgtcgccgttcttcattccgggccgcctgatcaatctcgcctccggctacgtctcgatcgcgcacgggctgaaggggccgaaccattcggtggtcacggcctgctcgaccggcgcgcatgcggtcggcgatgccgcccgcctgatcgcgctgggcgatgccgacgtgatggtcgccggcggcgctgagtcgccgatcagccgcatcggcattgccggcttcaacgccgcgcgcgcgctctcgaccggtttcaacgacacacccgagaaggcctcacgtccctacgacaaggatcgcgacggcttcgtgatgggcgagggcgccggcgtcctcgttctggaagaactcgagcacgcgaggcgacgcggcgccaagatctatgccgaggtgatcggctatggtctgtcgggcgacgcctatcacatcacgtcgccgtcgcccgacggcgatggcggcttccgcagcatgcaggccgcgctcaagcgcgccggcctcacggcgtccgatctcgactacatcaacgcgcacggcacctcgacgccgctcggtgacgagatcgagctcggcgcggtcgagcgtctgctcggcaatgccgcctccaaggtcgcgatgtcctcgaccaaatcgtcgaccggccatctgctcggcgcggccggtgcgatcgaggcgatcttcgccattctcgcgattcgcgataatgtcgtgccgccgactatcaacctcgacaatccgtcggtcgaaactacgatcgatctcgtgccgcacacggcgaagaagcgagaggtcaacgtcgcgttgtcgaattctttcggttttggcggtaccaatgcgtcggtgatcgtccgccgtttggccaattag

SEQ ID NO: 19757 - protein, 421 aa, Bradyrhizobium japonicum USDA 110
MRRVVVTGLGMVSPLGCGVEPTWKRILNGESGARRIESFDVSDLQTKIACTVVRGDGSNDTFNPDKWMEPKDQRKVDDFIIFGMAAAGQALDDANWHPETEEDKCATGTMIGSGIGGLNGIAETAILLKERGPRRVSPFFIPGRLINLASGYVSIAHGLKGPNHSVVTACSTGAHAVGDAARLIALGDADVMVAGGAESPISRIGIAGFNAARALSTGFNDTPEKASRPYDKDRDGFVMGEGAGVLVLEELEHARRRGAKIYAEVIGYGLSGDAYHITSPSPDGDGGFRSMQAALKRAGLTASDLDYINAHGTSTPLGDEIELGAVERLLGNAASKVAMSSTKSSTGHLLGAAGAIEAIFAILAIRDNVVPPTINLDNPSVETTIDLVPHTAKKREVNVALSNSFGFGGTNASVIVRRLAN

SEQ ID NO: 19758 - DNA, 1236 bp, Xylella fastidiosa Temecula1
  CDS (1)..(1236): transl_table=11
atgaatcgtcgggttgtcgttactgggatggggatggtgtcgccgttgggcaatgatttgaccacaagttgggatggcatcgttcacggacgttcgggtatcgctcccatcgtccagattgatgcttctaagttccccactcagattgctggcgaaatcaagggattcgatccaacgaagttcgtatccgcgaaggatgcgaagaaaatggattcgttcatttactatggtataggcgcagcgtttatggcgctggatgatgctggtttagagatcaatgagatcaatgctgagcgtgttggtgccctgatcggttctggtataggtggcgtgtttggcattgaagagcaaaccatcaagctctatgaggggggcgcacgcaagatatctcctttctatgtgccagcgacgatcatcaacatgctgccaggacagttgagtgttttgaaaggcttgaaaggcccgacgttctctgcggtatctgcctgcgcgacttcaaaccactccattggtatggcaatgcgcatgatccagtatggtgatgctgatgttatgttggctggtggttctgagcgcgcttcttcgccaactgcgattggtggcttttgtgcgatgagggcgatgtctacgcgtaacgatgatccaaccggcgcttcgcggccgtgggacaaggggcgcgatggctttgtgcttggtgatggtgccggcattctagtgctggaagagtatgagtatgctaaagcgcgaggcgcacgcatctatgctgaattggctggtttcggcgccacttccgatgccttccacatgacgatgccagtcgaggatggtgaaggtgcagcgcgttgtatgcgtatagcgttgcaggatgcgagggtcactccggagcaaattgattatctcaatgcacacggtacctcaactcctttgggcgatctgtgcgaaaccaacgcgatcaagacggtattaggaggtcatgcctacaaagtgatggttagctcgaccaaatcaatgaccggacatctactcggtgcggccggtggtgtggaagcaattttctcagtgatggcgttgcatactggcatcgttccgccgacgattaatctcgaagaaccagacgaaggctgtgatcttgattacgtgccgcatgtggcgcgtgaggccaaactggatgtggtgatttcaaacggttttggttttggtggtactaacggcacattagtgttcaagcgtatatga

SEQ ID NO: 19759 - protein, 411 aa, Xylella fastidiosa Temecula1
MNRRVVVTGMGMVSPLGNDLTTSWDGIVHGRSGIAPIVQIDASKFPTQIAGEIKGFDPTKFVSAKDAKKMDSFIYYGIGAAFMALDDAGLEINEINAERVGALIGSGIGGVFGIEEQTIKLYEGGARKISPFYVPATIINMLPGQLSVLKGLKGPTFSAVSACATSNHSIGMAMRMIQYGDADVMLAGGSERASSPTAIGGFCAMRAMSTRNDDPTGASRPWDKGRDGFVLGDGAGILVLEEYEYAKARGARIYAELAGFGATSDAFHMTMPVEDGEGAARCMRIALQDARVTPEQIDYLNAHGTSTPLGDLCETNAIKTVLGGHAYKVMVSSTKSMTGHLLGAAGGVEAIFSVMALHTGIVPPTINLEEPDEGCDLDYVPHVAREAKLDVVISNGFGFGGTNGTLVFKRI

SEQ ID NO: 19760 - DNA, 1245 bp, Clostridium tetani E88
  CDS (1)..(1245): transl_table=11
atgttaaaaatgaaaagagtagtaattacaggcatgggtgcagtaacacctttaggtaatgatgtaaatactttttggaataatataaagcttggaacttgcggtatagattttataaagaattttaatacagaaggatttaaagtaaaattagcggcagaagtaaaagattttgagccttcagatgtaatagaaaaaagagaattaaaaagaatggataaatattgtcaatttgccgtagtagcagcagaagaagcaataaaagatgctaatttaaatttagataatatagataaagataagtttggagtagtagttggttcaggtataggtggcatagagactatagaaaaacaatataaaactttaatggaaaagggacctaatagagttcatccattatttatacctatgataataagtaatatggcagcaggaaatattgctataagatatggggcaaaaggaatatgcacaacagtagtaacagcttgtgctacaggaacaaactctattggagaagcttatagaatgatacaaaatggaacttctgatgtaatgattgctggaggaacggaagcatctataactcctttagctatggctggatttacatcccttactgcattaagtaaaagtgaagatcctacaagagcatctataccttttgacaaagagagaaatggatttgtaatgggagaaggatcaggaatattaattttagaatctttagaacatgctcaaaaaagaggagctaaaatatatgctgaaatggttggatatggagcaacctgtgatgcttatcatataacatcaccggcaccaggaggagaaggagcatctagagcaattaggttagcaatagatgaagcaaagatatctcctagggaaatatcctatataaatgctcatggtacaggtacagaatataacgataaatttgaaacagaagcaattaaagatgtctttggagaatatgctataaatataccaataagctctataaaatccatgacaggacatttattaggagcagcaggagcagtggaggctattacttctgtaaaatctatatgtgaaggttttgtaccgccaactataggatacaagataaaagatgaagaatgtgatttagactatgtgcctaataaaggtagataccaagaaataaaatatgctatgtctaattctttaggatttggagggcataatgcaataatcctatttaaaaagtggagtgattaa

SEQ ID NO: 19761 - protein, 414 aa, Clostridium tetani E88
MLKMKRVVITGMGAVTPLGNDVNTFWNNIKLGTCGIDFIKNFNTEGFKVKLAAEVKDFEPSDVIEKRELKRMDKYCQFAVVAAEEAIKDANLNLDNIDKDKFGVVVGSGIGGIETIEKQYKTLMEKGPNRVHPLFIPMIISNMAAGNIAIRYGAKGICTTVVTACATGTNSIGEAYRMIQNGTSDVMIAGGTEASITPLAMAGFTSLTALSKSEDPTRASIPFDKERNGFVMGEGSGILILESLEHAQKRGAKIYAEMVGYGATCDAYHITSPAPGGEGASRAIRLAIDEAKISPREISYINAHGTGTEYNDKFETEAIKDVFGEYAINIPISSIKSMTGHLLGAAGAVEAITSVKSICEGFVPPTIGYKIKDEECDLDYVPNKGRYQEIKYAMSNSLGFGGHNAIILFKKWSD

SEQ ID NO: 19762 - DNA, 1233 bp, Lactobacillus plantarum WCFS1
  CDS (1)..(1233): transl_table=11
atgacagaacgagtagttgtgactggaatgggtgcggtgacgcccctcggtaatagtgttgatgaatttttaacggggttattcgcgggacaagttgggattaagcccatcacgaagtttgacgcgacgcccactgggattacagttgccggtgaggttaaggattttcagccagaagaacgaattgaaaagaaattagcgaaaagattggatttattttccgtttatggtctatacagtgcaagtgaagcgatggcgcaagccggactaaatgaagcaaatattgacccagaacgattaggcgttatttatggttcgggtatcggtggtttaacgacgattgaagcgcaagtgatcaagatgcacgacaagagtcccaaacgagtttcaccgttattcgtccctaattcaatcattaacatggttgttggtaatatcgcgatgcaatttaacgcacagaataccagtcaagcgattgtgaccgcgtgtgcgtcggcgacgaatgccatcggcgatgcgtttgaatatttgcgtcaaggaaaggcagatgtgatcatcacgggtggttcagaagcttccgtcaacgaaatcggtattgcagggtttgcgtccctgactgcgttgtcgaaagccactgacccaacgttggcttcgttaccgtttgatcgtcaacgcaatgggtttgtgatgggtgaagggggtgcgacgttagtcttagaaacgttggcccatgcccaagcccgaggcgcccagattcttggtgaagtcgtgggttacggaacgactagcgatgcttatcatatgacagccccccgaccggatggtgctggtgccaaacgtgcaatgcaacaagccgttgcggaagccggcattcaaccgcgtgatgtggattacatcaatgctcatggaacagccacacatgcgaatgatagtgccgaagctcaagcaattagcgcgttgtttggtcaagatgtacaagtcagcagtactaaaggaatgacggggcacttattaggcgctgcgggtgcaattgaagctgttgcaacgattggtgctctgcaagcgggtcagttacctgcgaatattggttgtacggaccaagatcctgagtgtccagtcaatttagtaacgccagcaactcaacatcaagccgcaacctatgctttgagtaattcatttggttttgggggccataatgccgtggttgcctttaagaagtgggtgaatgtatga

SEQ ID NO: 19763 - protein, 410 aa, Lactobacillus plantarum WCFS1
MTERVVVTGMGAVTPLGNSVDEFLTGLFAGQVGIKPITKFDATPTGITVAGEVKDFQPEERIEKKLAKRLDLFSVYGLYSASEAMAQAGLNEANIDPERLGVIYGSGIGGLTTIEAQVIKMHDKSPKRVSPLFVPNSIINMVVGNIAMQFNAQNTSQAIVTACASATNAIGDAFEYLRQGKADVIITGGSEASVNEIGIAGFASLTALSKATDPTLASLPFDRQRNGFVMGEGGATLVLETLAHAQARGAQILGEVVGYGTTSDAYHMTAPRPDGAGAKRAMQQAVAEAGIQPRDVDYINAHGTATHANDSAEAQAISALFGQDVQVSSTKGMTGHLLGAAGAIEAVATIGALQAGQLPANIGCTDQDPECPVNLVTPATQHQAATYALSNSFGFGGHNAVVAFKKWVNV

SEQ ID NO: 19764 - DNA, 1245 bp, Pseudomonas syringae pv. tomato str. DC3000
  CDS (1)..(1245): transl_table=11
gtgtcgcgtagacgcgtcgtggtcaccgggatgggcatgctttcgccactgggcaatgacgtgcccagcagttggcaaggcattctggcgggccgcagtggcattggccttatcgagcacacggacttgtcagccttcaccacccgtttcggcggttcggtcaagggtttcaacgtcgaagaatacctggcgcccaaagaagcgcgtcggctcgatctcttcattcagtacggcctcgcagccagctttcaggcggtgcgtaacgccggccttgaagtcactgatgcaaaccgtgagcgcatcggcgtggcaatgggttcgggcatcggtggtctgaccaacatcgaaaacagcagtcgtctgctgcatgagcaaggtccagggcggatttctccgttttttgtgccaggctcgatcatcaacatgatttccggtttcctgtctatccatctgggtgcacaggggcctaactacgccatcgccacagcgtgcacgaccgcgactcactgcatcggcatggcggcgcgcaacatcgcctacgacgaagctgacgtgatgattgccggtggtgctgaaatggcagcctgtggcctcggtctgggcggcttcggcgctgcacgcgcgttgtcgacccgcaacgacgaccccacgcgtgccagccgtccgtgggacaaaggccgtgacggtttcgtgctgtccgacggtgccggtgcgatggtgcttgaagaactcgagcacgccaaagcgcgcggcgcgaccatctatgccgaactggtcgggtttggcatgagtggcgacgcctatcacatgacctccccgcctgatgacggtgccggcgccgcacgttgcatcgtcaacgccctgcgtgatgccaaggtcaatgcggatcaggtgcagtacatcaacgcacacggtacctcgacacctgcgggcgatctggccgaggcatctgcgatcaagtcggtgttcggcgatcacgcctacaagctggcggtcagctcgaccaagtcgatgaccggccacttgctgggggctgccggtgcggtcgaggcaattttcagcgtgctggcaatggttgatcaggtggctccgccgaccatcaatctggatgaaccgagcgaaggctgcgacctgaactttgtgcctcacgaagcgcgccggatgccgattgatgtagtcctgtcgaactccttcgggttcggtggcaccaacggctcgctggtgtttcgtcggttcgccgagtaa

SEQ ID NO: 19765 - protein, 414 aa, Pseudomonas syringae pv. tomato str. DC3000
MSRRRVVVTGMGMLSPLGNDVPSSWQGILAGRSGIGLIEHTDLSAFTTRFGGSVKGFNVEEYLAPKEARRLDLFIQYGLAASFQAVRNAGLEVTDANRERIGVAMGSGIGGLTNIENSSRLLHEQGPGRISPFFVPGSIINMISGFLSIHLGAQGPNYAIATACTTATHCIGMAARNIAYDEADVMIAGGAEMAACGLGLGGFGAARALSTRNDDPTRASRPWDKGRDGFVLSDGAGAMVLEELEHAKARGATIYAELVGFGMSGDAYHMTSPPDDGAGAARCIVNALRDAKVNADQVQYINAHGTSTPAGDLAEASAIKSVFGDHAYKLAVSSTKSMTGHLLGAAGAVEAIFSVLAMVDQVAPPTINLDEPSEGCDLNFVPHEARRMPIDVVLSNSFGFGGTNGSLVFRRFAE

SEQ ID NO: 19766 - DNA, 1251 bp, Vibrio parahaemolyticus RIMD 2210633
  CDS (1)..(1251): transl_table=11
gtgtccaagcgtcgtgtagttgtcactggcatgggtatgttgtcaccggtaggcaacacagtagaatcatcttggaaagccctgcttgaaggtaaaagcggtatcgtaaatatcgaacacttcgatactacgaacttctcaactcgttttgcaggtcttgttaaagatttcgattgcacagagtacatgtctaaaaaagatgctcgtaaaatggatctattcatccagtacggcattgcagcgggtatccaagcgctagatgactctggcttacaaattaccgaagaaaacgctcctcgagttggtgttgcaatcggctcaggtattggcggcctagacctcattgaaactggtcactcagcactggttgagaaaggtcctcgcaaagttagcccattttttgttccttcgaccatcgtaaacatggttgcgggtaacctgtctatcatgcgtggtcttcgtggtccaaacatcgcgatctctactgcatgtactacaggtctacataacattggccacgctgctcgtatgattgcatacggtgatgcagacgcgatggttgctggtggtgcagagaaagcttctacgcctcttggtatggctggcttcggtgctgctaaagcactttctactcgcaatgacgaacctcaaaaggcatctcgcccatgggataaaggccgtgacggcttcgttctaggtgatggtgctggcgtgatggttcttgaagaatacgaacatgcgaaagcacgtggcgctaagatttacgcagagctagttggctttggtatgtctggcgatgcttaccacatgacttcaccaagtgaagatggttcaggtggtgcgttagcaatggaagcagcaatgcgtgatgcgaacatcacgggtactcaagtaggttacgtgaatgctcacggtacatctactcctgctggcgacgttgctgaaatcaagggtgtgaaacgtgctcttggtgaagaaggtgcaaaacaagttcttgtttcttcaactaagtcaatgactggtcacctattgggtgctgctggttcagttgaagctatcatcacgattatgtctttggttgaccaaattgttccaccaacgattaaccttgatgatccagaagaaggtctagatattgaccttgtgccacacactgcgcgcaaagttgaaggtatggaatacgcaatctgtaactcgtttggctttggtggtacaaacggttctttgatcttcaaaaagttcgctgagtaa

SEQ ID NO: 19767 - protein, 416 aa, Vibrio parahaemolyticus RIMD 2210633
MSKRRVVVTGMGMLSPVGNTVESSWKALLEGKSGIVNIEHFDTTNFSTRFAGLVKDFDCTEYMSKKDARKMDLFIQYGIAAGIQALDDSGLQITEENAPRVGVAIGSGIGGLDLIETGHSALVEKGPRKVSPFFVPSTIVNMVAGNLSIMRGLRGPNIAISTACTTGLHNIGHAARMIAYGDADAMVAGGAEKASTPLGMAGFGAAKALSTRNDEPQKASRPWDKGRDGFVLGDGAGVMVLEEYEHAKARGAKIYAELVGFGMSGDAYHMTSPSEDGSGGALAMEAAMRDANITGTQVGYVNAHGTSTPAGDVAEIKGVKRALGEEGAKQVLVSSTKSMTGHLLGAAGSVEAIITIMSLVDQIVPPTINLDDPEEGLDIDLVPHTARKVEGMEYAICNSFGFGGTNGSLIFKKFAE

SEQ ID NO: 19768 - DNA, 1212 bp, Vibrio parahaemolyticus RIMD 2210633
  CDS (1)..(1212): transl_table=11
atgaaacgagtcgtaatcaccggtatgggtattgtttcaagtatcggtaacaacgtcgaagaagttctagcgtctcttaaagcgggcaaatctggcatcactgcgtctgagcagttcaaagaacacggtcttcgttcgcaagtttggggtgatctaaaaatcaaccctgcggagcatattgaccgtaaacagatgcgctttatgggtgatgcggctgcttatgcatacctatcaatgcagcaggcgattgaagacgctggtctaactgaagaacaagtttcaaacgatcgtacaggtatcgttgctggttctggtggtgcttctgcattaaaccaaacagtagcaaccgatattatgcgcgagaaaggcgtaaaacgcgtaggcccttacatggttcctcgtactatgtcttctaccgtatcagcatgtcttgcgacaccatttaaaattcgtggtgtgaactactcaatgagttcagcttgtgcgacttctgcacactgtatcggccacgcaatggagcttatccaacttggcaaacaagacatcgtgttcgctggtggtggtgaagagctagattggtctcaaacgatgatgtttgatgcgatgggcgcactatcaactaaatacaacgatacgccagaaaaagcgtctcgtacttacgatgcagaccgtgacggttttgttatctctggcggcggcggcatgctggttatcgaagaacttgagcacgctctagcacgtggcgcgaaaatctacggcgaaatcgtaggctacggtgcgacttctgatggctacgacatggtagcaccttcaggtgaaggtgcagtgcgttgtatgaagatggctatgcaagacgttgacagcattgattacgttaacactcacggtacgtctactcctgttggcgacgtgaaagagctaggcgcaatccaagagctatttggcgacaacagcccagcaatctctgcaacaaaagcgatgacaggtcacgctctaggtgcggctggtgttcacgaagcgatttactcgactctaatgctagacaacaacttcatcgcgccaagcatcaatattgaaaacttggatgaagcggcaaaaggtctggatatcgtgacagaagctcgcgacgcagagctaacgacagtcatgtcaaacagctttggcttcggtggtaccaacgcaacattggttatcaaaaaataccaagcgtaa

SEQ ID NO: 19769 - protein, 403 aa, Vibrio parahaemolyticus RIMD 2210633
MKRVVITGMGIVSSIGNNVEEVLASLKAGKSGITASEQFKEHGLRSQVWGDLKINPAEHIDRKQMRFMGDAAAYAYLSMQQAIEDAGLTEEQVSNDRTGIVAGSGGASALNQTVATDIMREKGVKRVGPYMVPRTMSSTVSACLATPFKIRGVNYSMSSACATSAHCIGHAMELIQLGKQDIVFAGGGEELDWSQTMMFDAMGALSTKYNDTPEKASRTYDADRDGFVISGGGGMLVIEELEHALARGAKIYGEIVGYGATSDGYDMVAPSGEGAVRCMKMAMQDVDSIDYVNTHGTSTPVGDVKELGAIQELFGDNSPAISATKAMTGHALGAAGVHEAIYSTLMLDNNFIAPSINIENLDEAAKGLDIVTEARDAELTTVMSNSFGFGGTNATLVIKKYQA

SEQ ID NO: 19770 - DNA, 1233 bp, Streptococcus pyogenes SSI-1
  CDS (1)..(1233): transl_table=11
atgacatttaaaagagtagtggtaacaggttatggtctaacatctccaatcgggcatgatcctgaaacgttttgggacaatctgaaagctggccaaattggtattggtcctattactaaatttgacacgactgattatgcagtcaagaatgctgctgaaattcaggattttccatttgacaaatactttgtgaaaaaagatttgaaccgtttcgatagatattctctttatgctctttacgcagcgaaagaggctattaatcatgctgatttaaatattgagatgattgattccgatcgatttggcgttattgtcgcttcaggtattggtggaattgcggagattgaagagcaggtgattcgcttacatgaaaaagggccaaaacgtgtgaagccaatgacgttgccaaaagcgctaccaaatatggctgcaggaaatgtcgccatgtctttaaaagctcaaggagtatgtaaatcagttaatactgcctgcgcttcttcaaatgatgcgattggggatgcctttcgtgccattaaatttgggactcaagatgtgatgatagttggtgggtcagaggcggccataaccaagtttgccattgctggcttccaaagtttaacagctctctcaacaactgaagatccaagcagaagctctattccatttgataaagaccgaaatggttttatcatgggagaaggatcaggaatgcttgttttagaaagcctagaacatgcgcaagaacgcggggcgacaatcttagcagaaattgtgggttatggaaatacctgcgatgcctaccatatgacatctccaaatcctgagggattaggagctcgtaaagccatccacttagccttacaagaagctggtattgaagccagtgctattaattatgtcaatgcgcacggaacttcaaccccagctaatgaaaaaggagaaagtcaagcaattgtagccgttcttggtaaggatgttccggtgtcttcaacaaaatcgtttacgggtcaccttcttggagcagcaggcgctattgaagctattgccactatcgaggctatgcgtcataactatgttccgatgacggctgggacacaagctttatcagaggatatcgaagcaaatgtcatctttggagaaggaaaagaaacagctatcaactatgccatttcaaatacttttggatttggtggtcataatgctgtattagctttcaaatgttgggaggagtag

SEQ ID NO: 19771 - protein, 410 aa, Streptococcus pyogenes SSI-1
MTFKRVVVTGYGLTSPIGHDPETFWDNLKAGQIGIGPITKFDTTDYAVKNAAEIQDFPFDKYFVKKDLNRFDRYSLYALYAAKEAINHADLNIEMIDSDRFGVIVASGIGGIAEIEEQVIRLHEKGPKRVKPMTLPKALPNMAAGNVAMSLKAQGVCKSVNTACASSNDAIGDAFRAIKFGTQDVMIVGGSEAAITKFAIAGFQSLTALSTTEDPSRSSIPFDKDRNGFIMGEGSGMLVLESLEHAQERGATILAEIVGYGNTCDAYHMTSPNPEGLGARKAIHLALQEAGIEASAINYVNAHGTSTPANEKGESQAIVAVLGKDVPVSSTKSFTGHLLGAAGAIEAIATIEAMRHNYVPMTAGTQALSEDIEANVIFGEGKETAINYAISNTFGFGGHNAVLAFKCWEE

SEQ ID NO: 19772 - DNA, 1242 bp, Salmonella enterica subsp. enterica serovar Typhi Ty2
  CDS (1)..(1242): transl_table=11
gtgtctaagcgtcgtgtagttgtgaccggacttggcatgttgtctcctgtcggcaataccgtagagtctacctggaaagctctccttgccggtcagagtggcatcagcctgatcgaccatttcgatactagcgcctatgcaacgaaatttgctggcttagtaaaggattttaactgtgatgacattatctcgcgcaaagaacagcgcaagatggatgccttcattcaatatggaattgtcgctggcgtacaggccatgcaggattctggccttgaagtgacggaagagaacgcaagccgtattggcgccgctatcggctccggtatcggtggtctcggtctgatcgaagaaaaccacagttcgctggtaaaaggcggaccgcgtaagattagcccgttctttgtcccgtcgacgattgttaacatggtagcaggccatctgactatcatgtatggcctgcgtgggccaagcatctctattgcgactgcctgtacttcaggcgtgcataacatcggccatgccgcgcgtatcatcgcctatggtgatgcggacgcgatggtggcaggtggcgcagaaaaagccagtacgccgctgggcgtaggtggttttggcgcagcgcgcgcgctgtcgacccgcaacgataacccacaggcggcgagccgtccgtgggataaagaacgcgatggttttgtactgggcgacggtgccggtatgttggtgcttgaagagtacgaacatgcaaaagcgcgtagtgcgaaaatctatgctgaaatcgtcggctttggtatgagcagcgatgcttaccatatgacgtcgccgccggaaaatggcgcaggcgctgcgctggcgatggttaacgcgttgcgtgatgccgcgattgagcctgctcagattggctacgtcaacgcgcacggcacgtcgacgcctgccggcgacaaagctgagacgcaggcggttaagtcagtctttggcgatgctgcaagccgagtgatggtgagctcgaccaaatcgatgaccggccatctgttgggcgccgcaggcgcagtagagtctattttctctattctggcgctacgcgatcaggccattccgccaaccattaatctggataacccggatgaaggttgcgatctggacttcgtgccgcatgaagcgcgccaggtcagcgatctggagtacgcgctgtgtaactcctttggctttggcggaactaacggttccttgatctttaaaaagatctaa

SEQ ID NO: 19773 - protein, 413 aa, Salmonella enterica subsp. enterica serovar Typhi Ty2
MSKRRVVVTGLGMLSPVGNTVESTWKALLAGQSGISLIDHFDTSAYATKFAGLVKDFNCDDIISRKEQRKMDAFIQYGIVAGVQAMQDSGLEVTEENASRIGAAIGSGIGGLGLIEENHSSLVKGGPRKISPFFVPSTIVNMVAGHLTIMYGLRGPSISIATACTSGVHNIGHAARIIAYGDADAMVAGGAEKASTPLGVGGFGAARALSTRNDNPQAASRPWDKERDGFVLGDGAGMLVLEEYEHAKARSAKIYAEIVGFGMSSDAYHMTSPPENGAGAALAMVNALRDAAIEPAQIGYVNAHGTSTPAGDKAETQAVKSVFGDAASRVMVSSTKSMTGHLLGAAGAVESIFSILALRDQAIPPTINLDNPDEGCDLDFVPHEARQVSDLEYALCNSFGFGGTNGSLIFKKI

SEQ ID NO: 19774 - DNA, 1263 bp, Bacteroides thetaiotaomicron VPI-5482
  CDS (1)..(1263): transl_table=11
atggaattaaaaagagtggtagtaacaggccttggcgccattactcctgttggcaatgatgtacccgaattctgggaaaatctagtgaacggggttagtggagcagggcctattactcattttgatgcgtcgcaattcaagacccagtttgcatgcgaagtgaaaaacttcgatgtaactaaatatatcgaccgtaaagaggcaagaaagatggacttatacactcagtatgctgtcgctgttgccaaagaagcggtatcggactccggtcttgacgtcgaaaaagaagatttgaacagaatcggtgttatttttggcgccggtatcggtggtatacatacattcgaggaagaagtaggcaactactacactcatcaggaaataggtcccaagttcaatccgttcttcatcccgaagatgatctcggatattgctgccggacagatttctatcatgtatggcttccatggtcctaactacgcgacttgttcagcatgtgctacttctaccaatgccattgcggatgccttcaacctgattcgtctgggtaaagcaaacgtaatcgtatccggtggttcggaagcagccatcttccctgcaggcgtaggcggtttcaacgctatgcatgctctgtcaacacgcaacgatgagccgagcaaggcttcacgtccattcagcgcaagccgtgacggcttcatcatgggcgaaggtggcggttgcctgatcttggaagaactggaacacgctaaggcccgtggtgcgaaaatctatgcagaagttgccggtgtaggtatgtctgcagatgctcatcacctgacagcttcccatccggaaggtcttggtgccaaactggtaatgctgaacgctctggaagatgcagaaatggatccgaaagaagtagattacatcaacgttcacggaacatctactccggtaggtgatatttctgaagcgaaagcaattaaggaagtattcggtgatcacgcatacgaactgaacatcagttctacaaaatcaatgactggtcacttgctgggagctgccggtgcggtagaatctatcgcaagcatccttgccatcaagaacggcattgttcctccgactatcaaccacgaagaaggtgacaacgacgagaacattgactacgaccttaatttcacgttcaacaaagctcagaaacgtgaggttaatgttgccctgtccaatacatttggattcggtggtcacaatgcgtgcgttatcttcaagaaatacgctgagtaa

SEQ ID NO: 19775 - protein, 420 aa, Bacteroides thetaiotaomicron VPI-5482
MELKRVVVTGLGAITPVGNDVPEFWENLVNGVSGAGPITHFDASQFKTQFACEVKNFDVTKYIDRKEARKMDLYTQYAVAVAKEAVSDSGLDVEKEDLNRIGVIFGAGIGGIHTFEEEVGNYYTHQEIGPKFNPFFIPKMISDIAAGQISIMYGFHGPNYATCSACATSTNAIADAFNLIRLGKANVIVSGGSEAAIFPAGVGGFNAMHALSTRNDEPSKASRPFSASRDGFIMGEGGGCLILEELEHAKARGAKIYAEVAGVGMSADAHHLTASHPEGLGAKLVMLNALEDAEMDPKEVDYINVHGTSTPVGDISEAKAIKEVFGDHAYELNISSTKSMTGHLLGAAGAVESIASILAIKNGIVPPTINHEEGDNDENIDYDLNFTFNKAQKREVNVALSNTFGFGGHNACVIFKKYAE

SEQ ID NO: 19776 - DNA, 1239 bp, Enterococcus faecalis V583
  CDS (1)..(1239): transl_table=11
atgaaaagagtggtcataaccggcatgggtgccgtaacaccattaggcaataccgtaaaagaattttggcataatctagtggatggcaagctaggaattggcaaaattactaaatttgattctgaagatactggggtggctttggctggtgaagtgaaagagtttgacccaagtgctgttttagaacgcaaagagcaaaaaagaatggacttattttctcaatatggcttggtcgctgctttagaagcgtgggaaatgagtggtttaacagaagcaacgattgacccgactcgtttaggtgtgattgtcggtagtgggattggcgggatgactaccttacaagaccaagtacgggtaatggataaaaaaggcgcaaaacgcgtaacaccatttttcgtgcccatggtaattgctaatatggcagcgggaaatatttcgattcgtctaggtgcaaaaggaccttctcaaactatcgtgactgcttgtgcttctgcgacgaatgcgattggtgaagcttttcgcacgattaaatatggtttagcggacatgatggtaactggggggacagaagccacagtatgtgaaattgggattgcaggctttgcagcattgaatgctttaaatacaacagaagatgcgactcgggcttcgattccttttgataaagaacgaaaaggttttgtgatgggtgaaggcgcaggaatgctggttttagaagaactcgagcatgcacagaaacgtggcgcaactatctacggcgaaattgttggatatggcagcaactgtgatgctagccacatgaccgctcctttaaaagacggtagtggcgcggcagctgcgatggaaatggcgattgcagaagcagggattacaccggaacaaattgggtatatcaatgctcatggtacgtcaaccccagcgaatgacgctgcggaaacaacggccatcaaacgtgtctttggtgagcgagcatcgcaaattccaatttcaagtacaaagagtatgactggacatttattgggcgcggctggcggtatcgaagcgatcgcttgtgtgcaaacattgcaagaaggaaaagctcatccgacagtaggctaccaagttgctgatccagattgtgatttagattatgtcacagaaggtgcacgtgacattacagcggactatacaattagtaattcgtttggctttggtggccataatggtgtaatttgcttgaagaaatgggaggaaaactag

SEQ ID NO: 19777 - protein, 412 aa, Enterococcus faecalis V583
MKRVVITGMGAVTPLGNTVKEFWHNLVDGKLGIGKITKFDSEDTGVALAGEVKEFDPSAVLERKEQKRMDLFSQYGLVAALEAWEMSGLTEATIDPTRLGVIVGSGIGGMTTLQDQVRVMDKKGAKRVTPFFVPMVIANMAAGNISIRLGAKGPSQTIVTACASATNAIGEAFRTIKYGLADMMVTGGTEATVCEIGIAGFAALNALNTTEDATRASIPFDKERKGFVMGEGAGMLVLEELEHAQKRGATIYGEIVGYGSNCDASHMTAPLKDGSGAAAAMEMAIAEAGITPEQIGYINAHGTSTPANDAAETTAIKRVFGERASQIPISSTKSMTGHLLGAAGGIEAIACVQTLQEGKAHPTVGYQVADPDCDLDYVTEGARDITADYTISNSFGFGGHNGVICLKKWEEN

SEQ ID NO: 19778 - DNA, 1236 bp, Enterococcus faecalis V583
  CDS (1)..(1236): transl_table=11
atgaatcgagtagttattaccggttacggtgtcacctcgccgattggcaatgaacctgagacttttttagaaagtttgaaaacagggaaaaatggtatcggaccgattagtaaatttgatgttagtgaaacaggtgtcaccttagcagctgaagtgaaagactttccaatggaaaaatattttgttaaaaaagatggcaaacgcatggataagttttcgttatttggcatttatgcggccttagaagcaatggctatgagtggcttggataccagtcaactagatgtggatcggtttggcgttatggtgggttccggaattggtggtttggaaacaattcaaaatcaagtaattcggatgcacgacaaaggacctgaacgtgtggcaccgttatttattccaatggcgattggaaacatggtggcgggaaatattgctttacgtgttggtgccaaaggaatttgtacttcaacagtgacagcttgtgctagtgcaactcattcaattggggaagcgttccgcaatatcaaacatggctactccgatgtcattattgctggtggagcagaagcgcctattacagaaatcggtatttcaggatttgcttccttgaccgctttaacaaaggcgactgatccagaaaaagcctcaattccctttgataaagaacgtagtggatttgtgatgggagaaggagcgggtgtctttattttagaatcattagatcatgctctagaacgaggcgcaactattttaggtgaagtggttggctatggtgctaattgcgatgcctatcatatgacatcaccaacaccagatgggagcggcgcagcgaaagccatggtactagcaatggaagaagcggggatttctccagaaaaaattggctatattaacgcccatggaacaagcacacaagccaatgacagtgcagaatctaaagcaattgaattggctttaggtgatgccgcaaaaacggcgtatgtaagtagtacaaagagtatgacgggacatctcttaggcgccgctggtggaattgaaggaattgctaccctaaatgctttacaacatcaatttattccgccaaccattaatgtggaaaatcaagatgaagcaattacggtgaacgttgttttaaacgaaagcaaagagcataaatttgattatgctttaagtaactcgctaggctttggtggccacaatgcagttatttgcttaaaacgctgggaggattaa

SEQ ID NO: 19779 - protein, 411 aa, Enterococcus faecalis V583
MNRVVITGYGVTSPIGNEPETFLESLKTGKNGIGPISKFDVSETGVTLAAEVKDFPMEKYFVKKDGKRMDKFSLFGIYAALEAMAMSGLDTSQLDVDRFGVMVGSGIGGLETIQNQVIRMHDKGPERVAPLFIPMAIGNMVAGNIALRVGAKGICTSTVTACASATHSIGEAFRNIKHGYSDVIIAGGAEAPITEIGISGFASLTALTKATDPEKASIPFDKERSGFVMGEGAGVFILESLDHALERGATILGEVVGYGANCDAYHMTSPTPDGSGAAKAMVLAMEEAGISPEKIGYINAHGTSTQANDSAESKAIELALGDAAKTAYVSSTKSMTGHLLGAAGGIEGIATLNALQHQFIPPTINVENQDEAITVNVVLNESKEHKFDYALSNSLGFGGHNAVICLKRWED

SEQ ID NO: 19780 - DNA, 1245 bp, Coxiella burnetii RSA 493
  CDS (1)..(1245): transl_table=11
ttggagaaacggcgcgttgtaataaccgggttgggggttgtgagccccctcggaaataaagtttcggatatgtggcaggcgctcttggcgggtaaaagtggagtgaagccgattactcgattcgatgcgtcctcttttcctacccaaattgcggccgaagtcagggattttgacccggccttagtattagatcttaaaagcattcgtaaaacggacgtttttgtgcaattcgccatggaatctgcccgtcaggcgtgggaggattcaggactagaaatcaacgaaactaacgcgcctcgcgtgggggtggctattgggtccggcatcggagggatgccttggattgaaaaaaattatgacgcgttattaacttccggtccgcgaaaaatttctcccttttttattccgggggctattattaatatggcttctggtatggtgtctattaaatacgatttaaagggtcctaatatctcaatcgtgaccgcctgtacgacgggtcttcataacatcggccacgcagcgagaatgattgcccacaatgatgcagatgcgatgattgcagggggaacggagatggcatccactcccctcggtattggcggctttgctgctgtgcgcgctttatcgacacgaaatgatgagcccgaaaaagcgagccgtccgtgggataaaggtcgcgatggttttgtgttgggggaaggcgccgcgtgtgtagtagtagaagagttagaacacgccaaaaagcgcaacgcgaccatctacgccgaaattatcggatttgggatgagtggtgatgcttatcacatgacacgcccagaccccgaagctgaaggatttaccacttgcatgaaaaattccctccgggatgccggcatcgctcctgagcgggtcgactacataaacgcccacggtacctcgacgcctgccgccgatccgcttgaggcgcgggccattaaaaaaacatttggggatcatgcttataaactagccgtaagctccacaaaatcaatgacaggacacatgctaggggcagcaggtgccttagaaaccgtaatttcagtgttagcgattcgcgataatacggcaccaccgacgattaatcttgaaaatcccgatgaaggctgtgatttagattttgtacccaatgaggcgcgggagatgaagatcgataccgtaatgtcaaattcatttggctttggtggcactaacggaaccttggttttaagccgagtttttgactaa

SEQ ID NO: 19781 - protein, 414 aa, Coxiella burnetii RSA 493
MEKRRVVITGLGVVSPLGNKVSDMWQALLAGKSGVKPITRFDASSFPTQIAAEVRDFDPALVLDLKSIRKTDVFVQFAMESARQAWEDSGLEINETNAPRVGVAIGSGIGGMPWIEKNYDALLTSGPRKISPFFIPGAIINMASGMVSIKYDLKGPNISIVTACTTGLHNIGHAARMIAHNDADAMIAGGTEMASTPLGIGGFAAVRALSTRNDEPEKASRPWDKGRDGFVLGEGAACVVVEELEHAKKRNATIYAEIIGFGMSGDAYHMTRPDPEAEGFTTCMKNSLRDAGIAPERVDYINAHGTSTPAADPLEARAIKKTFGDHAYKLAVSSTKSMTGHMLGAAGALETVISVLAIRDNTAPPTINLENPDEGCDLDFVPNEAREMKIDTVMSNSFGFGGTNGTLVLSRVFD

SEQ ID NO: 19782 - DNA, 1221 bp, Streptomyces avermitilis MA-4680
  CDS (1)..(1221): transl_table=11
atggccggcatggacatcgccgtcaccgggctcggcctggtcaccccgggcggtatcggggtcgggcccagctgggcggcggtctgcgacggcaggccggccgccgccctcgatccggtgctggcggacaatcccgtacgtatctcctgccgggtgcccgacttcgacccggagcaactgctcagcgcacgacgggcgcaccgcctggacaggttcgtgcagttcgctctggtcgccgcccatgaggcggtggccgacgccggtctcgacccgaccacctgggacggggctcgggtcggtgtggtgctgggctgcgcggacggcggtcccggcacggtcgaggagcagcaccgggtgctgctggagcagggcgccgaccgggtgtccccgctgctgctgcccatgcagctgccgaacatgctggccggtcagacggccatcgagttcggggcgaccgggcccaacctggtggtggccacggcctgcgcttcgggcgcgaccgccatcggcacggcccgggacctgctcgcgctcggccgctgcgacgtggtcctggcgggcggcagcgaggcgatgatcactccgctggtcatggccggcttcgcccagatgggcgcgctgtcgcggcgcgaggacgacccggcgtcggcgtcgcgtcccttcgacgccgaccgggacggcttcgtcgccggtgagggcgccgggatcctcgtcatggaacgtgtcgaggacgcccgggcccgcggtgcgcacatccacggccggatcatcggctacggggccaccgcggacgcccaccacatgacgtcgccgcacccggacggcgccggcatcgaggcggcggtccgcgcggctctcgccgacgccggcgcggacccggacgacgtgcagcacgtgaacgcccacggcacgtcgacgccgctcaacgatctggccgaggcacgcatgatccagcggaccctgcagggcgacccgctggtcacctcgacgaagggagtcaccggacatctgctcggcgcggccggcgcggtcgaggccgcgttcgccctgctgagcatcgagcacgagatggttccgccgatcgcgggcctgtgcatccccgatccccggatcgacatcaagctcgcccagtcggccacgtcgatgccgatcgacctcgcgctcagcaattcgtgcgggttcggcggccagaacacggcgcttgcgatcgctccggcctga

SEQ ID NO: 19783 - protein, 406 aa, Streptomyces avermitilis MA-4680
MAGMDIAVTGLGLVTPGGIGVGPSWAAVCDGRPAAALDPVLADNPVRISCRVPDFDPEQLLSARRAHRLDRFVQFALVAAHEAVADAGLDPTTWDGARVGVVLGCADGGPGTVEEQHRVLLEQGADRVSPLLLPMQLPNMLAGQTAIEFGATGPNLVVATACASGATAIGTARDLLALGRCDVVLAGGSEAMITPLVMAGFAQMGALSRREDDPASASRPFDADRDGFVAGEGAGILVMERVEDARARGAHIHGRIIGYGATADAHHMTSPHPDGAGIEAAVRAALADAGADPDDVQHVNAHGTSTPLNDLAEARMIQRTLQGDPLVTSTKGVTGHLLGAAGAVEAAFALLSIEHEMVPPIAGLCIPDPRIDIKLAQSATSMPIDLALSNSCGFGGQNTALAIAPA

SEQ ID NO: 19784 - DNA, 1251 bp, Streptomyces avermitilis MA-4680
  CDS (1)..(1251): transl_table=11
atggcgccgcgtcgggtcgtcgtcaccgggctcggtgccgtcaccccgctcggggtcggtgtgggtgagctctggcgggggctcctcgaaggggagtgcggcatacgggagttggacggggaggagttcgaggggctgcccgtgcgggtggccgggaccgtgcccgtggaccccgccacgctgctgccccggccgcaggcgcggcggatgaaccgggccgcccagttcgccgtgctcgccgcgcgggaggcctggcgggacgccgggttcgacggggccgggacggcggagagcgggctcgaccccgcgcgggtcggcgtgtccgtcggggccatcctcggggacgcgtccgtcctcgtcggaggcgaccgcaagctgcgcgccaaggggccgcgctcggtgtcgcccctcaccacccccatgacggtgccctcgcaggccgcctcgcaggtctctctcgcgttgcgcatcaccggcgaggcccgcaccgtgaccagcgcgtgcgcctccggcaccgaggcgatcgggctggccatcgaccggatccggtacggacatgtggacatcgcgctggccgggggcgccgaggccgtcgtcacgcccgcgatcatggcgtcgttcgccgcgatgcgggcgctgtcgcaccacggtctgacggagggctcgccctcccggcccttcgccaaggaccgcgacgggttcgtcaacggggagggtgccgggtttttgctgctggagacggaggagcacgcgcgggcgcgcggggcgcggatctactgcgaggccgccggctgggggctgtccgccgacgcccaccacatggccgcgcccgacccgtccggcagcggcgtcgcgctcgcgctgcggcgcgcgctgaaggacgccgggggtcatgtcgtggacgtcgtgcacgtcaacgcgcatgccacggccaccgtcgagggcgatctcgccgaggcgaacgcgttgcgggcggtgctcggcgggccggtgccggtcacggccctgaaggggcacctcggtcatctccagggcgccgcgggcggggtggaggccgtcgcgacggccctcacgctgcaccacggtctcatcccgcccacgatcggctgcgcgatccaggacgacgagatcggcctggacgtcgtgacccacagcgcgcgcccgctgccggccggcggagacctggccctcagcaactcgttcggcttcggcggccacaacgcggtgctggcgctgcggcgagtggggtag

SEQ ID NO: 19785 - protein, 416 aa, Streptomyces avermitilis MA-4680
MAPRRVVVTGLGAVTPLGVGVGELWRGLLEGECGIRELDGEEFEGLPVRVAGTVPVDPATLLPRPQARRMNRAAQFAVLAAREAWRDAGFDGAGTAESGLDPARVGVSVGAILGDASVLVGGDRKLRAKGPRSVSPLTTPMTVPSQAASQVSLALRITGEARTVTSACASGTEAIGLAIDRIRYGHVDIALAGGAEAVVTPAIMASFAAMRALSHHGLTEGSPSRPFAKDRDGFVNGEGAGFLLLETEEHARARGARIYCEAAGWGLSADAHHMAAPDPSGSGVALALRRALKDAGGHVVDVVHVNAHATATVEGDLAEANALRAVLGGPVPVTALKGHLGHLQGAAGGVEAVATALTLHHGLIPPTIGCAIQDDEIGLDVVTHSARPLPAGGDLALSNSFGFGGHNAVLALRRVG

SEQ ID NO: 19786 - DNA, 1272 bp, Streptomyces avermitilis MA-4680
  CDS (1)..(1272): transl_table=11
gtgagcccgaccaatcgcaccgtggtcgtcaccggtatcggcgcaaccacaccgctgggtggcgacgtagcctctacctgggagggcctggtcgccggacgttccggtgtccgtcccctggagcaggagtgggccgccgagcaggcggtccgcatcgcagcacagatcgccgtggagcccggcgaggtcattccccgtccgcaggcccgccgcctcgaccgctcggcgcagttcgcgctgatcgcggccaaggaggcctgggcggatgccggtttcaccgacaaggcgggcgccgacccggccgtcgacccggaccgcctcggcaccgtgatcgcctccggcatcggtggtgtgacgactctgctcgaccagtacgacgtgctgaaggagaagggcgtacgccgtgtctccccgcacaccgtgccgatgctgatgccgaacggcccgtccgccaacgtgggcctcgccgtgggcgcccgcgccggtgtgcacaccccggtctccgcctgcgcgtcgggcgccgaggccatcggctacgcgatcgagatgatccgcaccgggcgcgccgacgtcgtcgtcgccggtggtacggaggcggcgatccacccgctgcccatcgccgcgttcggcaacatgatggcgatgtccaagaacaacgacgacccgcagggcgcctcgcgtccctacgacgtcgcccgggacggcttcgtcctcggcgagggcgccggcgtcatcgtgctggagtcggccgagcacgccgcgaagcgcggtgcccgcgtgtacgcggaggcggtcggccagggcatctccgccgacagccacgacatcgtgcagccggagcccgagggccggggcatctcgcacgccctgcagaacctgctcgacagcaccgacctgaaccccgccgagatcgtgcacgtcaacgcgcacgccacctcgacgccggccggtgacgtcgccgaactgaaggcgctgcgcaaggtgttcggcgacgacgccgaccacttcgcggtctccgccaccaagtcgatgaccggtcacctcctcggcggcgccggcggtgtcgagtcggtcgcctcggtgctcgccctgtaccaccgggtggcgccgccgaccatcaacgtcgacaacctcgaccccgaggccgaggccaacgccgacatcgtccgcggcgaggcgcgcaagctccccgtcgagggccgcatcgccgcgctgaacgactcgttcggcttcggcgggcacaacgtggtgctggcgttccggacggtctga

SEQ ID NO: 19787 - protein, 423 aa, Streptomyces avermitilis MA-4680
MSPTNRTVVVTGIGATTPLGGDVASTWEGLVAGRSGVRPLEQEWAAEQAVRIAAQIAVEPGEVIPRPQARRLDRSAQFALIAAKEAWADAGFTDKAGADPAVDPDRLGTVIASGIGGVTTLLDQYDVLKEKGVRRVSPHTVPMLMPNGPSANVGLAVGARAGVHTPVSACASGAEAIGYAIEMIRTGRADVVVAGGTEAAIHPLPIAAFGNMMAMSKNNDDPQGASRPYDVARDGFVLGEGAGVIVLESAEHAAKRGARVYAEAVGQGISADSHDIVQPEPEGRGISHALQNLLDSTDLNPAEIVHVNAHATSTPAGDVAELKALRKVFGDDADHFAVSATKSMTGHLLGGAGGVESVASVLALYHRVAPPTINVDNLDPEAEANADIVRGEARKLPVEGRIAALNDSFGFGGHNVVLAFRTV

SEQ ID NO: 19788 - DNA, 1251 bp, Chlamydophila caviae GPIC
  CDS (1)..(1251): transl_table=11
atgaataaaaaacgtgtagtagtcacgggattgggcgttgtttcttgtttgggcaatgaaatagacaccttttatgataacctgcttgctggtatcagtggcgttcgtacaatcacttcttttccatgcgaagattatgctacccgttttgctgcttggattcctgaatttaatcccgagccttatttagataaaaaacaagcacgtagagttgatccttttattacttacgcagtagttgcagctaaaaaagctattgcgatgtctcgatgggataaagacaatcttcctgctgatcctctccgttgcggtgttatcatcggctctggtatgggaggtctacagactttagatgaaggtatggaacgtcttattttaggcaataagaagctttctcctttctttatcccttatattattactaatatggctcctgcgcttattgctatggactttggacttatgggtccaaattattcgatctccacagcttgcgcaacttcgaattattgtattgatgcagcttaccagcatcttgtttccggacgttctgacatgatagtttgtggtggaactgaggctgcagtgaaccgtgtcggattgaccggttttattgctaaccgtgctttatcggagaggaatgacgctcctcaagaagcgtctcgtccttgggatagagatagagatggttttgttattggagagggagctggagttttagttttagaaactttagagaacgctttgaagcgaggagctccgatatatgcggagatacttggttcatataccacctgtgatgctttccatattacagctcctagagatgatggagagggcattacttcatgtattcttggagctctagagagttctggcattcctaaagaacgcgtaaattatattaatgctcatgggacatcaactcctctaggagacatatcggaagttttggcattgaaaaaagcttttggtagtcatgtgaaaaatttacgaatgaattccacaaagtctcttataggtcattgcctgggagcggctgggggagtcgaagctgttgcaacaattcaagcaattcaaacgggcaaattacatcctacgattaatttagagaacccgattgcagaaattgatgattttgacgtggttgcaaataaggcccaagattgggatattgacgttgctatgtcgaattcttttggttttggtggacataattcaacgatattattctcgaggtatataccctaa

SEQ ID NO: 19789 - protein, 416 aa, Chlamydophila caviae GPIC
MNKKRVVVTGLGVVSCLGNEIDTFYDNLLAGISGVRTITSFPCEDYATRFAAWIPEFNPEPYLDKKQARRVDPFITYAVVAAKKAIAMSRWDKDNLPADPLRCGVIIGSGMGGLQTLDEGMERLILGNKKLSPFFIPYIITNMAPALIAMDFGLMGPNYSISTACATSNYCIDAAYQHLVSGRSDMIVCGGTEAAVNRVGLTGFIANRALSERNDAPQEASRPWDRDRDGFVIGEGAGVLVLETLENALKRGAPIYAEILGSYTTCDAFHITAPRDDGEGITSCILGALESSGIPKERVNYINAHGTSTPLGDISEVLALKKAFGSHVKNLRMNSTKSLIGHCLGAAGGVEAVATIQAIQTGKLHPTINLENPIAEIDDFDVVANKAQDWDIDVAMSNSFGFGGHNSTILFSRYIP

SEQ ID NO: 19790 - DNA, 1239 bp, Bacillus cereus ATCC 14579
  CDS (1)..(1239): transl_table=11
atggaaaaaaagagggtcgtaattacaggactaggagctgttacaccggtcggaacagatgttgaaacagcgtgggaaaacattaaaaagggtgtatctggaatcgggcgacttacaagaattgatccagaactatttccagcaaaagtagcagcggaaattaacgactttgaagtcgagaaatatattgataaaaaagaagcgcgccgtatggatcgctttacacaatatgcagtggcagcagcgaaaatggcagttgcagatgcaaaacttgaaattacagaagaaaacggacctcgaattggtgtatggattggatctggtattggcggtatggaaacatacgaagaacaatttaagatttttactgagaaaggcccacgccgcgtgagcccattcttcgtgccgatgatgattccagatatggcagcaggtcaagtatcaatcgcaacaggagcaaaaggaattaacacttgttctgtaacggcttgtgcatctggtgcaaactcaattggtgatgcatttaaagcaattcagcgtggtgatgctgatgcaatgattacaggcggagcagaagcgccgctaacaagtatggcattcgcaggatttagctcagcgaaagcattaacatttaatgaagacccagcaacggcttgccgtccatttgataaaaaccgtagcggtttcgtaatgggtgaaggctcaggtattctaattcttgaagaattagagcacgcattagcacgcggtgctcacatttacgcggaaattgcgggttatggtgcaactggagatgcattccatattacaatgcctgctcctggtggggaaggcggagtgcgtgcaatgcgtcaagctttagctgatgcaggcctacagccagaagatattgattacattaatgcgcacggtacaagtactgatgcgaatgaaaaatatgaaacgatggcaattaaagaaactttcggtgagcacgcgtataaagtagcaattagctcaacgaaatcaatgacaggtcacttattaggagcagctggtgctgttgaagcgattttctctattaaatcaattacagacggagtaattcctccaacaattaactatgagacaccagatccagaatgtgacttagattacgtcccaaatcaagcgagacaccaagaagtaaatgcagtattaagtaactcattaggatttggtggtcataacgcagtgttagtatttaaatcgtataaataa

SEQ ID NO: 19791 - protein, 412 aa, Bacillus cereus ATCC 14579
MEKKRVVITGLGAVTPVGTDVETAWENIKKGVSGIGRLTRIDPELFPAKVAAEINDFEVEKYIDKKEARRMDRFTQYAVAAAKMAVADAKLEITEENGPRIGVWIGSGIGGMETYEEQFKIFTEKGPRRVSPFFVPMMIPDMAAGQVSIATGAKGINTCSVTACASGANSIGDAFKAIQRGDADAMITGGAEAPLTSMAFAGFSSAKALTFNEDPATACRPFDKNRSGFVMGEGSGILILEELEHALARGAHIYAEIAGYGATGDAFHITMPAPGGEGGVRAMRQALADAGLQPEDIDYINAHGTSTDANEKYETMAIKETFGEHAYKVAISSTKSMTGHLLGAAGAVEAIFSIKSITDGVIPPTINYETPDPECDLDYVPNQARHQEVNAVLSNSLGFGGHNAVLVFKSYK

SEQ ID NO: 19792 - DNA, 1242 bp, Nitrosomonas europaea ATCC 19718
  CDS (1)..(1242): transl_table=11
ttgtccaaacgtaaagtagccattaccgggttaggcataatttcacccgtcggcaatacggtttctgaagcatgggaaaacgtcattgccggaaaatccggtattacacgaatcacgcgcttcgatgcatcagacttttcctcgaaaattgcaggagaagtcaacggattcgacataacagagtacctctccgccaaagaagcgcgccgtatggatatatttatccagtacggaatggcggctgccatccaagctatcagagatgccggcatcagtgatgtaagcgggttcaacgcagatcgtattggtgtgaacatcggctccgggatcggcggcctgcccatgattgaaaataccgatgctgcctatcatgctggcggcccccggaaaatctcccccttcttcatccctagtaccatcatcaacatggtagccggtaatctgtctatcatgttcgggtacaaagggcccaatcttgccatcgttactgcctgtacaactgccacgcactgtataggcagttctgccagaatgatcgaatatggcgatgctgatatcatggtctgcgggggtacggaatcatgtgttacaccacttgctgtcggtggatttgcttcagcacgtgccttgtcatcgaacaatgatgacccggcggcagcaagtcgaccatgggatctcaaaagagatggattcgttctgggagaaggagcaggtattctcgttctggaagagatggagcatgccagaaaacgtggtgcaaagatttatgcggaactggccggattcggtatgagtgcagatgctcatcacatgactgcaccctgtgaagatggagaaggcgcagcccgttgcatgacaaatgcattgtctgatgcgcaaatgcacgctgatgagcttcattacatcaatgcacacggaacatcgactccattgggagatattgcagaaacgattgcagtcaagcgctgctttggtgaacatgcaaaagatctggcagtcagctccaccaaatcgatgaccgggcatttattgggtgctgcaggaggtgtagaggcaattttttctgctttggctgtttatcaccagattgcccctcccactatcaatctcgatgacccggatcctgcatgcgatctggattatgtgcccaacaatgccagagaaatgaaaattgatgcagctctgtcgaactcgttcgggtttggcggaactaatggcacactagtcttcagaaaaatctga

SEQ ID NO: 19793 - protein, 413 aa, Nitrosomonas europaea ATCC 19718
MSKRKVAITGLGIISPVGNTVSEAWENVIAGKSGITRITRFDASDFSSKIAGEVNGFDITEYLSAKEARRMDIFIQYGMAAAIQAIRDAGISDVSGFNADRIGVNIGSGIGGLPMIENTDAAYHAGGPRKISPFFIPSTIINMVAGNLSIMFGYKGPNLAIVTACTTATHCIGSSARMIEYGDADIMVCGGTESCVTPLAVGGFASARALSSNNDDPAAASRPWDLKRDGFVLGEGAGILVLEEMEHARKRGAKIYAELAGFGMSADAHHMTAPCEDGEGAARCMTNALSDAQMHADELHYINAHGTSTPLGDIAETIAVKRCFGEHAKDLAVSSTKSMTGHLLGAAGGVEAIFSALAVYHQIAPPTINLDDPDPACDLDYVPNNAREMKIDAALSNSFGFGGTNGTLVFRKI

SEQ ID NO: 19794 - DNA, 1626 bp, Arabidopsis thaliana
  CDS (1)..(1626)
atggtgggtgcgtcttcctcttacgcatctccgttatgtacctggtttgttgctgcttgcatgtccgtctctcacggtggaggagatagccgtcaggctgttgctcttcaatctggtgggcggagtcggcgaaggaggcagcttagcaaatgctctgtcgcttctggatccgctagcattcaggctctcgtcacttcttgtttggattttggtccttgtactcactacaacaacaacaatgcattgtcttctctctttggatcgaatagtgtttctttgaatcgaaaccagaggagattgaatcgtgctgctagctccggtggagccatggcagtgatggagatggaaaaggaagctgcggttaacaagaaaccacctacggagcagcgtcgagttgtagtgacaggcatgggagttgaaacatcattgggtcatgacccacataccttctatgagaatttgctacaaggcaacagtggtattagccagattgaaaattttgattgttctgaatttcctacgcgaattgcgggagagatcaaaagcttctcgactgaaggatgggttgctccaaaactttctaaaaggatggacaaattcatgctctatcttctcacagctggtaagaaagctttggctgatggtggggttactgatgaagtaatggcagagtttgacaaaaccaaatgtggagttttgattggctcggcaatgggaggaatgaaggtcttttacgatgctattgaagctctgagaatctcttacaagaagatgaatcctttttgtgtaccttttgcgacaacaaacatgggttctgctatgcttgccatggatctgggatggatggggccaaactattctatttcaactgcttgtgccacaagcaacttttgcattctgaattcagcaaaccacattattaaaggtgaagctgatgtaatgctctgtggtggctcagatgcagttattattccaatagggttgggaggttttgttgcatgccgggctctttcacaaaggaataatgatcccacaaaagcttcacgtccttgggataccaatcgagatggtttcgtgatgggagagggagctggagttctacttttggaagaactcgagcatgctaagaaaagaggtgcaactatctacgcagagttcctcggtgggagtttcacatgtgatgcctatcacatgaccgagcctcaccctgatggggctggtgttattctctgtattgagagagcgttagctagtgctgggatttccaaggaacaaataaattacataaatgcacatgcaacctcaacgcatgctggagatattaaggaataccaagcccttgctcactgttttggccaaaatcctgagcttaaggtaaattccacaaaatctatgattggacacttgctgggagctgctggggccgtggaggctgttgcaactgtgcaggcgatacggaccggatgggttcatccaaatatcaacctcgagaatccagacagtggagtggatacaaagctgctggtgggtcctaagaaggagagactggacattaaagcagccttgtcaaattcattcgggtttggtggtcataactccagcatcatttttgctccttacaagtga

SEQ ID NO: 19795 - protein, 541 aa, Arabidopsis thaliana
MVGASSSYASPLCTWFVAACMSVSHGGGDSRQAVALQSGGRSRRRRQLSKCSVASGSASIQALVTSCLDFGPCTHYNNNNALSSLFGSNSVSLNRNQRRLNRAASSGGAMAVMEMEKEAAVNKKPPTEQRRVVVTGMGVETSLGHDPHTFYENLLQGNSGISQIENFDCSEFPTRIAGEIKSFSTEGWVAPKLSKRMDKFMLYLLTAGKKALADGGVTDEVMAEFDKTKCGVLIGSAMGGMKVFYDAIEALRISYKKMNPFCVPFATTNMGSAMLAMDLGWMGPNYSISTACATSNFCILNSANHIIKGEADVMLCGGSDAVIIPIGLGGFVACRALSQRNNDPTKASRPWDTNRDGFVMGEGAGVLLLEELEHAKKRGATIYAEFLGGSFTCDAYHMTEPHPDGAGVILCIERALASAGISKEQINYINAHATSTHAGDIKEYQALAHCFGQNPELKVNSTKSMIGHLLGAAGAVEAVATVQAIRTGWVHPNINLENPDSGVDTKLLVGPKKERLDIKAALSNSFGFGGHNSSIIFAPYK

SEQ ID NO: 19796 - DNA, 1266 bp, Streptomyces rochei
  CDS (1)..(1266): transl_table=11
atgagacgggtcgtcatcaccgggatcggggtggtcgcgccgggcggcgtcggcaccgcggacttctgggcgctgctgaccgaggggcgtaccgccacccgccgtatcaccctcttcgacgcctcctcgttccgctcccggatcgccgccgaggccgacttcgaccccgccgggcacggtttcgctcccgacgaggcgcgccgcctggaccgcgtcgcgcagttcgccctggtcgcggcgcgggaggcggtcgccgacagcgggctcgtgctcgccgccgagggggagcgcaccggggtgagcctgggcaccgcggtcggatgcagcagcggcctcgacgagacctacgcacacgtcagcgagtcgggcaggccgctggctgctggatcccgcacggccgaggcccggctcggggactacctcgtgcccagctcggtcgccgccgaggtcgcccgcgacagcggcgcgctgggctcggtcgccgtcgtgtccacgggctgcacctcgggactcgacgcgctcggccacgcgaccgagctgatccgcgagggcagcgccgacatcatggtggcgggcggcgcggaagcccccatcacccccatcaccctcgcctcgttcgacgccatccgcgccacctcggcgcgcaacgacgagcccgagaccgcctcccgcccctacgaccgcacccgcgacgggttcgtgctcggcgagggcagcgcggtgctcgtcctggaggagcacgaccgggcggtacggcgcggcgcccgcatctacgcggaggtgagcgggttcgccacccgctccaacgcctatcacatgaccggactgcgcccggacggcggggagatggccgaggccatccgggtcgccctggacgaggcccgcctgaaccccgcggacgtccactacgtcaacgcccacggttcggggaccaagcagaacgaccggcacgagacggccgcgttcaaggcgagcctcgggcagcacgcccaccgggtgccggtcagctccgtcaagtcgatgatcgggcactcgctcggcgccatcggcgggctcgaaatcgccgccagcgcgctggccatcgcccatgacacggtgccgcccaccgccaacctgcacgaggccgacccggcctgcgacctcgactacacgccgctgaccgcacgcgagcagcgcaccgacacggtgctcagcgtcggcagcggcttcggcggcttccagagcgcgatggtgctcaccagccggcacacgggggcggccgcgtga

SEQ ID NO: 19797 - protein, 421 aa, Streptomyces rochei
MRRVVITGIGVVAPGGVGTADFWALLTEGRTATRRITLFDASSFRSRIAAEADFDPAGHGFAPDEARRLDRVAQFALVAAREAVADSGLVLAAEGERTGVSLGTAVGCSSGLDETYAHVSESGRPLAAGSRTAEARLGDYLVPSSVAAEVARDSGALGSVAVVSTGCTSGLDALGHATELIREGSADIMVAGGAEAPITPITLASFDAIRATSARNDEPETASRPYDRTRDGFVLGEGSAVLVLEEHDRAVRRGARIYAEVSGFATRSNAYHMTGLRPDGGEMAEAIRVALDEARLNPADVHYVNAHGSGTKQNDRHETAAFKASLGQHAHRVPVSSVKSMIGHSLGAIGGLEIAASALAIAHDTVPPTANLHEADPACDLDYTPLTAREQRTDTVLSVGSGFGGFQSAMVLTSRHTGAAA

SEQ ID NO: 19798 - DNA, 1236 bp, Helicobacter hepaticus ATCC 51449
  CDS (1)..(1236): transl_table=11
atgcgtcgagtagtggtaactggtttaggaatgattaactcattaggcttaaacaaaagtgactcttttaaagctatcattaatggacaatgtgggattaaaagaatttcttgctttgatgtagaaaattttcctgtcaaaattgctggtgaaattacagactttaatgttgaagaagttcttgacccacgcgaggtaaaaaaggctgaccgatttatccagcttggcttaaaagcagcaaaggaagcaatgagtgagtgcggattgcttgaaggtaatgtcgtaaatatgtcacttagtgagcggtttggtgttagctccggcgcaggtattggtgggcttggcaatattgagaagaactccgttgtttgtgagcaaaaaggaccacgcagaattaatccattttttattccttctgcgcttgtaaatatgctcggaggttttatctctattgaatacgcacttaagggtcctaatcttgcaagtgttacggcttgtgcggctggaactcacgctattagcgaagcagcaaagactattatgctcaatggcgcagatgctatgcttgtaattggttcagaatcttcaatttgccctgtgggaattggtggttttgcagcgatgaaagcactaagtgatagaaatgatgaacccttgaaagcttcgcgtccatttgataaagaacgtaatggatttgttatgggtgaaggtgctggagcactggtgcttgaggaatatgagagtgctaaaaaacgtggtgcaaaaatttatgcagaattgattggttttggtgagagcggtgatgctaatcatatcacaactcctgctccacaaggtgaaggagcattaagggctatcaaagctgcactcaaaatggcaaataaacctgtgggatatgtcaatgcacacggcacaagcacggcttataatgacctttatgagacaatggcacttaaagctgcttttggttctaaagaatctgtgccacctgtaagttctacaaaagggcaaattgggcattgtttaggtgcagctggtgctatagaagcagtcatttctattatggcaatgcaagagggtatcttgcctccaacaattaaccaagaaaacccagaccctgaatgtgatttggattatattcccaatactgcacgtgaggcaaaagttgatgttgtaatgagtaactcatttggctttggtggcacaaatggtgttgtaatatttagcaaaatctaa

SEQ ID NO: 19799 - protein, 411 aa, Helicobacter hepaticus ATCC 51449
MRRVVVTGLGMINSLGLNKSDSFKAIINGQCGIKRISCFDVENFPVKIAGEITDFNVEEVLDPREVKKADRFIQLGLKAAKEAMSECGLLEGNVVNMSLSERFGVSSGAGIGGLGNIEKNSVVCEQKGPRRINPFFIPSALVNMLGGFISIEYALKGPNLASVTACAAGTHAISEAAKTIMLNGADAMLVIGSESSICPVGIGGFAAMKALSDRNDEPLKASRPFDKERNGFVMGEGAGALVLEEYESAKKRGAKIYAELIGFGESGDANHITTPAPQGEGALRAIKAALKMANKPVGYVNAHGTSTAYNDLYETMALKAAFGSKESVPPVSSTKGQIGHCLGAAGAIEAVISIMAMQEGILPPTINQENPDPECDLDYIPNTAREAKVDVVMSNSFGFGGTNGVVIFSKI

SEQ ID NO: 19800 - DNA, 1290 bp, Rhodopirellula baltica SH 1
  CDS (1)..(1290): transl_table=11
atgacggacgcttcttcaacgccttcttacgatccttccatgtcacgacgtgtcgtgatcaccggcttgggtaccgtcacacctttgggctgcgacgtcgaaactctttggtcagccttgttggccggaaagtccgggatccatgagttgtccatcatggacacgtcgaaatacaaggttcactttggcggcgacattcctgacttcaatgttgcggatcatgtcgaacccaaagaagccaaacgtctggatcgtttcactcagttcgccgttcacgctggtgcacaagcggtccaggattccggcatcgactgggaaaaaaccgaccgaacacgctgtggtgtgatattgggttcgggcattggtggcctcaacgaaatcgaagaacaaatcgagcgaatgctcaacaagggccccgaccgagtcagcccgttcaccgtcccaaagatgatggtcaacgccgccgggggaaacatctccatccgctatggactcaaaggccccaactacgcggtcgcaaccgcatgtgccagtgcaaccaacgccatgggagacgctctacgcagtatccgtggtggcgaaaccgatgttgtgatcaccggcggaaccgaagccgcgatcactcgcatgggcttggctgctttccaaaacatgaaagccctttcgacccgcaatgacgaacctcaacgggccagccgtccgtttgattctgaccgcgatggttttgtcttggccgaaggcgcagggctgctcgtcttcgaagaactcgagcacgcgaaagctcgcggtgcaaagatctacgcggaagtcctcggctatggaacaaccagcgacgcgggccatatcaccgctcctgatccagaaggattgggtgccgccgctgccatgcgagccgcgattcaggacagtggccgcgcggcctctgaaattgattatattaacgctcacgggacgagcacacctttgggtgacaaagcagaaactcgcgcgatccacaccgttttaggtgaccatgcccaaaacgttgcgatcagcagtaccaaaagcgctctgggacactccttgggtgctagcggcgggattgaagcggtgattctttgccaaacgatccaaaacaatgtgattgccccgacaattaatctcgacacaccagatccaagttgcgatctcgactatgttcccaaccaaccccgggaacaaaaagttgacctggcaatgagcaatagcttcggatttggcggtcacaacgcatgcgttctctttggacggttctctcatgacggctcttga

SEQ ID NO: 19801 - protein, 429 aa, Rhodopirellula baltica SH 1
MTDASSTPSYDPSMSRRVVITGLGTVTPLGCDVETLWSALLAGKSGIHELSIMDTSKYKVHFGGDIPDFNVADHVEPKEAKRLDRFTQFAVHAGAQAVQDSGIDWEKTDRTRCGVILGSGIGGLNEIEEQIERMLNKGPDRVSPFTVPKMMVNAAGGNISIRYGLKGPNYAVATACASATNAMGDALRSIRGGETDVVITGGTEAAITRMGLAAFQNMKALSTRNDEPQRASRPFDSDRDGFVLAEGAGLLVFEELEHAKARGAKIYAEVLGYGTTSDAGHITAPDPEGLGAAAAMRAAIQDSGRAASEIDYINAHGTSTPLGDKAETRAIHTVLGDHAQNVAISSTKSALGHSLGASGGIEAVILCQTIQNNVIAPTINLDTPDPSCDLDYVPNQPREQKVDLAMSNSFGFGGHNACVLFGRFSHDGS

SEQ ID NO: 19802 - DNA, 1290 bp, Rhodopirellula baltica SH 1
  CDS (1)..(1290): transl_table=11
atgtcgtcgcgtcgccgagtcgtcgtcaccggaatcggtatgatcaacccaatgggttgggatgtcgccaccgtttggtctggcctgcaagaaagcggcagtggcgttgcgcccacgacgctgttcaacgccagcggtttccccacgcgaatcagtgcggaaatcaaaaactgggacatcaccaaagcggttgaagacggtgaaaaacacgtccaacgcggacgtcacacgcaatttgcgattgcggctgccactcaagcgatgaaggacagcggtgtcctgtcgtcgatcaaggatcccacgcgaatcggcgtttatttgggcagtggtgaaggcaaccaagacttcaacacgttcagcaaaatgatggttgcggcactggccgacggaacctacgacccaaccaagttcattgccgccggattgagcctgctcgatccagccaaagaactggaacaagaaccgaatatgcccgcggcgcacctcgccgcccgcttcaacgcacagggcccaaacttcaactgcctgaccgcatgtgcggccagcagccaagccgttggcgaagccaccgaaatcatccgtcgcggcgaagccgatgcgatgttggcgggcggaacgcacagcatgattcacccgtttggtgtgaccggattcaacttgctgacggcgttgagcgaaagcaacgacgatccgaccaaggccagtcgcccctttgacgcgggccgcaacggttttgtgctgggtgaaggctccgccatggtcgtgctggaagaactcgaatcagccaagaaacgtggtgcaacgatctacggggaagttgccggctacggcacaaccgccgacgcctatcgcatcaccgacatcccgccggacggtcacggcggcatcgggtccatgcgaatggcaatcgccgacgcgggactcaatccgtccgacatcggttacgtcaacgctcacggaaccagcaccaaagtcaacgaccgcgttgaaaccaaagcttgtcgcgaggtgtttggcgagcatgccgaacagactcccgttagcagcaccaagagcatgatgggccacctgatcgcggccgcgggtgtgaccgagatgatcgtgtgcctgatggcgattcgcgattcggttttgccgccgacgatcaaccaagagacaccggacccggactgcgatttggactacgtgcccaatgaagctcgcccagccgagatcaaacacgcactgaacaacagcttcggctttggtggccaaaacgtgacgctgtgcctgagccgcttcgacggctaa

SEQ ID NO: 19803 - protein, 429 aa, Rhodopirellula baltica SH 1
MSSRRRVVVTGIGMINPMGWDVATVWSGLQESGSGVAPTTLFNASGFPTRISAEIKNWDITKAVEDGEKHVQRGRHTQFAIAAATQAMKDSGVLSSIKDPTRIGVYLGSGEGNQDFNTFSKMMVAALADGTYDPTKFIAAGLSLLDPAKELEQEPNMPAAHLAARFNAQGPNFNCLTACAASSQAVGEATEIIRRGEADAMLAGGTHSMIHPFGVTGFNLLTALSESNDDPTKASRPFDAGRNGFVLGEGSAMVVLEELESAKKRGATIYGEVAGYGTTADAYRITDIPPDGHGGIGSMRMAIADAGLNPSDIGYVNAHGTSTKVNDRVETKACREVFGEHAEQTPVSSTKSMMGHLIAAAGVTEMIVCLMAIRDSVLPPTINQETPDPDCDLDYVPNEARPAEIKHALNNSFGFGGQNVTLCLSRFDG

SEQ ID NO: 19804 - DNA, 1248 bp, Prochlorococcus marinus subsp. marinus str. CCMP1375
  CDS (1)..(1248): transl_table=11
atgatggagaaactccatcgagttgtcattactggtctcggcgctattacgcctattggcaataccgtcgcagattatctctctggattgaaatctggccttaatggggtcggaccaatctccctatttgatgcatcccaacatgcctgtaggttcgctgcagaagtatcaaattttgaccctactgggttactagagccaaaagagtccaaaagatgggaccgtttctccaaatttggagttattgctgcaaaagaagcaattgcagactcaggcttaattattgatgatgccaatgcctcaagaataggtgtcatcattggttctggagtggggggcttactaacaatggaaactcaagctcaggttctaaataacaaagggcctggaagagttagtccatttacagtcccaatgatgattcccaatatggctacaggacttacggctattgctcttggtgcaaaaggccctagttcagcagtagcaacagcatgtgctgcaggatcaaacgctataggagattcttttaggctgctgcaattaggaaaagcagatgcaatgatttgtggaggagcagaagcaagtattactccccttggagtagcagggttctcaagtgccaaggctctctcatttcgcaatgatgatccatcttcagcaagcagaccatttgatgcagatcgagatggttttgttataggagaagggtcaggtgtcttaattcttgaaacttttgaccatgcaaaagaacgtaatgcccaaatttacgcagagttaattggttatggcactacatgtgatgctcatcacataactgccccatctcctggcggaataggaggagcagaagctattaaagaaaccattcaagatggaaaaatcaatattgaagaaattgattacattaatgcccatggaacaagcacagccgcaaatgacaaaaatgaaacttctgcgataaaaaacgcacttggagaaagggctagacaaatcccaattagttcaacaaaatcgatgacaggtcatcttcttggaggatctgggggcattgaagccgtagcatgtgtactttctattaaacacggggtaatcccaccaacaatcaattattccaaaccagatcctgactgtgatctggattatgtgcctaacactgctcgagaaagcaaattaaatgttgtgctttctaattcgtttggcttcggagggcataatgtgtgcctggctttccgaaaaatcaactaa

SEQ ID NO: 19805 - protein, 415 aa, Prochlorococcus marinus subsp. marinus str. CCMP1375
MMEKLHRVVITGLGAITPIGNTVADYLSGLKSGLNGVGPISLFDASQHACRFAAEVSNFDPTGLLEPKESKRWDRFSKFGVIAAKEAIADSGLIIDDANASRIGVIIGSGVGGLLTMETQAQVLNNKGPGRVSPFTVPMMIPNMATGLTAIALGAKGPSSAVATACAAGSNAIGDSFRLLQLGKADAMICGGAEASITPLGVAGFSSAKALSFRNDDPSSASRPFDADRDGFVIGEGSGVLILETFDHAKERNAQIYAELIGYGTTCDAHHITAPSPGGIGGAEAIKETIQDGKINIEEIDYINAHGTSTAANDKNETSAIKNALGERARQIPISSTKSMTGHLLGGSGGIEAVACVLSIKHGVIPPTINYSKPDPDCDLDYVPNTARESKLNVVLSNSFGFGGHNVCLAFRKIN

SEQ ID NO: 19806 - DNA, 1230 bp, Bordetella bronchiseptica RB50
  CDS (1)..(1230): transl_table=11
gtgaagcgacgagtcgtcatcaccggcctgggtatcgttagccccgtgggcaacgacattgccagcgcctgggacaatatcgtcaacggacgttccggcatcagccgcatctcccgtttcgaccctaccccgctgacgacgcacatcgccggcgaggtcaaggatttcgacgtcacccagtacatgcccgccaaagaagcccgccagatggataccttcatccattatggcctggccgccggcatgcaggcgtggcgcgattgcggccttgaggtcaccgaaaccaatgccgagcgcattggcgtgatcgtggggtcgggcatcggtggcctgccgcgcatcgaagaaacccagaccgagatgttggccaagggaccgcgccgcatttcgccgttcttcgtgcctgcgtcgttgatcaatctcatttccggccagctctccatcgcctatggcatgaagggcccgagctacgcggtcgtgtccgcgtgcaccaccggcctgcattgcatcggcgatgccgcgcgcctgatcgaatacggcgatgccgatgtcatgcttgccggtggggccgaatcgaccgtctcgccgctgggcatcggcggctttgccgcgatgcgcgcgctgtcgacgcgcaacgacgatccgaccaccgcctcgcgtccctgggaccgcgaccgcgatggtttcgtgctgggcgaaggcgccggcgtgctggtgctcgaagagtacgagcatgccaagaagcgcggcgcgcgcatctacggcgaactggccggctacggcatgagctccgacgcgcaccatatcaccgcccccgacaaggacggcccgcgccgcggcattctcaatgcgctgcgcaacggcggcatcaatgccgacgaggtttcctatgtcaatgcgcacggcacgtccacgccgctgggcgacaagaacgaaaccgacgcgttgaaactggctttcggcgaccatgcctccaagctggtggtgaattcgaccaaatccatgaccgggcacctgctgggcgccgctggcgggatcgaagccgtattcacgaccctggccgtccataatcagatttcgccgccgaccatcaacatcttcaaccaggatccggagtgcgacctggattactgcgccaacgaggcgcggcccatgaagatcgagatcggcctgtcgaattcgttcgggtttggcggcaccaacggttcgatggccgttcgtcgggtctga

SEQ ID NO: 19807 - protein, 409 aa, Bordetella bronchiseptica RB50
MKRRVVITGLGIVSPVGNDIASAWDNIVNGRSGISRISRFDPTPLTTHIAGEVKDFDVTQYMPAKEARQMDTFIHYGLAAGMQAWRDCGLEVTETNAERIGVIVGSGIGGLPRIEETQTEMLAKGPRRISPFFVPASLINLISGQLSIAYGMKGPSYAVVSACTTGLHCIGDAARLIEYGDADVMLAGGAESTVSPLGIGGFAAMRALSTRNDDPTTASRPWDRDRDGFVLGEGAGVLVLEEYEHAKKRGARIYGELAGYGMSSDAHHITAPDKDGPRRGILNALRNGGINADEVSYVNAHGTSTPLGDKNETDALKLAFGDHASKLVVNSTKSMTGHLLGAAGGIEAVFTTLAVHNQISPPTINIFNQDPECDLDYCANEARPMKIEIGLSNSFGFGGTNGSMAVRRV

SEQ ID NO: 19808 - DNA, 1245 bp, Prochlorococcus marinus subsp. pastoris str. CCMP1986
  CDS (1)..(1245): transl_table=11
atgccaaatttccatcgagtagttattaccggtataggggcagtaaccccaattggtaacaacattgatgaatatttactcggcctacaaaaggggtcaaatggagtttcagatattactctctttaatcctgaacaacatccctgcaagtttgcagcagaagttaaaaatcttcaatccgaaaattttattgaacctaaagaatctaaaagatgggatcgattttcacaatttggagtaatagctgcaaagcaagctttcaatgattctggacttgaaataactgaagacaatgaatcaagaattggagtaataattggctctggtgttggaggcttacttacaatggaaagtcaagctcaaatattgagtcataaaggcccaaaaagagtaagcccctttacagttccaatgatgatacccaacatggcgacagggcttgctgctattgcgttaggagcaaaaggtccaagctctgctgtatctaccgcctgtgctgctggatcaaatgctattggagactcttttagattgttacagctggggaaagcagatgcgatgatttgcggaggggcagaggcaagtataactcctcttggagtagcaggttttgcaagcgctaaagcactctcttttagaaatgacagtcctcaaactgcaagtagaccttttgatgctgagagggatggatttgtgattggagaaggatctgggattcttgttctagaaacttttgaaagtgcaaaaaaaagaggcgcaaaaatttatgctgaaattattggttatgggtcaacttgtgatgctcatcacattacttcgccttctccagggggaactggaggggcagaagcaatcaagctagccattgatgatagttcaattaaccttgatcaggttgattacataaatgctcatggaactagcactacagcaaatgacaaaaatgaaacttctgcaattaaatccatatttaaagacagatcttacctcattcctgtaagctctactaagtcgatgactggtcatctcttagggggttcaggaggtatagaagctgtagcttgtattctttctttgacacataattttgtccctcctacaataaactacgtcaatcctgatccagactgcgatcttgattatgtaccaaataatgctagagatgctcaaataagagttgctctttctaattcattcggctttggtggtcacaacgtttgtctagcatttagcaaacttgattga

SEQ ID NO: 19809 - protein, 414 aa, Prochlorococcus marinus subsp. pastoris str. CCMP1986
MPNFHRVVITGIGAVTPIGNNIDEYLLGLQKGSNGVSDITLFNPEQHPCKFAAEVKNLQSENFIEPKESKRWDRFSQFGVIAAKQAFNDSGLEITEDNESRIGVIIGSGVGGLLTMESQAQILSHKGPKRVSPFTVPMMIPNMATGLAAIALGAKGPSSAVSTACAAGSNAIGDSFRLLQLGKADAMICGGAEASITPLGVAGFASAKALSFRNDSPQTASRPFDAERDGFVIGEGSGILVLETFESAKKRGAKIYAEIIGYGSTCDAHHITSPSPGGTGGAEAIKLAIDDSSINLDQVDYINAHGTSTTANDKNETSAIKSIFKDRSYLIPVSSTKSMTGHLLGGSGGIEAVACILSLTHNFVPPTINYVNPDPDCDLDYVPNNARDAQIRVALSNSFGFGGHNVCLAFSKLD

SEQ ID NO: 19810 - DNA, 1248 bp, Prochlorococcus marinus str. MIT 9313
  CDS (1)..(1248): transl_table=11
atgatggaggatctccatcgggttgtgatcaccggtctcggagcggtcacaccgattggcaacacggtcgcggactatttagaagggttgaagacagccaacaatggcgtaggcgccataagcctgtttgacgcgtcagcccatgcatgtcgctttgccgcagaggtcaaagactttgacccaaccggtttcctcgaagcgaaggaatcaaaaagatgggatcgattcagcaaattcggtgttgtagcagccaagcaggcagttgctgatgccgggctaagcatcgaagaggaaaattcctcccgcatcggggtgattattggttcaggtgtcggtggtctgctcaccatggagacccaagcccacgttttgaatgagaaaggtcccggtcgggtcagcccattcacagtgccgatgatgatccccaacatggctactgggcttgccgccattgcgttgggggccaaaggacccagctcagcagtggccacagcctgtgcagctggatccaatgccatcggcgatgccttccggctgctgcaactcggcaaagcggatgtcatggtgtgtggtggtgcagaagcaagcatcacaccactaggtgtggctggcttcgccagtgccaaggccctctccttccgcaatgacgaccccaccacggctagccgtccgttcgatgcagaacgagatggattcgtcatcggtgaaggctctggcgtcctggtccttgaaacccttgagcacgccaaaaatcgcgatgccacgatccatgctgagattgtgggctatggcatgacctgcgatgcccaccacatcactgccccaacccctggcggcgttggtggtgcagaagcaatccgcctggccctaaaagacggaaagctggagcccaccagcgtggattacatcaatgcccatggcaccagtactcctgccaatgacagcaacgaaacagcagccatcaaaaatgctctcggcgaaagggcttctcagattcctgtgagctccacaaaatccatgacgggtcaccttcttggtggatcgggcggcattgaagctgtggcgtgcgtgcttgcccttcagcacgacatggtgcctcccacaattaattacctcaacccagatccacagtgtgatctcgactatgtccccaacatggccagagaacacagattaagcgtggtgctctccaattccttcggcttcggcggccacaacgtctgcctcgccttccgccaaatgccctaa

SEQ ID NO: 19811 - protein, 415 aa, Prochlorococcus marinus str. MIT 9313
MMEDLHRVVITGLGAVTPIGNTVADYLEGLKTANNGVGAISLFDASAHACRFAAEVKDFDPTGFLEAKESKRWDRFSKFGVVAAKQAVADAGLSIEEENSSRIGVIIGSGVGGLLTMETQAHVLNEKGPGRVSPFTVPMMIPNMATGLAAIALGAKGPSSAVATACAAGSNAIGDAFRLLQLGKADVMVCGGAEASITPLGVAGFASAKALSFRNDDPTTASRPFDAERDGFVIGEGSGVLVLETLEHAKNRDATIHAEIVGYGMTCDAHHITAPTPGGVGGAEAIRLALKDGKLEPTSVDYINAHGTSTPANDSNETAAIKNALGERASQIPVSSTKSMTGHLLGGSGGIEAVACVLALQHDMVPPTINYLNPDPQCDLDYVPNMAREHRLSVVLSNSFGFGGHNVCLAFRQMP

SEQ ID NO: 19812 - DNA, 1248 bp, Synechococcus sp. WH 8102
  CDS (1)..(1248): transl_table=11
atggtggacggtctccatcgcgtcgtcgttacgggcctcggcgcggtcacaccgatcggcaatacggttcaggactactggagcggcctgatctccggacgcaacggggttgatgccatcaccctgtttgatgcgtcagcccatgcctgtcgtttcgcagcggaagtcaaggacttcgaccctgctgggttgattgaaccgaaggaagccaaacgctgggatcgcttctgcaagttcggtgtcgtggccgccaaacaggccatcgctgatgccggtctcacgatttccgacgccaacgccgatcgcatcggcacgatgattggttccggcgtgggcggtctgctcaccatggagacccaggctcacgtgctggagggcaaaggaccgggacgggtgagtccgttcacggtgccgatgatgattcccaacatggcgacgggtcttgccgccattgccttaggcaccaaggggccgagctccgccgtggccaccgcttgtgccgccggctccaatgccatcggagatgccttccggctgctccagctgggcaaagccgacgccatggtgtgcggtggtgccgaatcggcaatcacccctttgggggttgccggcttcgccagcgccaaggccctgtcgttccgcaacgacgaccccgccaccgctagtcgcccgttcgacaaggaacgcgacggcttcgtaatcggcgaaggtgccggtgtgctggtgctcgaaacgctggagcacgcccaagcccgcggcgccacgatcctcggtgaagtggtgggctacggcatgacttgcgatgcccaccacatcacctcacccacaccgggcggtgtcggcggcgctgaagcgatgcgactggccctggctgatggcggcatcgatccttcggagatcgattacgtgaacgcccacggcaccagcacccccgccaacgacaaaaacgagacctcggccatcaagagtgctctgggggatcgtgcgctgcagatcccagtgagctccaccaaatcgatgaccggccacctgctgggtggatcgggcggcatcgaggcggtggcctgcgtgctggccctccagcatggggtcgtgcccccgaccatcaaccacaccaacccggatcctgactgtgatctggatgtcgtgcccaatcaggcgcgggatcagacactgggaacggtgttgtccaactccttcggcttcggcggccacaacgtctgcctggctttcaaacgcgccagttga

SEQ ID NO: 19813 - protein, 415 aa, Synechococcus sp. WH 8102
MVDGLHRVVVTGLGAVTPIGNTVQDYWSGLISGRNGVDAITLFDASAHACRFAAEVKDFDPAGLIEPKEAKRWDRFCKFGVVAAKQAIADAGLTISDANADRIGTMIGSGVGGLLTMETQAHVLEGKGPGRVSPFTVPMMIPNMATGLAAIALGTKGPSSAVATACAAGSNAIGDAFRLLQLGKADAMVCGGAESAITPLGVAGFASAKALSFRNDDPATASRPFDKERDGFVIGEGAGVLVLETLEHAQARGATILGEVVGYGMTCDAHHITSPTPGGVGGAEAMRLALADGGIDPSEIDYVNAHGTSTPANDKNETSAIKSALGDRALQIPVSSTKSMTGHLLGGSGGIEAVACVLALQHGVVPPTINHTNPDPDCDLDVVPNQARDQTLGTVLSNSFGFGGHNVCLAFKRAS

SEQ ID NO: 19814 - DNA, 1242 bp, Chromobacterium violaceum ATCC 12472
  CDS (1)..(1242): transl_table=11
gtgtccaaacgcagagtagtagtcaccggcctgggccatgtgtccccggtcggcaacgacgtcgccaccggctgggccaatctgttggccggcaagagcggcatcgccaagatcacccgtttcgacgccagcgacatggcctgccagatcgcgggcgaggtcaaggacttcaatatcggcgactacatttcgccgaaggaagcgcgtcgcaacgacctgttcattcactacggcatcgccgcggccttgcaggccgtcgccgacgccgggctggacgacatcccgggcctggacaagacccgcgtcggcgtcaacatcggctccggcatcggcggcctgccgctgatcgaggaaaccggcgtggcgctgatggaaggcggtccgcgcaagatcggcccgtttttcatcccgggctcgctgatcaacctgatcgccggccaggtgtccatcctgaagggctatcaaggccccagctacggcatcgtgtccgcctgcaccaccggcgcgcactgcatcggcgacgccgcgcgcctgatccagtacggcgacgccgacatcatggtcgccggcggcgccgagggcgcggtgtcgcgcctgggcatcggcggcttcgccgcgatgaaggcgctgtccacgcgcaacgacgaccccgaggccgcctcccgtccgtgggacaagggccgcgacggcttcgtgatgggcgagggcgccggcgtgctggtgctggaagagtacgagcacgcggtcaagcgcggcgccaagatctatgccgagctgatcggtttcggcatgagctcggacgcgcaccacatcaccgcgcccaacgccgagggcccggcccgcggcgtggtcaacgcgctgcgcgacgccggcatcaatgccgacgcggtgcagtacgtgaacgcgcacggcacgtccaccccgctgggcgacgccaacgagaccaacgcgctgaagatcgcttttggcgatcacgccaagaagctggtcgtcaactccaccaagtccatgaccggccacttgctgggcggcgcgggcggcgtggaggcgatctacaccatcctggcgatccacaaccaggtgtctccgccgaccatcaacctggtcgagcaggatctggaagccggctgcgatctcgattacgcggccaacaccgcgcgcgagatgaagatcgaggtgggcatttccaactccttcggcttcggcggcaccaacggcaccctggtgttcaagcgcgtctga

SEQ ID NO: 19815 - protein, 413 aa, Chromobacterium violaceum ATCC 12472
MSKRRVVVTGLGHVSPVGNDVATGWANLLAGKSGIAKITRFDASDMACQIAGEVKDFNIGDYISPKEARRNDLFIHYGIAAALQAVADAGLDDIPGLDKTRVGVNIGSGIGGLPLIEETGVALMEGGPRKIGPFFIPGSLINLIAGQVSILKGYQGPSYGIVSACTTGAHCIGDAARLIQYGDADIMVAGGAEGAVSRLGIGGFAAMKALSTRNDDPEAASRPWDKGRDGFVMGEGAGVLVLEEYEHAVKRGAKIYAELIGFGMSSDAHHITAPNAEGPARGVVNALRDAGINADAVQYVNAHGTSTPLGDANETNALKIAFGDHAKKLVVNSTKSMTGHLLGGAGGVEAIYTILAIHNQVSPPTINLVEQDLEAGCDLDYAANTAREMKIEVGISNSFGFGGTNGTLVFKRV

SEQ ID NO: 19816 - DNA, 1257 bp, Porphyromonas gingivalis W83
  CDS (1)..(1257): transl_table=11
atggaactgaaaagagtagtagtaacagggttaggagccattactccgcttggcaactctgctcccgaaacgtgggaaagcttagtggcaggcaagagtggagccggacctatcacgctctttgatgcctccaagttcaaaacgcagttcgcctgcgaagtgaagggttttgaccctttgcaacattttgaccgcaaggaggtgcgtaagttagaccgctacgcgcaacttgcacaagtagcggccgatgagagtgtaaaagactccggcctcgatttggaccaattggacaagaatcgtgtgggagtgatcgtttctgccggaatcggtggtctgacgactttcgaaagtgaagtgcgcgactacaatccggagaacgggcctcgtttcaatccgtttttcatccccaagatgatctccgatattgcagccggccagatctcgatcaaatacggcttccatggtcctaactattccatcgcatccgcatgcgcttcctctaccaatgctctgatcgatgcttgccatctgatccgcttaggcaaagccaatgtaatcattgcaggaggctctgaggcgtcgatttgcgctgccggagtgggaggtttcaatgcaatgaatgctctctccactcgcaacgatgctccacaagaggccagccgccccttcagtgccagtcgtgacgggtttgtaatgggtgaaggagcagcatgtatagttctcgaagaactggaacatgctcttaaacgcggtgctcgcatctatgccgaattggtgggaacaggtctttcagccgatgcatatcacctgacggcaagtcatcctgacgggttgggagccaagctggttatgacaaacgctatcgaagatgctggattgaagccggaggatattgactacgtcaatgtacacggtacttctactcctgttggggacatttcagaggcaaaagctatcaaggatgtcttcggagaacatgcttataagctgaacatcagttctaccaagagtatgacaggacatcttctcggagctgccggagctgtagaagctatggtgtgcgttaagtctgtccacgaggatatcgttccgcctacgatcaaccatcaggacgacgatcgcgatccggaaatcgattataacctgaactttacattcaacgaagcacaaaagcgtcaggtacgtgtagccctgtccaatacttttggattcggaggacataatgccagcgttgtattcaagaagttcgagaaataa

SEQ ID NO: 19817 - protein, 418 aa, Porphyromonas gingivalis W83
MELKRVVVTGLGAITPLGNSAPETWESLVAGKSGAGPITLFDASKFKTQFACEVKGFDPLQHFDRKEVRKLDRYAQLAQVAADESVKDSGLDLDQLDKNRVGVIVSAGIGGLTTFESEVRDYNPENGPRFNPFFIPKMISDIAAGQISIKYGFHGPNYSIASACASSTNALIDACHLIRLGKANVIIAGGSEASICAAGVGGFNAMNALSTRNDAPQEASRPFSASRDGFVMGEGAACIVLEELEHALKRGARIYAELVGTGLSADAYHLTASHPDGLGAKLVMTNAIEDAGLKPEDIDYVNVHGTSTPVGDISEAKAIKDVFGEHAYKLNISSTKSMTGHLLGAAGAVEAMVCVKSVHEDIVPPTINHQDDDRDPEIDYNLNFTFNEAQKRQVRVALSNTFGFGGHNASVVFKKFEK

SEQ ID NO: 19818 - DNA, 1242 bp, Wolinella succinogenes DSM 1740
  CDS (1)..(1242): transl_table=11
gtgcgtagagtcgtcgtgacaggcatcggaatgatcaatgcactaggcaacaacagaggagattcttttaaggctatcgttgaaggaaagtgcggaattaaaagaatctcttgctttgacgtggaagattttcccgtgaaaatcgccgcggaaatcaccgattttgaccccagtcttgtcatggatcccaaggaggtcaaaaaagccgatcgattcattcaacttggcatcaaagctgccaatgaagcaatgcacgattcgggtcttttagggagtgatcaccgccttctccctgagattgatggcgatcgatttgggattagctctgcttcaggaatcggtgggcttcaaaacatcgaaaaaaactctgtcatcaacgccgaacgcggccccaagagaatctctcctttcttcattccctcttccttggtgaatatgctaggggggtttgtctcgattgattatggcgtcaaaggccccaacctctcaagcgtcacagcttgcgccgcaggaactcacgccatcatcgaagcggccaaaaccatcatgcttgatggtgccgatcgaatgctcgtggttgcctccgaagcggctatttgtgctgtagggatcggtggctttgccgctatgaaagcgctaagcgacctcaacgatgagccgcttaaagcctctaggccttttgatgcaaatcgcaatggttttgtcatgggcgaaggagccgcctccttagtgctcgaagagtatgaagcggccaaaaagcgtggagccactatctatggcgagctcatcggatttggtgaaagcggcgatgccaaccacatcaccacccccgctcccgagggtgaaggcgcgctaagagcgatgagggccgccctcaggatggcaaacacctccattgattatgtcaacgctcatggcaccagcaccaaatacaacgatatgtatgagacaatggctctcaaaagtgcttttggttccaaagaggccgttccccccgtgagctctaccaaaggtcaaacgggtcactgccttggtgcagcgggcgcgattgaggcagtcatctcccttatgtctatgcaagagggaattttgccccccactatcaactacgagacccccgatcctgattgcgatctagattacatccccaacaccgctagagaggccaaacccaccacggtcatgagcaactcctttggctttggtggaaccaacggagtcgttatctttaaaaaactctaa

SEQ ID NO: 19819 - protein, 413 aa, Wolinella succinogenes DSM 1740
MRRVVVTGIGMINALGNNRGDSFKAIVEGKCGIKRISCFDVEDFPVKIAAEITDFDPSLVMDPKEVKKADRFIQLGIKAANEAMHDSGLLGSDHRLLPEIDGDRFGISSASGIGGLQNIEKNSVINAERGPKRISPFFIPSSLVNMLGGFVSIDYGVKGPNLSSVTACAAGTHAIIEAAKTIMLDGADRMLVVASEAAICAVGIGGFAAMKALSDLNDEPLKASRPFDANRNGFVMGEGAASLVLEEYEAAKKRGATIYGELIGFGESGDANHITTPAPEGEGALRAMRAALRMANTSIDYVNAHGTSTKYNDMYETMALKSAFGSKEAVPPVSSTKGQTGHCLGAAGAIEAVISLMSMQEGILPPTINYETPDPDCDLDYIPNTAREAKPTTVMSNSFGFGGTNGVVIFKKL

SEQ ID NO: 19820 - DNA, 1272 bp, Gloeobacter violaceus PCC 7421
  CDS (1)..(1272): transl_table=11
atgaaaagcaggaatcaaagagagttaaagcgcgttgtcgtcacaggcatgggatcaattactcctctacaaaatgatccagaatccttctggcagcagttacttgttggcagatctggggtgagtcggatcacgtactttgacacatcgcatcatcgttgccagattgctgctgaagtaaaggggtttgaggcgtcagattatctatcattaaaagcagctaagcgcaccgaaagatgtattcagttcgctattgccggggctaggcaggcccttgacgatgctcaattttcgatcgatgcactgaatgccagtcaagtgggggtcgtgattggtacagccattgggggaatccgaatcttcgaagcacaagcaaatgtttatgcccagaaaggaccagatcgttgcagtccctttttgacgccgatgacgatttgcaatatggctgctgctcaggtcgctattcaaattggagcgacggggccatgtttttgcccagctactgcttgtgctgccggttccaatgcgattggagatgcttttcggttaattcagttggggcatgttcaagcagtgattgctggaggcaccgaagcgcccatcacaccattggtcatcgcagggtttgaagctgctagagttgtatctactctcaatcaggaaccggaaaaagctagtcgaccttttgataaaagtagggatggatttgtcattggagaaggttcaggaatccttttgcttgaggaacttgaacacgctctcaggcgcggtaaaaagatatatgcagaattgatcggatatggagctagttgtgatgcacatcatatcacttctcctttaccaaccggtgctggggcagctcaggcaatgcgactggctatcgaggatgccgacttatctcctggccaggtcaattacattaatgcccacggcactagcacccttgctaacgatgcaatggaaattaaaggaattagtcttgcatttggagaactagctcctctgattcctatcaactccaccaaatcgatgactggtcacctcttaggagcagcgggggggattgaagctatcgcaacaatcatgacgatcactaaggaccagatccctgccacgctcaatctccaaaatcctgatactgaatgcgatctcgattttgtgacgaaggaaagtcgtcacaaaattgtggatgtagcgatgtcaaattcatttggatttgggggacataacgtatcattaatttttcgcaagttccccggcatgcttgaataa

SEQ ID NO: 19821 - protein, 423 aa, Gloeobacter violaceus PCC 7421
MKSRNQRELKRVVVTGMGSITPLQNDPESFWQQLLVGRSGVSRITYFDTSHHRCQIAAEVKGFEASDYLSLKAAKRTERCIQFAIAGARQALDDAQFSIDALNASQVGVVIGTAIGGIRIFEAQANVYAQKGPDRCSPFLTPMTICNMAAAQVAIQIGATGPCFCPATACAAGSNAIGDAFRLIQLGHVQAVIAGGTEAPITPLVIAGFEAARVVSTLNQEPEKASRPFDKSRDGFVIGEGSGILLLEELEHALRRGKKIYAELIGYGASCDAHHITSPLPTGAGAAQAMRLAIEDADLSPGQVNYINAHGTSTLANDAMEIKGISLAFGELAPLIPINSTKSMTGHLLGAAGGIEAIATIMTITKDQIPATLNLQNPDTECDLDFVTKESRHKIVDVAMSNSFGFGGHNVSLIFRKFPGMLE

SEQ ID NO: 19822 - DNA, 1248 bp, Gloeobacter violaceus PCC 7421
  CDS (1)..(1248): transl_table=11
atggaaaaaaagcgggtggtggtgaccggcgtcggcgcggtgacgcctcttggcaacacggcggccgacttctgggaaggcttgctcgcaggccgttccggtgtggcacctatcagtctgtttgacccgagccgccacgacgcgcgcatcgcggccgaggtcaaaaattttgatccccaccagtacctcgagaaaaaagaagtcaagcgcacggtgcgctttacccagatggcggtggccgcgagcaagcaggcggtcgccgacgcggctcttgccatcaacgagttcaacagcgaacaggtcggggtgattatcggcaacggcaccggcggcatggagtggctggagcagcaggacggcatcctgcgcgagcagggacccaaccgcgtttcaccctttatggtgccgctgtttatcgccaatatggccgccggcttcaccgccattcagctgggcgccaaaggccccaattcctgcaccgtcaccgcctgcgccgccggctccaacgccatcggcgacgcttttcggcttatccagtacggcgaagcccaggcggtgatctgcggcggcaccgaggcgtgcatcaccccgctggtggtggcgggcttcgccgcgtcgcgcgccctttcgacccgcaacgacgaacctgaaacagcgagccggcctttcgatttaaaccgcgacggctttgtgattggcgagggggcgggcattctggtgctcgaagaactcagccacgccctggcgcgcggcgcgcgcatctacgccgaaatctgcggctacgcgatgacctgcgacgcttatcacatgacctcgcccgcaccggccggcgaaggggccgctcgggccatccggctggcgctcaaggatgcaggcgtgttcccggaccaggtgagctacatcaacgcccacggcaccagtacgcccctcaacgacaccaacgagacccaggcgattaagaccgtgctgggagaggctgcctacagcgtggcggtcagttccaccaaatcgatgaccggtcacctgctgggcggatccgggggcatcgaggcggtggccacggctctggctgtttaccacgacatcgcgccgcccaccatcaaccttgagacccccgacccgagctgcgacctcgactacgtgccgggggtcgcccggacgatgcctatcgaggtggctctatccaattccttcggcttcggcggccacaacgtcaccctggtatttagaaagttccgcgaagcctag

SEQ ID NO: 19823 - protein, 415 aa, Gloeobacter violaceus PCC 7421
MEKKRVVVTGVGAVTPLGNTAADFWEGLLAGRSGVAPISLFDPSRHDARIAAEVKNFDPHQYLEKKEVKRTVRFTQMAVAASKQAVADAALAINEFNSEQVGVIIGNGTGGMEWLEQQDGILREQGPNRVSPFMVPLFIANMAAGFTAIQLGAKGPNSCTVTACAAGSNAIGDAFRLIQYGEAQAVICGGTEACITPLVVAGFAASRALSTRNDEPETASRPFDLNRDGFVIGEGAGILVLEELSHALARGARIYAEICGYAMTCDAYHMTSPAPAGEGAARAIRLALKDAGVFPDQVSYINAHGTSTPLNDTNETQAIKTVLGEAAYSVAVSSTKSMTGHLLGGSGGIEAVATALAVYHDIAPPTINLETPDPSCDLDYVPGVARTMPIEVALSNSFGFGGHNVTLVFRKFREA

SEQ ID NO: 19824 - DNA, 1251 bp, Photorhabdus luminescens subsp. laumondii TTO1
  CDS (1)..(1251): transl_table=11
gtgtctaagcgtcgagtagttgtgaccggactaggcatgttatctcctgtcggtaatacagctgaatcttcttggaaagctgtttgtgccggacagagtggtatcagccttattgaccattttgacaccagtcaccatgcaactaagtttgctggtctggttaaaggttttaatcatgaagatttcaatatttcgcgcaaggatgcacgaaaaatggatgatttcattcaatatggtattgcagcaggtgtgcaagccattgaagattctggaattgaagtaacagaagccaatgctagtcgttttggtgctgctattggttctggtattggtggtttgggtctgattgaagaaaatcacggggcgttggtggcgagtggtcctcgtaagatcagcccgttcttcgtaccttctacgatcgtaaacatggtagcaggtcatctgagtattatttacggtttgcgtggcccaagtatttctatcgccacagcatgtacgtcaggtgtacataatattggtcatgctgcccgtattattgcttataatgatgctgacattatgctggccggtggtgcagaaaaagccagtactcctctgggggttggtggttttggtgctgcccgagctttatctacccgtaacggtaatccacaaggtgcaagtcgtccgtgggataaagaccgcgatggctttgttctgggggatggcgcaggtatcctggtactggaagagtatgagcatgcgaagagacgtggtgcgaaaatttacgcagaaatcgttggctttggcatgagcagcgatgcttatcatatgacgtcaccaccagaaaatggtgcaggtgctgcgttggcgatggaaaatgcgctgagagatgccggtatcactaccaagcaagtgggatatattaatgctcacggtacttcaacatctgctggcgacttagcagaagcgcatgcagttgagtccgtgtttggtgaaggcactgatgttttagtgagctccactaaatcaatgacgggtcatttgttgggcgctgcgggggccgttgaatctattttcactatcctggcattgcgtgatcaagttgttccgccgactatcaacctggaaaatcaggatgagaactgccgtctggatttcgtgccaaatgagtcccgtaaggtagaggggatggaatatgcattgtgtaactctttcggcttcggtggtactaacggctcactgattttccgtaagattaaacctgattaa

SEQ ID NO: 19825 - protein, 416 aa, Photorhabdus luminescens subsp. laumondii TTO1
MSKRRVVVTGLGMLSPVGNTAESSWKAVCAGQSGISLIDHFDTSHHATKFAGLVKGFNHEDFNISRKDARKMDDFIQYGIAAGVQAIEDSGIEVTEANASRFGAAIGSGIGGLGLIEENHGALVASGPRKISPFFVPSTIVNMVAGHLSIIYGLRGPSISIATACTSGVHNIGHAARIIAYNDADIMLAGGAEKASTPLGVGGFGAARALSTRNGNPQGASRPWDKDRDGFVLGDGAGILVLEEYEHAKRRGAKIYAEIVGFGMSSDAYHMTSPPENGAGAALAMENALRDAGITTKQVGYINAHGTSTSAGDLAEAHAVESVFGEGTDVLVSSTKSMTGHLLGAAGAVESIFTILALRDQVVPPTINLENQDENCRLDFVPNESRKVEGMEYALCNSFGFGGTNGSLIFRKIKPD

SEQ ID NO: 19826 - DNA, 1242 bp, Vibrio vulnificus YJ016
  CDS (1)..(1242): transl_table=11
gtgtccaagcgtcgtgtagttgtcactggcatgggtatgttgtcaccggttggcaacaccgtagcagaatcctggaaatccctgcttgaaggcaaaagtggtatcgtcaatatcgaacatttcgatgcaactaacttctctacccgtttcgccggtttggtaaaagacttcaactgcgaagaatacatgtctaaaaaagatgcacgtaaaatggatctcttcatccagtacggcattgcagcaggtattcaggctttagacgattcaggtcttgaaattacggatgaaaacgcacaccgcgttggtgttgcgatcggctctggtatcggcggtcttgatcttattgaagctggccacaccgctttagttgaaaaaggcccacgtaaagttagcccattcttcgttccttcaactattgtaaacatggttgcaggtaatctatctatcatgcgtggcatgcgcggtccgaacatcgcgatttctactgcatgtactactggtctgcataacatcggccatgcagcgcgaatgatcgcttacggcgatgctgatgctatggttgctggtggtgctgagaaagcatcaacaccgcttggtatggctggctttggtgcggcgaaagctctttctactcgtaacgatgaaccacaaaaagcgtctcgtccttgggataaagatcgcgatggtttcgtattaggcgatggtgctggcatcatggtacttgaagagtacgaacatgcaaaagcacgtggcgcaaaaatttacgctgagctggttggctttggtatgtcgggtgatgcttatcacatgacttcaccaagcgaagacggctctggtggcgctctagcgatggaagcggcaatgcgtgacgcaggtattgttggtacacaagtgggttatgtgaacgctcacggtacatcaacaccagcaggcgatgtggctgaaattaaaggcgtaaaacgtgctcttggtgaagagggcgcaaaacaagttaaagtatcttcaacaaaatctatgaccggccacctacttggtgctgctggctctgttgaagcgatcattaccgtgttgtcgttggttgatcagatcgttccaccaaccattaacctggataatccagaagaaggtttggatatcgatcttgttccacatactgcgaagaaagtggatatggaatacgcgatctgtaactcattcggcttcggtggaacaaacggctcactcgtatttaagaaaatctaa

SEQ ID NO: 19827 - protein, 413 aa, Vibrio vulnificus YJ016
MSKRRVVVTGMGMLSPVGNTVAESWKSLLEGKSGIVNIEHFDATNFSTRFAGLVKDFNCEEYMSKKDARKMDLFIQYGIAAGIQALDDSGLEITDENAHRVGVAIGSGIGGLDLIEAGHTALVEKGPRKVSPFFVPSTIVNMVAGNLSIMRGMRGPNIAISTACTTGLHNIGHAARMIAYGDADAMVAGGAEKASTPLGMAGFGAAKALSTRNDEPQKASRPWDKDRDGFVLGDGAGIMVLEEYEHAKARGAKIYAELVGFGMSGDAYHMTSPSEDGSGGALAMEAAMRDAGIVGTQVGYVNAHGTSTPAGDVAEIKGVKRALGEEGAKQVKVSSTKSMTGHLLGAAGSVEAIITVLSLVDQIVPPTINLDNPEEGLDIDLVPHTAKKVDMEYAICNSFGFGGTNGSLVFKKI

SEQ ID NO: 19828 - DNA, 1266 bp, Rhodopseudomonas palustris CGA009
  CDS (1)..(1266): transl_table=11
atgagacgggttgtcgtcacgggccttggcatggtgtcgccgctgggctgcggcgtcgaaccgacctggagccgagtgctcgccggcgaaagcggcgcacgcaagatcgatacgttcgacgtgtcggatctcgccagccagatcgcctgcgtcattccgcgcggcgacggcaccaacggcactttcaatcctgatcaatggatggagccgaaagaccagcgtaaggtcgatgacttcatcgtctatgcgatggcggcggcgcgtcaggcgctcgacgatgccggctggcatccctccacggaagaagagcgctgcgcctcgggcgtgctgatcggctccggcatcggcggcctgcagggcatcgccgagactgcgctgctgctcgagcaacgcggcccgcgccggatctctccgttctttattcccggccgcctgatcaatcttgcgtccggctatgtctcgatcgaattcggtctgaagggccccaaccattcggtcgtcacggcttgctcgaccggcgcccatgcgatcggcgatgcctcgcggttgatcgcgctcggcgacgccgacgtgatggtcgcgggcggtaccgaatctccgatcagccgtctggcgatggccggtttcgctgccgcgcgggcgctgtcgaccggtttcaacgatgcaccgaccaaggcttcgcggccttacgacaaggatcgcgacggcttcgtgatgggcgagggcgccggcgtggtcgtgctggaagagtacgaacacgccaaggcgcgtggcgcgcggatctatgccgaagtgatcggctacggtctgtcgggcgacgcttatcacatcacggcgccgagctctgatggtgacggcgcattccgctgcatgagcgccgcgatcaagcgcggcggcatcgcagtgtcggacatcgactacatcaacgcacacggcacctcgacgccgctcggtgacgagatcgagctcggtgcggcacagcgcctgctgggcaatgcggcctcgcgcgtgtcgatgtcgtcgaccaagtcgtcgatcggccatctgcttggggccgccggtgctgtggaagcgatcttctgcgtgctcgcgattcgcgacaacgttgcgccgccgacgatcaatctcgactccccctcggtcgagacggcgatcgatctggttccgtggaagccgcgggcccgcgagatcaacgttgcattgtcgaactcgttcgggttcggtggcacgaacgcgtcgctggtgttgcagcgcgtgccgaactaa

SEQ ID NO: 19829 - protein, 421 aa, Rhodopseudomonas palustris CGA009
MRRVVVTGLGMVSPLGCGVEPTWSRVLAGESGARKIDTFDVSDLASQIACVIPRGDGTNGTFNPDQWMEPKDQRKVDDFIVYAMAAARQALDDAGWHPSTEEERCASGVLIGSGIGGLQGIAETALLLEQRGPRRISPFFIPGRLINLASGYVSIEFGLKGPNHSVVTACSTGAHAIGDASRLIALGDADVMVAGGTESPISRLAMAGFAAARALSTGFNDAPTKASRPYDKDRDGFVMGEGAGVVVLEEYEHAKARGARIYAEVIGYGLSGDAYHITAPSSDGDGAFRCMSAAIKRGGIAVSDIDYINAHGTSTPLGDEIELGAAQRLLGNAASRVSMSSTKSSIGHLLGAAGAVEAIFCVLAIRDNVAPPTINLDSPSVETAIDLVPWKPRAREINVALSNSFGFGGTNASLVLQRVPN

SEQ ID NO: 19830 - DNA, 1233 bp, Geobacter sulfurreducens PCA
  CDS (1)..(1233): transl_table=11
atgagaagagtagtggtgacgggagtcggcgccgtatctccgctcggagtcggcaacgccgccaactgggacgcgctcgtttcaggcacgtcgggcattgggcacataacccgctttgacgcctccgacctgccggtgaggatcgccggtgaggttaagggctttgatcccgagcagtacatcgacaagaaagaggtcaagaagatggacctcttcatccagtacgccatggcagctgcccattacgccatggaagattccggcctccagatcaccgaggagaacgcggagcgtacgggtgtcctggtcggcgcgggactgggcggtttgccgaccatcgaaaagtatcatgccgccatgctcgaaggcgggcacaagaaaatttcccccttcttcattccgatgctgatcatcaatctggcacccggccacatttcaatcaagtatggggccaagggacccaatctgtcgtcggtatccgcctgcgccaccggtacacattccatcggtgatgcgtaccatatgatcaagcgcggcgatgcggacgccatgattgctggtggtaccgagtccacggtgactcccctcggaattggcggttttgcggtcatgaaggctctctccacgcgtaacgacgatccgaccgctgcgtcgcgtccctttgaaaagaatcgcgatggtttcgttctcgctgagggtgcgggtatcgtcgttcttgaggagtatgaggctgccaagaaacgcggggccaaaatttatgccgagatcgtcggctatggtctcacgggcgacgcctaccatctcaccgctccggcaccggagggagaaggtgcagcgcggtgtatgaaaatggctctcaacaacgccggggtccgtccggaggaagtggactacatcaacgctcatggcacgtccacgcccttcaatgactactacgagacccttgccgtcaagagcgtgttcggtgactacgcgaaaaaggttatggtgtcctccaccaagtccatgaccgggcacctgctcggcgcagccggcggtgttgaagctgtctttaccctcatggccatggacaagggtgtgattccgccgaccatcaactatcaggagcaggaccccgagtgcgatcttgattatgttcccaatgccgcccgggagaagtcgatcacgtacgccctcagcaataacttcggttttgggggcacgaacgcgacgctgctctttaagaaagtatag

SEQ ID NO: 19831 - protein, 410 aa, Geobacter sulfurreducens PCA
MRRVVVTGVGAVSPLGVGNAANWDALVSGTSGIGHITRFDASDLPVRIAGEVKGFDPEQYIDKKEVKKMDLFIQYAMAAAHYAMEDSGLQITEENAERTGVLVGAGLGGLPTIEKYHAAMLEGGHKKISPFFIPMLIINLAPGHISIKYGAKGPNLSSVSACATGTHSIGDAYHMIKRGDADAMIAGGTESTVTPLGIGGFAVMKALSTRNDDPTAASRPFEKNRDGFVLAEGAGIVVLEEYEAAKKRGAKIYAEIVGYGLTGDAYHLTAPAPEGEGAARCMKMALNNAGVRPEEVDYINAHGTSTPFNDYYETLAVKSVFGDYAKKVMVSSTKSMTGHLLGAAGGVEAVFTLMAMDKGVIPPTINYQEQDPECDLDYVPNAAREKSITYALSNNFGFGGTNATLLFKKV

SEQ ID NO: 19832 - DNA, 1251 bp, Mycobacterium avium subsp. paratuberculosis K-10
  CDS (1)..(1251): transl_table=11
gtgagtaagccttccactgctaacggcggttaccccagcgttgtggtaaccgccgtcacggcgacgacgtcgatcgcgccggacgtcgagagcacgtggaagggtctactcgccggcgaaagcggcatccacgtcctcgaagacgactacatcaccaagtgggacctgccggtccggatcggtggccacctcaaggagcccatcgacgagcggatgagcaggctcgacctgcgccgcatgtcctacgtccagcggctggccaagctgctcagcacccagctgtgggagaccgccggcaacccggagctcgaccccgaccggttctcggtcgtggtgggcaccggcctcggtggtgccgagcggatcgtggagagctacgacctgatgaacgagggcgggccccgcaaggtgtcgccgctggccgtgcagatgatcatgcccaacggcgccgccgccgtggtgggtctgcagctcggcgcccgcgccggggtgatcaccccggtgtcagcctgttcgtcgggctcggaggcgatcgcccacgcgtggcgccagatcgtcatgggcgacgccgatgtcgccgtgtgcggtggtgtcgagggccctatcgacgcgctgccgatcgcggccttctcgatgatgcgggccatgtcgacgcgcaacgacgagcccgagcgggcgtcgcggccgttcgacaaggaccgcgacgggttcgtgttcggcgaggccggcgcgctgatgctgatcgagaccgaggagcacgccaaggcccgcggtgccaagccgctggcccggttgatgggtgccggcatcacgtccgatgcgttccacatggtggccccggcgggcgacggtgtgcgggcgggccgggccatgacgcggtcgctggagttggcgggcctgtccccgaaggacgtcgaccacgtcaacgcgcacggcaccgcgacgccgatcggtgacaccgccgaggccaacgccatccgggtggccggatgtcaggaggcggcggtgtatgcgccgaagtccgcgctgggacactcaatcggcgcggtcggcgcgctggaatcggtgctcacggtgctgaccctgcgcgacggcgtcattccgcccaccttgaactatgaaaccccggaccccgaaatcgatctggacatcgtggcgggcgaaccccgctacggcgactaccaatacgcgatcaacaactcgttcggcttcggtggccacaacgtggcactggccttcgggcgctactga

SEQ ID NO: 19833 - protein, 416 aa, Mycobacterium avium subsp. paratuberculosis K-10
MSKPSTANGGYPSVVVTAVTATTSIAPDVESTWKGLLAGESGIHVLEDDYITKWDLPVRIGGHLKEPIDERMSRLDLRRMSYVQRLAKLLSTQLWETAGNPELDPDRFSVVVGTGLGGAERIVESYDLMNEGGPRKVSPLAVQMIMPNGAAAVVGLQLGARAGVITPVSACSSGSEAIAHAWRQIVMGDADVAVCGGVEGPIDALPIAAFSMMRAMSTRNDEPERASRPFDKDRDGFVFGEAGALMLIETEEHAKARGAKPLARLMGAGITSDAFHMVAPAGDGVRAGRAMTRSLELAGLSPKDVDHVNAHGTATPIGDTAEANAIRVAGCQEAAVYAPKSALGHSIGAVGALESVLTVLTLRDGVIPPTLNYETPDPEIDLDIVAGEPRYGDYQYAINNSFGFGGHNVALAFGRY

SEQ ID NO: 19834 - DNA, 1272 bp, Wolbachia endosymbiont of Drosophila melanogaster
  CDS (1)..(1272): transl_table=11
atgagcagaagagtagtagtcactggtgttggtttaatcactccactagcggcagatgttgacaacacttggtcaaggctaataaaaagtgagtctggcataaaagcaatcaatacggagagatttgactcttctgatcttgcttgcaaaattgcagggcaggtgccgttgcaatcagacaacattgagcaccatttcaatccactagattatatttctgagaaagactcaaaaaggacagatcgttttatccattacggtattgcagcagctattcaggcagtagatgattcattaattttggaaagccaaaatatcaatcgggaacgtgttggtgtgactattggctctggtataggtggtcttccgtcaattcaggaaaatgttattaccatgcaggaaaaagggcccagacgtgtcagtccattttttgtccctgcaagtctaataaatttgatatctggccatatttctattaaatacgaatttacaggtccaaacgattcagcagtaaccgcatgtgcaacaggtgcgcatgcaatcataaactcagcaagaactataaaacttggtgaagcggatgttatgattgcaggtggagcagaaagtgcactgtgtagagttggaattgcaggttttgcatctatgaaggcgttatcaactaaatttaacgataaaccggaagaagcttcaaggccatgggatgaagaacgcgatggttttgttatgggtgaaggagcaggtatattggtgctggaggaatacgaacatgcgaaaaaaaggggggcaaaaatacatgctgaactggttgggtacggactcacaggagatgcgcaccacattacagcaccacatccagaaggaagaggcgcatttaaggcaatgcagcttgctttaaagagcgcacaaattaatcccaatcaagtagggtatatcaatgcacatggaacttcaacgccacttggagataaaattgaagtaatagcaatgaaacagttattcggtgactacgtttataaaatacctgtttcttcaactaaatcttctataggacatttacttggtgctgcagggagcgttgaagcaatattcagtattcttgcgttaaataatggaattattccgccaaccttaaatttacacaagccttcagaaggatgtgatttaaattttgtaccgtttaaagctcaggagcataaaattcaatatgcactttctaattcgtttggttttggtggcactaatgcatcgctcatatttggacaagtttag

SEQ ID NO: 19835 - protein, 423 aa, Wolbachia endosymbiont of Drosophila melanogaster
MSRRVVVTGVGLITPLAADVDNTWSRLIKSESGIKAINTERFDSSDLACKIAGQVPLQSDNIEHHFNPLDYISEKDSKRTDRFIHYGIAAAIQAVDDSLILESQNINRERVGVTIGSGIGGLPSIQENVITMQEKGPRRVSPFFVPASLINLISGHISIKYEFTGPNDSAVTACATGAHAIINSARTIKLGEADVMIAGGAESALCRVGIAGFASMKALSTKFNDKPEEASRPWDEERDGFVMGEGAGILVLEEYEHAKKRGAKIHAELVGYGLTGDAHHITAPHPEGRGAFKAMQLALKSAQINPNQVGYINAHGTSTPLGDKIEVIAMKQLFGDYVYKIPVSSTKSSIGHLLGAAGSVEAIFSILALNNGIIPPTLNLHKPSEGCDLNFVPFKAQEHKIQYALSNSFGFGGTNASLIFGQV

SEQ ID NO: 19836 - DNA, 1272 bp, Bdellovibrio bacteriovorus HD100
  CDS (1)..(1272): transl_table=11
atgaactcccgatttgaacgtccatccaaaccacaaagaagagttgtcgtcaccggagtaggcgcagtcactccccttggtaataccattgaggacagctgggctgccgcaatccgtggtcaatctgggatcgccaagatcaccaaattcgacacgacaggcttcgatgtgacttttgccggcgaagtaaaaggtttcaacacagaccaatacgtcgagaaaaaagagcaaaagaaaatggacgagttcattcactactcgatcgcagcttccaaaatggccgtggaaatggccaagctggaactgaccgaagaagtgaagaatcaagcgggagtgattattggtgtcggtatcggtggtcttgcgaacatcgaagaaaccgccataaaaatgaaggaaagaggaccgggccgtatcagtccgttcttcatcccttctgtgatcacgaacctggccgcgggtcaggtgacgatctcattgggactgaaaggtcctaactattctgtgacttccgcgtgtgcttcaggtgttcactctatcggagatgcggttcgctatattcgcgacggcgtgactgatgtgatgcttgcaggtggcgcagaaagcacgatctgcggactggctgttggaggctttgcttccatgcgcgccctgtccacccgcaacgatgctcctgaaaaagccagccgtccttgggataaagaccgtgacggatttgttttggcagagggtgcggcggttctttgcatcgaatcccttgagcacgcggtcaaacgtggcgccaatattctttgcgaaatcacaggctacggagtttcctccgatgcttaccacatgacttccccggctccggaaggcgctggtggttatgcggcgatgtccatggctttgaaagactccggtctgaaagcggaagacatcaactatatcaacgctcacggcacaagtacgccggtgggtgacggccttgaaaccgcggcaatcaaacgcctgctgggtgatcatgcgaaaaaggtctgggtttccagcaccaagtccatgatgggtcacgcgttgggcgcagctggcgcaattgaatctgctttctgtgtgatggcaattcgcgaccaggtggctcctccaacgatcaacttggaaaatccaagtgaagactgtgatttggattacgttcctaatgaggcacgtaaaggtaaaatcaccaatgtcatcaacaacagctttggtttcggtggaaccaacgcctccatgatcttctctaaatacgaaggataa

SEQ ID NO: 19837 - protein, 423 aa, Bdellovibrio bacteriovorus HD100
MNSRFERPSKPQRRVVVTGVGAVTPLGNTIEDSWAAAIRGQSGIAKITKFDTTGFDVTFAGEVKGFNTDQYVEKKEQKKMDEFIHYSIAASKMAVEMAKLELTEEVKNQAGVIIGVGIGGLANIEETAIKMKERGPGRISPFFIPSVITNLAAGQVTISLGLKGPNYSVTSACASGVHSIGDAVRYIRDGVTDVMLAGGAESTICGLAVGGFASMRALSTRNDAPEKASRPWDKDRDGFVLAEGAAVLCIESLEHAVKRGANILCEITGYGVSSDAYHMTSPAPEGAGGYAAMSMALKDSGLKAEDINYINAHGTSTPVGDGLETAAIKRLLGDHAKKVWVSSTKSMMGHALGAAGAIESAFCVMAIRDQVAPPTINLENPSEDCDLDYVPNEARKGKITNVINNSFGFGGTNASMIFSKYEG

SEQ ID NO: 19838 - DNA, 1236 bp, Treponema denticola ATCC 35405
  CDS (1)..(1236): transl_table=11
atgagaagagttgtaattacaggcctcggtgccgtaacccccataggaaacaccctggatgaaacatgggaaggaatcaaagcaggtaaatgcggaatcggaaacattacccaatttgattgttccgattttaagattcagatagcggcagaagtaaaaaactttgacgcttcacaatttatggataaaaaagatgcccgtaaaatggcgcggttcactcaatttgccgtagccgcagcttcgcaggcaatgaaggatgccggcctttcaaaagaaaacatcgatgcaaaccgcacaggtataatactcggaaacggtataggcggttttgaaatctaccaagaagcctttaaaaaatactttcaagttgctccggatcgtattccgcctatgactgttcctcttcttattccgaatgaggcagccggaaacataagtatgcagttcggcataaagggaccgtcttggacattggccacggcctgtgcttccggtaccgatgctctcggaaacgctttagaccttgtccgctcaggaaggcttgatgtatgtgtatcgggcggtacggaagctacaattaccggtttcggcataagcggttttacgattttgcaaaccctcgcctcaggcgatcctgccaaggcttgctgtcccttcgataaaaagcgttcaggctttgtgatgggcgaaggctcaggcattctcatccttgaagaatatgaacatgcaaaaaaaaggggagctaaaatatatgcagaatttgcgggctatggagcctcctccgatgcctaccacttaaccagccccgacccctcaggtgacggaggagcattggctatcaccaacgccctcgccgatgcaggcgtaaaacctgaagaagttcaatactataatgctcacggaacatcgacgccgattaacgaccctgcagaaacggccatgattaaaaaagcttttggagaccatgcatataaaatgaaggtttcttcaaccaaatcgatgataggccattgcttaggtgccgcaggagctcttgaagctatcttctgtataaaggcaatggaagaaggattttatcccccgaccattaacctaaccgaacccgaccttgaagccggctgcgatttggactatgttccgaacaagggcgtcaaaggcgaaataaactgtgccgcctcaggctctctcggcttcggaggccataacggcgtcgccgtctttaaaaagataaagtaa

SEQ ID NO: 19839 - protein, 411 aa, Treponema denticola ATCC 35405
MRRVVITGLGAVTPIGNTLDETWEGIKAGKCGIGNITQFDCSDFKIQIAAEVKNFDASQFMDKKDARKMARFTQFAVAAASQAMKDAGLSKENIDANRTGIILGNGIGGFEIYQEAFKKYFQVAPDRIPPMTVPLLIPNEAAGNISMQFGIKGPSWTLATACASGTDALGNALDLVRSGRLDVCVSGGTEATITGFGISGFTILQTLASGDPAKACCPFDKKRSGFVMGEGSGILILEEYEHAKKRGAKIYAEFAGYGASSDAYHLTSPDPSGDGGALAITNALADAGVKPEEVQYYNAHGTSTPINDPAETAMIKKAFGDHAYKMKVSSTKSMIGHCLGAAGALEAIFCIKAMEEGFYPPTINLTEPDLEAGCDLDYVPNKGVKGEINCAASGSLGFGGHNGVAVFKKIK

SEQ ID NO: 19840 - DNA, 1239 bp, Bacillus cereus ATCC 10987
  CDS (1)..(1239): transl_table=11
atggaaaaaaagagggtcgtaattacaggactaggagctgttacaccggtcggtacagatgttgaaacagcgtgggaaaacattaaaaaaggtgtatctggaatcggacgacttacaagaattgatccggaactatttccagcaaaagtagcagcagaaattaacgactttgaagtcgagaaatatattgataaaaaagaagcgcgccgtatggatcgctttacacaatatgcagtagcagcagcgaaaatggcagttgcagatgcaaagcttgagattacagaggaaaacggacctcgaattggtgtatggattggttctggtattggcggtatggaaacatacgaagaacaatttaagatttttactgagaaaggtccgcgccgcgtgagcccattcttcgtaccgatgatgattccagatatggcagcaggccaagtatcaattgcaaccggagcaaaaggaattaacacttgttctgtaacggcttgtgcatctggtgcaaactcaattggtgatgcgtttaaagcgattcagcgcggtgatgctgatgcaatgattacaggcggagcagaggcgccgttaacaaatatggcattcgcaggatttagctcagcgaaagcattaacattcaatgaagatccagcaacagcttgccgtccattcgataaaaaccgtagcggtttcgtaatgggtgaaggttcaggtattttaattcttgaagaattagagcacgcattagctcgtggtgctcacatttatgcggaaatcgctggttacggtgcaactggtgatgcattccatattacaatgccggctcctggcggtgaaggcggcgtgcgcgcaatgcgtcaagctttagcagatgcaggtctacagccagaagatattgattacattaatgcgcatggtacaagtacggatgcgaatgaaaagtatgaaacgatggcaattaaagaaacgttcggtgagcatgcgtataaagtagcgatcagctcaacgaaatcaatgacaggtcacttattaggggcagctggtgctgttgaagcgattttctctattaaatcaattacagatggagtaattcctccaacaattaactatgagacaccagatccagaatgtgacttagattacgtaccgaatcaagcgagacatcaagaagtaaacgcagtgttaagtaattcattaggattcggtggtcataacgcagtattagtatttaaagcgtataaataa

SEQ ID NO: 19841 - protein, 412 aa, Bacillus cereus ATCC 10987
MEKKRVVITGLGAVTPVGTDVETAWENIKKGVSGIGRLTRIDPELFPAKVAAEINDFEVEKYIDKKEARRMDRFTQYAVAAAKMAVADAKLEITEENGPRIGVWIGSGIGGMETYEEQFKIFTEKGPRRVSPFFVPMMIPDMAAGQVSIATGAKGINTCSVTACASGANSIGDAFKAIQRGDADAMITGGAEAPLTNMAFAGFSSAKALTFNEDPATACRPFDKNRSGFVMGEGSGILILEELEHALARGAHIYAEIAGYGATGDAFHITMPAPGGEGGVRAMRQALADAGLQPEDIDYINAHGTSTDANEKYETMAIKETFGEHAYKVAISSTKSMTGHLLGAAGAVEAIFSIKSITDGVIPPTINYETPDPECDLDYVPNQARHQEVNAVLSNSLGFGGHNAVLVFKAYK

SEQ ID NO: 19842 - DNA, 1302 bp, Eremothecium gossypii
  CDS (1)..(1302)
atgcatccccgagtggtcgtgaccggcattgggtgctatactcctctggggccgtcgctagcccagtcttggaaggagctgttgcgagggacgagcggccttgtcaggctgcaagatctggcagagtacgagggcgattacaaaccactgtcgaggcttatatccggtgatcttcgagtcgggaaagttggatttgaggcgcgcgaccaggagctgctttcgagccaggagcaacggcggacctcgcgcgccgcgcagctggccatggtcaccgcagaagaagcgctccggcacgcaggtctccttagcggctcgcatctcgttgccagcgtggaccgcaaccgggcagggtgcatcattggcgcggggctaccctccatggaggacatatcgcaggcgacggcttctctgtcgtccgcacggcgaccgtccgtgtcgccgttcttcatcccaaagatgctcaacaacatggctgcgggaaacgtcgccattaagtttcaactccggggagccagcaattgtccctccacagcttgcgcgtcgggaaataatgcgatcggtgacgcatacaatttcatccgcctgggctactcagacgtaattgtggctggggccagcgagctgagtgtgcatcccttggcattggcggggtttgtgaaggccaagagtatctccgcgagcggcatttcgagaccgttcgacgcacggcgagacggctttgtgttgggcgagggctgcggcttactcgtgcttgagtcgcttgagcatgcacgtcaccgtggcgcagagataattgcggaagtggttgggtacggtgtgtgctcagatgcacaccacatcacgtcaccatcagagggcggggacggagcccgcagggctatgcacatggcattgcaggatgccggcatctgggacacgcgcgaccaggttggatatgtcaacgcccacgccacgagtacacctcttggcgaccgtgctgaggcgcgggccattcaggcggtgtttggtgctactggcacaggctctacgcttgtcagtagtaacaagggacatatgggccatctactaggtgctgcgggcgccgtggaagcagtcttcacagttcaatcgttgagggaaggcattgtaccccacacactaaatctgcaaacggttggagaggggctggcagacaaaaaagacggattcggtgggattacgttcgtgcaagataatcctgtccccgctcctctcacatacgcaatgaacaacagtttcggtttcggtgggattaactcctcgttgctgttcaagaaatggtga

SEQ ID NO: 19843 - protein, 433 aa, Eremothecium gossypii
MHPRVVVTGIGCYTPLGPSLAQSWKELLRGTSGLVRLQDLAEYEGDYKPLSRLISGDLRVGKVGFEARDQELLSSQEQRRTSRAAQLAMVTAEEALRHAGLLSGSHLVASVDRNRAGCIIGAGLPSMEDISQATASLSSARRPSVSPFFIPKMLNNMAAGNVAIKFQLRGASNCPSTACASGNNAIGDAYNFIRLGYSDVIVAGASELSVHPLALAGFVKAKSISASGISRPFDARRDGFVLGEGCGLLVLESLEHARHRGAEIIAEVVGYGVCSDAHHITSPSEGGDGARRAMHMALQDAGIWDTRDQVGYVNAHATSTPLGDRAEARAIQAVFGATGTGSTLVSSNKGHMGHLLGAAGAVEAVFTVQSLREGIVPHTLNLQTVGEGLADKKDGFGGITFVQDNPVPAPLTYAMNNSFGFGGINSSLLFKKW

SEQ ID NO: 19844 - DNA, 1335 bp, Anopheles gambiae str. PEST
  CDS (1)..(1335)
atgaaaagtctcccctacgtgctgcgaactattcaccattcacactcgaaacacaccagagacagtggacgacgccgggtggtggtaacggggctcggtgtagtatcacctgtcggctgcaatgtggaagcggcctggcaaacgatcctctccggtcagtcaaaagttggtcgactggtgggagaaacgtacgacaagcttccctgccgcgtagcggccacaatcgacacgaacgacatcgatctggaaaagtgtttctccaaaaccgagctcaaaacgatggcacgcgctaccgcctttgcgttgatcgctgccaaggaggctctctcgagggctagctggatgccgggcgtggaggatgaaaccgcctgccagcgcaccggtgttgccatcggtatgggcatggtagatctgatggacatttgcgagacgaacgaagcgctcaagaagggatacaaccgggtgagcccattttttgtgccccgcatcttgcccaacatgccggccgggcagctcagcatccggtacgggtttcgcggaccgaaccatgccgtttctaccgcctgtgctacgggtgcccatgccataggcgatgcgttccgcttcattcagcacggcgatgcggacgtgatggtgtgtggcggtgcggaagcttgcatcagtccgctcgggattgccggattctgtcggctgcgagcgctcagcacggcgttcaacgacgaaccgacggcatcgtcccgaccgttcgacgagcgtcgcgatggctttgtgatgggcgaggggtcggccattttcgtgctggaagagctgcagcatgccctgcggcgaggagcaccaatctacggcgagatactcgggtatggattgtctggcgatgcgtcccatctgacggcaccgcgggaggatgggacgggagcgctgttggcgatgcagcgagcccttgccgatggtggcgtaacggttgccgatattgggtacgttaatgcacacgccacatcgaccccgatcggtgatgcgatagaagcccgtgcgataaggacacttttcggagagcacacacggtcgctggcggtttcgtcgacaaagggagcccatggtcatttgctcggtgcggccggcaacttggaagcgctgttcgtcgtgatggcctgcaggcatggtctgcttccacccaccgtcaatctgcagaacgtaacggacgatatggccgggctgcattacgtggcgaacagctccgaaccatgggaggggaagcaccgtcggcgggtggctttgaaaaactcgttcggttttggtggcaccaacgcttgtctctgcattggtgaatacagctag

SEQ ID NO: 19845 - protein, 444 aa, Anopheles gambiae str. PEST
MKSLPYVLRTIHHSHSKHTRDSGRRRVVVTGLGVVSPVGCNVEAAWQTILSGQSKVGRLVGETYDKLPCRVAATIDTNDIDLEKCFSKTELKTMARATAFALIAAKEALSRASWMPGVEDETACQRTGVAIGMGMVDLMDICETNEALKKGYNRVSPFFVPRILPNMPAGQLSIRYGFRGPNHAVSTACATGAHAIGDAFRFIQHGDADVMVCGGAEACISPLGIAGFCRLRALSTAFNDEPTASSRPFDERRDGFVMGEGSAIFVLEELQHALRRGAPIYGEILGYGLSGDASHLTAPREDGTGALLAMQRALADGGVTVADIGYVNAHATSTPIGDAIEARAIRTLFGEHTRSLAVSSTKGAHGHLLGAAGNLEALFVVMACRHGLLPPTVNLQNVTDDMAGLHYVANSSEPWEGKHRRRVALKNSFGFGGTNACLCIGEYS

SEQ ID NO: 19846 - DNA, 1524 bp, Oryza sativa (japonica cultivar-group)
  CDS (1)..(1524)
atggcggccgtggcggtgcccccgctctccgcgtggctcgtcgccgcgcgctcctcgacgcaggcggaatgcggcggcgccgacgagcaccaccaccaccaccatcagcagcagcaccagtgctgcgtcggcggcgggtccagcacggtgatgttcggcccgcgccgccgccgcttcctcggcggcggcgcgcggcggcgcggcgcggcgcgctctggaatggccatggctgttgccctgcagcctgaaaggagaactgttgaaaagaaacctgatgttaaacaaagaagggtggttatcactggcatgggtgtagtaacaccgttgggccatgatcctgatgtgttttacaacaaccttctggatggtgttagtggaataagcgagatagaaaggttcgactgctccacgtttccgacgagaattgcaggagagataaaatccttttctactgatggttgggttgctcctaagctagctaggcgaatggacaagttcatgctatatttgataactgctggaaagaaggcgttggaacatggtggtctcactgaagaactcaggaatgaattggataaaaccagatgcggtgttctcattggttctgcaatgggtggcatgaaggtttttaatgatgcgattgaagcattgagggtctcctacaagaaaatgaacccattttgtgtcccttttgcaactacaaatatgggctctgcaatacttgcaatggatctgggctggatggggccgaactattctatttccaccgcgtgtgctaccagtaatttctgtatcctcaatgcagcaaaccatatcagaagaggggaagctgatgttatgctctgtggtggttctgatgcaccactcatcccaattggattaggaggttttgtggcttgcagagcactttcacagagaaacagtgacccaactaaagcttcccggccatgggatgtggaccgtgacggttttgttatgggggaaggggcaggtgttcttgtgttggaagaacttgaacacgccaagcaaagaggtgcaaaaatatatgctgaatttctaggtggaagcttcacgtgtgatgcataccacatgactgagccacatcctgaaggaagagggattattctttgtatagaaaaggcactggctgattcaggagtagcaagggaagaaatcaactatgtcaatgctcacgcaacgtctacacagtcaggtgatttgaaggagtatgaagctattgtccgctgctttggccagaaccctcagctaagggtgaactcaacaaaatcaatgactggacatctaataggtgcagctggtggaatagaagctgttgctgctattcaagctataagaactggctgggtccatccgaatctgaatttggagaacccagagaaaatagtggatgtgggcgtgctggtcgggtcgcagaaggagagatgcaaagtgaatgtggcactgtcaaactcatttggatttggtgggcacaactcatcaattctgtttgcacccttcaagtga

SEQ ID NO: 19847 - protein, 507 aa, Oryza sativa (japonica cultivar-group)
MAAVAVPPLSAWLVAARSSTQAECGGADEHHHHHHQQQHQCCVGGGSSTVMFGPRRRRFLGGGARRRGAARSGMAMAVALQPERRTVEKKPDVKQRRVVITGMGVVTPLGHDPDVFYNNLLDGVSGISEIERFDCSTFPTRIAGEIKSFSTDGWVAPKLARRMDKFMLYLITAGKKALEHGGLTEELRNELDKTRCGVLIGSAMGGMKVFNDAIEALRVSYKKMNPFCVPFATTNMGSAILAMDLGWMGPNYSISTACATSNFCILNAANHIRRGEADVMLCGGSDAPLIPIGLGGFVACRALSQRNSDPTKASRPWDVDRDGFVMGEGAGVLVLEELEHAKQRGAKIYAEFLGGSFTCDAYHMTEPHPEGRGIILCIEKALADSGVAREEINYVNAHATSTQSGDLKEYEAIVRCFGQNPQLRVNSTKSMTGHLIGAAGGIEAVAAIQAIRTGWVHPNLNLENPEKIVDVGVLVGSQKERCKVNVALSNSFGFGGHNSSILFAPFK

SEQ ID NO: 19848 - DNA, 1245 bp, Anopheles gambiae str. PEST
  CDS (1)..(1245)
atggaattaaagagagtagtagtaactggcttcgggtcccttacaccgataggaaataatgcaaatgagtactgggagagccttgtaaaaggcacaagtggagcagcgccgattactctttttgattccactaattttaaaactcaatttgtcgaggttaaaaacttcgatccgttaaaccacttcgataagaaagaggctaaaaaaatggaccgtaactcgcaattagggcaggttgttgcacgtgaggcgattgctcacagtcgtattattgaggacaatgtagacaaagaccgtgtaggtgttatctggggatccggaattggcggacttgaaactttcgaaactgaagttttgggatacgctgcttcaaatagtatcccaagattcaaccctttctttattcctaaaatgatcgccgacattacaccggggaatatttctatagaatttggattccatggtcctaactataccacagtttcagcttgtgcttcttctgccaatgcaattattgatgctaaaatgcttattcagttaggcaaagcagatgttattgtttgcggaggatctgaagcagctgtaacagctagtggtgtaggtggcttcaatgctatgcatgcactttcaacaagaaatgacgatcctaaaacagcttcccgtccattcgacaaagacagagatggttttgtactgggtgaaggagcaggatgtatcattcttgaagaatacgaacacgctgtaaaaagaggcgctacaatttatgccgaactactgggcggaggtcttagtgcagatgctcaccacatgacagctccacatccggaaggattaggtgcttatttagtaatgaaaagatgtctggatgatgccggagttactactgatgaagtagaccacatcaacatgcatggtacttctactccattaggagacattgcggaatctcaggcaattgctaaattattaggtgaacacgcatttgatattcagatcaattctactaagtctatgacggggcatttattaggtgcagccggagttatagaatctatagcagctttaggcactattatccacggaattgttcctccaacgatcaatcatttcacagatgatgagagactggacagcagacttaactttactttcaacacagcagtgaagaaggaagtgaatattgcaatgagcaacacttttggaattggagggcataatgcctgcgttttattcaaaaagatttaa

SEQ ID NO: 19849 - protein, 414 aa, Anopheles gambiae str. PEST
MELKRVVVTGFGSLTPIGNNANEYWESLVKGTSGAAPITLFDSTNFKTQFVEVKNFDPLNHFDKKEAKKMDRNSQLGQVVAREAIAHSRIIEDNVDKDRVGVIWGSGIGGLETFETEVLGYAASNSIPRFNPFFIPKMIADITPGNISIEFGFHGPNYTTVSACASSANAIIDAKMLIQLGKADVIVCGGSEAAVTASGVGGFNAMHALSTRNDDPKTASRPFDKDRDGFVLGEGAGCIILEEYEHAVKRGATIYAELLGGGLSADAHHMTAPHPEGLGAYLVMKRCLDDAGVTTDEVDHINMHGTSTPLGDIAESQAIAKLLGEHAFDIQINSTKSMTGHLLGAAGVIESIAALGTIIHGIVPPTINHFTDDERLDSRLNFTFNTAVKKEVNIAMSNTFGIGGHNACVLFKKI

SEQ ID NO: 19850 - DNA, 1227 bp, Thermus thermophilus HB27
  CDS (1)..(1227): transl_table=11
atgcgacgcgtggtggtcaccggcctaggcgccctcacgcccatcggcgtggggcaggaggccttccacaaggcccagctcgcgggcaaaagcggggtcaggcccatcacccgctttgacgcctcggccctccccgtgcgcatcgccgccgaggtggacgtggaccccggggcctacctggaccggaaggagctcaggcgcctggaccgcttcgtccagtacgccctcatcgccgctcagcttgccctggaggacgcggggctaaagcccgaagaccttgaccccgagcgggtgggcaccctggtgggcacggggatcgggggcatggagacctgggaggcccaaagccgggtcttcctggagcggggcccaaaccgcataagccccttcttcatccccatgatgatcgccaacatggcctcggcccacatcgccatgcgctacggcttcaccgggccttcctccacggtggtcaccgcctgcgccacgggggcggacgccctgggaagcgccctgcgcatgatccagctcggcgaggccgacctcgtcctggcgggggggacggaggccgccatcacccccatggccatcggggccttcgccgtgatgcgggccctttccacaaggaacgaggagcccgagaaggcgagccgccccttcaccctctcccgggacgggttcgtcatgggggagggggccggggtcttggtcctggaggcgtacgagcacgcgaagaagcggggcgcccgcatctacgccgagctcgtgggcttcggccggagcgccgacgcccaccacatcaccgagccccaccccgagggaaagggcgccgccttggccatggcccgggccctgaaggacgcgggcatcgcccccgagcaggtgggctacatcaacgcccacggcacctccacccccgcgggggaccgggcggaggtgctggccatcaagcgggtcttcggggaccacgccaagaggctcatggtctccagcaccaagagcatgatcggccacctcctgggagcggcgggggcggtggaggccatcgccacggtccaggccctctaccacggggtcatccctcccacgatcaacctcgaggaccccgaccccgagctggacctggacttcgtccccgagccccgggaggccaaggtggactacgccctctccaactccttcgccttcgggggccacaacgccgtcctggtcttcaagagggtctga

SEQ ID NO: 19851 - protein, 408 aa, Thermus thermophilus HB27
MRRVVVTGLGALTPIGVGQEAFHKAQLAGKSGVRPITRFDASALPVRIAAEVDVDPGAYLDRKELRRLDRFVQYALIAAQLALEDAGLKPEDLDPERVGTLVGTGIGGMETWEAQSRVFLERGPNRISPFFIPMMIANMASAHIAMRYGFTGPSSTVVTACATGADALGSALRMIQLGEADLVLAGGTEAAITPMAIGAFAVMRALSTRNEEPEKASRPFTLSRDGFVMGEGAGVLVLEAYEHAKKRGARIYAELVGFGRSADAHHITEPHPEGKGAALAMARALKDAGIAPEQVGYINAHGTSTPAGDRAEVLAIKRVFGDHAKRLMVSSTKSMIGHLLGAAGAVEAIATVQALYHGVIPPTINLEDPDPELDLDFVPEPREAKVDYALSNSFAFGGHNAVLVFKRV

SEQ ID NO: 19852 - DNA, 1257 bp, Parachlamydia sp. UWE25
  CDS (1)..(1257): transl_table=11
ttgaggaaaatgagcaaaaaacgaattgtcattacaggaatgggtattgtttcatgttttggaaacgatgttgatgctttttatcaaaatcttttagccggtcagagtggtattcaacctatcacagaattcccatgtgaagattatccaacgcgatttgctggaattatccccaattttgaagctggtgagtatttagacaaaaagcaggctcgtcgagtggataaatcgattgcttatacgatggtagcaggaaaaaaatcactagaatcagctaatttaaatgaagaaaacttaaaaagacttcaaaaagaacggtgcggtattttgattggttctggaatgggaggaatgacaatgtttgctgatggagtgcaaacattagttgaaaaaggacctcgaaaagtatctcctttttttgttccttttattttgacaaatatgtgtggggcgttgctgggaatagatattggttttatgggccctaactattctatttcaacagcttgtgctaccgcaaataattcgattatttctgctgctcaacacatcagaaatggagaggctgatttgatgctgtgtggaggtgtagaagcggctgtgatgccgatgggattagcaggtttttgcgcatgtaaagccctttctcaacgaaacgaaaatccagctaaagcttctcgcccttgggatcagggaagagatggtttcgtccttggtgaaggagctggtgttcttgtgatggaaagtttagatcacgctttagctcgagaagcacctattttggctgagtatttaggaggtggattgtcgtgtgatgcttatcatatgacagagccacgttcagacggagagggtgttgctttatgtattcgcagagctttacaggatgcaggaatccaacccgaagagattaattatattaatgctcatgccacttctactcctgcgggagatatggctgaggttaatgccctaaaaaaagtttttaaaaacccttcttcgatcaaaatgaacgcaacaaaatcgatgataggtcacttgttaggcgctgcaggtggggtggaagcaattgcgacaattaaagcgattcttgaacatcaaattcatccaaccattaatttagaaaacccagaacctaatttagaatttgatgtttcatccgaggcgcaacgatttatcgtgaaacgtgcgatttctaattcgtttggctttggaggtcataatgcttctgttatttttgctccttatgaaccctag

SEQ ID NO: 19853 - protein, 418 aa, Parachlamydia sp. UWE25
MRKMSKKRIVITGMGIVSCFGNDVDAFYQNLLAGQSGIQPITEFPCEDYPTRFAGIIPNFEAGEYLDKKQARRVDKSIAYTMVAGKKSLESANLNEENLKRLQKERCGILIGSGMGGMTMFADGVQTLVEKGPRKVSPFFVPFILTNMCGALLGIDIGFMGPNYSISTACATANNSIISAAQHIRNGEADLMLCGGVEAAVMPMGLAGFCACKALSQRNENPAKASRPWDQGRDGFVLGEGAGVLVMESLDHALAREAPILAEYLGGGLSCDAYHMTEPRSDGEGVALCIRRALQDAGIQPEEINYINAHATSTPAGDMAEVNALKKVFKNPSSIKMNATKSMIGHLLGAAGGVEAIATIKAILEHQIHPTINLENPEPNLEFDVSSEAQRFIVKRAISNSFGFGGHNASVIFAPYEP

SEQ ID NO: 19854 - DNA, 1248 bp, Desulfovibrio vulgaris subsp. vulgaris str. Hildenborough
  CDS (1)..(1248): transl_table=11
atgaccggaaagcgcgttgtggtgacgggccttgcagccctcaccccccttggaaatgacatcgaaaccagctgggataaccttgttgccggcaagtccggcatcgggcccatcacccgcttcgacgccacagaatacgcctcgcgtatcgcaggcgaagtgaaggatttcgatcctgagaagttcatgcccgccaagcaggcacgacgcatggaccgcttcgtccagttcgccgttgccaccggcaagatgctcgtagagcattccggcctcgtcatcgacgagagcaacgccgaccgcgtgggcgtgcttctgggcgtggggcttggtggtctcgagaccatcgaggtcttccacaccaaactcatggaggcaggccccaacaaggtctcgccgttcatgatccccatgctcatctccaacatggcaccggggcaggtttcgatattcacaggagccagaggccccaacgtggtcatgacgagcgcatgcgcgtctgccacccatgccatcggctacgccttcagcgagatcaagctgggacgtatcgacgcagccatcaccggcggcgtcgaatcgaccatcacccccatgggtgtctcgggcttcaccgccctgaaggcactctccaccgcgcacaacgactcgcccgagaaggcgtcacgccccttcgacaaggaacgtgacggcttcgtcctcggcgagggaagcggcatgctgatgctcgaatcgctcgattcggccctggcgcgcggtgcgaccatctacgccgaggtcgtcggcttcggtgcgtcgggtgacgcctaccacatgaccgccccccacgaatcaggggatggcatggcgctcgcgatgcgcaatgccgtgagggaagcgggcatacctgtggaagccgtcgaccacatcaacgcccacgccacctcgacccacctcaacgacctgtgcgaaacccgcgccatcaagcaggtcttcggtcagcacgcctacaacatcgccatcacggccaacaagtcgatgacgggccatctgctgggcgcagcaggcggtttggaaagcgtgttcaccgtgctcaccctgcacaggggcatcattcccggcaccatcaaccatgagacgccggaccccgagtgcgacctgaactacatgacggaaggttcgaaggagatgcaggcccactatgcgctgtgcaactcgttcggcttcggcggcaccaacgccagccttctgttcaaacggtacgaagactag

SEQ ID NO: 19855 - protein, 415 aa, Desulfovibrio vulgaris subsp. vulgaris str. Hildenborough
MTGKRVVVTGLAALTPLGNDIETSWDNLVAGKSGIGPITRFDATEYASRIAGEVKDFDPEKFMPAKQARRMDRFVQFAVATGKMLVEHSGLVIDESNADRVGVLLGVGLGGLETIEVFHTKLMEAGPNKVSPFMIPMLISNMAPGQVSIFTGARGPNVVMTSACASATHAIGYAFSEIKLGRIDAAITGGVESTITPMGVSGFTALKALSTAHNDSPEKASRPFDKERDGFVLGEGSGMLMLESLDSALARGATIYAEVVGFGASGDAYHMTAPHESGDGMALAMRNAVREAGIPVEAVDHINAHATSTHLNDLCETRAIKQVFGQHAYNIAITANKSMTGHLLGAAGGLESVFTVLTLHRGIIPGTINHETPDPECDLNYMTEGSKEMQAHYALCNSFGFGGTNASLLFKRYED

SEQ ID NO: 19856 - DNA, 1242 bp, Listeria monocytogenes str. 4b F2365
  CDS (1)..(1242): transl_table=11
atggataagagaagagtagttgttactggtattggagctgttacacctattggaaatgatgcggaaacttcttgggaaaacgcaaaaaaaggtgttaatggtgttgcaaaaatgacaagacttaatccggatgactttccggttaaaattgcagcagaattaaaagattttgatgtagaaaaatatctagagaaaaaagaagctcgtaaaatggaccgttttacgcattatgcaattgcaagtgctgaaatggccgtgcaagactctggtttagttattgatgattccaatgcaaaccgagttggtgtttggattggttcaggaattggtggaatggaaactttcgaaacacaatatgaaattttcttaaatcgcggtcatcgccgagttagcccgtttttcgtacctatgatgattccagatatgggttcaggccaggtttctattcgttttggtgctaaaggcattaattctacaacagttacagcttgtgcaactgcaacaaactcaatcggcgacgcgtttaaagttattgagcgtggagatgctgatgcaatgattactggtggagcagaagcaccgattactaaaatgtcacttgctggttttactgctaataaagctttgtcattaaatccagatccagaaactgcatgccgtccgtttgataaagatcgtgatggttttattattggtgaaggcgcaggtatcgttattttagaagaatacgaacatgcaaaagcacgtggggcaaaaatttacgctgaaatcgttggttacggtgcaacaggagatgcttaccacattactgctccagctccaaacggtgaaggtgctgcgcgcgcaatgaaaatggcgattgatgatgctggccttacccctgataaagtagattacattaatgcccacggaacaagtacaccgtacaatgatgaatacgaaacacaagctattaaaactgtctttggagatcatgcgaaaaaattagcgattagttctactaagtcaatgactggacatactctaggtgcgtctggcggaatagaagctattttcgccctattgactattcgtgataatattattgcaccaacgattcatttgaaaaaccaagatgaagtttgtgacttggattatgttccaaatgaagcacgtgaggcaaatgtaaatgtagtaatttctaactcttttggctttggtggtcacaatgcgactttagtatttaaaagaatagaagactaa

SEQ ID NO: 19857 - protein, 413 aa, Listeria monocytogenes str. 4b F2365
MDKRRVVVTGIGAVTPIGNDAETSWENAKKGVNGVAKMTRLNPDDFPVKIAAELKDFDVEKYLEKKEARKMDRFTHYAIASAEMAVQDSGLVIDDSNANRVGVWIGSGIGGMETFETQYEIFLNRGHRRVSPFFVPMMIPDMGSGQVSIRFGAKGINSTTVTACATATNSIGDAFKVIERGDADAMITGGAEAPITKMSLAGFTANKALSLNPDPETACRPFDKDRDGFIIGEGAGIVILEEYEHAKARGAKIYAEIVGYGATGDAYHITAPAPNGEGAARAMKMAIDDAGLTPDKVDYINAHGTSTPYNDEYETQAIKTVFGDHAKKLAISSTKSMTGHTLGASGGIEAIFALLTIRDNIIAPTIHLKNQDEVCDLDYVPNEAREANVNVVISNSFGFGGHNATLVFKRIED

SEQ ID NO: 19858 - DNA, 1239 bp, Bacillus anthracis str. Sterne
  CDS (1)..(1239): transl_table=11
atggaaaaaaagagggtcgtaattacaggactaggagctgttacaccggtcggtacagatgttgaaacagcgtgggaaaacattaaaaagggtgtatctggaatcggacgacttacaagaattgatccggaactatttccagcaaaagtagcagcagaaattaacgactttgaagtcgagaaatatattgataaaaaagaagcgcgccgtatggatcgctttacacaatatgcagtagcagcagcgaaaatggcagttgcagatgcaaagcttgagattacagaagaaaacggacctcgaattggtgtatggattggttctggtattggcggtatggaaacatacgaagaacaatttaaaatttttactgagaaaggcccgcgccgcgtgagcccattcttcgtaccgatgatgattccagatatggcagcaggccaagtatcaatcgcaacaggagcaaaaggaattaacacttgttctgtaacggcttgtgcatctggtgcaaactcaattggtgatgcatttaaagcgattcagcgtggggatgctgatgcaatgattacgggcggggcagaggcaccgttaacaagtatggcattcgcaggatttagctcagcgaaagcattaacattcaatgaagacccagcaacagcttgccgtccatttgataaaaaccgtagcggtttcgtaatgggtgaaggttcaggtattttaattcttgaagaattagagcacgcattagctcgtggtgctcatatttatgcggaaatcgctggttacggtgcaactggtgatgcattccatattacaatgcctgctcctggcggtgaaggcggcgtgcgcgcaatgcgtcaagctttagcggatgcaggtctacagccagaagatattgattacattaatgcgcatggtacaagtacggatgcgaatgaaaagtatgaaacgatggcaattaaagaaacgttcggtgagcacgcgtataaggtagcgatcagctcaacgaaatcaatgacaggtcacttattaggagcagcaggtgctgttgaagcgatcttctctattaaatcaattacagatggagtaattcctccaacaattaactatgaaacaccagatccagaatgtgacttagattacgtaccaaataacgcgagacatcaagaagtaaacgcagtgttaagtaattcattaggattcggtggtcataacgcagtattagtatttaaatcgtataaataa

SEQ ID NO: 19859 - protein, 412 aa, Bacillus anthracis str. Sterne
MEKKRVVITGLGAVTPVGTDVETAWENIKKGVSGIGRLTRIDPELFPAKVAAEINDFEVEKYIDKKEARRMDRFTQYAVAAAKMAVADAKLEITEENGPRIGVWIGSGIGGMETYEEQFKIFTEKGPRRVSPFFVPMMIPDMAAGQVSIATGAKGINTCSVTACASGANSIGDAFKAIQRGDADAMITGGAEAPLTSMAFAGFSSAKALTFNEDPATACRPFDKNRSGFVMGEGSGILILEELEHALARGAHIYAEIAGYGATGDAFHITMPAPGGEGGVRAMRQALADAGLQPEDIDYINAHGTSTDANEKYETMAIKETFGEHAYKVAISSTKSMTGHLLGAAGAVEAIFSIKSITDGVIPPTINYETPDPECDLDYVPNNARHQEVNAVLSNSLGFGGHNAVLVFKSYK

SEQ ID NO: 19860 - DNA, 1263 bp, Bartonella quintana str. Toulouse
  CDS (1)..(1263): transl_table=11
atgagacgtgttgttgttactggtttaggattggtttctccattagctgctaatgtcgaatatagttggaaacgccttcttgaaagggaaagtggtgttcgacgcattactgaattcgatgtatcggatttaccgtgccagattgctgcgcgtatccccttaggggatggaacaaatggtacatataatgctgatttgcatatggaacccaaggagcagcgtaaggttgatgcatttattgtttatgcaatggctgctgttgaccaagcacttgcagatgctgagtggtttcctaagagtgatgaagatcagatttccacaggtgtgttaattggttcgggtattggtggcattgaaggcattgttgaggcaggttatacgcttcgtgataaaggtccacgacgtgtttctcctttttttattccagggcgtttgattaatcttgcttctggctatgtgtctattaaatatgatttgcgcggccctaatcattcggttgtaacggcttgttcgacaggtgcgcatgccattggtgatgcagcacgtttgattgcgctcggtgatgcagatgtaatgctagcaggtggcactgaatctccgataaatcgaatatctcttgctggttttgctgcttgtagagctctttctacttgtcgtaatgatgatcctgaacgggcgtcacgcccttatgacgttgatcgtgatggttttgtgatgggtgagggagcggcgattgttgttttagaagagcttgaacatgcaaaaagacggggtgcacgtatttatgctgagctgataggttatggcttatcgggtgatgcttaccacattacagcaccttcagagagtggcgaaggtgcgcagcgtagtatgatggctgctctcaagcgtgcacaagtgaatgtgagtgaacttgattacattaatgcccacggtacatcgacgatggctgatgttatagagttggcagctgttgagcgtgttttgggccactatgcagcacaagtgtccatgtcatcaacaaagtcatctgtggggcatttgcttggtgccgcaggtgcagctgaggctattttttgtattttagccatacgagataatatagctccggcgacactcaatcttgataatccatcgattgaaacaaaaatcgatcttgtcccacacaaaccacgcgaacgaaagattgatacgattctttccaattcctttgggtttggtggaacaaatgcatctttagtgatgcgacgtttcaggggataa

SEQ ID NO: 19861 - protein, 420 aa, Bartonella quintana str. Toulouse
MRRVVVTGLGLVSPLAANVEYSWKRLLERESGVRRITEFDVSDLPCQIAARIPLGDGTNGTYNADLHMEPKEQRKVDAFIVYAMAAVDQALADAEWFPKSDEDQISTGVLIGSGIGGIEGIVEAGYTLRDKGPRRVSPFFIPGRLINLASGYVSIKYDLRGPNHSVVTACSTGAHAIGDAARLIALGDADVMLAGGTESPINRISLAGFAACRALSTCRNDDPERASRPYDVDRDGFVMGEGAAIVVLEELEHAKRRGARIYAELIGYGLSGDAYHITAPSESGEGAQRSMMAALKRAQVNVSELDYINAHGTSTMADVIELAAVERVLGHYAAQVSMSSTKSSVGHLLGAAGAAEAIFCILAIRDNIAPATLNLDNPSIETKIDLVPHKPRERKIDTILSNSFGFGGTNASLVMRRFRG

SEQ ID NO: 19862 - DNA, 1263 bp, Bartonella henselae str. Houston-1
  CDS (1)..(1263): transl_table=11
atgaggcgtgttgttattactggtttaggattggtatctccattagctggtgatgtcgagtatagttggaaacgacttcttgaaggaaaaagtggtgttcgacgcattactgaatttgatgtatccgacttatcgtgccagattgctgcgcgtatccccgtaggggatggtacaaatggtacatataatgctgatttgcatatggaatccaaggagcagcgtaaggttgatgcatttattgtttatgcaattgcagccgctgaccaagcacttgcagatgctgagtggtttcccaagagtgatgaagaccagatttgcacaggtgtgttaattggttcgggtattggtggcattgaagggattgttgaggctggttatacgcttcgtgataaaggtccacggcgtatttctcctttttttattccaggacgtttgattaatcttgcttctggttatgtatctattaaatatggtttgcgtggtcctaatcattcggttgtaacggcctgttcaacaggtgcacatgccattggtgatgcagcacgtttgattgcgttgggtgatgcagatgtgatgctagcaggtggcactgaatccccgataaatcgaatatctcttgctggtttttctgcttgtcgagctctttctacttgtcgtaatgatgatcctgaacgggcatcacgtccttatgatgttgatcgtgatggttttgtgatgggggaaggagcagcgattgttgttttagaagagcttgaacatgcaaaaaaacgaggtgctcgtatttatgctgagattattggctatggtctatctggtgacgcttaccacattacagcaccttcagagagtggtgaaggtgcgcagcgtagtatgatggctgctcttaagcgtgcacaagtgaatgtaagcgaacttgattacattaatgctcacggtacatcgacgatggctgatgttatagaattggctgctgttgagcgtgttttgggctattatgcaccacaagtatccatgtcatcaacaaagtcatctataggacatttacttggtgcagctggtgcagctgaggctattttttgtgttttagctatacgagataatatagctccagcaacacttaatcttgaaaatccatcaattgaaacgaaaattgaccttgttccacataaaccgcgcgagcgaaaaattgatacagttctatccaattcttttggatttggtggaacaaatgcgtctttagtgatgcggcgtttttcggaataa

SEQ ID NO: 19863 - protein, 420 aa, Bartonella henselae str. Houston-1
MRRVVITGLGLVSPLAGDVEYSWKRLLEGKSGVRRITEFDVSDLSCQIAARIPVGDGTNGTYNADLHMESKEQRKVDAFIVYAIAAADQALADAEWFPKSDEDQICTGVLIGSGIGGIEGIVEAGYTLRDKGPRRISPFFIPGRLINLASGYVSIKYGLRGPNHSVVTACSTGAHAIGDAARLIALGDADVMLAGGTESPINRISLAGFSACRALSTCRNDDPERASRPYDVDRDGFVMGEGAAIVVLEELEHAKKRGARIYAEIIGYGLSGDAYHITAPSESGEGAQRSMMAALKRAQVNVSELDYINAHGTSTMADVIELAAVERVLGYYAPQVSMSSTKSSIGHLLGAAGAAEAIFCVLAIRDNIAPATLNLENPSIETKIDLVPHKPRERKIDTVLSNSFGFGGTNASLVMRRFSE

SEQ ID NO: 19864 - DNA, 1245 bp, Staphylococcus aureus subsp. aureus MRSA252
  CDS (1)..(1245): transl_table=11
atgagtcaaaatataagagtagttattacaggtatgggagccctttctccaatcggtaatgatgtcaaaacaacatgggagaatgctctaaaaggcgtaaatggtatcgataaaattacacgtatcgatactgaaccttatagcgttcacttagcaggagaacttaaaaactttaatattgaagatcatatcgacaaaaaagaagcgcgtcgtatggatagatttactcaatatgcaattgtagcagctagagaggctgttaaagatgcgcaattagatatcaatgaaaatactgcagatcgaatcggtgtatggattggttctggtatcggtggaatggaaacatttgaaattgcacataaacaattaatggataaaggcccaagacgtgtgagtccatttttcgtaccaatgttaattcctgatatggcaactggacaagtatcaattgacttaggtgcaaaaggaccaaatggtgcaacagttacagcatgtgcaacaggtactaactctatcggtgaagcatttaaaattgtgcaacgcggtgatgcagatgcaatgattactggcggtacggaagctccaattactcatatggcaattgcaggtttcagtgcaagtcgagcgctttctacaaatgatgacattgaaacagcatgtcgtccattccaagaaggtagagacggttttgttatgggtgaaggtgctggtattttagtaatcgaatctttagaatcagcacaagctcgaggtgcaaatatttatgctgagatagttggctatggtactacaggtgatgcttatcatattacagcgccagctccagaaggtgaaggcggttctagagcaatgcaagcagctatggatgatgctggtattgaacctaaagatgtacaatacttaaatgcccatggtacaagtactcctgttggtgacttaaatgaagttaaagctattaaaaatacatttggtgaagcagctaaacacttaaaagttagctcaacaaaatcaatgactggtcacttacttggtgcaacaggtggaattgaagcaatcttctcagcgctttcaattaaagactctaaagtcgcacctacaattcatgcggtaacaccagacccagaatgtgatttggatattgttccaaatgaagcgcaagaccttgatattacttatgcaatgagtaatagcttaggattcggtggacataacgcagtattagtattcaagaaatttgaagcataa

SEQ ID NO: 19865 - protein, 414 aa, Staphylococcus aureus subsp. aureus MRSA252
MSQNIRVVITGMGALSPIGNDVKTTWENALKGVNGIDKITRIDTEPYSVHLAGELKNFNIEDHIDKKEARRMDRFTQYAIVAAREAVKDAQLDINENTADRIGVWIGSGIGGMETFEIAHKQLMDKGPRRVSPFFVPMLIPDMATGQVSIDLGAKGPNGATVTACATGTNSIGEAFKIVQRGDADAMITGGTEAPITHMAIAGFSASRALSTNDDIETACRPFQEGRDGFVMGEGAGILVIESLESAQARGANIYAEIVGYGTTGDAYHITAPAPEGEGGSRAMQAAMDDAGIEPKDVQYLNAHGTSTPVGDLNEVKAIKNTFGEAAKHLKVSSTKSMTGHLLGATGGIEAIFSALSIKDSKVAPTIHAVTPDPECDLDIVPNEAQDLDITYAMSNSLGFGGHNAVLVFKKFEA

SEQ ID NO: 19866 - DNA, 1245 bp, Staphylococcus aureus subsp. aureus MSSA476
  CDS (1)..(1245): transl_table=11
atgagtcaaaataaaagagtagttattacaggtatgggagccctttctccaatcggtaatgatgtcaaaacaacatgggagaatgctctaaaaggcgtaaatggtatcgataaaattacacgtatcgatactgaaccttatagcgttcacttagcaggagaacttaaaaactttaatattgaagatcatatcgacaaaaaagaagcgcgtcgtatggatagatttactcaatatgcaattgtagcagctagagaggctgttaaagatgcgcaattagatatcaatgaaaatactgcagatcgaatcggtgtatggattggttctggtatcggtggtatggaaacatttgaaattgcacataaacaattaatggataaaggcccaagacgtgtgagtccatttttcgtaccaatgttaattcctgatatggcaactgggcaagtatcaattgacttaggtgcaaaaggaccaaatggtgcaacagttacagcatgtgcaacaggtacaaattcaatcggagaagcatttaaaattgtgcaacgcggtgatgcagatgcaatgattactggtggtacagaagcaccaattactcatatggcaattgctggtttcagtgcaagtcgagcgctttctacaaatgatgacattgaaacagcatgtcgtccattccaagaaggtagagatggttttgttatgggtgaaggtgctggtattttagtaattgaatctttagaatcagcacaagctcgaggtgccaatatttatgctgagatagttggctatggtactacaggtgatgcttatcatattacagcgccagctccagaaggtgaaggcggttctagagcaatgcaagcagctatggatgatgctggtattgaacctaaagatgtacaatacttaaatgcccatggtacaagtactcctgttggtgacttaaatgaagttaaagctattaaaaatacatttggtgaagcagctaaacacttaaaagttagctcaacaaaatcaatgactggtcacttacttggtgcaacaggtggaattgaagcaatcttctcagcgctttcaattaaagactctaaagtcgcaccgacaattcatgcggtaacaccagatccagaatgtgatttggatattgttccaaatgaagcgcaagaccttgatattacttatgcaatgagtaatagcttaggattcggtggacataacgcagtattagtattcaagaaatttgaagcataa

SEQ ID NO: 19867 - protein, 414 aa, Staphylococcus aureus subsp. aureus MSSA476
MSQNKRVVITGMGALSPIGNDVKTTWENALKGVNGIDKITRIDTEPYSVHLAGELKNFNIEDHIDKKEARRMDRFTQYAIVAAREAVKDAQLDINENTADRIGVWIGSGIGGMETFEIAHKQLMDKGPRRVSPFFVPMLIPDMATGQVSIDLGAKGPNGATVTACATGTNSIGEAFKIVQRGDADAMITGGTEAPITHMAIAGFSASRALSTNDDIETACRPFQEGRDGFVMGEGAGILVIESLESAQARGANIYAEIVGYGTTGDAYHITAPAPEGEGGSRAMQAAMDDAGIEPKDVQYLNAHGTSTPVGDLNEVKAIKNTFGEAAKHLKVSSTKSMTGHLLGATGGIEAIFSALSIKDSKVAPTIHAVTPDPECDLDIVPNEAQDLDITYAMSNSLGFGGHNAVLVFKKFEA

SEQ ID NO: 19868 - DNA, 1242 bp, Erwinia carotovora subsp. atroseptica SCRI1043
  CDS (1)..(1242): transl_table=11
gtgtctaagcgtcgagtagttgtgaccggactgggcatgttatctcctgtcggcaatacagttgagtctacctggagtgctcttcttgccggtcagagtggtatcagcctgatcgaccatttcgatactagtgcctacgcaacgcgttttgctggcttagtaaagaattttaattctgaggaattcatttcgcgtaaagaagcacgcaaaatggatgcctttattcaatatggtgttgctgctggcgttcaggctatgcaggactccggtttggaagtaacggaagaaaacgctccgcgtatcggtgcggcgattggttccggcatcggcggtctgggtcttattgaagagaaccacactgcgctggtgaacggtggcacgcgtaaaatcagcccgttcttcgtaccgtcaaccatcgtcaatatggtggctgggcatcttactatcatgttcggactgcgtggccccagcatttctatcgctactgcctgtacgtctggcgtgcataatattggccatgccgcacgtatcattgcctacaacgatgcggatgtgatgttggccggtggtgcagaaaaagccagtacgccattaggcgtcggtggattcggtgccgctcgtgcattgtctacgcgcaatgacgatcctcaggcggcaagccgtccgtgggataaagatcgtgatggttttgtactgggcgacggcgctggcctcatggtgctggaagagtatgaacacgcgaaaaagcgcggtgcgaaaatctatgcagaaattgttggatttggcatgagcagcgatgcgtatcatatgacgtctccgccggaggacggttcaggcgccgcgctggcgatggagaacgcactgcgtgatgctggtgtatcaacgagccagatcggttatatcaacgcgcatggcacttctacgcctgcgggtgataaagctgaaacacaggccgtgaaatccgtgtttggtgcggacgccagtcgtgtactggttagctcgacaaaatccatgacgggtcacttgttgggtgcagcaggcgcggtggagtcaatcttcagtattcttgctctgcgcgatcaggctgttccgccaacgctcaacctggataatccagatgaaggctgcgatctggattttgtgccgcatgaggcgcgtcaggtcagcaatctggaatacgtactctgcaactctttcggtttcggtggaaccaacggttctctgatcttccgtaaagtttga

SEQ ID NO: 19869 - protein, 413 aa, Erwinia carotovora subsp. atroseptica SCRI1043
MSKRRVVVTGLGMLSPVGNTVESTWSALLAGQSGISLIDHFDTSAYATRFAGLVKNFNSEEFISRKEARKMDAFIQYGVAAGVQAMQDSGLEVTEENAPRIGAAIGSGIGGLGLIEENHTALVNGGTRKISPFFVPSTIVNMVAGHLTIMFGLRGPSISIATACTSGVHNIGHAARIIAYNDADVMLAGGAEKASTPLGVGGFGAARALSTRNDDPQAASRPWDKDRDGFVLGDGAGLMVLEEYEHAKKRGAKIYAEIVGFGMSSDAYHMTSPPEDGSGAALAMENALRDAGVSTSQIGYINAHGTSTPAGDKAETQAVKSVFGADASRVLVSSTKSMTGHLLGAAGAVESIFSILALRDQAVPPTLNLDNPDEGCDLDFVPHEARQVSNLEYVLCNSFGFGGTNGSLIFRKV

SEQ ID NO: 19870 - DNA, 1290 bp, Erwinia carotovora subsp. atroseptica SCRI1043
  CDS (1)..(1290): transl_table=11
atgacgctaacaagtcataagcgaatagtggtaaccggctgcggcattatcagtcctctggggtgcggtacagatatagtctggcgcaggctgctggaggggcgatcgggcataagaacgcttcctgctgatatcagcgacggcacgggtatttccgtagcagggcaggtccctgggctttcggatgaccctgaagcaggttatgaaccagagcgttttataccggccaaagagcgcaagaaaatggatcgcttcatagaatttgcccttatcgccgctcaggaggctgtgacgcaggcaggctggcacccagctaatgaacacgagcggcagcggacggcgacaattatcgcatcgggagtggggggatttggtgccattgctgaagcggttcgcactaccgatacgcgcggtccccgacggttgtcaccattcaccgcgccctcatttctggccaatatggcagcaggccaagtctcgatccagcagggtttcaggggaccattgggcgcgcccattacagcatgtgcagctggtgtgcaggcgattggtgatgcggcccgccttatcagaaacggagaagcggacattgccatttgtggtggcacagaagccgctattgatcgtgtcacgctaggctgctttgctgctgcacgtgcgctttctaccggatttgcagataagccagaagaagcatcgcggccttttgatcgtgatcgagacgggtttgttatggcggaaggtgctggattattagtgattgaatcccttgagcatgcattggctcgtggtgctacgccactggcagaattagtgggatatggcaccagtgccgatgcatggcatctgaccgctgggccagaagacggtagcggtgcccgacgggcgatggaattggctttaggccaggctgggatcaatgcggatgagatacaacacatcaatgcccatgcgacatcgactcaggtaggtgacagaggggaactggcggcgattcggtcagtgtttggtagtgaatcaggcgtggcagtcagttcgaccaaatcagctaccggccatcttctgggcgcggcaggtggcattgaagcgatatttactgtgcttgccctgcgtgaccaggttattccgcccacgctaaacctgcgtaacccggacgaggcaggacgcggcttggatcttgtcgcgttaaaggcacgttacgctacgataacgtatgccttatccaacggtttcggtttcggcggcgttaatgcaagtgtgctttttcgccgatgggagacgacgccatga

SEQ ID NO: 19871 - protein, 429 aa, Erwinia carotovora subsp. atroseptica SCRI1043
MTLTSHKRIVVTGCGIISPLGCGTDIVWRRLLEGRSGIRTLPADISDGTGISVAGQVPGLSDDPEAGYEPERFIPAKERKKMDRFIEFALIAAQEAVTQAGWHPANEHERQRTATIIASGVGGFGAIAEAVRTTDTRGPRRLSPFTAPSFLANMAAGQVSIQQGFRGPLGAPITACAAGVQAIGDAARLIRNGEADIAICGGTEAAIDRVTLGCFAAARALSTGFADKPEEASRPFDRDRDGFVMAEGAGLLVIESLEHALARGATPLAELVGYGTSADAWHLTAGPEDGSGARRAMELALGQAGINADEIQHINAHATSTQVGDRGELAAIRSVFGSESGVAVSSTKSATGHLLGAAGGIEAIFTVLALRDQVIPPTLNLRNPDEAGRGLDLVALKARYATITYALSNGFGFGGVNASVLFRRWETTP

SEQ ID NO: 19872 - DNA, 1272 bp, Propionibacterium acnes KPA171202
  CDS (1)..(1272): transl_table=11
atgagcgacgtcgtcatcactggtttcgggaccaccacaccgttgggacccgacgcccctagcacctggcaggggctgctggaagggcgaaacggggtacacaccctcgacttcgactggattgacgacgttcccgtcaaattcgccgcaccggcggtcgatgatccggccaaccacctgccccgtccacaggctcgccgtctagaccgctcaagccagctggcccttgtcgctgccaaggaggcctgggccgacgccggcctggagcttcccgaagccgacgacaactccggttccaacggcatcgaccccgaacgcttggtggtgtgctgcgctaccggtattggtggcctgcactctttgctcggccagtgggacattcagaaagacaagggcttcaaacgggttagtccctttaccgtcccgatgctaatggccaatgcaccggcggccaatattggcttgatggtgcatgccaaggccggcgtccatacccccgtttcggcttgcgcttcatcttccgaagcaatctcgctcggcctggatcagcttcatctggggcgagccgatattgccgtcgtcggcggcgccgaggccatcatccatccgttgccggtggccgctttcgcccaaatgaaagccttgtcgactcgcaacgacgatcctgagcacgcttcacgtccatgggacgttgatcgtgacggcttcgtcatcggcgagggagcggcgatcatggtcattgagacactcgagcatgctcaagcccgcggggcaaagatctacggcactcttgccggatccggtatttcggctgattcgcacgatatcgttcagccagatcccactggttccggccaggcatccgcgatgcacaaggctcttgcatccgccgggctatccccctccgacgtcaaccacgtcaacgcccacgccacctcgaccccactcggtgacactgcggaggcccactccatcgccgcggtcctagagaaagccactgaccaggtgcttgtcaacggcaccaagtcgatgacgggacacctgttaggtggagctggggctttggaatccttcgcagcggtgatggccctactgaagcgtcaggtgcctggcaccatcaacgtcgaacacctcgaagagggcttggaaatcaacgtcgtcaccgagacgaccgacctacccgacggtgatctggctgctcttaataactctttcgggttcggagggcacaacgtcaccttggcgttcactaacaccaacgccactcgctga

SEQ ID NO: 19873 - protein, 423 aa, Propionibacterium acnes KPA171202
MSDVVITGFGTTTPLGPDAPSTWQGLLEGRNGVHTLDFDWIDDVPVKFAAPAVDDPANHLPRPQARRLDRSSQLALVAAKEAWADAGLELPEADDNSGSNGIDPERLVVCCATGIGGLHSLLGQWDIQKDKGFKRVSPFTVPMLMANAPAANIGLMVHAKAGVHTPVSACASSSEAISLGLDQLHLGRADIAVVGGAEAIIHPLPVAAFAQMKALSTRNDDPEHASRPWDVDRDGFVIGEGAAIMVIETLEHAQARGAKIYGTLAGSGISADSHDIVQPDPTGSGQASAMHKALASAGLSPSDVNHVNAHATSTPLGDTAEAHSIAAVLEKATDQVLVNGTKSMTGHLLGGAGALESFAAVMALLKRQVPGTINVEHLEEGLEINVVTETTDLPDGDLAALNNSFGFGGHNVTLAFTNTNATR

SEQ ID NO: 19874 - DNA, 1233 bp, Streptococcus pyogenes MGAS10394
  CDS (1)..(1233): transl_table=11
atgacatttaaaagagtagtggtaacaggttatggtctaacatctccaatcgggcatgatcctgaaacgttttggaacaatctgaaagctggccaaattggtattggtcctattactaaatttgacacgactgattatgcagtcaagaatgctgctgaaattcaggattttccatttgacaaatactttgtgaaaaaagatttgaaccgtttcgatagatattctctttatgctctttatgcagcgaaagaggctattaatcatgctgatttaaatattgagatgattgattccgatcgatttggcgttattgttgcttcaggtattggtggaattgcggagattgaagagcaggtgattcgcttacatgaaaaagggccaaaacgtgtgaagccaatgacgttgccaaaagcgctaccaaatatggctgcaggaaatgtcgccatgtctttaaaagctcaaggagtatgtaaatcaattaatactgcctgcgcttcttcaaatgatgcgattggggatgcctttcgtgccattaaatttgggactcaagatgtgatgatagttggtgggtcagaggcggccataaccaagtttgccattgctggcttccaaagtttaacagctctctcaacaactgaagatccaagcagaagctctattccatttgataaagaccgaaatggttttatcatgggagaaggatcaggaatgcttgttttagaaagcctagaacatgcgcaagaacgcggggcgacaatcttagcagaaattgtgggttatggaaatacctgcgatgcctaccatatgacatctccaaatcctgagggattaggagctcgtaaagccatccacttagccttacaagaagctggtattgaagccagtgctattaattatgtcaatgcgcacggaacttcaaccccagctaatgaaaaaggagaaagtcaagcaattgtagccgttcttggtaaggatgttccggtgtcttcaacaaaatcgtttacgggtcaccttcttggagcagcaggcgctattgaagctattgccactatcgaggctatgcgtcataactatgttccgatgacggctgggacacaagctttatcagaggatatcgaagcaaatgtcatctttggagaaggaaaagaaacagctatcaactatgccatttcaaatacttttggatttggtggtcataatgctgtattagctttcaaatgttgggaggagtag

SEQ ID NO: 19875 - protein, 410 aa, Streptococcus pyogenes MGAS10394
MTFKRVVVTGYGLTSPIGHDPETFWNNLKAGQIGIGPITKFDTTDYAVKNAAEIQDFPFDKYFVKKDLNRFDRYSLYALYAAKEAINHADLNIEMIDSDRFGVIVASGIGGIAEIEEQVIRLHEKGPKRVKPMTLPKALPNMAAGNVAMSLKAQGVCKSINTACASSNDAIGDAFRAIKFGTQDVMIVGGSEAAITKFAIAGFQSLTALSTTEDPSRSSIPFDKDRNGFIMGEGSGMLVLESLEHAQERGATILAEIVGYGNTCDAYHMTSPNPEGLGARKAIHLALQEAGIEASAINYVNAHGTSTPANEKGESQAIVAVLGKDVPVSSTKSFTGHLLGAAGAIEAIATIEAMRHNYVPMTAGTQALSEDIEANVIFGEGKETAINYAISNTFGFGGHNAVLAFKCWEE

SEQ ID NO: 19876 - DNA, 1263 bp, Leifsonia xyli subsp. xyli str. CTCB07
  CDS (1)..(1263): transl_table=11
atgttcctactacacggagttgccgttatgaccaagaagatcgtgatcaccgggctcggagcgtcctcgccgctcggtggcaccgctccggaaagctgggccgcgctgctggccggcgagtccggagcccgttcgctcacccacgactgggtcaccgagctggaactgccgatcaccttcgccgccgaagccaaggtacggccgtccgccgtgctcgagcgcccggtcgcgaagcggctggacccttccagccagtttgcgctggtctccgcgatggaggcctgggccgatgcgggctccccccgggtggccccggaacgcctcggcgtcgactacgccacgggcatcggcggcgtgtggaccctgctggacgcctgggacacgctgcgcgagcgcgggccacgccgtgttctgccgatgaccgtcccgatgctcatgccgaatgcggccgcagccgccgtctccatgcacttcgaggcgcgcgcgttcgcccgcaccgtcgcttccgcctgcgcgtcgagcaccgagtcgctcgtcaacgcttacgagcacttgcaggccgggctggccgacatcgtgatcaccggcggcagcgagtcggccatccacccgatcacgctcgcgtcgttcgcctccatgcaggccctctcgcgccgcaacgacgaccccgccaccgcttcccggccctatagtatcgaccgggacggcttcgtgatgggcgagggcgcggcgagcctcgtgctcgagaccgagaagcatgcgttcgcccgcggcgcccgtatctacgcggaagtcgtcggcggcggtgtaacggcggattcgtaccacatcaccgcgaacgaccccgagggccgcggcgccagccgggctgtgcggatggcgctggagcaggcgggcgcctcgcccgatgaggtgacgcacatcaatgcgcacgcgacgagcacgccggtcggcgacccgtcggagtatgtggctctgcgcgaggtcttcggcgaccgcgtccacagtgtcccggtctccgccaccaaagcgtcaacgggccatttgctcggcggaaccggtgcgctggaagctgtgttcaccgtcctcgcgctgcgcgatcgcatcgccccgccgacgatcaacatcacggagatggacccggccatcccgttgcaggtctcgggcgagtcccagccgctcggcaacggtccgcagctcgccatcagcaactcgttcggcttcggcggccacaacgccgtcgtcgccatccgctcggtctga

SEQ ID NO: 19877 - protein, 420 aa, Leifsonia xyli subsp. xyli str. CTCB07
MFLLHGVAVMTKKIVITGLGASSPLGGTAPESWAALLAGESGARSLTHDWVTELELPITFAAEAKVRPSAVLERPVAKRLDPSSQFALVSAMEAWADAGSPRVAPERLGVDYATGIGGVWTLLDAWDTLRERGPRRVLPMTVPMLMPNAAAAAVSMHFEARAFARTVASACASSTESLVNAYEHLQAGLADIVITGGSESAIHPITLASFASMQALSRRNDDPATASRPYSIDRDGFVMGEGAASLVLETEKHAFARGARIYAEVVGGGVTADSYHITANDPEGRGASRAVRMALEQAGASPDEVTHINAHATSTPVGDPSEYVALREVFGDRVHSVPVSATKASTGHLLGGTGALEAVFTVLALRDRIAPPTINITEMDPAIPLQVSGESQPLGNGPQLAISNSFGFGGHNAVVAIRSV

SEQ ID NO: 19878 - DNA, 1245 bp, Desulfotalea psychrophila LSv54
  CDS (1)..(1245): transl_table=11
gtgaagcgtagagttgttgtcaccggtgtgggtcttgttacgcctcttggtacgggggttgagaaaacctgggaaaatttgtgtgcaggaaagagtggtattgatactattacgcgttttgatacgagtgactttgccgttaaaattgctgctgaagtaaaagatttccaggcagaagatttttttgataaaaaatcagccaaacatatggatctttttgctcaatatggtgtggcagctgctgttatggccctgaaagacagtggctttgagataactgaggaaaattgtgagcgggtaggtgttattaccggttgtggtatgggaagtttgcctatgattgaaaaatatcatcaggtgtttatggagaagggaccgcgtaaaatttctccattttttatccccatggccatccctaatatgccttcaggccatatatctatgcgaattggggctaaagggccaaatcttgctctgaccacagcctgtgcggctggaactcatgccgtgggtgaagcctttaatgcggtgagctcaggtaagtgccttgctattgttgctggtggaactgaatccgttatctgtcctacagggattggggggtttaccgcccttaaggctctgtcgaccagaaatgatgatcctgctgcttcctcccgtccctttgacaaggaccgtgatggttttgttatggcagagggtgcaggaatgcttatcctcgaagattatgaacacgccattgccagaggtgctcggatttatgctgagatggcgggttatggtttgagcagtgatgcatatcatataacagcccctccggaagatggagagggtggcgctcgggcaatgaagatggccattgaagatgcaggttttcagccagaggatattgattatatcaatgcccatggtacatcgactcccctgaatgatcgttgtgaaactcgggcaataaagagtgtttttggagaacatgcgtataagcttgccattagttcgacaaaatcaatgcttggccatatgcttggggcaacaggtggtgttgaagctgtcttgacagctctgagccttgataagcaatttgttttgccaacgattaatttgcaggagccaagtcctgagtgtgacttggattatactcctaatgttggtcgttcgatgaagatgcgtgccgcaatctccaactcttttggttttggtggtaccaatgctgttgtggcaatgaagcagtatattggtgagtag

SEQ ID NO: 19879 - protein, 414 aa, Desulfotalea psychrophila LSv54
MKRRVVVTGVGLVTPLGTGVEKTWENLCAGKSGIDTITRFDTSDFAVKIAAEVKDFQAEDFFDKKSAKHMDLFAQYGVAAAVMALKDSGFEITEENCERVGVITGCGMGSLPMIEKYHQVFMEKGPRKISPFFIPMAIPNMPSGHISMRIGAKGPNLALTTACAAGTHAVGEAFNAVSSGKCLAIVAGGTESVICPTGIGGFTALKALSTRNDDPAASSRPFDKDRDGFVMAEGAGMLILEDYEHAIARGARIYAEMAGYGLSSDAYHITAPPEDGEGGARAMKMAIEDAGFQPEDIDYINAHGTSTPLNDRCETRAIKSVFGEHAYKLAISSTKSMLGHMLGATGGVEAVLTALSLDKQFVLPTINLQEPSPECDLDYTPNVGRSMKMRAAISNSFGFGGTNAVVAMKQYIGE

SEQ ID NO: 19880 - DNA, 1281 bp, Rickettsia typhi str. Wilmington
  CDS (1)..(1281): transl_table=11
atgtcaaatcaaaacataaataaaagagtagttattactgggcttggacttgttactcctgttgggcttaatgttaactcatcttggaaaaatattgtagatggagtaagtggtataaaaactattacagaatttgacacttctaaacttgcgtgtaaaattgctggagttatagatatttctgagcacgatggatttaaactagaaaattttacacaagcagatgatattaatagactaagtaaaatggataaatttatccattatgggatagcagctgcaaccgaagcagttgaagatagcggatggttacctgaagatgaaaaatctcgtgatagaacaggcctgatattaggttcaggaatcggtgggcttaaaatgattgaagatacctctattaaactttataaagaaaataacggcaaagttagtcctttctttattccagcatcattaattaaccttttatcaggtcttgtttctataaaatacggttttagtggcccgaatcaagcagcagtaacagcgtgctctacaggtgcacatgctataggtgatgcgatgcgtatgataaagcatggttatgccgatgttatgatcgcaggtggtgcagaagctccagttacacctgtcggagttgcaggtttcgttgctgctagagcattatgtactaaatataacgataatcctgaaaaagcctcaagaccttgggataaaggtcgaagtggttttgtgatgggtgaaggagcaggcattgtagtcttagaagaatatgaacatgcagtaaatcgtggagctaaaatttattgtgaagttatagggtacggctctacaggtgatgcataccatatgaccgctccacatcctcaaggtagaggagcttatagagcaatgagtgaagcgttacaagatgctggtatcaatcctagtatgattgattatattaatgcacacggtacttctactactcttggagacatgatcgaattagaagctacacaaaaattatttttagaatcgaatcccaaaattctaatgtcttctactaaatcatcaataggacatttgcttggtgcagcaggaagtgttgaatttatattttcagttcttacaattcgagatcagattgcaccaccaaccttaaacttagaaaaccctatggatgatgttaaaatagatttagtaaaattaaaagctagagaaactgtggtagattacgtattatctaattcttttggcttcggtggtaccaatgctagcttagtcattaagaggatttaa

SEQ ID NO: 19881 - protein, 426 aa, Rickettsia typhi str. Wilmington
MSNQNINKRVVITGLGLVTPVGLNVNSSWKNIVDGVSGIKTITEFDTSKLACKIAGVIDISEHDGFKLENFTQADDINRLSKMDKFIHYGIAAATEAVEDSGWLPEDEKSRDRTGLILGSGIGGLKMIEDTSIKLYKENNGKVSPFFIPASLINLLSGLVSIKYGFSGPNQAAVTACSTGAHAIGDAMRMIKHGYADVMIAGGAEAPVTPVGVAGFVAARALCTKYNDNPEKASRPWDKGRSGFVMGEGAGIVVLEEYEHAVNRGAKIYCEVIGYGSTGDAYHMTAPHPQGRGAYRAMSEALQDAGINPSMIDYINAHGTSTTLGDMIELEATQKLFLESNPKILMSSTKSSIGHLLGAAGSVEFIFSVLTIRDQIAPPTLNLENPMDDVKIDLVKLKARETVVDYVLSNSFGFGGTNASLVIKRI

SEQ ID NO: 19882 - DNA, 1275 bp, Yersinia pseudotuberculosis IP 32953
  CDS (1)..(1275): transl_table=11
atgagtacacgccatgtagtaattacaggtatgggtgtcgtttccccattaggctgcggtatcgaaacggtctggcaacggctcttggcagggcaatcaggcatccgtgttctatcggatgaaattgtcggtgacttgcccgctaaaattggtgggcaagtgcctacgttagcagaagacgctaaagctggtttcgatccagataaagcggttaccccaaaagatcaaaagaaaatggatcgctttattgagtttgcgatggcggcggccgatgaggcaattagccaggcaggctggcatgcggataacacagagaaacaagagcgtaccgcgacaatcataggcgcgggtattggtggttttccggccattgcccatgcagtgcggacttccgacagccgtgggccaaaacgcctctcaccgtttactgtcccttcattcttagtgaatttggccgctggccatgtttctatcaaacatcattttaaaggcccgattggcgcaccagtcactgcctgtgctgccggtgtacaggcaatcggtgacgccgtgcggatgatccgcaacaatgaagcagatgttgccctgtgcggtggcgcagaagccgtgatcgataccgtgagtctggccggttttgctgccgctcgtgcgttatcaacccactttaatagcacaccagaaaaagcctcccgccccttcgacactgcccgtgacggttttgtgatgggagaaggtgctggtttactgattattgaggagttggagcatgctttagccagaggcgcgaagccactagcagaaatagtcggctatggtaccagtgccgatgcttaccatatgacctctggcgctgaggatggcgacggggcctatcgcgccatgaaaatcgctttgcgtcaggccggtattacgcccgagcaagttcagcatctgaatgcccacgcgacctcaacaccggtaggtgatctcggtgaaattaatgccattaaacatttgtttggcgagagtaatgcgttagcgattacctcaacaaaatccgccacagggcacctgttgggcgctgctggtgggctggaaaccattttcactgtactggcattgcgtgatcaaatcgtgcccgcaacgttgaatctggaaaatccagatcctgcagccaagggactcaacattattgcaggtaacgcacaacctcatgacatgacgtatgccctttccaatggttttggctttggtggggtgaacgcaagtatcttactgaaacgctgggtggactaa

SEQ ID NO: 19883 - protein, 424 aa, Yersinia pseudotuberculosis IP 32953
MSTRHVVITGMGVVSPLGCGIETVWQRLLAGQSGIRVLSDEIVGDLPAKIGGQVPTLAEDAKAGFDPDKAVTPKDQKKMDRFIEFAMAAADEAISQAGWHADNTEKQERTATIIGAGIGGFPAIAHAVRTSDSRGPKRLSPFTVPSFLVNLAAGHVSIKHHFKGPIGAPVTACAAGVQAIGDAVRMIRNNEADVALCGGAEAVIDTVSLAGFAAARALSTHFNSTPEKASRPFDTARDGFVMGEGAGLLIIEELEHALARGAKPLAEIVGYGTSADAYHMTSGAEDGDGAYRAMKIALRQAGITPEQVQHLNAHATSTPVGDLGEINAIKHLFGESNALAITSTKSATGHLLGAAGGLETIFTVLALRDQIVPATLNLENPDPAAKGLNIIAGNAQPHDMTYALSNGFGFGGVNASILLKRWVD

SEQ ID NO: 19884 - DNA, 1242 bp, Yersinia pseudotuberculosis IP 32953
  CDS (1)..(1242): transl_table=11
gtgtctaagcgtcgagttgttgtgactggactgggcatgttgtctcctgtcggtaatacagtcgaatccacatggaaagctgttcttgccgggcagagtggcatcagcctgatcgaccatttcgatactagtgcctacgcaacgcgatttgctggcttagtaaaagattttaattgtgaagattacatttcgcgtaaagatgcacgcaaaatggatgctttcattcagtacggtgttgctgctggcatgcaagctatgcaagacgccgggcttgacattacagaagccaacgcttcccgtattggtgccgctatcggttctggtattggcgggctgggtctgattgaagaaaaccacaccgcattggtgaacggtgggccacgtaaaattagcccattctttgtgccttcaaccattgtgaacatgattgctggtcatctgactatcatgtatggcctgcgtggaccaagcatatctattgctaccgcttgtacttctggcgtacataatatcggtcacgcggcacgtatcattgcttataatgatgctgatgtcatggtggctgggggggctgaaaaagccagtacaccactaggtgtcggcggttttggtgcagcccgcgcattgtctacccgtaacgataacccacaagcagcaagtcgcccgtgggataaagaccgtgatggtttcgttctgggtgatggtgccggcatgatggtgttggaagagtacgaacacgcgaagaagcgtggtgcaaaaatctatgctgaagttgttggttttggtatgagcagcgatgcctaccatatgacctctccgccggaagacggttcaggagccgctttggccatggtgaatgcattacgtgatgctggcatcacaacctcgcaaattggttatattaatgcccacggcacatcaactcctgctggcgataaagccgaaacgcaggccgttaagtctgtatttggtgaagatgcctataaagttatggtcagttccaccaaatccatgactgggcacttattgggtgcagctggtgccgtagagtctatctttaccgtgttggcgctgcgtgatcaggctattcctgcaacgatcaacttggataacccagatgaaggttgcgatttggattatgttccgcatgatgcgcgtcaagtaaaagatatggaatacaccctgtgtaattcctttggtttcggcggcactaacggctctttggtattccgtaaggtataa

SEQ ID NO: 19885 - protein, 413 aa, Yersinia pseudotuberculosis IP 32953
MSKRRVVVTGLGMLSPVGNTVESTWKAVLAGQSGISLIDHFDTSAYATRFAGLVKDFNCEDYISRKDARKMDAFIQYGVAAGMQAMQDAGLDITEANASRIGAAIGSGIGGLGLIEENHTALVNGGPRKISPFFVPSTIVNMIAGHLTIMYGLRGPSISIATACTSGVHNIGHAARIIAYNDADVMVAGGAEKASTPLGVGGFGAARALSTRNDNPQAASRPWDKDRDGFVLGDGAGMMVLEEYEHAKKRGAKIYAEVVGFGMSSDAYHMTSPPEDGSGAALAMVNALRDAGITTSQIGYINAHGTSTPAGDKAETQAVKSVFGEDAYKVMVSSTKSMTGHLLGAAGAVESIFTVLALRDQAIPATINLDNPDEGCDLDYVPHDARQVKDMEYTLCNSFGFGGTNGSLVFRKV

SEQ ID NO: 19886 - DNA, 1242 bp, Symbiobacterium thermophilum IAM 14863
  CDS (1)..(1242): transl_table=11
atggagcgacgggtagtggtcaccggcatggggctgatctcgcccctgggcaacagcgtccgggccaactgggaggcggcggtggcgggccgctcaggcatcggcccgatcacccgcttcgacgcctcccgcctgccgacccggttcgccggcgaggtgcgcgacttcgaccccgcgacggtgatggaccccaaggaggtccggcggtacgatcccttcatccactacgccctggccgcggccgcggaggcggtggaggacgcgggcctcaccttcgagggcgagctggccgagcgcaccggcgtcgtgttcggcagcggcatgggcggtctggagggcatcgtggagaacgccctgatcctgcaggagcggggcccccggcggatctcgccgttcttcgtcccgcgctgcatcatcaacagcgccgccggcctgatctcgatgaagtacggcgtgcatgggcccaactacgggacggtgtccgcctgtgcctcggcgggccacgccatcgccgacgcgatgcacatcatccgtcgcggcgacgccgacgtcatgatcaccggcggcagcgaggcgaccatcacggagctggcgtttgccggcttcagctccgccaaggcgctctccacccggaacgacgacccccagggcgcctcccgcccgtttgacgcggaccgggacggctttgtcatgagcgagggcgcgggctgcctggtgctggaggagctggagcacgccaggcggcggggcgcccggatctacgccgaactggccggcgccggcatgtcgggggatgcgtaccacatcaccgcgccgcacccggagggccggggcgcggtcctggcgatgaagggcgccctgcgcagcgcccggctgaacccggaggacgtgggctacatcaacgcgcacgccacctccaccgacctgggcgacgtgcaggagagcctggcgatcgagcaggtcttcggcgatcacgcccggaagctggccgtctccggcaccaagtcgatgcacggccacctcctgggggcggcgggggccatcgaggcgatcctgaccgtgctctcgctgtaccaccaggtgctgctgccgaccatcaacctgcacaggcccgacccggagtgccgcttggactacgtgccccacacggcccgggaggtccgcggtgtggaggctgccctctgtaacaacttcggcttcggcggcaccaacgtgtcgctcgcgttccgccgctttgtctag

SEQ ID NO: 19887 - protein, 413 aa, Symbiobacterium thermophilum IAM 14863
MERRVVVTGMGLISPLGNSVRANWEAAVAGRSGIGPITRFDASRLPTRFAGEVRDFDPATVMDPKEVRRYDPFIHYALAAAAEAVEDAGLTFEGELAERTGVVFGSGMGGLEGIVENALILQERGPRRISPFFVPRCIINSAAGLISMKYGVHGPNYGTVSACASAGHAIADAMHIIRRGDADVMITGGSEATITELAFAGFSSAKALSTRNDDPQGASRPFDADRDGFVMSEGAGCLVLEELEHARRRGARIYAELAGAGMSGDAYHITAPHPEGRGAVLAMKGALRSARLNPEDVGYINAHATSTDLGDVQESLAIEQVFGDHARKLAVSGTKSMHGHLLGAAGAIEAILTVLSLYHQVLLPTINLHRPDPECRLDYVPHTAREVRGVEAALCNNFGFGGTNVSLAFRRFV

SEQ ID NO: 19888 - DNA, 1239 bp, Bacillus licheniformis ATCC 14580
  CDS (1)..(1239): transl_table=11
atgaatagtaaaagagtagtcattaccggattaggagctttatcacctcttggtaatgacgtcaaaacaagctggaacaacgcgatcaacggggtttccggagtcggcccgataacaagggtgaacgcggacgagtatcctgctaaagtagccgcagaactgaaagattttaagatagaagattatatggataaaaaagaagcgagaaaaatggaccgcttcacacaatatgccgttgtgtcggcgaaaatggccgtggaagacgcgggcctcgacattaacgaaagcaacgcagaccggatcggcgtctgggtcggttccggaatcggcggccttgaaacgcttgaacagcagttcgaaacatttttaacaaaaggaccgcggcgcgtcagcccgttctttgtaccgatgatgattcctgatatggcgaccggccagatttcgatctctctcggtgcaaaaggggtcaactcttgtacggtgacggcttgcgcgacgggtacaaactcaatcggcgacgctttcaaggtcattcagcgcggcgatgccgatgtcatgatctccggaggaacggaagccccgcttacaagaatgtcatttgccggcttttcagccaataaagcgctatccactaatccggatccgaaaacggcaagccgtccgtttgacaaaaaccgcgacggcttcgtcatgggagaaggagctggaatcgtcgttcttgaggagcttgagcacgccttaaaccgcggagcgacaatctacgcggaagtggtcggctacggatcaacgggagacgcctatcatattacggcacctgcgccaaatggagaaggcggcgtcagagccatgaaagaagcgatcaaagatgcgggtctgtcccctgtggacattgattatatcaatgctcatggaacaagcacgccgtacaatgataaatttgaaacgatcgccattaaagaagtgttcggagagcatgcctacaagcttgccgtcagctcgacaaaatcgatgacagggcacttgctcggggctgccggaggcatcgaagcgattttctccgtccttgccattaaggaaggcatcattcctccgacaatcaatatcgaaacgcctgatgaagattgcgatctggactatgtaccggatcaagcccgccgccaggacgtgaatgttgtgctcagcaactcgcttggtttcggcggacacaacgcaacgctgatcttcaaaaaatatgaataa

SEQ ID NO: 19889 - protein, 412 aa, Bacillus licheniformis ATCC 14580
MNSKRVVITGLGALSPLGNDVKTSWNNAINGVSGVGPITRVNADEYPAKVAAELKDFKIEDYMDKKEARKMDRFTQYAVVSAKMAVEDAGLDINESNADRIGVWVGSGIGGLETLEQQFETFLTKGPRRVSPFFVPMMIPDMATGQISISLGAKGVNSCTVTACATGTNSIGDAFKVIQRGDADVMISGGTEAPLTRMSFAGFSANKALSTNPDPKTASRPFDKNRDGFVMGEGAGIVVLEELEHALNRGATIYAEVVGYGSTGDAYHITAPAPNGEGGVRAMKEAIKDAGLSPVDIDYINAHGTSTPYNDKFETIAIKEVFGEHAYKLAVSSTKSMTGHLLGAAGGIEAIFSVLAIKEGIIPPTINIETPDEDCDLDYVPDQARRQDVNVVLSNSLGFGGHNATLIFKKYE

SEQ ID NO: 19890 - DNA, 1221 bp, Mannheimia succiniciproducens MBEL55E
  CDS (1)..(1221): transl_table=11
atgaaaagagcagtgattacaggttttggtgtaatttcaagcatcggtaataataaagaagaagttttagcttctttaaaagcaggtaaatcaggaattgaaatcgtaccgagttttgtagaaatgggtatgcgtagccatgtcgccggaacagttaagttaaatcctgccgaattaattgatcgtaaaatttatcgttttatgggtgatgccgccgcttatgcctacctgtcaatgaaagaagctattgaagatgcaggtcttagcgaagatcaggtttctaatgagcgtacgggtcttgttatcggtgccggtatcggttcggcgcattatcaggtgaaagcggccgatgcggcacgcggttcccgtggtgttaaagcaattggtccttatgcggtaactaaaaccatgtcttcaagtgtttccgcttgtttggcaactccgttcaaaattaaaggcgttaactattctatcagttccgcttgtgcaacttcggcacattgtatcggtaatgcctttgagttaattcaattaggtaaacaagatattgttttcgcaggcggtgcggaagaattatcctgggaaggagcggcacaattcgatgcaatgggtgccgtttcaaccaaatataatgaaaccccggaaaaagcgtctcgcgcttatgatgcggatcgtgacggtttcgttattgccggcggcggtgcggttgttgttgttgaagaattagaacacgctcttgcccgcggtgcaaaaatttatgcggaaatcgtaggctacggcgcgacttcagacggttacgacatggtagcgccaagcggcgaaggtgcggaacgttgcatgaaacaagcgatggcgaatattgatacgccgatcgactatatcaacgttcacggtacttcaacaccggttggtgacgtgaaagaattaggcgcaatcagaaatgtatttggtgaagctaaaccggcaatttcttcaacaaaatccatgacaggtcactcgttaggtgcggctggtgcgcacgaagcgatttatacgttattaatgttacacaacgactttatcgccccaagcattaacatcgaaacattagacgagcaggccgaaggtttaaatatcgttaccgaaacaaaagaaaatgcaggtttacaaaccgtgatgtcaaacagctttggtttcggcggtacgaacgctacattagtgttcaaacgttacgctaaataa

SEQ ID NO: 19891 - protein, 406 aa, Mannheimia succiniciproducens MBEL55E
MKRAVITGFGVISSIGNNKEEVLASLKAGKSGIEIVPSFVEMGMRSHVAGTVKLNPAELIDRKIYRFMGDAAAYAYLSMKEAIEDAGLSEDQVSNERTGLVIGAGIGSAHYQVKAADAARGSRGVKAIGPYAVTKTMSSSVSACLATPFKIKGVNYSISSACATSAHCIGNAFELIQLGKQDIVFAGGAEELSWEGAAQFDAMGAVSTKYNETPEKASRAYDADRDGFVIAGGGAVVVVEELEHALARGAKIYAEIVGYGATSDGYDMVAPSGEGAERCMKQAMANIDTPIDYINVHGTSTPVGDVKELGAIRNVFGEAKPAISSTKSMTGHSLGAAGAHEAIYTLLMLHNDFIAPSINIETLDEQAEGLNIVTETKENAGLQTVMSNSFGFGGTNATLVFKRYAK

SEQ ID NO: 19892 - DNA, 1230 bp, Legionella pneumophila subsp. pneumophila str. Philadelphia 1
  CDS (1)..(1230): transl_table=11
atgaaaaaaagggttgttattactggtatggaaataacgtcatccataggatcgggaattgataaattttggcttgctgcatctcaaggtcaatgcggaattaaacgcatccaatcttatgatccatccccctattcgacccaaatagcaggtgagattacagacttatctctcgaccatctccccgaattcaacaaaagcaaacgttatcctcgcgctgctcagtatgcattattttgcgcacatcatgccatcgagaaagcagggcttgagcaagctgagctcaatgcagcaggcacctttataggcacaagcattggcggtcaacctgaactggaagcaggttacaggttattctttacagacagctggaagaaaatcccccctcttagcgtgattagggggatgcccaattcaatcgccaatcatatcgcaattgcttttggcataggtggaccaaactcaaccatttccaatgcctgtgtttcatccggggaagcgataggcatggcttaccaacaaattgcccatggcaatttgaccacagctctttgcggaggaacagaatctttagtctgggaatcggttatggctgcctggtgtaagcttagagtaatgtcaactaacaatgaaaatccctcacaagccagcagaccgtttgatctcaatcgggatggaatggttatggcggatggggctgggatattaattcttgaagagctacaacaagcaaaagcaaggggagcacaaattctcggagaaatcattggctatggcgcaagttgtgatgcattccatgtcacagcgccaaactcacaaggacaagcaagagctattgttgctgctttaaatgatgccaaattatcaattaacgatgtccattacatcaacgcacatgggacaggaacccagctcaatgacagcacagaaacagaaacgattaaaatggttttcggtaaaagagcctatgacatcccgattactgctcaaaaagccatgacaggacatgcgattggggcagcaggagcaatggaaatcattgcaacaacactaagcttgcaaaaaaacacgctgttaccaactattaacctgcataccccagacccagcctgtgatctggattatgtgcctaatgctgcgcgagaaaaaaccattgatattgctttatccaaccatttcgctttcggtggagcaaatgccgctttagttctgcgcaaatacattagttaa

SEQ ID NO: 19893 - protein, 409 aa, Legionella pneumophila subsp. pneumophila str. Philadelphia 1
MKKRVVITGMEITSSIGSGIDKFWLAASQGQCGIKRIQSYDPSPYSTQIAGEITDLSLDHLPEFNKSKRYPRAAQYALFCAHHAIEKAGLEQAELNAAGTFIGTSIGGQPELEAGYRLFFTDSWKKIPPLSVIRGMPNSIANHIAIAFGIGGPNSTISNACVSSGEAIGMAYQQIAHGNLTTALCGGTESLVWESVMAAWCKLRVMSTNNENPSQASRPFDLNRDGMVMADGAGILILEELQQAKARGAQILGEIIGYGASCDAFHVTAPNSQGQARAIVAALNDAKLSINDVHYINAHGTGTQLNDSTETETIKMVFGKRAYDIPITAQKAMTGHAIGAAGAMEIIATTLSLQKNTLLPTINLHTPDPACDLDYVPNAAREKTIDIALSNHFAFGGANAALVLRKYIS

SEQ ID NO: 19894 - DNA, 1293 bp, Legionella pneumophila subsp. pneumophila str. Philadelphia 1
  CDS (1)..(1293): transl_table=11
atgaaacgacgagttgctattacaggtctaggggttgtttcgcctctaggaaatgatgtatccaccacttggatgaatttgatcgctggtcattctggcatagatagtatcaagcagtttgacgccagtgcttttcctaccactattgcggctgaagtaaagaacttttcacctgatacgtctatttcgggaaagcatactcgatttatcatgtcttttactcattttgctttggaagctgcacgccaggcatttgaagatgcttctatatttcctaccaagcaaacatctgatcggtggggaatagtaacaggcagtgggatgatgacggccgagtttgagtatttaacgcggtttcaacaagcttgtgccgcaggcggtgaaattgattggggaaagctgcaatctaatagcagggatttctataatttggttgattttggtaaaaccacttcaaactctggtctttccttattaatacaacaatatgggattactggttatgcctcttctgtccatacggcctgcgcttcaggaggccaagccttgggattggcaatgcaggtgatccgtcgtggcgaggcagattttatgttggcaggtggatttgattccatgattaatcctttgggtttgtcgagcttttgtcttttgggtgccttatcaacgtataatgagactccgcaaacggcaagtcgcccctttgatgcgacacgcaatggttttgtcctgggtgaaggggctgcctttttgatccttgaagaatggagtaaggcaaaagcccgtggggcaaaaatctatgctgaactggccggtgaggggaattctttgagctcctaccgaataactgattcacatcccaacggtgatggtgctattcaagcgattaaacgtgcgttggaggatgcgggtgttcaaccacgggatgtcgattatattaatgcgcatggtacatccactaaaatgaatgatttaagtgaaaccaatgcaatcaaagttgtctttggggacaggatcgccaatttaccagtgagctctaccaaaagtcaaacggggcatttaatcgcagctgcgggagcgcttgaagcggtattgtcagttaaatccatagaacaggcgcaagtccccaaaacagcgaatttaaaaacacctgatccggagtgtgatttggattatgttgttgatggtccacgtgaaaaatctttaggggtagtattatctaattcgtttggttttggaggttctaatagctgcttgttatttaaacatccagaattcgaggagacaaaataa

SEQ ID NO: 19895 - protein, 430 aa, Legionella pneumophila subsp. pneumophila str. Philadelphia 1
MKRRVAITGLGVVSPLGNDVSTTWMNLIAGHSGIDSIKQFDASAFPTTIAAEVKNFSPDTSISGKHTRFIMSFTHFALEAARQAFEDASIFPTKQTSDRWGIVTGSGMMTAEFEYLTRFQQACAAGGEIDWGKLQSNSRDFYNLVDFGKTTSNSGLSLLIQQYGITGYASSVHTACASGGQALGLAMQVIRRGEADFMLAGGFDSMINPLGLSSFCLLGALSTYNETPQTASRPFDATRNGFVLGEGAAFLILEEWSKAKARGAKIYAELAGEGNSLSSYRITDSHPNGDGAIQAIKRALEDAGVQPRDVDYINAHGTSTKMNDLSETNAIKVVFGDRIANLPVSSTKSQTGHLIAAAGALEAVLSVKSIEQAQVPKTANLKTPDPECDLDYVVDGPREKSLGVVLSNSFGFGGSNSCLLFKHPEFEETK

SEQ ID NO: 19896 - DNA, 1239 bp, Legionella pneumophila subsp. pneumophila str. Philadelphia 1
  CDS (1)..(1239): transl_table=11
ttgaatagtcggcgtgtggttattaccggcatgggtatgcttactcctgtcggacttaatgtagaagaaacttggcgaagtattttagctggggttagtggggtaggtttggtggaagattttgatactactgaatacccaactaagatttgggctaaggtcaagaattttaatgttgagaatcacatgccaattaaagacgcccgcaaaatggacgtctttacacaatatggtatggctgctgctgatgaagcgatgcttgactcgggtttaaaaattgatgaagtcttatctcgtcgaatcggtgtcgcagtgggcgcaggtattggtggtattcaaacaatcacaaataaccaggataaactggttgccggtggaccacgtaaggtttcgccattttttattccggcaggtattatcaatatggttgctggacagatttctattaaacataatttaaaaggacctaatatttcggttgtgactgcatgtactaccggaacacataatatcgggctagccgggcgtataattgcttatggcgatgccgatgtcatgatttgtggtggagcggaaatgaccacaacgccactttgtcttgctgggttttcagcagtaagatctttatccaaacggaatgatgagcctgagaaagcctcaaggccttgggataaagacagagacggttttgttatgggtgagggtgctggtgttttggttttagaagaatatgaacacgctaaagctcgtggagccaaaatttatgctgaattggttggttttggtatgtcaggagatgcttatcatattaccgcacccgatgaagatgccgatggagcttcacgagctatggaggcagccatccaggatgctggtatcgatcccagacaagttgattatattaatgctcacggtacgtcgacttatttaaacgatttaaatgaaacaaaagccattaagcgtgttttccagaaccatgcttatgatctggcggttagctcaaccaaatccatgacaggccatttgctcggagctgcaggtgcagtagaggcaattataagtattttagccataagagatcaggtggctccacctacaataaatttggataatcctgatgaaggttgtgatttgaattatgtagcacatgtaccacaaagcagaacaattaattatgttctaagtaattcacttggttttggtgggacaaacggtagcttactgttcaagcgaatctaa

SEQ ID NO: 19897 - protein, 412 aa, Legionella pneumophila subsp. pneumophila str. Philadelphia 1
MNSRRVVITGMGMLTPVGLNVEETWRSILAGVSGVGLVEDFDTTEYPTKIWAKVKNFNVENHMPIKDARKMDVFTQYGMAAADEAMLDSGLKIDEVLSRRIGVAVGAGIGGIQTITNNQDKLVAGGPRKVSPFFIPAGIINMVAGQISIKHNLKGPNISVVTACTTGTHNIGLAGRIIAYGDADVMICGGAEMTTTPLCLAGFSAVRSLSKRNDEPEKASRPWDKDRDGFVMGEGAGVLVLEEYEHAKARGAKIYAELVGFGMSGDAYHITAPDEDADGASRAMEAAIQDAGIDPRQVDYINAHGTSTYLNDLNETKAIKRVFQNHAYDLAVSSTKSMTGHLLGAAGAVEAIISILAIRDQVAPPTINLDNPDEGCDLNYVAHVPQSRTINYVLSNSLGFGGTNGSLLFKRI

SEQ ID NO: 19898 - DNA, 1263 bp, Bacteroides fragilis YCH46
  CDS (1)..(1263): transl_table=11
atggaattaaagagagttgtagtaacaggtctgggcgccattactcctgttggcaataatgtcccggaattctgggagaacctcgtgaacggggttagtggagcaggacctattactcatttcgatgcatcgcaattcaagactcaatttgcatgtgaagttaaaggcttcgatgcaactcaatatatcgaccgcaaagaggctcgtaaaatggacctgtacacacagtatgccgttgccgttgccaaagaagcagttgcagactcgggtcttgatatcgaaaatgaggatttaaacagaatcggcgttatttttggtgccggtatcggtggtatacgtacatttgaggaggaaacgagtaattacgcccttcacaaagaaaacggtcctaagtacaatccgttcttcatccctaagatgatttcagatattgctgccggacagatttctattatgtatggcttccacggcccgaactacgcaacttgttctgcatgtgcaacttctactaacgccatcgccgatgcattcaacctgatccgtctgggtaaggcaaacgtgattgtatccggtggttcggaagccgctatcgcagctgccggtgtaggaggtttcaatgctatgcatgcattgtcaactcgtaacgacgaaccacaatctgcatctcgtccgttcagtgcaagccgtgacggctttgtaatgggtgaaggtggtggatgtttgattcttgaagaactggaacatgcaaaagcccgtggcgcaaaaatctatgcagaagttgccggcgtaggtatgtctgctgatgctcaccacctgacagcatctcatccggaaggactcggtgcaaaattggtgatgaagaatgccttggaagacgcagagatgagtcctgaagaagtggattacatcaatgttcatggaacatctactccggtcggagatatatcggaagccaaagcaatcaaagaagtatttggtgaacatgcttttgagttgaatatcagttcaaccaaatcaatgacaggtcacttgttgggcgctgccggtgcggtagaatcaattgcaagtattctggctattaagaacggcatcgttcctccgactatcaatcatgccaaaggtgacaatgacgagaacattgactataatcttaatttcacgttcaacaaagcacagaaacgcgaaattaatgttgccctttcgaatacattcggattcggcggtcacaatgcttgtgtaatcttcaagaaatacgctgaataa

SEQ ID NO: 19899 - protein, 420 aa, Bacteroides fragilis YCH46
MELKRVVVTGLGAITPVGNNVPEFWENLVNGVSGAGPITHFDASQFKTQFACEVKGFDATQYIDRKEARKMDLYTQYAVAVAKEAVADSGLDIENEDLNRIGVIFGAGIGGIRTFEEETSNYALHKENGPKYNPFFIPKMISDIAAGQISIMYGFHGPNYATCSACATSTNAIADAFNLIRLGKANVIVSGGSEAAIAAAGVGGFNAMHALSTRNDEPQSASRPFSASRDGFVMGEGGGCLILEELEHAKARGAKIYAEVAGVGMSADAHHLTASHPEGLGAKLVMKNALEDAEMSPEEVDYINVHGTSTPVGDISEAKAIKEVFGEHAFELNISSTKSMTGHLLGAAGAVESIASILAIKNGIVPPTINHAKGDNDENIDYNLNFTFNKAQKREINVALSNTFGFGGHNACVIFKKYAE

SEQ ID NO: 19900 - DNA, 1239 bp, Burkholderia mallei ATCC 23344
  CDS (1)..(1239): transl_table=11
gtgagccgccgtcgtgttgttgttacaggccttgggctgatttcgcctgttggcaataatgttgccgacggctgggccaatctcgtggccggcaagtccggcatcgtcaatatcacgaagttcgacgcgacgaacttctcgacccgcttcgcgggcgaggtgaagggcttcaacgtcgaggagtacatcccggcgaaggaagcgcgccacatggatacgttcatccattacggcatcgcggccggcatgcaggcgatgcaggacagcggcttccaggtcaccgacgaaaacgcggagcgcgtcggcgtcgtggtcggctcgggcatcggcgggctgccgatgatcgaagtcacgcagaccgagctgctcaaccgcggcccgcgccggatctcgccgttcttcgtgccggcgtcgatcatcaacatgatctccggccacctgtcgatcaagttcggcatcaagggcccgaatctcgcgatcgtcaccgcgtgcacgaccggcctgcactgcatcggcgaggcggcgcgtctgatcgaatacggcgacgccgacgtgatgatcgcgggcggcgcggaagcgaccgtgtcgccgctcggcatcggcggcttcgcggcggcgcgcgcgctgtcgcagcgcaacgacgatccggcgacggcgagccgtccgtgggacaaggatcgcgacggcttcgtgctcggcgagggcgcgggcgtgatggtgctcgaggagtacgagcacgcgaaggcgcgcggcgcgaagatctacgcggaagtcgcgggctacgggatgagcggcgacgcgtaccacatgacggcgccgctcgagaacggcgacggcgcacgccgctgcatgctggccgcgctgcgcaacgcgggcgtgaacgccgatcaggtgaattacctgaacgcgcacggcacgtcgacgccgctcggcgatctggcggagaccgtcgcgatcaagcgcgcgttcggcgatcactcgaaggacatcgtcgtcaactcgaccaagtcgatgacggggcacttgctcggcggcgccggcgggctcgaatcggtgttcacggtccttgccgtccacaaccaggtgtcgccgccgacgatcaacatcttcaaccaggaccccgagtgcgatctcgactattgcgcgaacgaagcgcgcgagatgaagatcgacgtcgcgttgaagaactccttcggcttcggcgggactaacggcacgctggtcttcaagcgcgcctga

SEQ ID NO: 19901 - protein, 412 aa, Burkholderia mallei ATCC 23344
MSRRRVVVTGLGLISPVGNNVADGWANLVAGKSGIVNITKFDATNFSTRFAGEVKGFNVEEYIPAKEARHMDTFIHYGIAAGMQAMQDSGFQVTDENAERVGVVVGSGIGGLPMIEVTQTELLNRGPRRISPFFVPASIINMISGHLSIKFGIKGPNLAIVTACTTGLHCIGEAARLIEYGDADVMIAGGAEATVSPLGIGGFAAARALSQRNDDPATASRPWDKDRDGFVLGEGAGVMVLEEYEHAKARGAKIYAEVAGYGMSGDAYHMTAPLENGDGARRCMLAALRNAGVNADQVNYLNAHGTSTPLGDLAETVAIKRAFGDHSKDIVVNSTKSMTGHLLGGAGGLESVFTVLAVHNQVSPPTINIFNQDPECDLDYCANEAREMKIDVALKNSFGFGGTNGTLVFKRA

SEQ ID NO: 19902 - DNA, 1206 bp, Methylococcus capsulatus str. Bath
  CDS (1)..(1206): transl_table=11
atggtctgtccggtgggcctcaatgtccccgagagctgggacagcatcctgaacggccgcagcggaatcggcccgatcgagcatttcgatgtatccgacttcgctacccgcttcggtggcagcgtgcgtaacttcgatgtcacccggtatctgcccgaaaaagaagccaagaagatggatactttcatccactacggcatggcagcgggtagtcaggcgttcgaagattcggggctggaggtcaccgagtccaatgcggaccgcgttggcgtctgcgtcggctccggcatcggcgggatcaccggtatcgagcatggttacggcgtgttcctcaaaagtggaccccgcaaaatttctcctttctttgtgccggccaacatcatcaacatgatttccggcaacctctccatcaagtacggcctgaaaggcccgaattacgcgatcgtcactgcctgtgccacggcgactcacagcatcggcagcgcggcccgaatcatccagtatggcgatgccgacgtcatgttggccggtggtgccgaaatggcaagctcaccgacggccttgggtggattcatctcggcccgcgccttgtcgcgccgcaatgacgacccggtgcgggcgagccgtccttgggacaaggaccgcgacggctttgtactgggtgatggtgccggcgtggtggtgctggaggagctggagcatgccaagaagcgcggtgcccgcatctacgcggagctgatcggcttcggcatgtcaggagatgcccatcacatgacccagccgcccgaggacggcgatggtgcggcgcgttgtatgatgcacgcgatgcgggatgctggagtgaatccggaagacatcgattacgtcaatgcccacggcacttcgacgccggccggcgatctggcggagacccgcgccatgaagacggtgctcgggccgcatgcgtactcgacggctatcagctcgaccaagtccatgaccggccatctgcttggtgcggcgggtggaatcgaggcgatcttctctgtccttgcgattcgggaccgcgtggtaccgccgaccatcaatctggatacgcccgatccggaatgcgatctggattatgtgcctcataccgcccgggaaaaagatctcgaagtggtcatgtccaactcgttcggctttggcggtaccaacgccactttgattttcaagaaattcagatag

SEQ ID NO: 19903 - protein, 401 aa, Methylococcus capsulatus str. Bath
MVCPVGLNVPESWDSILNGRSGIGPIEHFDVSDFATRFGGSVRNFDVTRYLPEKEAKKMDTFIHYGMAAGSQAFEDSGLEVTESNADRVGVCVGSGIGGITGIEHGYGVFLKSGPRKISPFFVPANIINMISGNLSIKYGLKGPNYAIVTACATATHSIGSAARIIQYGDADVMLAGGAEMASSPTALGGFISARALSRRNDDPVRASRPWDKDRDGFVLGDGAGVVVLEELEHAKKRGARIYAELIGFGMSGDAHHMTQPPEDGDGAARCMMHAMRDAGVNPEDIDYVNAHGTSTPAGDLAETRAMKTVLGPHAYSTAISSTKSMTGHLLGAAGGIEAIFSVLAIRDRVVPPTINLDTPDPECDLDYVPHTAREKDLEVVMSNSFGFGGTNATLIFKKFR

SEQ ID NO: 19904 - DNA, 1251 bp, Nocardia farcinica IFM 10152
  CDS (1)..(1251): transl_table=11
gtgaccactccttccaccttgaacgggaatttccccaacgtcgtcgtgacgagcatggcggctaccacgtcgatcgcgggcgacgtcgatgcgacgtggaagggactcctcaacggcgagagcggcatcgacgttctcgaggattccttcatcgaggagtacgacctccctgttcgcatcggcggacacctgaaggtcaaccccgacaccctgctgagcagggtcgagatccgtcgcatggcgtacgtcgagcgactcgcgaccgttctgggtcgcgaggtgtggaagaacgccggcagcccggaggtcgaccccgaccgcctggctgtggcgatcggcaccggtctcggcggcggtgacgcgctgatcgactcggtcgacaagctgaagaacggtggctatcgcaagatctcgccgctggctgttcagatggtcatgccgaacggtccgtccgcctgtgtcggactcgagctgaaggccagggcgggagtggtcactccggtctcggcgtgctcgtcgggttcggaagccatcgccaacgcgtggcggatgatcgtgatgggtgacgccgatgtggtcgtcaccggcggtgtcgaaggctacatcgactccgtgccgatcgccgcgttctcgatgatgcgcgcgatgagcacccgcaacgacgatcccaagggcgcttcgcggcccttcgacaaggatcgcgacggtttcgtcttcggcgaggccggcgccctgatggtgctcgagaccgaggagcacgccaaggctcgtggcgccaccatccatgcccgcctgctgggtgcgggcatcacctccgatggttaccacctggtcgcccccgatccggagggcaccggcgcggcccgcgcgatgacccgcgcgatgcagtccgccggcctgaccaagcaggacatcacccacatcaacgcgcacgccaccgccacccccatcggtgacacggcggaggccaacgcgatcaacaaggccgtgggcaaccacccctcggtctacgcgcccaagtcggcgctcggccactcgatcggcgccgtgggcgcgctcgagtcggtgctcaccgtgctgagcatccgcgacggcatcgtgccgccgacgttgaacctggacaaccaggacccggagatcgatctcgatgtggtgaagggcgaggcccgccgccaggaaatcgaatacgcgatcaacaactcgttcggtttcggcgggcacaatgtcgccctcgccttcggtcgcgcatag

SEQ ID NO: 19905 - protein, 416 aa, Nocardia farcinica IFM 10152
MTTPSTLNGNFPNVVVTSMAATTSIAGDVDATWKGLLNGESGIDVLEDSFIEEYDLPVRIGGHLKVNPDTLLSRVEIRRMAYVERLATVLGREVWKNAGSPEVDPDRLAVAIGTGLGGGDALIDSVDKLKNGGYRKISPLAVQMVMPNGPSACVGLELKARAGVVTPVSACSSGSEAIANAWRMIVMGDADVVVTGGVEGYIDSVPIAAFSMMRAMSTRNDDPKGASRPFDKDRDGFVFGEAGALMVLETEEHAKARGATIHARLLGAGITSDGYHLVAPDPEGTGAARAMTRAMQSAGLTKQDITHINAHATATPIGDTAEANAINKAVGNHPSVYAPKSALGHSIGAVGALESVLTVLSIRDGIVPPTLNLDNQDPEIDLDVVKGEARRQEIEYAINNSFGFGGHNVALAFGRA

SEQ ID NO: 19906 - DNA, 1230 bp, Legionella pneumophila str. Paris
  CDS (1)..(1230): transl_table=11
atgaaaaaaagggttgttattactggcatggaaataacgtcatccataggatcgggaattgataaattttggcttgctgcatctcaaggtcaatgtggaattaaacgcatccaatcttatgatccatccccctattcaacccaaatagcaggtgagattacagacttatctcttgaccatctccccgaattcaacaaaagcaaacgttatcctcgtgctgctcagtacgcattattttgcgcacatcatgccattgagaaagcagggcttgagaaagctgagctcaatgcagcaggtacctttataggcacaagcattggcggccaacctgaactggaagcaggttacaagttattctttacagacagctggaagaaaatcccccctcttagcgtgattaggggaatgcccaattcaatagccaatcatatcgcaattgcttttggcataggtggaccaaactcaaccatttccaatgcctgtgtttcatccggggaagcgataggcatggcttaccaacaaattgcccatggcaatttgaccacagctctttgcggaggaacagaatctttagtctgggaatcggttatggctgcctggtgtaagcttagagtaatgtcaactaacaatgaaaatccctcacaagccagcagaccgtttgatctcaatcgggatggaatggttatggcggatggggctgggatattaattcttgaagagctacaacaagcaaaagcaaggggagcacaaattctcggagagatcattggctatggcgcaagttgtgatgcattccatgtcacagcaccaaactcacaaggacaagcaagagctattgttgctgctttaaatgatgccaagttatcaattaacgatgtccattacatcaacgcacatgggacaggaacccagctcaatgacagcacagaaacagaaacgattaaaatggttttcggtaaaagagcctatgacatcccgattactgctcaaaaagccatgacaggacatgcgattggggcagcaggggcaatggaaatcattgcaacaacactaagcttgcaaaaaaatacgctgttaccaacgattaacctgcatactccagacccagcctgtgatctggattatgtgcctaatgctgcgcgagaaaaaaccattgatattgctttatccaaccatttcgctttcggtggagcaaatgccgctttagttctgcgcaaatacattagttaa

SEQ ID NO: 19907 - protein, 409 aa, Legionella pneumophila str. Paris
MKKRVVITGMEITSSIGSGIDKFWLAASQGQCGIKRIQSYDPSPYSTQIAGEITDLSLDHLPEFNKSKRYPRAAQYALFCAHHAIEKAGLEKAELNAAGTFIGTSIGGQPELEAGYKLFFTDSWKKIPPLSVIRGMPNSIANHIAIAFGIGGPNSTISNACVSSGEAIGMAYQQIAHGNLTTALCGGTESLVWESVMAAWCKLRVMSTNNENPSQASRPFDLNRDGMVMADGAGILILEELQQAKARGAQILGEIIGYGASCDAFHVTAPNSQGQARAIVAALNDAKLSINDVHYINAHGTGTQLNDSTETETIKMVFGKRAYDIPITAQKAMTGHAIGAAGAMEIIATTLSLQKNTLLPTINLHTPDPACDLDYVPNAAREKTIDIALSNHFAFGGANAALVLRKYIS

SEQ ID NO: 19908 - DNA, 1293 bp, Legionella pneumophila str. Paris
  CDS (1)..(1293): transl_table=11
atgaaacgacgagttgctattacaggtctaggggttgtttcgcctctaggaaatgatgtatccaccacttggaacaatttgatcgctggccattctggcatagatagtatcaagcagtttgatgccagtgcttttcctaccactattgctgctgaagtaaagaatttttcacctgatacgtctatttcgggaaagcatactcgatttatcatgtcttttactcattttgcattggaagctgcacgccaggcttttgaggatgcttctatcttccctaccaagcaaacatccgatcggtggggaatcgtaacaggcagtgggatgatgacggccgagtttgagtatttaacgcggtttcaacaaacttgtgctgcaggcggtgaaattgattggggaaagctgcaatctaatagcagggatttctataatttggttgattttggtaaaaccacttcaaactctggtctttccttattaatacaacaatatgggattactggttatgcctcttctgtccatacggcctgcgcttcaggaggccaagccttgggattggcaatgcaggtgattcgtcgtggcgaggcagattttatgctggcaggtggatttgattccatgattaatcctttgggtttgtcgagcttttgtcttttgggtgccttatcaacttataatgagactccgcaaacggcaagtcgcccctttgatgcgacacgcaatggttttgtcctgggtgaaggggctgcctttttgatccttgaagaatggagtaaagcaaaagcccgtggggcaaaaatctatgctgaactggccggagaggggaattctttgagctcctaccgaataactgattcacatcccaacggtgatggtgctattcaagcgattaaacgtgcgttggaggatgccggtgttcaaccacgagatgtcgattatattaatgcgcatggcacatccactaaaatgaacgatttaagtgaaaccaatgcaatcaaagttgtctttggggataggatcgctaatttacctgttagctctaccaaaagccaaacggggcatttaatcgcagctgcaggagcacttgaagcggtattgtcagttaaatccatagaacaggcgcaagttcccaaaacagcgaatttaaaaacgcctgatccggagtgcgatttggattatgttgttgatggcccacgtgaaaaatctttaggggtagtattatctaattcgtttggttttggagggtctaatagctgcttattatttaaacatccagaattcgaggaggcaaaataa

SEQ ID NO: 19909 - protein, 430 aa, Legionella pneumophila str. Paris
MKRRVAITGLGVVSPLGNDVSTTWNNLIAGHSGIDSIKQFDASAFPTTIAAEVKNFSPDTSISGKHTRFIMSFTHFALEAARQAFEDASIFPTKQTSDRWGIVTGSGMMTAEFEYLTRFQQTCAAGGEIDWGKLQSNSRDFYNLVDFGKTTSNSGLSLLIQQYGITGYASSVHTACASGGQALGLAMQVIRRGEADFMLAGGFDSMINPLGLSSFCLLGALSTYNETPQTASRPFDATRNGFVLGEGAAFLILEEWSKAKARGAKIYAELAGEGNSLSSYRITDSHPNGDGAIQAIKRALEDAGVQPRDVDYINAHGTSTKMNDLSETNAIKVVFGDRIANLPVSSTKSQTGHLIAAAGALEAVLSVKSIEQAQVPKTANLKTPDPECDLDYVVDGPREKSLGVVLSNSFGFGGSNSCLLFKHPEFEEAK

SEQ ID NO: 19910 - DNA, 1239 bp, Legionella pneumophila str. Paris
  CDS (1)..(1239): transl_table=11
ttgaatagtcggcgtgtggttattaccggcatgggtatgcttactcctgtcggacttaatgtagaagaaacttggcgaagtattttagctggggttagtggggtaggtttggtagaagattttgacactactgaatacccaactaagatttgggctaaggtcaagaattttaatgttgagaatcacatgccaattaaagacgcccgcaaaatggacgtctttacacaatacggtatggctgctgccgatgaagcgatgcttgactcgggtttaaaaattgatgaaaccttatctcgtcgaatcggtgtcgcagtgggggcaggtattggtggtattcaaacaatcacaaataaccaggataaactggttgccggtggaccacgtaaggtttcgccattttttattccggcaggtattatcaatatggttgctggacagatttctattaaacataatttaaaaggacctaatatttcggttgtgactgcatgtactaccggaacacataatatcgggctagcagggcgcataattgcttatggcgatgccgatgttatgatttgtggtggagcggaaatgaccacaacgccactttgtcttgctgggttttcagcagtaagatctttgtccaagcggaatgatgagcctgagaaagcctcaaggccttgggataaagacagagacggttttgttatgggtgagggtgctggtattttggttttagaagaatatgaacacgctaaagctcgtggagccaaaatttatgctgaattggttggttttggtatgtcaggagatgcttatcatattactgcacccgatgaagatgccgatggagcttcacgagctatggaggcagccatccaggatgctggtatcgatcccagacaagttgattatattaatgctcacgggacgtcgacttatttaaacgatttaaatgaaacaaaagccattaagcgtgttttccagaatcatgcttatgatctggcggttagctcaaccaaatccatgacaggacatttgctcggagctgcaggtgcagtagaggcaattataagtattttagccataagagatcaggtggctccacctacaataaatttggataatcctgatgaaggttgtgatttgaattatgtagcacatgtaccacaaagcagaacaattaattatgttctaagtaattcacttggttttggtgggacaaacggtagcttactgttcaagcgaatctaa

SEQ ID NO: 19911 - protein, 412 aa, Legionella pneumophila str. Paris
MNSRRVVITGMGMLTPVGLNVEETWRSILAGVSGVGLVEDFDTTEYPTKIWAKVKNFNVENHMPIKDARKMDVFTQYGMAAADEAMLDSGLKIDETLSRRIGVAVGAGIGGIQTITNNQDKLVAGGPRKVSPFFIPAGIINMVAGQISIKHNLKGPNISVVTACTTGTHNIGLAGRIIAYGDADVMICGGAEMTTTPLCLAGFSAVRSLSKRNDEPEKASRPWDKDRDGFVMGEGAGILVLEEYEHAKARGAKIYAELVGFGMSGDAYHITAPDEDADGASRAMEAAIQDAGIDPRQVDYINAHGTSTYLNDLNETKAIKRVFQNHAYDLAVSSTKSMTGHLLGAAGAVEAIISILAIRDQVAPPTINLDNPDEGCDLNYVAHVPQSRTINYVLSNSLGFGGTNGSLLFKRI

SEQ ID NO: 19912 - DNA, 1239 bp, Legionella pneumophila str. Lens
  CDS (1)..(1239): transl_table=11
ttgaatagtcggcgtgtggttattaccggcatgggtatgcttactcctgtcggacttaatgtagaagaaacttggcgaagtattttagctggagttagtggggtaggtttggtggaagattttgacactactgaatacccaactaagatttgggctaaggtcaagaattttaatgttgagaatcacatgccaattaaagacgcccgcaaaatggacgtctttacacaatacggtatggctgctgctgatgaagcgatgcttgactcgggtttaaaaattgatgaagccttatctcgtcgaatcggtgtcgcagtgggggcaggtattggtggtattcaaacaatcacaaataaccaggataaactggttgccggtggaccacgtaaggtttcgccattttttattccggcaggtattatcaatatggttgctggacagatttctattaaacataatttaaaaggacctaatatttcggttgtgactgcatgtactaccggaacacataatatcgggctagccgggcgtataattgcttatggcgatgccgatgtcatgatttgtggtggggcggaaatgaccacaacgccactttgtcttgctgggttttcagcagtaagatctttatccaaacggaatgatgagcctgagaaagcctcaaggccttgggataaagacagagacggttttgttatgggtgagggtgctggtattttggttttagaagaatatgaacacgctaaagctcgtggagccaaaatttatgctgaattggttggttttggtatgtcaggagatgcttatcatattactgcacccgatgaagatgccgatggagcttcacgagctatggaggcagccatccaggatgctggtatcgatcccagacaagttgattatattaatgctcacggtacgtcgacttatttaaacgatttaaatgaaacaaaagccattaagcgtgttttcgagaaccatgcttatgatctggcggttagctcaaccaaatccatgacaggccatttgctcggagctgcaggtgcagtagaggcaattataagtattttagccatcagagatcaggtggctccacctacaataaatttggataatcctgatgaaggttgtgacttgaattatgtagcacatgtaccacaaagcagaacaattaattatgttctaagtaattcacttggttttggtgggacaaacggtagcttactgttcaagcgaatctaa

SEQ ID NO: 19913 - protein, 412 aa, Legionella pneumophila str. Lens
MNSRRVVITGMGMLTPVGLNVEETWRSILAGVSGVGLVEDFDTTEYPTKIWAKVKNFNVENHMPIKDARKMDVFTQYGMAAADEAMLDSGLKIDEALSRRIGVAVGAGIGGIQTITNNQDKLVAGGPRKVSPFFIPAGIINMVAGQISIKHNLKGPNISVVTACTTGTHNIGLAGRIIAYGDADVMICGGAEMTTTPLCLAGFSAVRSLSKRNDEPEKASRPWDKDRDGFVMGEGAGILVLEEYEHAKARGAKIYAELVGFGMSGDAYHITAPDEDADGASRAMEAAIQDAGIDPRQVDYINAHGTSTYLNDLNETKAIKRVFENHAYDLAVSSTKSMTGHLLGAAGAVEAIISILAIRDQVAPPTINLDNPDEGCDLNYVAHVPQSRTINYVLSNSLGFGGTNGSLLFKRI

SEQ ID NO: 19914 - DNA, 1242 bp, Photobacterium profundum SS9
  CDS (1)..(1242): transl_table=11
gtgtcaaaacgtcgtgtagttgttactggcatgggtatgctaactcctgttggcaattcggttgaatcttcttggaaggctttactatctggtactagtggtattagtactattgagcattttgatgctagcttatttgctactcagtttgctggtatgattaaagacttcaatcctgaagaatacatgaccaaaaaagatgcccgtaaaatggatttatttatccaatacggcattgcagctggcgtgcaagcatttaaagattcaggtattgaagtaacagaagagaacgcacaccgtattggtgttgctatcggttctggtattggtggtcttgggcttatcgaagctggtcatcaagcccttatggagaaaggaccgcgcaaaattagcccgttctttgttccatcaacaattgtaaatatgattgctggtcacatgtctatcatgcatggcctacgcggtcctaacatcgctatttctacggcttgtactactggccttcataatattggccatgcagcacgtatgattgcatatggtgatgctgacgcaatgctagctggcggtgctgaaaaagcatctactgagctaggcatgggtggctttgcggctgctaaagcgttatcaactcgcaatgatgatccacaagcggcttctcgcccttgggacaaagaccgtgacggttttgttctgggtgatggcgcaggcgtgattgttgtcgaagaatacgaacacgctaaagcgcgtggcgcaacaatctacgctgaacttgttggttttggtatgagtggtgatgcttatcacatgacttcaccaagtcctgatggttcgggtggcgctttggcaatggaagcaacactgcgtgatgcgggtatcaatgctgataaaattggctatattaacgctcacggtacatcaacacctgcaggtgacgcagctgaaacgcgtggtatcaagcgcgctatgggtactgcagctgatgatgtattagtatcatcaacaaaatcgatgactggtcacctgttaggtgcggcgggttctgttgaagccattatttctattatgtctcttgttgatcaggctgtaccgccaacgattaacttagataaccctgatgaaggctgtgaccttgattatgtagccggtgaagctcgccaagttaagaaccttgagtactctctgtgtaactcatttggttttggcggtacaaacggctcgctactattcaagaaaatttaa

SEQ ID NO: 19915 - protein, 413 aa, Photobacterium profundum SS9
MSKRRVVVTGMGMLTPVGNSVESSWKALLSGTSGISTIEHFDASLFATQFAGMIKDFNPEEYMTKKDARKMDLFIQYGIAAGVQAFKDSGIEVTEENAHRIGVAIGSGIGGLGLIEAGHQALMEKGPRKISPFFVPSTIVNMIAGHMSIMHGLRGPNIAISTACTTGLHNIGHAARMIAYGDADAMLAGGAEKASTELGMGGFAAAKALSTRNDDPQAASRPWDKDRDGFVLGDGAGVIVVEEYEHAKARGATIYAELVGFGMSGDAYHMTSPSPDGSGGALAMEATLRDAGINADKIGYINAHGTSTPAGDAAETRGIKRAMGTAADDVLVSSTKSMTGHLLGAAGSVEAIISIMSLVDQAVPPTINLDNPDEGCDLDYVAGEARQVKNLEYSLCNSFGFGGTNGSLLFKKI

SEQ ID NO: 19916 - DNA, 1233 bp, Streptococcus thermophilus LMG 18311
  CDS (1)..(1233): transl_table=11
atgtctacaaatcgtgttgttgttacaggttacggtgtaacctcgccaatcggtaatacaccagaagaattttggaacagtcttcatgacggtaagattggtattaagccaatcaccaagtttgatgcttctgatatcccagtctttaacgctggtgaaatccaagatttcccattcgacaagtattttgtgaaaaaagatactaaccgtatggacacttattcactttatgcgatttatgctgctatggaagcacttgaaaattcaggacttaatatggaagaagtaaatcgtgatcgcgttggtgttatcgtgtcatctggtatcggtggtttacaagaacttgaagatcaaattatccgcatgtatgaacgtggtatgaaacgtatcaagccaatgtttattcctaaagctctctcaaacatgggtgcagggaacattgctcttaagattggtgctcaaggagtatgtaaatcagtgacaactgcctgtgcctctgccaatgatgctatcggtgaagccttccgcgaaattaaatttggatttcacgatgttgtcttggctggtggtgcggaagcttcaatcactaaaattggtattggaggttttaacgctcttacagccctttcaacaacagaagatccagaacgttcttcaattccatttgataaagaccgtaatggttttgttatgggtgaaggtgctggggttcttgttattgaaagcttggagcatgcgcaaaaacgtggtgccaacatcttggctgagattgttggttacggatcaaactgtgatgcctatcatatgacaacgccaactccagacggttcaggagctgctaaagcaattaaattggctatcaatgaagctggtatcaagcctgaagatgttgactatgtcaatgctcacggtacttcaacaccagccaacgaaaaaggtgaaagtgctgctattgtgtctgtacttggtaaagatgttccagtttcatctactaaatcatttacaggtcacctgcttggtgctgctggtgctgttgaagctattgcaacaattgaagctattcgtcacagctttgtaccaaaaactgctggtacaaaagaattgtctgactacattgaagctaatgttgtttacggtgaaggtaaagaagctgatattgagtatgcaatctcaaatacctttggttttggtggacacaacgctgttcttgcctttaaacgttgggagggctaa

SEQ ID NO: 19917 - protein, 410 aa, Streptococcus thermophilus LMG 18311
MSTNRVVVTGYGVTSPIGNTPEEFWNSLHDGKIGIKPITKFDASDIPVFNAGEIQDFPFDKYFVKKDTNRMDTYSLYAIYAAMEALENSGLNMEEVNRDRVGVIVSSGIGGLQELEDQIIRMYERGMKRIKPMFIPKALSNMGAGNIALKIGAQGVCKSVTTACASANDAIGEAFREIKFGFHDVVLAGGAEASITKIGIGGFNALTALSTTEDPERSSIPFDKDRNGFVMGEGAGVLVIESLEHAQKRGANILAEIVGYGSNCDAYHMTTPTPDGSGAAKAIKLAINEAGIKPEDVDYVNAHGTSTPANEKGESAAIVSVLGKDVPVSSTKSFTGHLLGAAGAVEAIATIEAIRHSFVPKTAGTKELSDYIEANVVYGEGKEADIEYAISNTFGFGGHNAVLAFKRWEG

SEQ ID NO: 19918 - DNA, 1227 bp, Thermus thermophilus HB8
  CDS (1)..(1227): transl_table=11
atgcgacgcgtggtggtcaccggcctaggcgccctcacgcccatcggcgtggggcaggaggccttccacaaggcccagctcgcgggcaaaagcggggtcaggcccatcacccgctttgacgcctcggccctccccgtgcgcatcgccgccgaggtggacgtggaccccggggcctacctggaccggaaggagctcaggcgcctggaccgcttcgtccagtacgccctcatcgccgctcagcttgccctggaggacgcggggctaaagcccgaagaccttgaccccgagcgggtgggcaccctggtgggcacggggatcgggggcatggagacctgggaggcccaaagccgggtctttctggagcggggcccaaaccgcataagccccttcttcatccccatgatgatcgccaacatggcctcggcccacatcgccatgcgctacggcttcaccgggccttcctccacggtggtcaccgcctgcgccacgggggcggacgccctgggaagcgccctgcgcatgatccagctcggcgaggccgacctcgtcctggcgggggggacggaggccgccatcacccccatggccatcggggccttcgctgtgatgcgagccctttccacaaggaacgaggagcccgagaaggcgagccgccccttcaccctctcccgggacgggttcgtcatgggggagggggccggggtcttggtcctggaggcgtacgagcacgcgaagaagcggggcgcccgcatctacgccgagctcgtgggcttcggccggagcgccgacgcccaccacatcaccgagccccaccccgagggaaagggcgccgccttggccatggcccgggccctgaaggacgcgggcatcgcccccgagcaggtgggctacatcaacgcccacggcacctccacccccgtgggggaccgggcggaggtgctggccatcaagcgggtcttcggggaccacgccaagaggctcatggtctccagcaccaagagcatgatcggccacctcctgggagcggcgggggcggtggaggccatcgccacggtccaggccctctaccacggggtcatccctcccacgatcaacctcgaggaccccgaccccgagctggacctggacttcgttcccgagccccgggaggccaaggtggactacgccctctccaactccttcgccttcgggggccacaacgccgtcctggctttcaagagggtctga

SEQ ID NO: 19919 - protein, 408 aa, Thermus thermophilus HB8
MRRVVVTGLGALTPIGVGQEAFHKAQLAGKSGVRPITRFDASALPVRIAAEVDVDPGAYLDRKELRRLDRFVQYALIAAQLALEDAGLKPEDLDPERVGTLVGTGIGGMETWEAQSRVFLERGPNRISPFFIPMMIANMASAHIAMRYGFTGPSSTVVTACATGADALGSALRMIQLGEADLVLAGGTEAAITPMAIGAFAVMRALSTRNEEPEKASRPFTLSRDGFVMGEGAGVLVLEAYEHAKKRGARIYAELVGFGRSADAHHITEPHPEGKGAALAMARALKDAGIAPEQVGYINAHGTSTPVGDRAEVLAIKRVFGDHAKRLMVSSTKSMIGHLLGAAGAVEAIATVQALYHGVIPPTINLEDPDPELDLDFVPEPREAKVDYALSNSFAFGGHNAVLAFKRV

SEQ ID NO: 19920 - DNA, 1239 bp, Geobacillus kaustophilus HTA426
  CDS (1)..(1239): transl_table=11
atggaaaaaagacgagtcgtcgtgacaggcataggcgccgtcaccccgcttgggaatgacgcagaaacgacgtggaaaaacattatcgccggccagtccggcatcgacattgtcactcgcgtcaatccggacgactttccggcgaaagtggcggcggaagtgaaagacttcgatccgtcgctgtttatcgaccgccgcgaggcgcggaagatggaccgatttacccaattcgccgtcgctgcggcgctcatggcggtcaaagatgccaatctcgacattaatgaaagcaacgctgaacgggtcggtgtttggattggttctggcatcggcggcatggagacgtttgaacagcagtttgagattttccagcagcgcggttatcgccgagtgagcccgtttttcgtgccaatgatgatcccggatatggccgctgggcaagtatcgatcatcctcggagcgaaagggatcaattcgtgcacggtgaccgcttgcgcgaccggggcgaactcgatcggtgatgcgtttaaagtcattcagcgcggcgacgccgatgtcatgatcaccggcgggacggaagcgccgattacgaaaatgtcgttcgccggtttttgcgccaatacggctctttcaaccaatccagatccaaaaacggcgagccgcccatttgacaaaaaacgcgacggtttcgtcatgggtgagggagcaggcatcgttgttcttgaggaattggagcacgcgttgcgccgcggcgcgaagatttacgcagaaattgtcggttacggtgcgaccgccgatgcgtaccatatcaccgcgccggctccgggcggcgaaggcggcgtgcgggcgatgcgccaagcgcttcatgacgctggcctgaagccggaggagatcgattacatcaacgcccacggcacgagcaccgagtacaatgataagtatgagacggcggcgatcaaagaagtattcggcgatcatgcctataagctcgccgtcagctcgacgaagtcgatgactgggcatttgctcggggcgaccggcgcggtggaagcgattttctccgtgctggcgatccgcgacggcatcattccgccgacgatcaactacgaaacaccggatccggaatgcgacctcgactatgtgccgaatgaagcgcgcaagcaagacgtgcgtgcggtcttaagcaactcatttggatttggcggccataatgcgacattgatttttaaaaaatatgtgtaa

SEQ ID NO: 19921 - protein, 412 aa, Geobacillus kaustophilus HTA426
MEKRRVVVTGIGAVTPLGNDAETTWKNIIAGQSGIDIVTRVNPDDFPAKVAAEVKDFDPSLFIDRREARKMDRFTQFAVAAALMAVKDANLDINESNAERVGVWIGSGIGGMETFEQQFEIFQQRGYRRVSPFFVPMMIPDMAAGQVSIILGAKGINSCTVTACATGANSIGDAFKVIQRGDADVMITGGTEAPITKMSFAGFCANTALSTNPDPKTASRPFDKKRDGFVMGEGAGIVVLEELEHALRRGAKIYAEIVGYGATADAYHITAPAPGGEGGVRAMRQALHDAGLKPEEIDYINAHGTSTEYNDKYETAAIKEVFGDHAYKLAVSSTKSMTGHLLGATGAVEAIFSVLAIRDGIIPPTINYETPDPECDLDYVPNEARKQDVRAVLSNSFGFGGHNATLIFKKYV

SEQ ID NO: 19922 - DNA, 1242 bp, Salmonella enterica subsp. enterica serovar Paratyphi A str. ATCC
  CDS (1)..(1242): transl_table=11
gtgtctaagcgtcgtgtagttgtgaccggactgggcatgttgtctcctgtcggcaataccgtagagtctacctggaaagctctccttgccggtcagagtggcatcagcctgatcgaccatttcgatactagcgcctatgcaacgaaatttgctggcttagtaaaggattttaactgtgatgacattatctcgcgcaaagaacagcgcaagatggatgccttcattcaatatggaattgtcgctggcgtacaggccatgcaggattctggccttgaagtgacggaagagaacgcaagccgtattggcgccgctatcggctccggtatcggtggtctcggtctgatcgaagaaaaccacagttcgctggtaaaaggcggaccgcgtaagattagcccgttctttgtcccgtcgacgattgttaacatggtagcaggccatctgactatcatgtatggcctgcgtgggccaagcatctctattgcgactgcctgtacttcaggcgtgcataacatcggccatgccgcgcgtatcatcgcctatggcgatgcggacgcgatggtggcaggtggcgcagaaaaagccagtacgccgctgggcgtaggtggttttggcgcagcgcgcgcgctgtcgacccgcaacgataacccacaggcggcgagccgtccgtgggataaagaacgcgatggttttgtactgggcgacggtgccggtatgttggtgcttgaagagtacgaacatgcaaaagcgcgtggtgcgaaaatctatgccgaaatcgtcggctttggtatgagcagcgatgcttaccatatgacgtcgccgccggaaaatggcgcaggcgctgcgctggcgatggttaacgcgttgcgtgatgccgcgattgagcctgctcagattggctacgtcaacgcgcacggcacgtcgacgcctgccggcgacaaagctgagacgcaggcggttaagtcagtctttggcgatgcagcaagccgagtgatggtgagctcgaccaaatcgatgaccggccatctgttgggcgccgcaggcgcagtagagtctattttctctattctggcgctacgcgatcaggccattccgccaaccattaatctggataacccggatgaaggttgcgatctggacttcgtgccgcatgaagcgcgccaggtcagcgatctggagtatgctctgtgtaactcctttggctttggcggaactaacggttccttgatttttaaaaagatctaa

SEQ ID NO: 19923 - protein, 413 aa, Salmonella enterica subsp. enterica serovar Paratyphi A str. ATCC
MSKRRVVVTGLGMLSPVGNTVESTWKALLAGQSGISLIDHFDTSAYATKFAGLVKDFNCDDIISRKEQRKMDAFIQYGIVAGVQAMQDSGLEVTEENASRIGAAIGSGIGGLGLIEENHSSLVKGGPRKISPFFVPSTIVNMVAGHLTIMYGLRGPSISIATACTSGVHNIGHAARIIAYGDADAMVAGGAEKASTPLGVGGFGAARALSTRNDNPQAASRPWDKERDGFVLGDGAGMLVLEEYEHAKARGAKIYAEIVGFGMSSDAYHMTSPPENGAGAALAMVNALRDAAIEPAQIGYVNAHGTSTPAGDKAETQAVKSVFGDAASRVMVSSTKSMTGHLLGAAGAVESIFSILALRDQAIPPTINLDNPDEGCDLDFVPHEARQVSDLEYALCNSFGFGGTNGSLIFKKI

SEQ ID NO: 19924 - DNA, 1284 bp, Anaplasma marginale str. St. Maries
  CDS (1)..(1284): transl_table=11
ttgtttcggttttgtatggctgatagggctagggttgtcgtaactggtatgggcctggtaacaccgctggggtttcagatccccgatgtgtgggaccgtttagtcaatgggaagtcgggaataagtgccattagcgggtttgacactcatgaccttgagtgcagagtcgggggccaggtgatttccgaaggccagtcaggggagaacgtgtttgaccccactcagtgggtcgaagaaaaagacgtaaaaaaggctgaccgcttcatcattttcggggtggccgcagcagatatggcgttgtccgacgccggcttgctgggcacggagtttgaccctgaccggatcggagtactggtagggtccggcgtaggcggcttaccgtgcatagaaagaaatgttatagccgtgcacgagcgcgggcctaggcgcgtgagcccgtttttcataccaggaagtctggtcaacttactccctggacacatttccatacgacacgggctgacggggtactgcaacgcatcagtgagtgcctgcgcgacgggggccgccgccattgccgacgcggcgcgagtcatagcatcaggagaggcggacgttatgctcgctggtggagcggagggtgcgttgtgtagggcggcagtggctgggttctgcatcataaaggccctatcgacaaaattcaatgatacaccagagctcgcttctcgtccttgggatagggacagggacggctttgtgatcggagagggtgccggcattctggtactggaaagctatgagcacgcaaagatgaggggtgcgaatatatacgcggagctcgtcggttacgggataacttcagatgcctatcacgtgacagccccacaccctgaaggtcgggggggagcggacgcaatgaaacgcgcgctgcaaatgtctgggattgctccagaaagtgtggggtatataaacgcgcatggaacctcaacgccggtgggagacagtgttgagatttccgcaataaaatcggtgtttggtgaccacgcataccgtatgcccatatcctccacaaaatcctctatcggccacctgttgggggcagccgggggtgtggaagccattttttccatactatctatccgcaatggggtcgtgcctccaacgttaaacttgcaaaattcttcggaagacagtaatttgaacttggtgcctttgaacgcgcaggaacataaggtgtcaagtgcgatgtcaaattccttcgggtttgggggagtgaatgcatcgctggtgttcggggccgtgtag

SEQ ID NO: 19925 - protein, 427 aa, Anaplasma marginale str. St. Maries
MFRFCMADRARVVVTGMGLVTPLGFQIPDVWDRLVNGKSGISAISGFDTHDLECRVGGQVISEGQSGENVFDPTQWVEEKDVKKADRFIIFGVAAADMALSDAGLLGTEFDPDRIGVLVGSGVGGLPCIERNVIAVHERGPRRVSPFFIPGSLVNLLPGHISIRHGLTGYCNASVSACATGAAAIADAARVIASGEADVMLAGGAEGALCRAAVAGFCIIKALSTKFNDTPELASRPWDRDRDGFVIGEGAGILVLESYEHAKMRGANIYAELVGYGITSDAYHVTAPHPEGRGGADAMKRALQMSGIAPESVGYINAHGTSTPVGDSVEISAIKSVFGDHAYRMPISSTKSSIGHLLGAAGGVEAIFSILSIRNGVVPPTLNLQNSSEDSNLNLVPLNAQEHKVSSAMSNSFGFGGVNASLVFGAV

SEQ ID NO: 19926 - DNA, 1239 bp, Azoarcus sp. EbN1
  CDS (1)..(1239): transl_table=11
ttgacccgtcgcagagtcgtcattaccggtctcggaatcatctcgccggtcggtaataccgttccggaggcctgggacaacattgtcaacggccgctccggcatcggcgaaatcacgcgtttcgatgcttccagcttcccggtcaggatcgccggcgaagtgaggggtttcgacattggcgcctacctgtctccgaaggaggcgcgtcgtatggatgttttcatccactacggcctggccgcaggcatccaggcgttcagggatgccgggctggacgttaccgcctccaatgcggaacgcataggggtcaacctcgggtcgggaatcggcggcttgccgatgatcgaagcgacccacgacgatttcctcaagggcggggcacgcaagatttcccctttcttcattcccggcacgatcatcaacatgatcgccggcaacctgtcgatcatgctcggactgaagggtccgtgcctggcgatggttaccgcatgcaccacggcgacgcactgcatcggcgaggcagcgcggctcatccagtacggggatgtcgatgtgatggtggccggcggcgcggaatccaccgtcactccgctcgccgttggcggcttcgcctccgcgaaggcgttgtcgacgcgcaacgatgatccgcttactgccagccgtccatgggacaaggggcgcgacggtttcgtgctcggcgaaggggccggcgtgctggtcctcgaagagtacgagcacgcgaaggcgcggggcgcccggatctacgccgaaatatccggctacggcatgagcgccgatgcctatcacatgactgcaccggccgaggacggtgacggcgccgcgcgctgcatggcgaacgcgatgcgcgatgcgcgcatgacggtcgaggagatcgactacgtcaacgcccacggcacttcgacgccccttggagacttggccgaaacgaccgcggtaaagcgctgtttcggcgatcgggcaagatcgatcgtggtgaactccaccaagtcgatgaccggccatctgctcggcgccgcgggaggtgtcgaagcggtgttcaccgcgctggccctgcacaaccagatcgctccgccgacgatcaacattttcgagcaggacgagcggtgcgaccttgattacgtcgcgaacaaggcgcgtccgatggagatccgggcagcgctttcgaattcgttcggcttcggtggcacgaacggcacgctggcgtttcgtcgcatctga

SEQ ID NO: 19927 - protein, 412 aa, Azoarcus sp. EbN1
MTRRRVVITGLGIISPVGNTVPEAWDNIVNGRSGIGEITRFDASSFPVRIAGEVRGFDIGAYLSPKEARRMDVFIHYGLAAGIQAFRDAGLDVTASNAERIGVNLGSGIGGLPMIEATHDDFLKGGARKISPFFIPGTIINMIAGNLSIMLGLKGPCLAMVTACTTATHCIGEAARLIQYGDVDVMVAGGAESTVTPLAVGGFASAKALSTRNDDPLTASRPWDKGRDGFVLGEGAGVLVLEEYEHAKARGARIYAEISGYGMSADAYHMTAPAEDGDGAARCMANAMRDARMTVEEIDYVNAHGTSTPLGDLAETTAVKRCFGDRARSIVVNSTKSMTGHLLGAAGGVEAVFTALALHNQIAPPTINIFEQDERCDLDYVANKARPMEIRAALSNSFGFGGTNGTLAFRRI

SEQ ID NO: 19928 - DNA, 1299 bp, Zymomonas mobilis subsp. mobilis ZM4
  CDS (1)..(1299): transl_table=11
atgctgaaggcattctgtcaaggggagaaaagtaatatgcgtcgtgtagtcgctaccggcttgggaatggtgacttcgctgggtggcgatgtcgaaacaacatggtcgaatattctggcctcaaagtccggtgctgggcgtatcacgcgtttcgatccggaaggttttgcttgtacggttgcttgtgaagtcaaaccggccgaccatgaatatggctttgatccgtccaaacgcgttgacagcaagacgataagacaggtcgaacccttcattatctatggcattgatgccgctggacaggctttggaagatgccggtctcatggatatgagcgaagaagaaaaactcagaacgggtctttctatcggcgctggtatcggtggtttaccccgtatcgaaaaagaatccatcatctgccatgaaaaagggccccgccgcgtttcgcctcatttcgtgcatgccagtcttatcaatctgacggctggacaggtttctatccgctatggcctgaaagggcctaaccacgctgtcgtcacggcttgctcttccggttgtcattccattggcgatgccagctggatgattcgcatgggctatgccgatgtgatggttgcagggggttctgaatcggctatttgccctctcggtatcgccggattctcacaggcacatgctctttcgacaggtcataacgacacgcccgaaaaagcttcccgtccatatgacaaaggccgcgacggttttgtcatgggtgatggtgccggtattattattctcgaagaatatgaacatgccaaggcacgtggagccaaaatttacggcgaaattatcggctatggtatgacgggtgatgcgtatcatgtgaccgctccccagccagatggtgatggtgcctatcgctccatgaaaatggcgcttgagcaggccaatcttaccaccgctgatattgattatatcaatgcacatggcacctcgacgcccatgggcgatgaaatcgaagccaacgccgttcgccggttgtttggggatgacattaaaaatatgtcaatgagttcaacgaagtctgccatcggccatttattgggcggtgcaggggctgttgaaacgattttctgcctgttggcgatgcgtgatcagattgcgcctccgaccatcaacctcgaaaatccgagcgatggcttagctggctttgatctggtgcccaatgttccgaaaaaacgctcaatcaaggccgttttgaataacagctttggttttggtggaaccaatgccagcttgatcttcaaagctgtagactaa

SEQ ID NO: 19929 - protein, 432 aa, Zymomonas mobilis subsp. mobilis ZM4
MLKAFCQGEKSNMRRVVATGLGMVTSLGGDVETTWSNILASKSGAGRITRFDPEGFACTVACEVKPADHEYGFDPSKRVDSKTIRQVEPFIIYGIDAAGQALEDAGLMDMSEEEKLRTGLSIGAGIGGLPRIEKESIICHEKGPRRVSPHFVHASLINLTAGQVSIRYGLKGPNHAVVTACSSGCHSIGDASWMIRMGYADVMVAGGSESAICPLGIAGFSQAHALSTGHNDTPEKASRPYDKGRDGFVMGDGAGIIILEEYEHAKARGAKIYGEIIGYGMTGDAYHVTAPQPDGDGAYRSMKMALEQANLTTADIDYINAHGTSTPMGDEIEANAVRRLFGDDIKNMSMSSTKSAIGHLLGGAGAVETIFCLLAMRDQIAPPTINLENPSDGLAGFDLVPNVPKKRSIKAVLNNSFGFGGTNASLIFKAVD

SEQ ID NO: 19930 - DNA, 1209 bp, Silicibacter pomeroyi DSS-3
  CDS (1)..(1209): transl_table=11
atgaaacgggtcgttatcaccggggccggcaccatcaacgcgctggggcactcggtacccgagacgctgaccgcgatgcgcgaggggaaatgcggcatcggcgaactggagtttcgcgatgtcgatcggctggccatccgcatcggtggccaggtccgcggattcgaggccgaaggccggttcaaccgccagcagatgtctctctatgaccggttcacccaattcaccctgaccgccgccaaagaggcgatcgaccaggccgggttggccttccacggtgaactggcggcgaaatcgggggtggtgctgggcacggccggcggcggcgtcagcacctgggacgagaattaccgctccgtctatgaagagggcaagaaccgggtccatccctttgtcgtgcccaagctgatgaacaacgcggccgccagccatgtgtcgatggaacataacctcaaggggccgtcctttaccgtctcgaccgcctgcgcctcgtcgaatcacgcgatggcacaggccttttccatggtgcgcagcggcatggcgccggtgatgatcaccggcggctcggaatcgatgctgtgttttggcggggtcaaggcctgggaagggctgcgggtgatgtccaaggacgcttgccgcccgttcagcgccaaccgcaacggcatggtccagggcgagggcgccggtatcttcgtgttcgaagaatacgaacatgccaaggcgcgcggcgccgagatcctgtgcgaagtggcgggttttgccatgtcctcggatgcggccgatatcgtgatgccctcgaaacagggggcggcgcgggcgatggcgggggcattggccgatgcgcgcatcaacccgggcgaggtcggctatatcaacgcccatggcaccggaacggcggccaatgacaagaccgaatgcgccgcggtggccgatgtgttcggccgtcatgccgacagcctgatgatttcctcgaccaaatcgatgcatggccacctgatcggcggtaccggcgcggtggagttgctggcctgtatcatggcgctgcgcgactgggtgatcgcgcccacgatcggttatgaagagcctgaccccgaatgcgcactggacgtggtccccaacgaggcgcgcgaggccaaggtggatgtggcgctcagcaacgcctttgcctttggcgggttgaacgcggttctggccctgcgcaaggtttga

SEQ ID NO: 19931 - protein, 402 aa, Silicibacter pomeroyi DSS-3
MKRVVITGAGTINALGHSVPETLTAMREGKCGIGELEFRDVDRLAIRIGGQVRGFEAEGRFNRQQMSLYDRFTQFTLTAAKEAIDQAGLAFHGELAAKSGVVLGTAGGGVSTWDENYRSVYEEGKNRVHPFVVPKLMNNAAASHVSMEHNLKGPSFTVSTACASSNHAMAQAFSMVRSGMAPVMITGGSESMLCFGGVKAWEGLRVMSKDACRPFSANRNGMVQGEGAGIFVFEEYEHAKARGAEILCEVAGFAMSSDAADIVMPSKQGAARAMAGALADARINPGEVGYINAHGTGTAANDKTECAAVADVFGRHADSLMISSTKSMHGHLIGGTGAVELLACIMALRDWVIAPTIGYEEPDPECALDVVPNEAREAKVDVALSNAFAFGGLNAVLALRKV

SEQ ID NO: 19932 - DNA, 1266 bp, Silicibacter pomeroyi DSS-3
  CDS (1)..(1266): transl_table=11
atgcgcagagtcgttgtaaccggactgggactgatcacacctttggccagcggggtcgaggaaacctggtcccgtctgctggagggacaatcgggcgcgggtccgattacgcggtttgatgcggtggcgtcgggtgttaccacgacctatgcctgcgaagtgccgcgcggcgatggcagcgatggcaccttcaatcccgatgactggatggcgccgaaagagcagcgcaagatcgaggatttcatcctctattccatcgcggccgccgagatggcctgcaaggatgccaactggctgcccgaggacgaagaggaccgcttgcgcaccggcgtgctgatcggctcgggtatcggcgggctgggctcgattgccgagaccgccaacctgatcaaggagaagggcccccgccgggtgtcgcccttctttatccccggcgcgctgatcaacctggcctcgggccaggtgtcgatccgtcacgggttcaaggggccgaaccactcggtggtgaccgcctgttcgaccggcgcgcatgcgattggcgatgccagccggatcatccgggccggtgacgcggatgtgatgatcgccggtggtggcgaggcctgtatctgcgaaatcggcattgccgggttcaacgcctgcaaggcgctgtcgaccaaatatgccgacaaccccaaggccgccagccgaccctatgacgccgaccgcgacgggttcgtgatgggtgagggcgccggcatcgtggtgctggaggactatgaacacgccaaggcgcgcggtgccaagatttatgccgaagtcttgggctatggcatgtcgggcgatgcctatcacatcactgcgccctccgagaccggcgacggggccgaacgctcgatgcgcgccgctctgcgcagcgccgggctggagccgtcggatctggattacatcaacgcccatggcacctcgaccatggccgacacgatcgagctgggcgcggtggagcggctgttgggcaaccatgcggccaatgtcaccatgtcctcgaccaaatcggccaccgggcacctgttgggcgctgccggcgcgatcgaggcgatcttttcgatcctggcgatccgcgatcaggtggccccgccaaccatcaacctggacaacccggcagttgagaccccggtcgatctggcgcccaatgccaagcgtgcgcgcaagatcgacgtggctctgtcgaactccttcggttttggcggcaccaatgcgagcgtgatcttcggaaaggccgactga

SEQ ID NO: 19933 - protein, 421 aa, Silicibacter pomeroyi DSS-3
MRRVVVTGLGLITPLASGVEETWSRLLEGQSGAGPITRFDAVASGVTTTYACEVPRGDGSDGTFNPDDWMAPKEQRKIEDFILYSIAAAEMACKDANWLPEDEEDRLRTGVLIGSGIGGLGSIAETANLIKEKGPRRVSPFFIPGALINLASGQVSIRHGFKGPNHSVVTACSTGAHAIGDASRIIRAGDADVMIAGGGEACICEIGIAGFNACKALSTKYADNPKAASRPYDADRDGFVMGEGAGIVVLEDYEHAKARGAKIYAEVLGYGMSGDAYHITAPSETGDGAERSMRAALRSAGLEPSDLDYINAHGTSTMADTIELGAVERLLGNHAANVTMSSTKSATGHLLGAAGAIEAIFSILAIRDQVAPPTINLDNPAVETPVDLAPNAKRARKIDVALSNSFGFGGTNASVIFGKAD

SEQ ID NO: 19934 - DNA, 1260 bp, Francisella tularensis subsp. tularensis SCHU S4
  CDS (1)..(1260): transl_table=11
atgaaatctaatcgtagagtagttgttactggcttaggcatggtaacacctttaggaaatgatgtccctacgacttgggctaatatcttagctggcaaaagtggagtagaaactataactggttttgacacacctgctcctgatattagcgagtttaaagttagatttgcagcaagaattaaaaattttgatgtagatgcacttgtaggtaaaaaagacgcaaagagagtagatcctttctgctactatggtattgccgctgctaatgaagctcttaaagatgctggaattgataaagtatctgaagaagattcatataagtttggcgtatgtgttagttctggtatcggtggtatcgagactttagaaactactaaagctgtaatagatacaaaaggaccttctaaaatttcacctttttgtataccatcctcaatcgtgaatatgctctctggaatcatttctataaatcatggcttacgtgggcctaatattccaatcgttactgcttgtactacaggtactcataatattggtatggctgctagattaatagctagtggtgatgctaatactatgcttgctggtggctctgaaaaagcaagtaacgctattggtatgggtggatttgctgctgctagagcattatcaacgcgcaatgatgatccacaaggtgcatcacgcccttgggacaaagacagagatggctttgtacttggcgatggtgctggtgttgttgtcttagaagaatatgaaagagctaaagctcgtggcgctaagatttatgctgaggttgtgggttttggtatgtctgctgatggttatcatatgactatgccttatgctccaggtcaagaaagatgtattcagaatgctttagctgatgctggacttgaaaataatcctgatgctatagactacgttaatgctcacagtacttcaactccactaggagatgttcaggagtcacaagttgttgaaaaagtaattggacaatatagaaaagatctagttatgagctcaacaaaatcaatgacaggacatttacttggtgcagctggtgctattgaatcaatatttagtgtattagcaataagagaccaagtagctccaccaacaataaacctacataatttagatgatggctgtaacttagattatgctgcaaatgctgctaagaaaatgaaaattgattatgtgctaaataactcttttggttttggtggcactaatggttctgtaattttcaaaaaaatctaa

SEQ ID NO: 19935 - protein, 419 aa, Francisella tularensis subsp. tularensis SCHU S4
MKSNRRVVVTGLGMVTPLGNDVPTTWANILAGKSGVETITGFDTPAPDISEFKVRFAARIKNFDVDALVGKKDAKRVDPFCYYGIAAANEALKDAGIDKVSEEDSYKFGVCVSSGIGGIETLETTKAVIDTKGPSKISPFCIPSSIVNMLSGIISINHGLRGPNIPIVTACTTGTHNIGMAARLIASGDANTMLAGGSEKASNAIGMGGFAAARALSTRNDDPQGASRPWDKDRDGFVLGDGAGVVVLEEYERAKARGAKIYAEVVGFGMSADGYHMTMPYAPGQERCIQNALADAGLENNPDAIDYVNAHSTSTPLGDVQESQVVEKVIGQYRKDLVMSSTKSMTGHLLGAAGAIESIFSVLAIRDQVAPPTINLHNLDDGCNLDYAANAAKKMKIDYVLNNSFGFGGTNGSVIFKKI

SEQ ID NO: 19936 - DNA, 1254 bp, Synechococcus elongatus PCC 6301
  CDS (1)..(1254): transl_table=11
atgactgaaaccggacgccagcgtgttgttattactggtttgggagccattactcccatcggtaatgatccaacggaatattggcagggactccttgccggtcgcaacggcatcgatctgattcggggctttgatgcgtctcgtcacgcctgcaaaattgccggggaggtcaaggactttgaccccacccagtacatggaccgcaaggatgctaagcggatggatcggtttgcacaactggcggttgctgccagtcgccaagcagtcgccgatgccaagctggacatcactgaactgaatgcggatgcgatcggggtgctgatcggctcaggcattggtggtttgagggtgatggaggaccagcagacggttttgctggaaaaaggccccgatcgctgcagccccttcatggtgccgatgatgatcgccaacatggcggcaggactgacggccatccagttgggtgccaaaggcccttgcaatgtcacggtgactgcttgcgctgcgggttctaatgcggtgggtgaagccttccggctgattcagcacggctatgcccaagccatgatctgtggcggaactgaatcctgtgtgaccccactggctatggccggttttgcggcctgtaaggcactgtcgctgcgcaacgatgacccggcccatgcttgccgtccctttgaccaaggccgtgatggttttgtgatgggcgaaggcgcagggattttggtcttggaatccttggagcatgcccaagcgaggggcgctcacatctatggcgaaatcgtcggctatggcatgacctgtgatgcctatcacatcacctcgccggtcccaggtggtttgggtgcggcccgggcgatcgagttggcgctccgcgatgccaatctgcagcccagccaagtcagctacatcaatgctcacggcaccagcacaccggccaacgacagcaccgaaacggcagctattaagaaagccctaggtgagcacgcctacaaaaccgtgatcagctcgactaagtcgatgaccggtcacctgttagggggctccggcggaattgaggcggtagcggcaaccctcgcgatcgctgaggacatggtgccgccgacgattaacctggaagatcccgatcccgattgcgacttggactatgtccccaatcaggcgcgatcgctaccggtggaagtggctttgtccaattccttcggctttggtgggcacaacgtcacgctggccttccggaaattccatccctag

SEQ ID NO: 19937 - protein, 417 aa, Synechococcus elongatus PCC 6301
MTETGRQRVVITGLGAITPIGNDPTEYWQGLLAGRNGIDLIRGFDASRHACKIAGEVKDFDPTQYMDRKDAKRMDRFAQLAVAASRQAVADAKLDITELNADAIGVLIGSGIGGLRVMEDQQTVLLEKGPDRCSPFMVPMMIANMAAGLTAIQLGAKGPCNVTVTACAAGSNAVGEAFRLIQHGYAQAMICGGTESCVTPLAMAGFAACKALSLRNDDPAHACRPFDQGRDGFVMGEGAGILVLESLEHAQARGAHIYGEIVGYGMTCDAYHITSPVPGGLGAARAIELALRDANLQPSQVSYINAHGTSTPANDSTETAAIKKALGEHAYKTVISSTKSMTGHLLGGSGGIEAVAATLAIAEDMVPPTINLEDPDPDCDLDYVPNQARSLPVEVALSNSFGFGGHNVTLAFRKFHP

SEQ ID NO: 19938 - DNA, 1242 bp, Bacillus clausii KSM-K16
  CDS (1)..(1242): transl_table=11
gtggaaaaacgacgtgtagttgtaacaggccttggggcggttacgccgctcgggctcgatgcaaaaacatcttgggagcaggcaaaagcaggaaagtcggggattggctatttgacccgcatagatgctgctgcttttccgatgaaagtggcggcagaaattgctgattttgacccaactgctgcgattgatcgtaaagaagttcggaaaatggatcgctttacccagtttgcggttgtttcagcccaagaagcattagcggatgcagggctagaaattacacctgaaaatgctgatcgcgttggcgtttggattggctctgggattggcgggatggaaacgtatgaaaatcaattccgcatctttttagaaaagggtcaacgccgcgttagcccatttttcgtgccgatgatgattccagatatggcgagcgggcaagtatcgatctttacaggagcaaaaggcccgaattcgtgctctgtaacggcgtgcgcatcagggacaaattcaatcggggacgcctttaaagtgatacagcgagggaatgcggacgttatgattacaggcggaagtgaagcgcctattaccaatatggctgtggctggtttctcatcagctaaagccattacaacaagcgatgacccggcaacggcttcgaggccattcgatgccaaccgcagcggctttgtcatgggtgaaggagcaggcatattaattttggaaagcttagagtctgcaaaagcccgaggtgcccacatttatgcggaaattgtcggctatggctcaacaggggacgccttccacgtcaccagccctgctcccgaaggtgaaggaggagcgcgcagcatgcaggcagcgattgacgacgccggtctagctcctgaagaggttagctacattaatgcccatggaacaagcacagagctcaatgatccttatgaaacaaaggcgataaaaaccgtgtttggcgagcatgcttataaactggcaataagttcaacaaaatcaatgacaggacacttgcttggagcggctggagcagtggaagccatcttctcagtgaaggcaattgatgaagacatcatcccgccaacgattaacttggaaacgccagaccctgagtgtgacttagattatgtgccgaacgaagcgagacaagcacctgtccatgttgctttaagcaactcactcggctttggcggccacaacgcctcactcgtatttaaaaaatgggttgaataa

SEQ ID NO: 19939 - protein, 413 aa, Bacillus clausii KSM-K16
MEKRRVVVTGLGAVTPLGLDAKTSWEQAKAGKSGIGYLTRIDAAAFPMKVAAEIADFDPTAAIDRKEVRKMDRFTQFAVVSAQEALADAGLEITPENADRVGVWIGSGIGGMETYENQFRIFLEKGQRRVSPFFVPMMIPDMASGQVSIFTGAKGPNSCSVTACASGTNSIGDAFKVIQRGNADVMITGGSEAPITNMAVAGFSSAKAITTSDDPATASRPFDANRSGFVMGEGAGILILESLESAKARGAHIYAEIVGYGSTGDAFHVTSPAPEGEGGARSMQAAIDDAGLAPEEVSYINAHGTSTELNDPYETKAIKTVFGEHAYKLAISSTKSMTGHLLGAAGAVEAIFSVKAIDEDIIPPTINLETPDPECDLDYVPNEARQAPVHVALSNSLGFGGHNASLVFKKWVE

SEQ ID NO: 19940 - DNA, 1215 bp, Campylobacter jejuni RM1221
  CDS (1)..(1215): transl_table=11
ttgaaaagagttgtagttacaggtattggtatgatcaatgcccttggtttagataaagaaagttcatttaaagcaatttgcaatggagaaagcggagtaaataaaattactctttttgatgctacggactttcctgttcaaattgcagctgaagttaaaaattttgatccattagaggttgttgatggcaaagaagtaaaaaaaattgaccgtttcatacaacttggaattaaagcagcaagagaagcaatgcaggatgctggatttagtgaagaattagataaagaagaatttggcattgtttcggcttctggtattggaggtttgcctaacatagaaaaaaattccattatttgttccgagcgaggtccgcgtaaaatttccccttttttcataccttcagcacttgtaaatatgttaggaggtttgatttctatagagcatgggcttaaagggccaaatatttcttgtgttacagcttgtgcagcaggaactcatgctataggagaagcttataaaagtatagctttgggaaatgctaaaaagatgttagtcataggtgcagaagctgcgatttgtcctgtaggtataggtggttttgcttcaatgaaagctttatcaactagaaatgaagatccagagcatgcttcaagaccatttgacaaagaaagagatggttttgtcatgggagaaggtgctggagctttagtttttgaggaatatgaagaggctaaaaaacgcggtgctacgatttatgctgaattaattggatttggagaaagtgcagatgcgcatcatattacttcaccaactttagatgggcctttaagagctatgaaaaaagctttaaatatggcagggaatccaaaggtagattatatcaatgcacatggaacttcaacccctgtaaatgacaaaaatgaaacagcagcaattaaagagctttttggcaataatatcccgcttataagttccaccaaaggacaaacaggtcattgcttgggtgctgcaggtgcaattgaagcagttgttagtgttatggctttaagagatggggtagttccacctacaatcaatcagcttgtaaaagatgatgaatgtgatcttgattatattccaaatatatcaagaaaagtagatttaaaagtggtgatgagtaattcttttggttttggtggcacaaatggctgtgttgtatttaaaaaagtagattaa

SEQ ID NO: 19941 - protein, 404 aa, Campylobacter jejuni RM1221
MKRVVVTGIGMINALGLDKESSFKAICNGESGVNKITLFDATDFPVQIAAEVKNFDPLEVVDGKEVKKIDRFIQLGIKAAREAMQDAGFSEELDKEEFGIVSASGIGGLPNIEKNSIICSERGPRKISPFFIPSALVNMLGGLISIEHGLKGPNISCVTACAAGTHAIGEAYKSIALGNAKKMLVIGAEAAICPVGIGGFASMKALSTRNEDPEHASRPFDKERDGFVMGEGAGALVFEEYEEAKKRGATIYAELIGFGESADAHHITSPTLDGPLRAMKKALNMAGNPKVDYINAHGTSTPVNDKNETAAIKELFGNNIPLISSTKGQTGHCLGAAGAIEAVVSVMALRDGVVPPTINQLVKDDECDLDYIPNISRKVDLKVVMSNSFGFGGTNGCVVFKKVD

SEQ ID NO: 19942 - DNA, 1272 bp, Ehrlichia ruminantium str. Welgevonden
  CDS (1)..(1272): transl_table=11
atgacaggaaaaagggtcgttattactgggttagggttagtaactccactaggaaatgatataaaaacagtatgggatcttttatgtaaaggaacttcaggaataaagaaaattaataggtttgatgcgtctgaccttgattgtaagatcggtggtcaaataataatgaagtcagattccgaaatacacacatttgatcctgcaaactggatagaagaaaaagaacttaaaaaaatggacatttttattcattttggtatagcagctgccattcaagcagttaatgactcaaacctgttagcttatagtaatcttgattataatagagtaggagtaatagttggatctggcataggtggattagcgtttatagagaaaacatctatttgtttacaagatcgtggaccaaaaagaattagcccattttttattcctgcaagtttgattaatttattacctggacacatatctataaaatatgggtttgcaggggttaatgatggaggagtaactgcatgtgcaacaagtgcacaaaccataggtaatgcagcaagaataatcaaatctggagaagcagatgttataatagcaggtggagctgaaagtgcaatatgtcgtatgggtgttgcagggtttgctgcattaaaggctttatcaacaaagttcaatgatactccagaattagcatcacgcccttgggataaacaacgtgacggttttgttatgggagaaggttcaggaataattgtacttgaagactacgaacatgctaaaaagcgtaatgcaaaaatatacgcagagttaatagggtatggtatgacggcagatgcatatcatataacagcacctcatccagaagggaaaggtggaaaaaaatctatggaattagcattaagtagtgctcaattaagtccagattctataaactacataaatgcacatggtacttctactccaattggagacagtactgaaattcacgcaataaaagaagtattcaaagatagtacatataagattccaatatcttcaacaaaatcttccataggacatttacttggagctgctggaagtgttgaggctatattttgtatacttgctattaatacaggaattgttccacctactctcaatttatatgattcatctgaggatccaaaactaaatcttgttccattaactgcacaagagcatacaataaattatgcgttatccaactcttttggttttggtggaacaaatgtatcactagtatttagtaagctatattaa

SEQ ID NO: 19943 - protein, 423 aa, Ehrlichia ruminantium str. Welgevonden
MTGKRVVITGLGLVTPLGNDIKTVWDLLCKGTSGIKKINRFDASDLDCKIGGQIIMKSDSEIHTFDPANWIEEKELKKMDIFIHFGIAAAIQAVNDSNLLAYSNLDYNRVGVIVGSGIGGLAFIEKTSICLQDRGPKRISPFFIPASLINLLPGHISIKYGFAGVNDGGVTACATSAQTIGNAARIIKSGEADVIIAGGAESAICRMGVAGFAALKALSTKFNDTPELASRPWDKQRDGFVMGEGSGIIVLEDYEHAKKRNAKIYAELIGYGMTADAYHITAPHPEGKGGKKSMELALSSAQLSPDSINYINAHGTSTPIGDSTEIHAIKEVFKDSTYKIPISSTKSSIGHLLGAAGSVEAIFCILAINTGIVPPTLNLYDSSEDPKLNLVPLTAQEHTINYALSNSFGFGGTNVSLVFSKLY

SEQ ID NO: 19944 - DNA, 1269 bp, Dehalococcoides ethenogenes 195
  CDS (1)..(1269): transl_table=11
atgactgataaccagccccaaaacagggttgtcataaccggcatcggcattgtcagccctcttggacttgatactcaaaccacctgggaaggcctgataaacggccgttcaggtatagaccatatcagcctctttgacgcatcaaatctggctgtccgctttggcggagaggtcaaagattttgacccggcgaactatatatcccgcaaggatatccgccgcatggaccgttttgcccagctggcggtagccgccggcaaacaggcactggaaaattcgggactgggggcagatgaaagcgtccggcaggatatcggggtaattgtaggcagcggcataggcgggctttcggttctctttgaacaaatcaaagttttcctggaacaagggccggacagagtcagcccttttttagtacccatgatgattgcagacatggccggagcccaggtttctatccagctgggtcttaaagggcctaatttctgtactacttcggcctgttcttctggttcagacgccataggcacagcatttgaaaaaatacgttttggttcggccaagattatcctggcgggcggtgccgaatctattatgaacccggttggttttgccggtttttcagccttaaaagccctatccacccgcaatgaagacccccagacggcttcgcgcccgtttgatgccaaccgggacggctttgttattgcggagggtgcggcgattttggttttggaagaaatggagtctgccaaagccaggggagcaaatatcattgccgagataatcggttacggcggctcttcagacgcttttcacataacccagccggtggaatccggtgtagaagccgcccgggctataaatattgccctgaataccgccggcatcaaaccggaagcggtagactatataaatgcccacggcacatctacccccctgaatgacaagatggaaaccaatgctattaaagtggccttcggggaacacgcccggaaactggccatcagctccaccaaatccatgctggggcatctgataggcggggccggggctattgaagcctctatctgcgccctgactattaaaaacggcattataccgcctaccataaactacaccactcctgaccctgactgtgatttagattacacccccaacaccgcccgcagagccaaggtaagggtggcgcttaataattcattcggtttcggcgggcataattcggtgcttatcctcagggaaatgggtgatgaaaatattggctaa

SEQ ID NO: 19945 - protein, 422 aa, Dehalococcoides ethenogenes 195
MTDNQPQNRVVITGIGIVSPLGLDTQTTWEGLINGRSGIDHISLFDASNLAVRFGGEVKDFDPANYISRKDIRRMDRFAQLAVAAGKQALENSGLGADESVRQDIGVIVGSGIGGLSVLFEQIKVFLEQGPDRVSPFLVPMMIADMAGAQVSIQLGLKGPNFCTTSACSSGSDAIGTAFEKIRFGSAKIILAGGAESIMNPVGFAGFSALKALSTRNEDPQTASRPFDANRDGFVIAEGAAILVLEEMESAKARGANIIAEIIGYGGSSDAFHITQPVESGVEAARAINIALNTAGIKPEAVDYINAHGTSTPLNDKMETNAIKVAFGEHARKLAISSTKSMLGHLIGGAGAIEASICALTIKNGIIPPTINYTTPDPDCDLDYTPNTARRAKVRVALNNSFGFGGHNSVLILREMGDENIG

SEQ ID NO: 19946 - DNA, 1245 bp, Staphylococcus epidermidis RP62A
  CDS (1)..(1245): transl_table=11
atgaataaaaataatagagttgttataacgggtatcggagccttatctccaattggtaacgatgctaaaacaacatgggacaatgcactaaaaggtgttaacggtatagataaaatcacaagaatagatactgatgattataatgtacatcttgctggtgaattgaaagattttaatatagaagaccacattgatagaaaagaagctcgccgtatggatcggtttacacaatacgcggtggttgctgcaagagaagcggttaaagatgcacaattaaatattaatgaaaaaaatgccgaccgtattggtgtatggattggttctggtatcggtggtatggaaactttcgaagttgcacatacaacacttgtagaaagaggaccacgtcgagtaagtccatttttcgttccaatgttaattcctgatatggctactggtcaagtttctattgatttaggtgccaaagggcccaatggttctacagtaacagcttgtgctacggggactaactcaataggtgaggcatttaaaattattcaacgtggtgatgcagatgcaatggtgactggtggaacagaggcacctattacacatatggcaatcgcagggtttagtgcaagtcgtgcattatctacaaacaatgaccctgaaacagcttgtcgaccattccaagaaggccgtgatggctttgttatgggtgaaggggcaggtattgttgtacttgaatcattagattcagctaaagagagaggcgctgaaatttacgctgaagttgtaggttatggttcctctggcgatgcacatcatattacagcacctgcgcctgaaggtgaaggtggctcacgagctatgcaagctgctttagatgatgctggaatcaaagctcaagatgtacagtatttaaatgcacatggcacaagtacacctgttggagatttatatgaggttcaagcgattaaaaatacattcggtgatgctgcgaagtcattaaaagtaagttcaactaaatcaatgactggacatttattaggtgctacaggtggaattgaagctattttttctgcgctatcaattcgtgattcaaaggtagcccctacaatacatgcaatcacaccagacgaagaatgtgatttggacattgttccgaatgtagcccaagacttagacattacctatgcaatgagtaatagtttaggatttggtggacataatgcagtgttagtatttaaaaaatttgaagactaa

SEQ ID NO: 19947 - protein, 414 aa, Staphylococcus epidermidis RP62A
MNKNNRVVITGIGALSPIGNDAKTTWDNALKGVNGIDKITRIDTDDYNVHLAGELKDFNIEDHIDRKEARRMDRFTQYAVVAAREAVKDAQLNINEKNADRIGVWIGSGIGGMETFEVAHTTLVERGPRRVSPFFVPMLIPDMATGQVSIDLGAKGPNGSTVTACATGTNSIGEAFKIIQRGDADAMVTGGTEAPITHMAIAGFSASRALSTNNDPETACRPFQEGRDGFVMGEGAGIVVLESLDSAKERGAEIYAEVVGYGSSGDAHHITAPAPEGEGGSRAMQAALDDAGIKAQDVQYLNAHGTSTPVGDLYEVQAIKNTFGDAAKSLKVSSTKSMTGHLLGATGGIEAIFSALSIRDSKVAPTIHAITPDEECDLDIVPNVAQDLDITYAMSNSLGFGGHNAVLVFKKFED

SEQ ID NO: 19948 - DNA, 1287 bp, Gluconobacter oxydans 621H
  CDS (1)..(1287): transl_table=11
atgagcgggactgcaactaacgggcggcgtgtcgtcgtaaccggtatcggtgttgtcagcccactggctgtgggcgcggaactgacatggaagcggctgatcgaaggacagtccggcattggccggatcacgcatttcgatccctccgaacttcctgcccaggtcgccggacaggttccggacggcccgacggcggaaggcggtctcacgttgtccgactgggtgccagtcaaggaccagaagaagatggaccgtttcatccatctgggccttgccgcagccatccaggctgtcgaggattcaggctggaagcctgaggacgaggacggtcgctgcgccacgggcgtgatgatcggctcgggtatcggcggtctccagacgatttatgacggctccctgacggtttcgagcggcaaggcccgccgtctgtcgccgttcttcattccctcggccctgatcaatctgatttccggtcacctctcgatccgctacgggttcaagggaccgaaccatgctgtcgtgacggcctgcgcgaccggcgttcatgccatcggtgatgcctcgcgcctcatccagtatggcgatgccgacgtgatggtggctggcggtgcggaagccgcgatctgctcgctcggtattgccggcttctgctcggcccgtgcgctctccaccggctccaacgatgatccgaccaaggcctcgcgcccgtgggacaaggaccgtgacggcttcatcatgggggagggtgccggtgtggtcgtgcttgaggaactcgagcatgccaagcgtcgtggtgcgaagatctatggtgagatcggcggctacggcatgtccggtgatgcgtatcacatcacggctcctgccgaaggtcacaacggtgcattccgtgccatgaaggccgcgctgcgcaacagcggcggcctgaccacggccgacatcgactatgtcaacgcccacggcacctccaccatggcggatgatcttgagcttgatgcggtcgagcgcttcttcggcgatgacgccaagcgtctggccatgtcctccacgaagtcggccattggccatcttctgggtgcggccggtgcggtcgaggctatcttctgccttcaggccatccgtgacggcatcgttccgcccacgctgaacctggacaacccggcgcgtgaaagcgtcatcgaccgcgtggcgcatgtggcccaggagcgcaagatcgacgttgccctgtccaacagcttcggctttggcggcacgaatgcgagcatcatcctcaagcgcttcaaggactga

SEQ ID NO: 19949 - protein, 428 aa, Gluconobacter oxydans 621H
MSGTATNGRRVVVTGIGVVSPLAVGAELTWKRLIEGQSGIGRITHFDPSELPAQVAGQVPDGPTAEGGLTLSDWVPVKDQKKMDRFIHLGLAAAIQAVEDSGWKPEDEDGRCATGVMIGSGIGGLQTIYDGSLTVSSGKARRLSPFFIPSALINLISGHLSIRYGFKGPNHAVVTACATGVHAIGDASRLIQYGDADVMVAGGAEAAICSLGIAGFCSARALSTGSNDDPTKASRPWDKDRDGFIMGEGAGVVVLEELEHAKRRGAKIYGEIGGYGMSGDAYHITAPAEGHNGAFRAMKAALRNSGGLTTADIDYVNAHGTSTMADDLELDAVERFFGDDAKRLAMSSTKSAIGHLLGAAGAVEAIFCLQAIRDGIVPPTLNLDNPARESVIDRVAHVAQERKIDVALSNSFGFGGTNASIILKRFKD

SEQ ID NO: 19950 - DNA, 1272 bp, Ehrlichia ruminantium str. Gardel
  CDS (1)..(1272): transl_table=11
atggcaggaaaaagggtcgttattactgggttagggttagtaactccactaggaaatgatataaaaacagtatgggatcttttatgtaaaggaacttcaggaataaagaaaattaataggtttgatgcgtctgaccttgattgtaagatcggtggtcaaataataatgaagtcagattccgaaatacacacatttgatcctgcaaactggatagaagaaaaagaacttaaaaaaatggacattttcattcattttggtatagcagctgccattcaagcagttaatgactcaaacctgttagcttatagtaatcttgattataatagagtaggagtaatagttggatctggcataggtggattagcgtttatagagaaaacatctatttgtttacaggatcgtggaccaaagagaattagcccattttttattcctgcaagtttgattaatttattacctggacacatatctataaaatatgggttcgcaggggttaacgatggaggagtaactgcatgtgcaacaagtgcacaaaccataggtaatgcagcaagaataatcaaatctggagaagcagatgttataatagcaggtggagctgaaagtgcaatatgtcgtatgggtgttgcaggatttgctgcattaaaggctttatcaacaaagttcaatgatactccagaattagcatcacgcccttgggataaacaacgtgacggttttgttatgggagaaggttcaggaataattgtacttgaagattacgaacatgctaaaaagcgtaatgcaaaaatatacgcagagttaatagggtatggtatgacggcagatgcatatcatataacagcacctcatccagaagggaaaggtggaaaaaaatctatggaattagcattaagtagtgctcaattaagtccagattctataaactacataaatgcacatggtacttctactccaattggagacagtactgaaattcacgcaataaaagaagtattcaaagatagtacatataagattccaatatcttcaacaaaatcttccataggacatttacttggagctgctggaagtgttgaggctatattttgtatacttgctattaatacaggaattgttccacctactctcaatttatatgattcatctgaggatccaaaactaaatcttgttccattaactgcacaagagcatacaataaattatgcgttatccaactcttttggttttggtggaacaaatgtatcactagtatttagtaagctatattaa

SEQ ID NO: 19951 - protein, 423 aa, Ehrlichia ruminantium str. Gardel
MAGKRVVITGLGLVTPLGNDIKTVWDLLCKGTSGIKKINRFDASDLDCKIGGQIIMKSDSEIHTFDPANWIEEKELKKMDIFIHFGIAAAIQAVNDSNLLAYSNLDYNRVGVIVGSGIGGLAFIEKTSICLQDRGPKRISPFFIPASLINLLPGHISIKYGFAGVNDGGVTACATSAQTIGNAARIIKSGEADVIIAGGAESAICRMGVAGFAALKALSTKFNDTPELASRPWDKQRDGFVMGEGSGIIVLEDYEHAKKRNAKIYAELIGYGMTADAYHITAPHPEGKGGKKSMELALSSAQLSPDSINYINAHGTSTPIGDSTEIHAIKEVFKDSTYKIPISSTKSSIGHLLGAAGSVEAIFCILAINTGIVPPTLNLYDSSEDPKLNLVPLTAQEHTINYALSNSFGFGGTNVSLVFSKLY

SEQ ID NO: 19952 - DNA, 1269 bp, Wolbachia endosymbiont strain TRS of Brugia malayi
  CDS (1)..(1269): transl_table=11
atgagcagaagagtagtagttactggtattggcttaattactccactggcagcagatgttgaaaatacttggcttaagttaataaatggtaagtctggtataaagaaaatcagtagattcgatgcttctgaccttagctgcaaagttgcagggcaagtccctttacaacatgacaacattgagcattgttttaacccattgaattacatctctgagaaagatctaaaaagaacagatcgctttattcattacggtattgcagctgccattcaggcagtagatgattcactaattttggaaaatcaaagcattaaccgagaacgtattggtgtggccattggctctggcataggtggtcttccatcaattcaggaaaatgtaattatcatgcaggaaaagggacccagacgtgttagtccattttttgttcctgcaagcttaataaatttaatatctggccatgtttctatcaaatatgaatttacaggtccaaatgattcagcagtaactgcatgtgcaacaggtgcacacgcaatcataaactcagcaagagctataaaacttggtgaagcagacgtgatgattgcaggtggatcagaaagtgcattgtgtagagttggaattgcaggttttgcatctatgaaggcattatcaactaaatttaacgataaacctaaagaagcttcaagaccgtggaatgaaggacgcgatggatttgtcatgggggaaggagcaggtatattagtgctagaagaatatgaacatgcaaaaaaaagaggtgcaaaaatatatgcagaactcactggatatgggctaacaggagatgcatatcatattacagcaccacatttagaaggaagaggtgcattaaaagcaatgcaactcgccttaaaaagtgcacaaataaatccaaatcaaatcgggtatatcaatgcacatggaacttcaacacctcttggagataaaattgaagtaatagcgataaaacaattattcgatgactatgcctataaaataccaatttcttcaactaaatcttctataggacatttacttggtgctgcaggaagtgttgaagcaatatttagcattcttgtgttaaacaatggaattgttccgccaactttaaatttacataaaccttcagaaggatgtgatttaaattttataccgcttaaagctcaagagcatgaaattcaatatgcgctttccaattcgtttggttttggtggtactaatgcatcacttgtttttggaaagtgtagttga

SEQ ID NO: 19953 - protein, 422 aa, Wolbachia endosymbiont strain TRS of Brugia malayi
MSRRVVVTGIGLITPLAADVENTWLKLINGKSGIKKISRFDASDLSCKVAGQVPLQHDNIEHCFNPLNYISEKDLKRTDRFIHYGIAAAIQAVDDSLILENQSINRERIGVAIGSGIGGLPSIQENVIIMQEKGPRRVSPFFVPASLINLISGHVSIKYEFTGPNDSAVTACATGAHAIINSARAIKLGEADVMIAGGSESALCRVGIAGFASMKALSTKFNDKPKEASRPWNEGRDGFVMGEGAGILVLEEYEHAKKRGAKIYAELTGYGLTGDAYHITAPHLEGRGALKAMQLALKSAQINPNQIGYINAHGTSTPLGDKIEVIAIKQLFDDYAYKIPISSTKSSIGHLLGAAGSVEAIFSILVLNNGIVPPTLNLHKPSEGCDLNFIPLKAQEHEIQYALSNSFGFGGTNASLVFGKCS

SEQ ID NO: 19954 - DNA, 1299 bp, Xanthomonas oryzae pv. oryzae KACC10331
  CDS (1)..(1299): transl_table=11
gtgtttttcaagcgtcatccgcaacccccaagcaccgtccgttacgtggttaggagatctgcaatgagtcgtcgtgttgtcgttaccggcatgggcattgtgtcgccgctgggcaatgatctggccaccagctgggatggaatcgtccacggccgctcgggcattggcccgatcacgcagatcgatgcctcgcagttcaccaccaagatcgccggtgaaatcaagaatttcgaccccacgctttttgtgtccgccaaggacgtcaagaagatggattcgttcatccactacggtctcggcgcctcgttcatggcgttggacgattccggcctggaaatcgacgacagcaatgccgaacgcgtgggcgccatcctcggctccggcatcggcgggctgctcggtattgaagagcagaccatcaaattccatgagggcggcgcgcgcaagatttccccgttctatgtgcccagcaccatcatcaacatgctgcctggccaggtgagcctgatcaaaggcctgaagggcccgacgttctcggcggtatcggcctgcgccacctccaaccattcgatcggcaccgcgatgcgcatgatccagcacggcgatgccgatgtgatgctggccggcggcgccgagcgcgggtcgtcgccgggttcggtgggcggcttctgcgcgatgaaggcgatgtccacccgcaacgacgacccgaccggcgcctcgcggccgtgggacaagcagcgcgatggcttcgtgctgggcgacggtgccggcgttctggtgctggaagaatacgaacacgccaaggcgcgtggcgcgcgcatctatgcagagctggttggcttcggcgccagttccgatgcgttccacatgaccgccccgagcgaagatggcgaaggcgcggcgcgcagcatggccgcggcgatgcgcgatgccaagctcaatcccgagcagatcggttatctcaatgcgcacggcacctccacgccgctgggcgatctggccgaaacgatcgcgatgaagcgcgcgctgggcgatcacgcctacaagaccatggtgagctcgaccaagtcgatgaccgggcatctgctcggcgcggccggtggcgtggaagcgatcttttcggtgatggcgctgcataccgggatcattccgccgaccatcaacctggaagagcccagcgaaggctgcgacctggattacgtgccgaacgtggcgcgcgaggtgcaggtggacgcggtaatgtccaacggcttcggctttggcggcaccaacggcacgctggtgttcaagcgcgtctga

SEQ ID NO: 19955 - protein, 432 aa, Xanthomonas oryzae pv. oryzae KACC10331
MFFKRHPQPPSTVRYVVRRSAMSRRVVVTGMGIVSPLGNDLATSWDGIVHGRSGIGPITQIDASQFTTKIAGEIKNFDPTLFVSAKDVKKMDSFIHYGLGASFMALDDSGLEIDDSNAERVGAILGSGIGGLLGIEEQTIKFHEGGARKISPFYVPSTIINMLPGQVSLIKGLKGPTFSAVSACATSNHSIGTAMRMIQHGDADVMLAGGAERGSSPGSVGGFCAMKAMSTRNDDPTGASRPWDKQRDGFVLGDGAGVLVLEEYEHAKARGARIYAELVGFGASSDAFHMTAPSEDGEGAARSMAAAMRDAKLNPEQIGYLNAHGTSTPLGDLAETIAMKRALGDHAYKTMVSSTKSMTGHLLGAAGGVEAIFSVMALHTGIIPPTINLEEPSEGCDLDYVPNVAREVQVDAVMSNGFGFGGTNGTLVFKRV

SEQ ID NO: 19956 - DNA, 1245 bp, Vibrio fischeri ES114
  CDS (1)..(1245): transl_table=11
gtgtccaaacgtcgtgtagttgttacaggcatgggtatgctaacaccggtgggtaacactgttgaagcatcttggaaagcgctgttagcaggccaaagcggtatcgttaatatcgaacactttgacaccactgagtttactactcgttttgcaggtctagttcaagactttaatgctgaagagtacatgtctaagaaagacgctcgtaagatggatttatttatccaatacggcgtagctgctggcattcaggcattagatgactcgggttttaaagttactgaagaaaatgctcaccgtatcggtgcagcaattggttcaggtattggtggccttggcttaattgaagctggctacaaagcattcagtgaaaaaggtcctcgtaagatcagcccgtttttcgtgccttctacaatcgttaatatgatcgcaggtcatatgtcgattattcgtggtttacgtggtccaaatatcgcaatttcaactgcttgtactacaggtcttcataatattggtcatgctgcacgtatgatcgcttatggtgatgctgatgcaatgctagctggtggtgctgagaaagcatctacagagctaggtatgggtggttttggtgcagcaaaagcactatctacaaataatgaaaaccctcaaggcgcatctcgtccttgggacaaaaaccgtgatggttttgttctaggtgatggtgctggcatgatggttcttgaagaatatgaacacgctaaagctcgtggtgctaagatctactgtgaacttgtaggttttggtatgagtggtgatgcttaccatatgacttcgccaacgccagatggttctggtggtgcgttagcgatggaagctgcgatgcgtgatgctggcgtaactggtgaacaaatcggttacgtaaatgcacacggtacgtctactcctgctggtgatgtagctgaaattaaaggcattaaacgtgctcttggtgaagctggctctaagcaagttttagtatcttcaacaaaatcaatgactggtcaccttttaggtgctgcaggttctgttgaagcaatcatcacagcgatgtctttggttgatcaaatcgttccaccaacaatcaaccttgatgatcctgaagaaggtttagatattgaccttgttccacacacagctcgtaaagtaacagatatggaatacgcaatctgtaactcattcggttttggtggtacaaacggttcactaatcttcaagaaaatgtaa

SEQ ID NO: 19957 - protein, 414 aa, Vibrio fischeri ES114
MSKRRVVVTGMGMLTPVGNTVEASWKALLAGQSGIVNIEHFDTTEFTTRFAGLVQDFNAEEYMSKKDARKMDLFIQYGVAAGIQALDDSGFKVTEENAHRIGAAIGSGIGGLGLIEAGYKAFSEKGPRKISPFFVPSTIVNMIAGHMSIIRGLRGPNIAISTACTTGLHNIGHAARMIAYGDADAMLAGGAEKASTELGMGGFGAAKALSTNNENPQGASRPWDKNRDGFVLGDGAGMMVLEEYEHAKARGAKIYCELVGFGMSGDAYHMTSPTPDGSGGALAMEAAMRDAGVTGEQIGYVNAHGTSTPAGDVAEIKGIKRALGEAGSKQVLVSSTKSMTGHLLGAAGSVEAIITAMSLVDQIVPPTINLDDPEEGLDIDLVPHTARKVTDMEYAICNSFGFGGTNGSLIFKKM

SEQ ID NO: 19958 - DNA, 1248 bp, Neisseria gonorrhoeae FA 1090
  CDS (1)..(1248): transl_table=11
atgagtcagagaagagtagtcattacaggcttaggtcaggtttcccctgtcggcaacactgccgcagaggcttgggacaacctgctcgccggcaaaagcggcatcggcgcgattacccgctttgacgcatccgacatcaacagccgtgtcgccggcgaagtgcgcggtttcgacatcggacaatacatcagcgcgaaagaagcgcgccggatggacgtgttcatccactacggcatcgccgccgcattgcaggcgattgccgattcgggtttggacgatgtggaaaacctcgacaaagaccgcatcggcgtgaacatcggttccggcatcggcggactgcccagcatcgaggccaccggcaaagccgtaatcgaaggcggcgcgcgcaaaatcaaccctttctttatccccggttcgctgatcaacctgatttccggacacgttaccatcctcaaaggctaccgcggcccgagctacggcatggtttccgcctgtaccaccggcgcgcacgccatcggcgattccgcccgactgatcaaatacggcgacgcggacataatggttgccggcggcgcggaaggcgcaatcagcaccttgggcgtgggcggttttgctgcgatgaaagccctctccacccgcaacgacgaccccgccaccgcttcccgtccgtgggacaaaggccgcgacggcttcgtcatcggcgaaggcgcgggcatattggtgttggaagaattagaacacgccaaaaaacgcggcgcgaaaatctacgccgaaatcgtcggcttcggcatgagttccgatgcttaccatatcaccgcgccgaacgaagaaggccccgcccttgccgttacccgcgcgctgaaagatgccggcatcaatcccgaagacgtggattacgtcaacgcgcacggcacgtccacccccttgggcgatgccaacgaaaccaaagccctcaaacgcgcgttcggcgaacacgcctgcaaaaccgtcatcagctcgaccaaatccatgaccggccacctgctcggcgcggcgggcggcgtggaggccgtgtacagcattttggcgatacacgacggcaaaatcccgccgaccatcaacatttttgaacaagacgttgaagccggctgcgatttggactactgcgccaacgaagcgcgcgacgcggaaatcgacgttgccatttccaactccttcggcttcggcggcaccaacggtacgctggtcttcaaacgcttcaaaggctga

SEQ ID NO: 19959 - protein, 415 aa, Neisseria gonorrhoeae FA 1090
MSQRRVVITGLGQVSPVGNTAAEAWDNLLAGKSGIGAITRFDASDINSRVAGEVRGFDIGQYISAKEARRMDVFIHYGIAAALQAIADSGLDDVENLDKDRIGVNIGSGIGGLPSIEATGKAVIEGGARKINPFFIPGSLINLISGHVTILKGYRGPSYGMVSACTTGAHAIGDSARLIKYGDADIMVAGGAEGAISTLGVGGFAAMKALSTRNDDPATASRPWDKGRDGFVIGEGAGILVLEELEHAKKRGAKIYAEIVGFGMSSDAYHITAPNEEGPALAVTRALKDAGINPEDVDYVNAHGTSTPLGDANETKALKRAFGEHACKTVISSTKSMTGHLLGAAGGVEAVYSILAIHDGKIPPTINIFEQDVEAGCDLDYCANEARDAEIDVAISNSFGFGGTNGTLVFKRFKG

SEQ ID NO: 19960 - DNA, 1263 bp, Bacteroides fragilis NCTC 9343
  CDS (1)..(1263): transl_table=11
atggaattaaagagagttgtagtaacaggtctgggcgccattactcctgttggcaataatgtcccggaattctgggagaacctcgtgaacggggttagtggagcaggacctattactcatttcgatgcatcgcaattcaagactcaatttgcatgtgaagtcaaaggcttcgatgcaactcaatatatcgaccgcaaagaggctcgtaaaatggacctgtacacacagtatgccgttgccgttgccaaagaagcagttgcagactcgggtcttgatatcgaaaatgaggatttaaacagaatcggcgttatttttggtgccggtatcggtggtatacgtacatttgaggaggaaacgagtaattacgcccttcacaaagaaaacggtcctaagtacaatccgttcttcatccctaagatgatttcagatattgctgccggacagatttctattatgtatggcttccacggcccgaactacgcaacttgttctgcatgtgcaacttctactaacgccatcgccgatgcattcaacctgatccgtctgggtaaggcaaacgtgattgtatccggtggttcggaagccgctatcgcagctgccggtgtaggaggtttcaatgctatgcatgcattgtcaactcgtaacgacgaaccacaatctgcatctcgtccgttcagtgcaagccgtgacggctttgtaatgggtgaaggtggtggatgtttgattcttgaagaactggaacatgcaaaagcccgtggcgcaaaaatctatgcagaagttgccggcgtaggtatgtctgctgatgctcaccacctgacagcatctcatccggaaggactcggtgcaaaattggtgatgaagaatgccctggaagacgcagagatgagtcctgaagaagtggattacatcaatgttcatggaacatctactccggtcggagatatatcggaagccaaagcaatcaaagaagtatttggtgaacatgcttttgagttgaatatcagttcaaccaaatcaatgacaggtcacttgttgggcgctgccggtgcggtagaatcaattgcaagtattctggctattaagaacggcatcgttcctccgactatcaatcatgccgaaggtgacaatgacgagaacattgactataatcttaatttcacgttcaacaaagcacagaaacgcgaaattaatgttgccctttcgaatacattcggattcggcggtcacaatgcttgtgtaatcttcaagaaatacgctgaataa

SEQ ID NO: 19961 - protein, 420 aa, Bacteroides fragilis NCTC 9343
MELKRVVVTGLGAITPVGNNVPEFWENLVNGVSGAGPITHFDASQFKTQFACEVKGFDATQYIDRKEARKMDLYTQYAVAVAKEAVADSGLDIENEDLNRIGVIFGAGIGGIRTFEEETSNYALHKENGPKYNPFFIPKMISDIAAGQISIMYGFHGPNYATCSACATSTNAIADAFNLIRLGKANVIVSGGSEAAIAAAGVGGFNAMHALSTRNDEPQSASRPFSASRDGFVMGEGGGCLILEELEHAKARGAKIYAEVAGVGMSADAHHLTASHPEGLGAKLVMKNALEDAEMSPEEVDYINVHGTSTPVGDISEAKAIKEVFGEHAFELNISSTKSMTGHLLGAAGAVESIASILAIKNGIVPPTINHAEGDNDENIDYNLNFTFNKAQKREINVALSNTFGFGGHNACVIFKKYAE

SEQ ID NO: 19962 - DNA, 1251 bp, Chlamydophila abortus S26/3
  CDS (1)..(1251): transl_table=11
atgagtaaaaaacgtgtagttgtcacgggattgggcgttgtttcttgtttaggtaacgaaatagacaccttttatgataatttgcttgccggtgttagcggtgttcgtacgatcacttctttcccatgcgaagattatgctacgcgttttgctggttggatccccgaatttaatcccgagccctatttagataaaaagcaagcacgaagagtagattgttttattacttacgccgtagttgcagctaagaaagctattgctatgtctagatgggacaaagataatcttccagcggatcctcttcgttgcggtgtgatcatcggttcgggtatgggaggattacagacattggacgatggtatggaacgcctgattcttggtaataaaaaactctctccatttttcataccttacattatcactaatatggctcctgccctgattgctatggatttcgggctgatgggaccgaactattccatatctacagcttgcgcaacttcaaactattgtatagatgccgcgtatcagcacctggtttctggacgcgcggatattatagtttgtggaggtaccgaagctgccgtgaatcgtgttggcttggcaggttttattgctaatcgtgccttatcagaaaggaatgatgcccctcaagaagcctctcgtccttgggatagggatagggacgggtttgtcattggtgaaggagccggaatcttagttttggaaaccttggaaaacgctttaaagcgaggagctcctatatatgcagagatcctcggtgcgtatactacttgcgacgcttttcatattacagctcctagagatgacggagaagggatcacctcctgtattcttggggctttagaaagttctggtattcctaaagaacgcgtaaactatattaacgctcatggtacatcaactcctctaggggatatatcggaagttttagcattgaaaaaagctttcggtagtcatgtaaagaagctgcgaatgaattccacgaagtcacttatagggcattgcctaggagctgctgggggcgtcgaagctgttgcgacaattcaagcaattcaaacggggaaattacatcctacgattaatttagaaaacccgattacggaaattgatgattttgacgtagttgcaaataaagcccaggattgggatatagatgtcgctatgtcgaattcttttggttttggtggacataattcaacgatattattctcgaggtatataccctaa

SEQ ID NO: 19963 - protein, 416 aa, Chlamydophila abortus S26/3
MSKKRVVVTGLGVVSCLGNEIDTFYDNLLAGVSGVRTITSFPCEDYATRFAGWIPEFNPEPYLDKKQARRVDCFITYAVVAAKKAIAMSRWDKDNLPADPLRCGVIIGSGMGGLQTLDDGMERLILGNKKLSPFFIPYIITNMAPALIAMDFGLMGPNYSISTACATSNYCIDAAYQHLVSGRADIIVCGGTEAAVNRVGLAGFIANRALSERNDAPQEASRPWDRDRDGFVIGEGAGILVLETLENALKRGAPIYAEILGAYTTCDAFHITAPRDDGEGITSCILGALESSGIPKERVNYINAHGTSTPLGDISEVLALKKAFGSHVKKLRMNSTKSLIGHCLGAAGGVEAVATIQAIQTGKLHPTINLENPITEIDDFDVVANKAQDWDIDVAMSNSFGFGGHNSTILFSRYIP

SEQ ID NO: 19964 - DNA, 1263 bp, Brucella abortus biovar 1 str. 9-941
  CDS (1)..(1263): transl_table=11
atgaggcgtgtcgtcatcaccggtctcggtctggtgtcaccgctcgcaagcggtgtggaagagacttggaagcggcttcttgccggtgaaagcggggctcgccgcgttacggaattcgaggtggacgatctggcctgccagattgcctgccgcattcccgttggcgatggcacgaacggtacgttcaatcccgacctgcatatggacccgaaggaacagcgcaaggtcgatcctttcatcgtttatgccgtcggtgcagccgatcaggctctggatgatgccggctggcacccggaaaatgatgaggatcaggtccgcaccggcgttcttatcggttcgggcatcggcggcatcgaaggcattgtcgaggcgggctacacgctgcgcgacaagggcccgcgccgtatttcgcccttcttcattccgggccgtctcatcaatctggcctccggccatgtgtcgatcaagcacaagctgcgcgggccgaaccactcggtcgtcacggcctgtgcaaccggcacgcacgctattggcgatgccgcccgcctcattgctttcggcgatgcggatgtgatggttgccggtggcacggaatcgccggtgagccgcatttcgcttgctggctttgccgcctgcaaggcgctttccaccgagcgcaatgacgatccgaccgccgcttcacgtccttatgacgaggatcgtgacggcttcgtcatgggcgaaggcgctggcattgtggtgcttgaagagctggaacacgctttggcgcgcggtgcgaagatttatgccgaagtcatcggctatggcatgtcgggcgatgccttccatatcacggccccgaccgagagcggtgagggcgcacagcgctgcatggtggcggctctcaagcgtgccgggatcgtgccggacgagatcgactatatcaatgcgcatggcacgtccaccatggccgatacgatcgagcttggcgcggtggagcgcgtggtgggtgaggcggctgcgaagatttcgatgtcttccaccaaatcatccatcggccacctgttgggtgcggcaggggctgccgaagcggtcttctccacgctggccattcgcgacaatatcgcgcctgccacactcaatctggacaatccggcggcgcagaccaggatcgatctcgtgccgcacaagccgcgcgaacgcaagatcgatgtggcgctgtcgaattcgttcggtttcggtggcaccaatgcatcgctggtgctgcgccgctacacggcctga

SEQ ID NO: 19965 - protein, 420 aa, Brucella abortus biovar 1 str. 9-941
MRRVVITGLGLVSPLASGVEETWKRLLAGESGARRVTEFEVDDLACQIACRIPVGDGTNGTFNPDLHMDPKEQRKVDPFIVYAVGAADQALDDAGWHPENDEDQVRTGVLIGSGIGGIEGIVEAGYTLRDKGPRRISPFFIPGRLINLASGHVSIKHKLRGPNHSVVTACATGTHAIGDAARLIAFGDADVMVAGGTESPVSRISLAGFAACKALSTERNDDPTAASRPYDEDRDGFVMGEGAGIVVLEELEHALARGAKIYAEVIGYGMSGDAFHITAPTESGEGAQRCMVAALKRAGIVPDEIDYINAHGTSTMADTIELGAVERVVGEAAAKISMSSTKSSIGHLLGAAGAAEAVFSTLAIRDNIAPATLNLDNPAAQTRIDLVPHKPRERKIDVALSNSFGFGGTNASLVLRRYTA

SEQ ID NO: 19966 - DNA, 1236 bp, Xanthomonas campestris pv. campestris str. 8004
  CDS (1)..(1236): transl_table=11
atgagtcgtcgtgttgtcgttaccggcatgggcatggtgtcgccgctgggcaatgatctggccaccagttgggatgggatcatccacggtcgctcgggcattggcccgatcaggcagatcgatgcctcgcagttcaccaccaggatcgcgggcgagatcaagaatttcgatcccacccagtttgtgtccgccaaggacgtcaagaagatggattcgttcatccactacggtgtcggcgcctcgttcatggcgttggacgattccgggctggagatcaacgaaagcaatgccgaacgcgtgggcgccattctgggctccggtatcggcgggctgctcggcatcgaagagcagaccatcaaattgcatgagggcggcgcgcgcaagatttcgccgttctatgtgcccagcaccatcatcaacatgctgccgggccaggtgagcctgatcaaaggcctgaagggcccgacgttctcggccgtgtcggcctgcgccacctccaaccattcgatcggcactgcgatgcgcatgatccagcacggcgatgccgacgtgatgctggccggtggcgccgagcgcggttcgtccccaagttcggtgggcgggttctgcgccatgaaggcgatgtccacgcgcaacgacgaccccaccgctgcatcgcgtccgtgggacaagcagcgcgacgggttcgtgctgggtgacggcgccggcgtgctggtgctggaagagtacgaacacgccaaggcacgcggcgcgcgcatctatgcagagctggtcggtttcggtgccagttcggatgcgttccacatgactgcgcccagcgaagatggcgaaggcgcggcgcgcagcatggccgcggcgatgcgcgatgccaagctcaaccccgagcagatcggctacctcaacgcgcacggcacctccacgccgctgggcgatctggccgaaaccatggcgatgaagcgtgcgctgggcgaccacgcgtacaagaccatggtcagctcgaccaagtcgatgaccggccacctgctcggcgcggccggcggcgtggaagcgatcttctcggtgatggcgctgcataccggcatcattccgccgaccatcaacctggaagagcccagcgaaggctgcgatctggactacgtgccgaacgtggcgcgcgaggtgcaggtggatgcggtgatgtccaacggcttcggctttggcggcaccaacggcaccctggtgttcaagcgcatctga

SEQ ID NO: 19967 - protein, 411 aa, Xanthomonas campestris pv. campestris str. 8004
MSRRVVVTGMGMVSPLGNDLATSWDGIIHGRSGIGPIRQIDASQFTTRIAGEIKNFDPTQFVSAKDVKKMDSFIHYGVGASFMALDDSGLEINESNAERVGAILGSGIGGLLGIEEQTIKLHEGGARKISPFYVPSTIINMLPGQVSLIKGLKGPTFSAVSACATSNHSIGTAMRMIQHGDADVMLAGGAERGSSPSSVGGFCAMKAMSTRNDDPTAASRPWDKQRDGFVLGDGAGVLVLEEYEHAKARGARIYAELVGFGASSDAFHMTAPSEDGEGAARSMAAAMRDAKLNPEQIGYLNAHGTSTPLGDLAETMAMKRALGDHAYKTMVSSTKSMTGHLLGAAGGVEAIFSVMALHTGIIPPTINLEEPSEGCDLDYVPNVAREVQVDAVMSNGFGFGGTNGTLVFKRI

SEQ ID NO: 19968 - DNA, 1281 bp, Rickettsia felis URRWXCal2
  CDS (1)..(1281): transl_table=11
atgtcgaaccaaagagtaaataaaagagtagttattactggacttggacttgttactcctgttgggcttaatgttagctcatcttggaaaaatattgtaaatgggataagcggtataaaaactattacggaatttgacacttctaaacttgcgtgtaaaattgccggacttatagataactctgagaaagatggatttaaacttgaaaacttcacacaagcagatgacgttaatagactaagtaaaatggataaatttatccattacggagtagcagccgcaaccgaagcagttgaagatagcggctggttacccgaagatgaagaatctcgtgatagaaccggtttgatattaggctcaggaatcggtgggcttaaaatgatcgaagatacctctatcaaactttatcaagaaaataacggcaaagttagccctttctttatccccgcttcattaattaatcttttatccggtcttgtttctataaaatacggttttagcggtccaaatcaagcagcagtaacggcttgctctacaggagcacatgctataggcgatgctatgcgtatgataaagcacggctatgcagatgttatggtcgcaggcggtgcagaagcccctgttacacctgttggagttgcaggtttcgttgctgctagagcattatgtactaaatataacgataatcctgaaaaagcctcaagaccttgggataaagaccgcagcggttttgttatgggtgaaggagcaggcgttgtagtcttggaagaatatgagcatgccttaaatcgaggggctaaaatttacggtgaagttataggatacggctctacaggtgatgcgtaccatatgacagcaccgcatcctgaaggtagaggagcttatagagcgatgagagatgcagtgctagatgcagctatcactcccgatatgattgattacattaatgcacatggcacttctactaatctcggtgatggaatagaattagcagcggtacaaaaattatttttagaagcgaatccccaaattttaatgtcttctactaaatcatcaataggacatttgcttggtgcggcaggaagcgttgagtttatcttttcagctcttgcaattcgagatcagattgcaccgccaactttaaatttagataaccctatggatgaggttaagatagatttagtaaaattaaaagctagagaaactaaaatagactacgtgctttccaactcattcgggttcggcggtactaatgctagcttagtcattaggaagatttga

SEQ ID NO: 19969 - protein, 426 aa, Rickettsia felis URRWXCal2
MSNQRVNKRVVITGLGLVTPVGLNVSSSWKNIVNGISGIKTITEFDTSKLACKIAGLIDNSEKDGFKLENFTQADDVNRLSKMDKFIHYGVAAATEAVEDSGWLPEDEESRDRTGLILGSGIGGLKMIEDTSIKLYQENNGKVSPFFIPASLINLLSGLVSIKYGFSGPNQAAVTACSTGAHAIGDAMRMIKHGYADVMVAGGAEAPVTPVGVAGFVAARALCTKYNDNPEKASRPWDKDRSGFVMGEGAGVVVLEEYEHALNRGAKIYGEVIGYGSTGDAYHMTAPHPEGRGAYRAMRDAVLDAAITPDMIDYINAHGTSTNLGDGIELAAVQKLFLEANPQILMSSTKSSIGHLLGAAGSVEFIFSALAIRDQIAPPTLNLDNPMDEVKIDLVKLKARETKIDYVLSNSFGFGGTNASLVIRKI

SEQ ID NO: 19970 - DNA, 1245 bp, Staphylococcus haemolyticus JCSC1435
  CDS (1)..(1245): transl_table=11
atgactgagaataaacgagttgtaattactggtatgggtgcattatcacctattggcaatgatgcccagacaagttgggaaaatgccttgaaaggtgttaatggaatcgatactattactagaatagatacagaagattataatgttcatttagcaggtgaacttaaagattttaatattgaagaccatattgaaaagaaagaagctcgacgtatggaccgtttcacacaatatgcggtagttgcagcacgtcaagcagttgaagatgctaaattggaaatcaatgatgaaactgctaatcgcataggtgtatggattggttcagggattggtggtatggaaacgtttgaaacagcacatacaacacttcaaaataagggtccaagaagagtaagtccattcttcgtacctatgttaattcctgatatggcaaccggccaagtatcaattgatttaggtgcaaaagggccaaatggttctacagttacagcatgtgcaactggtacaaactcaattggtgaagcatttaaaatcatacaacgtggcgatgcagatgcgatgataacaggtggtacagaagcgccaattacacacatggcacttgcaggattcagtgctagtcgtgccttgtctacaaatgatgataaagaaacagcttgtcgtccattccaagaaggtcgagatggcttcgttatgggtgaaggtgctggtattttagtgattgaatcattagaatcggcacaagcacgtggtgctcaaatctatgctgaaatagttggttatggttcaactggtgatgcatatcatattacagctcccgctcctgaaggtgaaggtggttcacgtgcaatgcaagcagcacttgatgatgcaggtattgaagcaaaagatgttcaatatcttaatgcacatggcacaagtacacctgtaggtgatatgtatgaaattagagcgatcaagaatacatttggagatgctgctaatcaactaaaagttagctctactaaatcaatgactggtcatttattaggtgctactggtggtttagaggctatcttctcagcattatctattcgtgactctaaagtcgcaccaactattcatgcgaatacaccagatcctgaatgtgatctagacatcgttccaaatgaagcgcaagatttagaaattacttatgcaatgagtaacagtcttggatttggtggtcataatgctgtattagtatttaagaaatttgaagattaa

SEQ ID NO: 19971 - protein, 414 aa, Staphylococcus haemolyticus JCSC1435
MTENKRVVITGMGALSPIGNDAQTSWENALKGVNGIDTITRIDTEDYNVHLAGELKDFNIEDHIEKKEARRMDRFTQYAVVAARQAVEDAKLEINDETANRIGVWIGSGIGGMETFETAHTTLQNKGPRRVSPFFVPMLIPDMATGQVSIDLGAKGPNGSTVTACATGTNSIGEAFKIIQRGDADAMITGGTEAPITHMALAGFSASRALSTNDDKETACRPFQEGRDGFVMGEGAGILVIESLESAQARGAQIYAEIVGYGSTGDAYHITAPAPEGEGGSRAMQAALDDAGIEAKDVQYLNAHGTSTPVGDMYEIRAIKNTFGDAANQLKVSSTKSMTGHLLGATGGLEAIFSALSIRDSKVAPTIHANTPDPECDLDIVPNEAQDLEITYAMSNSLGFGGHNAVLVFKKFED

SEQ ID NO: 19972 - DNA, 1245 bp, Pseudomonas fluorescens Pf-5
  CDS (1)..(1245): transl_table=11
gtgtcgcgtagacgcgtcgtagtcaccggtatgggtatgttgtcgccactgggtacggatgtgccaagcagctggcagggcattctggctggccaaagtggcatcggtctgatcgaacacaccgacctttctgcctattccacccgttttggcggctcggtaaagggcttcaatgtcgaggaatacctgtcggtcaaagaggcccgcaaactcgacctgttcattcaatacggcctggcagccggtttccaggcggtacgcaacgccggtctggaagtcaccgatgccaaccgtgaacgcatcggcgtggccatgggctcgggtattggcggtttgaccaatatcgaggaaaccagccgcatcctgcacgattccggcccacgacggatttctccgttcttcgtgcctggctcgatcatcaacatgatttccggtttcctgtccatccacttgggtgcccaggggccgaactacgccatttccactgcgtgcaccaccggtacccactgcatcggcatggctgcgcgcaacatcgcctacggcgaagccgacgtgatgatcgccggcggtgctgaaatggctgcctgtggcctgggcatgggcggcttcggcgcgtcccgtgcactgtcgacccgcaacgacgagccgacccgcgccagccgtccctgggacaaggggcgtgatggcttcgtcctgtccgacggcgccggcgccctggttctggaagagctggagcacgccaaggctcgtggggccaccatctatgcggagctgatcggcttcggcatgagcggtgacgcctatcacatgacgtcgcctcccgccgatggtgccggtgctgcgcgctgcatcgccaatgccctgcgcgacgccaagctcaacgtggaccaggtgcagtacatcaacgcccatggcacttcgaccccggccggcgacctggccgaggccgaagcgatcaagagcgtgttcggcgatcacgcctacaagctggcggtcagttccaccaagtccatgacgggtcacctgctgggtgccgcgggggcgatcgaggcgatcttcagtgtgctggcaatcaacagccaggccgcgccgcccaccatcaacctggatgagccggatgaaggctgtgacctcgatttcgtgccgcacaccgcgcgcagcatggacatcgacgtagtgctgtccaactccttcggttttggtggcaccaacggctccctggtgttccgccggttctccgagtga

SEQ ID NO: 19973 - protein, 414 aa, Pseudomonas fluorescens Pf-5
MSRRRVVVTGMGMLSPLGTDVPSSWQGILAGQSGIGLIEHTDLSAYSTRFGGSVKGFNVEEYLSVKEARKLDLFIQYGLAAGFQAVRNAGLEVTDANRERIGVAMGSGIGGLTNIEETSRILHDSGPRRISPFFVPGSIINMISGFLSIHLGAQGPNYAISTACTTGTHCIGMAARNIAYGEADVMIAGGAEMAACGLGMGGFGASRALSTRNDEPTRASRPWDKGRDGFVLSDGAGALVLEELEHAKARGATIYAELIGFGMSGDAYHMTSPPADGAGAARCIANALRDAKLNVDQVQYINAHGTSTPAGDLAEAEAIKSVFGDHAYKLAVSSTKSMTGHLLGAAGAIEAIFSVLAINSQAAPPTINLDEPDEGCDLDFVPHTARSMDIDVVLSNSFGFGGTNGSLVFRRFSE

SEQ ID NO: 19974 - DNA, 1269 bp, Pseudomonas fluorescens Pf-5
  CDS (1)..(1269): transl_table=11
atgagcaaacgcatcgtagtcaccggcatgggcgcaatcacgccactgggttgtggagtcgaacaggtatggcggcgcctgctggcaggccagtccggcatccgctcgttaccggaagaactcatcggcgagctgtcgaccaccatcggcggccaggtgcccgactcgctccaggacccggaggccggcttcgacccggaccaactgctggcccccaaggaacagcgcaagatggatcgcttcatcctcttcgccctggccgcggccgaggaggccctggcccaggccggctggaagccggataccgcagaagcccaggaacgcacggccaccatcatcgcctccggggtgggcggcttcccggccatcgccgaagcggtacgtaccaccgacagcaagggcccgcgccgcctgtcgccgttcaccattccctcgttcctgagcaacatggccgccgggcacgtgtcgatccgccatggtctcaagggccccctgggcgcgccggtgaccgcctgtgccgccggggtccaggcgattggcgatgccgcgcggatgatccgcgccggggaaatcgacatcgctgtgtgtggcggtgcagaggcggccatccaccgggtcagcctgggcggcttcgccgcagcccgcgccttgtccagcgaattcaacgacaccccggaacgcgcttcccgtccgttcgaccaggctcgggatggttttgtcatgggtgaaggcgccggcctgctggtcatcgaggaactggaacatgccctggcccgcggcgcccggcccatcgccgagctggtgggctacggcaccagcgccgacgcctaccacatgacggccggcccggaagacggcgacggcgcccgtcgcgccatgcagcaggccctgcgccaggccggtatccaggcatcccaggtgcagcacctcaatgcccacgccacctccacccccgtgggtgacaaaggcgagctggctgctatcagaacggtgttcggcaccgacagtggactggccatcagcgccaccaaatccgccactggccacctgctgggtgcggccggaggaatcgaggcgatcttcaccatcctcgccctgcgcgatcagatcgccccggccaccctcaacctggaaaacccggacagcgccgccgcagggctggacctggtcagggggcaggctcgccaactggccatgcaatacgcactgtccaatggcttcggctttggcggggtgaatgccagcgtgctgttcaagcgctgggaatag

SEQ ID NO: 19975 - protein, 422 aa, Pseudomonas fluorescens Pf-5
MSKRIVVTGMGAITPLGCGVEQVWRRLLAGQSGIRSLPEELIGELSTTIGGQVPDSLQDPEAGFDPDQLLAPKEQRKMDRFILFALAAAEEALAQAGWKPDTAEAQERTATIIASGVGGFPAIAEAVRTTDSKGPRRLSPFTIPSFLSNMAAGHVSIRHGLKGPLGAPVTACAAGVQAIGDAARMIRAGEIDIAVCGGAEAAIHRVSLGGFAAARALSSEFNDTPERASRPFDQARDGFVMGEGAGLLVIEELEHALARGARPIAELVGYGTSADAYHMTAGPEDGDGARRAMQQALRQAGIQASQVQHLNAHATSTPVGDKGELAAIRTVFGTDSGLAISATKSATGHLLGAAGGIEAIFTILALRDQIAPATLNLENPDSAAAGLDLVRGQARQLAMQYALSNGFGFGGVNASVLFKRWE

SEQ ID NO: 19976 - DNA, 1416 bp, Psychrobacter arcticum 273-4
  CDS (1)..(1416): transl_table=11
atgagccagcacagcagtttacccaacgactcacttatcgaccaagctatgaatagtactattaatagccctactgccaatactcctgccaccgctcagacaaaaaaacgtcataagccgccacatttcgagcgcactgatgatatgcgtgtcgtagtgactggcatgggtgccgttacgccattgggattagatgtcgaaagctcatgggcgaagctccttaaaggtgaaagcggtatcacagctatcagtcattttgatgcgtctggttatcgcgcgcaaatcgcaggcgtggtcaaagactttgatgccaagcaatacatgaacgccaaagacgcgcgccgttatgatgagtttatacattatgcggttgctgcctcttctatggcgctacatcaagcaggttttatcgaggaagtgagcgctgctgacgctccggtacaaggggttgatcaagagcgctttggggtgattataggttcagggattggtggtattcaaaacatcgaaaacagccgtgataccttacgtgaaaaaggctcaagcaaagtctccccctttattattccaggctctattgttaatatggcagcgggcttagtagctattaaacactgtttgaaaggtcccaatcttgcaacctcaactgcctgtaccacagcgactcatgcgattggtctagcagcgcggttgattgcttatggtgacgccgatgtgatactggcaggcggtagtgaaaaaggctcaagcccgcttggtatctcaggttttggtgctatgcatgccctctcaacccgcaatgatgagccaactcgcgcttcacgcccgtttgataaagatcgcgatggttttgtacttggtgatggtgctggcgtaatgatactagaaagccttgctcatgcaaaagcacgcggtgcgacgatattggctgaattggttggctttggtatgagtgacgatgccagtcatatcaccgcgcctccagaagatggtagcggtgcggcacgagcgatgcgtaatgccttaaatgatgcgggtattgagccgtcagtcgtgggctatgtcaatgcccatggcaccagcacgcctgccggtgatgtcgcggaatctatcgccattgaaacggtattttcgcctgtgaaagacaccattttggtcagctcaaccaaatcgatgaccggtcatctgcttggcgctgcgggtggtgttgaagctatttttactgtacttgctctgcaacatcagcaagtaccgccaacgattaatttggacaatattgaagacaactgtaatttggattatgtcgccaatcaatcgcgtcaagtagataatttgcagtacgcggtatccaatagctttggttttggcggcaccaacggctcactaatatttgcacgttggcctgtcaatcagtaa

SEQ ID NO: 19977 - protein, 471 aa, Psychrobacter arcticum 273-4
MSQHSSLPNDSLIDQAMNSTINSPTANTPATAQTKKRHKPPHFERTDDMRVVVTGMGAVTPLGLDVESSWAKLLKGESGITAISHFDASGYRAQIAGVVKDFDAKQYMNAKDARRYDEFIHYAVAASSMALHQAGFIEEVSAADAPVQGVDQERFGVIIGSGIGGIQNIENSRDTLREKGSSKVSPFIIPGSIVNMAAGLVAIKHCLKGPNLATSTACTTATHAIGLAARLIAYGDADVILAGGSEKGSSPLGISGFGAMHALSTRNDEPTRASRPFDKDRDGFVLGDGAGVMILESLAHAKARGATILAELVGFGMSDDASHITAPPEDGSGAARAMRNALNDAGIEPSVVGYVNAHGTSTPAGDVAESIAIETVFSPVKDTILVSSTKSMTGHLLGAAGGVEAIFTVLALQHQQVPPTINLDNIEDNCNLDYVANQSRQVDNLQYAVSNSFGFGGTNGSLIFARWPVNQ

SEQ ID NO: 19978 - DNA, 1239 bp, Colwellia psychrerythraea 34H
  CDS (1)..(1239): transl_table=11
atgagacgtgtagtagtaactggcattggcatgcttagcccattagccaacaccgcagaagaaacatggcaaaacctgctacttggtaaaagtggtataggtaatattgatcattttgataccacagattaccccactaaatttgctggtttagtaaaagactttgatgcccagaattatatggaacgaaaagaagccaaaaaaatggatctttttattcaatatggtattgcagcgggcgtacaagcttttaaagactcaggtcttgaagttactgagcaaaatgcaccacgtattggtgttgctattggctctggcattggcggtttaggcttaattgaacaaaatcataacaagctaatcaaagccgaaggtaatcctcgtaagttatcgccattttttgtgccttcaaccattatcaatatgattgcgggtcacttatcaataatgtttggcctgcaaggtcctaatattgccataactacagcgtgtacgagtggcgtgcataatattggccatgctgcccgtatgattgcttacggagatgccgacgcagttgttgccggaggtgctgaaaaagcgtccacaacactaggcatgggcggctttggtgctgctcgcgctttatctcgtcgaaatgatgaccctgaagcggcatctcgtccttgggacaaagatcgtgatggttttgttcttggtgatggtgctggtgttatcgttgttgaagaatatgaacatgcaaaagcccgtggcgcaaaaatttatgctgagctagttggttttggtatgagcggtgatgcttaccatatgacttcaccacctgaaaatggtgatggcgcagcgcgtgctatgcaaaatgctattaatgatgcgaaagtagatattagtagaattggttacattaatgcccacggtacttctacacaagccggtgatatggctgaaactaatgcggttaagactgtatttggtgctggtgcaaagaatgtaatgatgggttctaccaagtctatgactggacatttgttaggcgctgcaggagctattgaagctattttcagtatccaagcactagtgaataagcaagttccaccgacgataaatttagataaccctgatgaaggttgtgatctagattatattgctggtgcagcacgtgatgttgaacttgaatatgtactttgtaattcgtttggttttggtggtactaacggctcattaatctttaagaagatttag

SEQ ID NO: 19979 - protein, 412 aa, Colwellia psychrerythraea 34H
MRRVVVTGIGMLSPLANTAEETWQNLLLGKSGIGNIDHFDTTDYPTKFAGLVKDFDAQNYMERKEAKKMDLFIQYGIAAGVQAFKDSGLEVTEQNAPRIGVAIGSGIGGLGLIEQNHNKLIKAEGNPRKLSPFFVPSTIINMIAGHLSIMFGLQGPNIAITTACTSGVHNIGHAARMIAYGDADAVVAGGAEKASTTLGMGGFGAARALSRRNDDPEAASRPWDKDRDGFVLGDGAGVIVVEEYEHAKARGAKIYAELVGFGMSGDAYHMTSPPENGDGAARAMQNAINDAKVDISRIGYINAHGTSTQAGDMAETNAVKTVFGAGAKNVMMGSTKSMTGHLLGAAGAIEAIFSIQALVNKQVPPTINLDNPDEGCDLDYIAGAARDVELEYVLCNSFGFGGTNGSLIFKKI

SEQ ID NO: 19980 - DNA, 1212 bp, Colwellia psychrerythraea 34H
  CDS (1)..(1212): transl_table=11
atgaaacgtgtcgtaataacaggcttaggtatagtctcaagtattggtaacaatgcggatgaagtattagcctcattaaaagctggtaagtcaggtatctctcattctgaaagttttgcagagcaaggtctacgtagtcaagtttggggtaaacctgatattgaaactaaagatcacattgatcgtaaagccatccgtttcatgggtgatgctgcaggttatgcttatattgctatggatcaagctgttaaagatgcaaaattaactgaagatcaagtctcaaatttccgtactggtattgttgctggatctggtggagcttcatctgaaaacatcgttgcttcaactgatacgcttcgtaaccgtggtattcgtcgtgttggtccttatgccgtaccaaaaactatgggcagcacagtatcagcttgtttagcaacgccttttaaaattaaaggcgttaactactcaattagttcagcttgtgcaacaagtgctcattgtattggtaatgcgatggagcttattcaattaggcaaacaagatatcgtttttgctggtggtggtgaagaagttcattggtcacttgctatgatgtttgatggtatgggggctttatcagcgggtcgtaatgatacacctgaattagcttctcgtacctatgatgcagaccgtgatggttttgttatttctggcggcggcggtatggttgttgttgaagaattagaacatgcccttgcacgtggcgcacatatttacgctgaacttgttggctatggcgcaacctctgatggttatgacatggtagctccaagtggtgaaggcgcagttcgttgtatgcaacaagccatgcaaggtgttgaaggtaaacttgattacttaaatactcacggaacttctacaccggttggcgatgttaaagaattaggcgcaattcaagaattatttggtgaagattcaccagctattagtgctactaaagcaatgacaggtcatgcacttggtgctgctggcgttcacgaagctatttactcaatattaatgatggaaaacaactttgttgctccttcaattaacattgataatttagatgaaaaagcacaaggcttagatattgttactgaaaagcgtgatgttgagctaaaccttgttatgtcgaatagctttggttttggtggaactaatgccaccttggtaatgaaaaaatataaataa

SEQ ID NO: 19981 - protein, 403 aa, Colwellia psychrerythraea 34H
MKRVVITGLGIVSSIGNNADEVLASLKAGKSGISHSESFAEQGLRSQVWGKPDIETKDHIDRKAIRFMGDAAGYAYIAMDQAVKDAKLTEDQVSNFRTGIVAGSGGASSENIVASTDTLRNRGIRRVGPYAVPKTMGSTVSACLATPFKIKGVNYSISSACATSAHCIGNAMELIQLGKQDIVFAGGGEEVHWSLAMMFDGMGALSAGRNDTPELASRTYDADRDGFVISGGGGMVVVEELEHALARGAHIYAELVGYGATSDGYDMVAPSGEGAVRCMQQAMQGVEGKLDYLNTHGTSTPVGDVKELGAIQELFGEDSPAISATKAMTGHALGAAGVHEAIYSILMMENNFVAPSINIDNLDEKAQGLDIVTEKRDVELNLVMSNSFGFGGTNATLVMKKYK

SEQ ID NO: 19982 - DNA, 1245 bp, Pseudomonas syringae pv. phaseolicola 1448A
  CDS (1)..(1245): transl_table=11
gtgtcgcgtagacgcgtcgtggtcaccgggatgggcatgctttcgccactgggcaatgacgtgcccagcagttggcagggcattctggcgggccgcagtggcattggccttatcgagcacacggacttgtcggccttcaccacccgtttcggcggttcggtcaagggtttcaacgtcgaagaatacctcgcgcccaaagaagcgcgccggctcgatctcttcattcagtatggtctcgcggccagctttcaggcggtgcgtaatgcaggcctcgaagtcactgatgcaaaccgtgaacgcatcggcgtcgcgatgggttcgggtatcggtggtctgaccaatatcgaaaacagcagtcgtctgctgcacgagcaagggccaggacggatttctccgtttttcgtgccgggctcgatcatcaacatgatttccggtttcctgtctatccatctgggtgcacaggggcctaattactccatcgccacggcttgcaccacggcgacccactgcatcggcatggcggctcgcaacatcgcctatgacgaagcggacgtgatgattgccggtggcgctgaaatggctgcctgtggcctggggctgggtggtttcggtgccgcgcgtgcgctgtcgacccgcaacgacgacccgacccgtgccagtcgtccctgggacgaaggccgtgatggtttcgtcctgtccgacggtgcaggtgcgatggtgcttgaagaacttgagcacgccaaggcgcgtggtgcgaccatctacgctgagctggtcgggttcggcatgagcggcgatgcctatcacatgacctcgccacctgatgacggtgccggtgctgcacgctgcatcgtcaatgcgttgcgtgacgccaaggtcaatgccgatcaggttcagtacatcaacgcacacggtacgtcgacgcctgcgggcgatctggccgaggcttctgcgatcaagtcggtatttggcgatcatgcctacaagctggctgtcagttcgaccaagtcgatgaccggccacctgctgggcgctgctggtgctgtcgaggcgatcttcagtgtgctggcaatggttgatcaggtggctccgccgaccatcaacctggatgagccaagcgaaggctgcgatctggatttcgtgcctcacgaagcacgccgcatgccgatcgacgttgttctttcgaactcgttcggcttcggtggcaccaacggttcgctggtattccgtcggttcgccgagtaa

SEQ ID NO: 19983 - protein, 414 aa, Pseudomonas syringae pv. phaseolicola 1448A
MSRRRVVVTGMGMLSPLGNDVPSSWQGILAGRSGIGLIEHTDLSAFTTRFGGSVKGFNVEEYLAPKEARRLDLFIQYGLAASFQAVRNAGLEVTDANRERIGVAMGSGIGGLTNIENSSRLLHEQGPGRISPFFVPGSIINMISGFLSIHLGAQGPNYSIATACTTATHCIGMAARNIAYDEADVMIAGGAEMAACGLGLGGFGAARALSTRNDDPTRASRPWDEGRDGFVLSDGAGAMVLEELEHAKARGATIYAELVGFGMSGDAYHMTSPPDDGAGAARCIVNALRDAKVNADQVQYINAHGTSTPAGDLAEASAIKSVFGDHAYKLAVSSTKSMTGHLLGAAGAVEAIFSVLAMVDQVAPPTINLDEPSEGCDLDFVPHEARRMPIDVVLSNSFGFGGTNGSLVFRRFAE

SEQ ID NO: 19984 - DNA, 1233 bp, Streptococcus pyogenes MGAS5005
  CDS (1)..(1233): transl_table=11
atgacatttaaaagagtagtggtaacaggttatggtctaacatctccaatcgggcatgatcctgaaacgttttggaacaatctgaaagctggccaaattggtattggtcctattactaaatttgacacgactgattatgcagtcaagaatgctgctgaaattcaggattttccatttgacaaatactttgtgaaaaaagatttgaaccgtttcgatagatattctctttatgctctttacgcagcgaaagaggctattaatcatgctgatttaaatattgagatggttgattccgatcgatttggcgttattgttgcttcaggtattggtggaattgcggagattgaagagcaagtgattcgcttacatgaaaaagggccaaaacgtgtgaagccaatgacgttgccaaaagcgctaccaaatatggctgcaggaaatgtcgccatgtctttaaaagctcaaggagtatgtaaatcaattaatactgcctgcgcttcttcaaatgatgcgattggggatgcctttcgtgccattaaatttgggactcaagatgtgatgatagttggtgggtcagaggcggccataaccaagtttgccattgctggcttccaaagtttaacagctctctcaacaactgaagatccaagcagaagctctattccatttgataaagaccgcaatggttttatcatgggagaaggatcaggaatgcttgttttagaaagcctagaacatgcgcaagaacgcggggcgacaatcttagcagaaattgtgggttatggaaatacctgcgatgcctaccatatgacatctccaaatcctgagggattaggagctcgtaaagccatccacttagccttacaagaagctggtattgaagccagtgctattaattatgtcaatgcgcacggaacttcaaccccagctaatgaaaaaggagagagtcaagcaattgtagccgttcttggtaaggatgttccggtgtcttcaacaaaatcgtttacgggtcaccttcttggagcagcaggcgctattgaagctattgccactatcgaggctatgcgtcataactatgttccgatgacggctgggacacaagctttatcagaggatatcgaagcaaatgtcatctttggagaaggaaaagaaacagctatcaactatgccatttcaaatacttttggatttggtggtcataatgctgtattagctttcaaatgttgggaggagtag

SEQ ID NO: 19985 - protein, 410 aa, Streptococcus pyogenes MGAS5005
MTFKRVVVTGYGLTSPIGHDPETFWNNLKAGQIGIGPITKFDTTDYAVKNAAEIQDFPFDKYFVKKDLNRFDRYSLYALYAAKEAINHADLNIEMVDSDRFGVIVASGIGGIAEIEEQVIRLHEKGPKRVKPMTLPKALPNMAAGNVAMSLKAQGVCKSINTACASSNDAIGDAFRAIKFGTQDVMIVGGSEAAITKFAIAGFQSLTALSTTEDPSRSSIPFDKDRNGFIMGEGSGMLVLESLEHAQERGATILAEIVGYGNTCDAYHMTSPNPEGLGARKAIHLALQEAGIEASAINYVNAHGTSTPANEKGESQAIVAVLGKDVPVSSTKSFTGHLLGAAGAIEAIATIEAMRHNYVPMTAGTQALSEDIEANVIFGEGKETAINYAISNTFGFGGHNAVLAFKCWEE

SEQ ID NO: 19986 - DNA, 1236 bp, Dechloromonas aromatica RCB
  CDS (1)..(1236): transl_table=11
ttggcacgtcgcagagtcgtaattaccggtttggggctcatttccccggtcggcaacagcgtagaggaaggctggcagaacatcatcgccggccgttctggtatcgctcccgttacccgattcgatacttccaccttcccggttcagtttgccggtgaggtcaagaatttcgatattacccaatatatttcggccaaggatgcccggcgcatggataggtttatccattacggtctggctgccggcatacaggctgtccgcgatgccggtctggataaggaaggtgctgctgaccccgagcgcgtcggtgtcgccattggctccggtatcggcggtctgccgctgatcgaggaaaccaaagacgaatacattgctggcggtgtgcgcaaggtttcgccgttcttcgtgcccggttcgatcattaacatgatctccggcaacctgtcgatcgagtacggcttcaaggggccgaatctggctatcgtcaccgcttgtacgacgggtacccactcgatcggcgaggccgcgcgcatcattgaatacggcgatgccgatgtgatggtggccggtggtgctgaatcgacggtttcgccgctgggcatggggggcttcagtgccgctcgtgctctgtctactcgcaatgatgatccgacgacggccagtcgtccgtgggacaaggatcgtgatggctttgtcctcggcgaaggtgccggtgttctggttctcgaagagtacgagcatgccaaggcccgcggcgcaaagatctatgccgaagtggctggctacggccggagcgctgatgcttatcacattactgcgccgaacatggacggcccacgtcgttccatggtcaatgcactgaagaatgctggcattgcgccgtccgacgtgcagtacgtcaacgcgcatggcacttcgactccgcttggtgacaagaacgagtcggatgccatcaaggctgctttcggtgatgccgcttataagatcgtcgtcaattcgacaaagtcgatgaccggtcacctgttgggtggcgctggtggcgtcgagtctttgttcacggttctggccatccatcaccagatatctccgccaaccatcaacatcttcaaccaggatccggagtgcgacctggactactgtgccaacaaggcacggccgatgaagattgatattgcgctgaaaaacaacttcggcttcggcggtacgaacggctcgctggttttcaagcgcgtctaa

SEQ ID NO: 19987 - protein, 411 aa, Dechloromonas aromatica RCB
MARRRVVITGLGLISPVGNSVEEGWQNIIAGRSGIAPVTRFDTSTFPVQFAGEVKNFDITQYISAKDARRMDRFIHYGLAAGIQAVRDAGLDKEGAADPERVGVAIGSGIGGLPLIEETKDEYIAGGVRKVSPFFVPGSIINMISGNLSIEYGFKGPNLAIVTACTTGTHSIGEAARIIEYGDADVMVAGGAESTVSPLGMGGFSAARALSTRNDDPTTASRPWDKDRDGFVLGEGAGVLVLEEYEHAKARGAKIYAEVAGYGRSADAYHITAPNMDGPRRSMVNALKNAGIAPSDVQYVNAHGTSTPLGDKNESDAIKAAFGDAAYKIVVNSTKSMTGHLLGGAGGVESLFTVLAIHHQISPPTINIFNQDPECDLDYCANKARPMKIDIALKNNFGFGGTNGSLVFKRV

SEQ ID NO: 19988 - DNA, 1263 bp, Thermobifida fusca YX
  CDS (1)..(1263): transl_table=11
atgacacgacgcgtagtcatcaccggcatcggggtgatcgcacccggcgggataggcacgcaggccttctggaacctgctgaccgaaggcaggacagcgacccgccccatctccctgttcgacgcgagcgtcttccggtcccggatcgccgccgaagtcgacttccaccccgaagagcacggactcaccgcccagcaggcccgcaccatggaccgggccgcccagttcgctgtcgtcgccacccgcgaagccatggcggacagcggcctgaccatcgaccgcccagaccgggtcggcgtggtcgtaggcagcgccgtcggcgcatccaccagcctggaaaaccagtaccggctgtccagcgacgacggacagcttgaccccgtccgctacgaccccgcggtcaccgacctctaccggcacttcgtgcccagctcgttcgctaccgacgtggcctgggaggtaggggcggaaggaccagccaccgtggtgtccaccgggtgcacctctggactggactcggtgggctatgccgccgacctggtccgagaaggcatcgtcgacgccgtcgtcgtcggcagcaccgacgcccccctcacccccatcacctcggcctgcttcgacgcgatcaaggcgacctcaccccgcaacgacacccccgccaccgcgtcccgcccgttcgaccgcacccgcaacggcttcgtcctcggtgaaggatgcgccatgttcgtcatcgaggaacgcgagcacgcccgggcccgcggcgcccgcatatacggcgaactcgcaggctacgccacccggtccaacgcctaccacatgaccgggctccgcgcggacggccacgaaatggcggaagccatccgggtcgcgctgcacgaggcacgcgtcaaccccgacgacatcgactacatcaacgcgcacggctcaggcaccaaacagaacgaccgccacgagaccgccgccttcaaaaaagccctcggcagccacgcctaccggacaccggtcagctccatcaagtccatgatcggccactccctcggcgcgatcggctccatcgaaatcgccgcctgcctcttggccatgcgggacaacatcgtgccgccgacagccaacctgaccgaacccgaccccgagtgcgacctcgactatgtgccaatcaccgcgcgtgagcaccgagtcgacacggtgctcacggtaggcagcggcttcggcggcttccaaagcgcgatggtcctcaccacagcggacaggaggctcccatga

SEQ ID NO: 19989 - protein, 420 aa, Thermobifida fusca YX
MTRRVVITGIGVIAPGGIGTQAFWNLLTEGRTATRPISLFDASVFRSRIAAEVDFHPEEHGLTAQQARTMDRAAQFAVVATREAMADSGLTIDRPDRVGVVVGSAVGASTSLENQYRLSSDDGQLDPVRYDPAVTDLYRHFVPSSFATDVAWEVGAEGPATVVSTGCTSGLDSVGYAADLVREGIVDAVVVGSTDAPLTPITSACFDAIKATSPRNDTPATASRPFDRTRNGFVLGEGCAMFVIEEREHARARGARIYGELAGYATRSNAYHMTGLRADGHEMAEAIRVALHEARVNPDDIDYINAHGSGTKQNDRHETAAFKKALGSHAYRTPVSSIKSMIGHSLGAIGSIEIAACLLAMRDNIVPPTANLTEPDPECDLDYVPITAREHRVDTVLTVGSGFGGFQSAMVLTTADRRLP

SEQ ID NO: 19990 - DNA, 1239 bp, Thermobifida fusca YX
  CDS (1)..(1239): transl_table=11
atgagtaaccgcgaagtcgtcgtcaccggccttggagcgagcagtcctctgggaggtgacgtcgccacgacctggtcggcgctgctcgaaggtcgatccggcatcacttccctgcccgaggagtggcatgagaagctcccggtgcacttcgcgggcctcctcgctgaggagccgtccgagaagctggaacgccaccgactgcgccgcctggaccggacccagcagttggcgttgatcaccgcgcgggaagcgtgggacgacgcgggctcccctgaagtagacccgttgcgtctgggtgtcgtgatgtccagcggtatcggtggcatcttgaccaccctccaccagtacgacatcttccgggagaagggctggaagcgggtctccccgttcaccgtgccgatgctcatgcccaacagcccggccgccgctgtggcgctggagttcactgcccgggcgggggctcacgccgcggtcagcgcctgcgcgtccagtgcggaggccatcgctgacggcatcaacatgatccgctccggccgcgccgacgtggtgatcgcgggagggtgcgaggcggcgatccacccgctgaacattgccgcgttcgctgcgatgcgtgccttgtccacccgcaacgacgacccgcagggcgcgtcgcgtccgttcgacgtcaaccgggacggtttcgtcatgggtgagggggcagccactctcatcctggagtcggctgagcacgctgcggcccgcggggcccgcgtgtacgcggtggccgcgggagccggatacacctgcgacgcctacgacattgtgcagcctgacccggtcggtgctggggcttcccgtgcgatctctgccgcgatcgcggacgctgggctgagcccgtccgatatcgcgcacatcaacgcgcacgccacttccacgccggcgggtgacgtgccggagaccgtggcgatccgcagtgccctgggcgactcggctgctgacgctgtcgcggtgacctccaccaagtccatgaccggccacctgctgggtggtgctggtgcgttggagtcggtggccaccgtcttggcgctgtaccacggggtggtgcctgcaaccatcaacgttgaggagatcgaccccggcgtggtggttgacgtggtggtggacaagcctcgggagctgccgtcttccgcggtggctgcgctgaacaactctttcggtttcggcggacacaacatcgccttggcgttccgccgtccttga

SEQ ID NO: 19991 - protein, 412 aa, Thermobifida fusca YX
MSNREVVVTGLGASSPLGGDVATTWSALLEGRSGITSLPEEWHEKLPVHFAGLLAEEPSEKLERHRLRRLDRTQQLALITAREAWDDAGSPEVDPLRLGVVMSSGIGGILTTLHQYDIFREKGWKRVSPFTVPMLMPNSPAAAVALEFTARAGAHAAVSACASSAEAIADGINMIRSGRADVVIAGGCEAAIHPLNIAAFAAMRALSTRNDDPQGASRPFDVNRDGFVMGEGAATLILESAEHAAARGARVYAVAAGAGYTCDAYDIVQPDPVGAGASRAISAAIADAGLSPSDIAHINAHATSTPAGDVPETVAIRSALGDSAADAVAVTSTKSMTGHLLGGAGALESVATVLALYHGVVPATINVEEIDPGVVVDVVVDKPRELPSSAVAALNNSFGFGGHNIALAFRRP

SEQ ID NO: 19992 - DNA, 1248 bp, Prochlorococcus marinus str. NATL2A
  CDS (1)..(1248): transl_table=11
atgatggagaaactccatcgagttgttattacaggtcttggcgccattactccaattggcaacgacctcgaaagttacctcaaagggcttcaatccgggcaaaatggggtagatcaaataacactctttgatgcctcatcccatgcatgcagatttgcagcagaggtgaaaagttttgatccgactggcaaattagagccaaaagaatccaaacgatgggatcgtttttcaaaatttggagttattgcagcaaaagaagccttaaatcattcaggtctaataattgacaactcaaattctggaagaattggtgtaattattggttctggagttggcggattgttgactatggaaacccaagctcatgttttagagaacaagggagcaagtcgagttagtccttttactgttcccatgatgattcccaacatggctacagggttagcagctattgcactaggcgctaaaggtccaagttcagcagtttccactgcttgtgccgctggatcaaatgctataggtgatgcatttagactgctccaattaggcaaagcagatgcaatggtttgcggtggagcagaagcaagtatcacccctctaggagtagcaggatttgctagtgcaaaagccttatccttcagaaatgatgatccatctaccgcaagtagaccttttgattctcaacgagatggatttgtaattggagaaggggccggagtactaattttagaaactcttgatcatgcattaaaaagagacgcaacaatccatgcagagatcattggttatggaaccacttgtgatgctcatcacattacctctcctacacctggtggagtgggaggggcagaagctatgaaacttgcattaattgatggacaaattaatcccgaagaagtcgattacattaatgctcacggaactagcactccagctaatgacagcaatgaaacatctgctataaaagctgctttaggaaatcatgcgtatcaagtacctacaagctcaaccaaatctatgactgggcacttactaggagggtctggtggaatcgaagctgttgcttgtgctctggcaataaaacatgaaataattccgccaacaattaattattccaatccagacccaaattgtgatcttgattatgtgcccaacaaagcaagagaaaagaaattaggtgtcgtactatctaactcattcgggtttggcggtcacaatgtctgtctagcttttcgacaaatgatctaa

SEQ ID NO: 19993 - protein, 415 aa, Prochlorococcus marinus str. NATL2A
MMEKLHRVVITGLGAITPIGNDLESYLKGLQSGQNGVDQITLFDASSHACRFAAEVKSFDPTGKLEPKESKRWDRFSKFGVIAAKEALNHSGLIIDNSNSGRIGVIIGSGVGGLLTMETQAHVLENKGASRVSPFTVPMMIPNMATGLAAIALGAKGPSSAVSTACAAGSNAIGDAFRLLQLGKADAMVCGGAEASITPLGVAGFASAKALSFRNDDPSTASRPFDSQRDGFVIGEGAGVLILETLDHALKRDATIHAEIIGYGTTCDAHHITSPTPGGVGGAEAMKLALIDGQINPEEVDYINAHGTSTPANDSNETSAIKAALGNHAYQVPTSSTKSMTGHLLGGSGGIEAVACALAIKHEIIPPTINYSNPDPNCDLDYVPNKAREKKLGVVLSNSFGFGGHNVCLAFRQMI

SEQ ID NO: 19994 - DNA, 1233 bp, Ralstonia eutropha JMP134
  CDS (1)..(1233): transl_table=11
gtgagccgtcgtcgcgtcgttgtcactgggcttggccttgtgtctccggtcggaaacacggttgccgaaggctgggccaacctggttgccggcaagtccggtatcgccaccgtcaccaaattcgatcattccgcgctttccgtgcactttgccggtgaagtgaagggcttcaatgccgaggattacatcccggccaaggaagcccgcaatatggatacgttcatccactatggcattgctgccggcgcccaggcgctcaaggacagcggctatgaggtgaccgatgccaatgcggagcgcatcggcgtgctggtcggctcgggcattggcggcttgccgatgatcgaggacacgcatgccacgctgaccgagcgtggtccacgccgtatttcgccgttcttcgtgccgggatcgatcatcaacatgatctctggccacctgtcgatcatgcacggcctgaagggcccgaacctcgccgcggtgaccgcctgcacgaccggcctgcacagcattggcctggctgctcgcctgattcaggccggcgacgccgacgccatgctggcgggcggtgccgagtcgaccgtgtcgccgctgggcatcggcggtttcgcggccgcgcgcgccttgtcgacgcgcaatgacgatcccgcagccgcttcgcgcccgtgggacaaggaccgcgacggcttcgtgctgggcgagggtgccggcgtcatgatgctggaagagtacgaatctgcgaaggcgcgcggtgcgcgcatctatgcggagctcgtgggcttcggcatgagtggagacgcattccacatgactgcgccgaacatggacggcccgcgccgctgcatggtcaacgcgctgcgggacgccggcatcaacgcggacgaggtgcagtacctgaacgcgcacggcacgtcgacgccgctcggcgacaagaacgaaaccgatgctatcaaagcagccttcggtgaccatgcctacaagatggtggtgaattcgaccaagtcgatgaccggccacttgctgggcggcgcaggtggcctggaatcggtgttcaccgtgctcgcactgcataaccaggtgtcgccgccgaccatcaacatcgataaccaggatccggaatgtgacctggactacgtggccaacacggcgcgtgaaatgaaaatcgatgtggccgtgaagaacaacttcggcttcggcggtaccaacggcacgctggtcttccgtcgcgcctga

SEQ ID NO: 19995 - protein, 410 aa, Ralstonia eutropha JMP134
MSRRRVVVTGLGLVSPVGNTVAEGWANLVAGKSGIATVTKFDHSALSVHFAGEVKGFNAEDYIPAKEARNMDTFIHYGIAAGAQALKDSGYEVTDANAERIGVLVGSGIGGLPMIEDTHATLTERGPRRISPFFVPGSIINMISGHLSIMHGLKGPNLAAVTACTTGLHSIGLAARLIQAGDADAMLAGGAESTVSPLGIGGFAAARALSTRNDDPAAASRPWDKDRDGFVLGEGAGVMMLEEYESAKARGARIYAELVGFGMSGDAFHMTAPNMDGPRRCMVNALRDAGINADEVQYLNAHGTSTPLGDKNETDAIKAAFGDHAYKMVVNSTKSMTGHLLGGAGGLESVFTVLALHNQVSPPTINIDNQDPECDLDYVANTAREMKIDVAVKNNFGFGGTNGTLVFRRA

SEQ ID NO: 19996 - DNA, 1245 bp, Staphylococcus saprophyticus subsp. saprophyticus ATCC 15305
  CDS (1)..(1245): transl_table=11
atgagcaaagaacaacgtgttgttattacaggaattggcgcattatcacctataggaaatgatgctaagtctacttgggacaatgcattaaaaggtgtaagtggtatagattcgattacacgcatagatacaacggattacaatgtccatttagctggagagttaaaagactttgatattgaagagcatattcctaaaaaagaagcgagacgcatggatcgctttacacaatatgcagttgtagctgcaagagaagccgttaatgatgctaaacttgaaattaatgatagtactgcggataaaattggcgtatggattggttcaggtattggtggtatggaaacatttgaaatttcacatagccaattattaaatcgtggaccaagacgtgtgagtccgttcttcgtacctatgctgatcccagatatggcgacaggtcaagtatcaatagatttaggtgctaaagggccgaatggttcgacggttactgcttgtgcaactggtacgaactcaataggtgaagcattcaagattattcaacgtggcgatgcagatgcaatgattactggtggtacagaagcaccgattacacatatggcattagctggctttagtgcgagtcgtgcattatctacaaatgatgataaagaaactgcatgtcgtcctttccaagaaggtcgtgatggatttatcatgggtgaaggtgcaggtattgtcgttttagaatcacttgaatcagcgaaagctcgtggtgcgcaaatttacgctgaagtcgtaggttatggatcaactggtgacgcatatcatataacagccccagctccagaaggtgaaggcggttcacgtgctatgcaagcggcaatagatgatgctggtattgaagcgaaagacattcaatatttaaatgcacatggaacaagcactccagtaggtgacttaactgaaattcaagctattaagaatactttcggtgaagcggcgaaatcattgaaagtaagttcaactaaatcaatgacaggtcatttactaggggctacaggtggattagaagctattttctctgcactttcaattagagatagtcgtattgcaccaacgattcatgctgattcaccagatcctgaatgcgatttagatatcgttccaaacaaagcagaagatttagatattacctatgcaatgagtaatagtttaggttttggtggacacaatgctgtacttgtattgaaaaaatttactgattaa

SEQ ID NO: 19997 - protein, 414 aa, Staphylococcus saprophyticus subsp. saprophyticus ATCC 15305
MSKEQRVVITGIGALSPIGNDAKSTWDNALKGVSGIDSITRIDTTDYNVHLAGELKDFDIEEHIPKKEARRMDRFTQYAVVAAREAVNDAKLEINDSTADKIGVWIGSGIGGMETFEISHSQLLNRGPRRVSPFFVPMLIPDMATGQVSIDLGAKGPNGSTVTACATGTNSIGEAFKIIQRGDADAMITGGTEAPITHMALAGFSASRALSTNDDKETACRPFQEGRDGFIMGEGAGIVVLESLESAKARGAQIYAEVVGYGSTGDAYHITAPAPEGEGGSRAMQAAIDDAGIEAKDIQYLNAHGTSTPVGDLTEIQAIKNTFGEAAKSLKVSSTKSMTGHLLGATGGLEAIFSALSIRDSRIAPTIHADSPDPECDLDIVPNKAEDLDITYAMSNSLGFGGHNAVLVLKKFTD

SEQ ID NO: 19998 - DNA, 1269 bp, Ehrlichia canis str. Jake
  CDS (1)..(1269): transl_table=11
atgacaacaagaagaatcgtgatcactggtttaggattggttacttctttaggaagtgatgtaaaaacagtatgggaccttttatctaatggagtatcaggcataagcaaaattaatagatttgacacatctgaccttgactgtaagatagctggacaagtaataatgaagtctgaatctgaagaatacgtttttaatgctgcagactacattccagaaaaagacttaaaaaaaatggataactttattcattttggcatagcagctgccacacaagcagttaacgattctaatttacttgattgtaaagatcttgattatgacagagtaggagtaatagtaggatcaggaataggtggtcttccatttatagaaaaaacagttatatgcttacaagagagaggtcccagaaggattagtcctttcttcataccagcaagtttaattaatcttgtctctggtcatatatctataaagtatgggttcacagggttgactgacgcagtagtaactgcatgctctacaggagcacaagctataggtaatgcagcaagagtgattcaatctggtgaagcagatgtaataatagcaggtggagctgaaggtgcggtatgccgcataggaattgcaggattttcagctatgaaagcattatcaacaaaattcaatgatactccagagctagcatcacgaccttgggataaacaaagagatgggtttgtcatgggagaaggtgcaggaatagttatattagaagattatgagcatgcaaaaaaacgtggagcaaaaatatacggagaactgttaggatatggcatgacatcagatgcatatcatatatcagcacctcatccagaaggcaaaggagggatgaaagctatggaactagcgttatctagcgcacaattaaatccagagtctatcaattatataaacgcacatggcacttctactcctctaggagacagtacagaaattcaagcaataaaaagtatatttaaagaaagcatctacaaagttccaatatcatcaactaaatcttctataggtcacctacttggagcagcaggaagcgttgaagctatcttttctatacttgctatgaatacaagcattacaccccctacattaaacttatatgaatcatcagaggatccacaattaaatctcgttccactcaatgcacaggaacataagattaattattgtctttctaattctttcggctttggtggagtaaatatatcattagtttttgggaaattataa

SEQ ID NO: 19999 - protein, 422 aa, Ehrlichia canis str. Jake
MTTRRIVITGLGLVTSLGSDVKTVWDLLSNGVSGISKINRFDTSDLDCKIAGQVIMKSESEEYVFNAADYIPEKDLKKMDNFIHFGIAAATQAVNDSNLLDCKDLDYDRVGVIVGSGIGGLPFIEKTVICLQERGPRRISPFFIPASLINLVSGHISIKYGFTGLTDAVVTACSTGAQAIGNAARVIQSGEADVIIAGGAEGAVCRIGIAGFSAMKALSTKFNDTPELASRPWDKQRDGFVMGEGAGIVILEDYEHAKKRGAKIYGELLGYGMTSDAYHISAPHPEGKGGMKAMELALSSAQLNPESINYINAHGTSTPLGDSTEIQAIKSIFKESIYKVPISSTKSSIGHLLGAAGSVEAIFSILAMNTSITPPTLNLYESSEDPQLNLVPLNAQEHKINYCLSNSFGFGGVNISLVFGKL

SEQ ID NO: 20000 - DNA, 1269 bp, Dehalococcoides sp. CBDB1
  CDS (1)..(1269): transl_table=11
atgactgataaccagccccaaaacagggttgtcataaccggtatcggtattgtcagccctcttggacttgatacccaaaccacctgggaaggcctgataaacgggcgttcaggtatagaccatatcagcctttttgacgcatcaaatttggctgtccgctttggcggagaggtaaaggattttgacccggcaaactatatatcccgcaaggatatccgccggatggaccgttttgctcagctggccgtagctgccggtaaacaggcactggaaaattcaggcttaaccgtagacgaaagcaccagtcaggatattggcgtaattgtcggcagcggcataggcgggctttcggttctctttgaacagattaaagtatttctggaacaggggccggacagagtcagcccctttttagtaccgatgatgattgcagacatggccggtgcccaagtgtctatccagctgggtcttaaagggtctaatttctgtaccacatctgcctgttcttccggttcagatgccataggtacagcttttgaaaaaatacgtttcggttctgccaaaatcgttctggcaggcggcgccgaatccataatgaacccggtaggttttgccggtttctcagctctaaaagccctttccacccgcaatgaagacccccagacagcttcacgcccgtttgatgccaaccgtgacgggtttgttatttcggagggtgcggctattctggtactggaagagttgcagaccgctaaggcccgcggggcaaatattattgccgagataataggctacggcggttcatcagacgcttttcatatcacccagccggtggaatccggagttgaagccgcacgcgccataaatatcgcccttaaaacagccggtatcaagccggaggcggtggattatattaatgcccacggcacttccaccccgcttaatgacaagatggaaaccaatgctataaaggtggctttcggagaacatgcccgaaaacttgccatcagttccacaaaatccatgctggggcatcttatcggcggggcaggtgctatcgaagcatccatatgcgccctgactatcaaaaacggcattatccctccaactataaactacaccacgcctgatccggaatgtgatctggattacactcccaacaccgcccgtaaagctaaagtaaaggttgcccttaataattcctttggtttcggcgggcataattcagtgcttatcctcagggaaatgggcaatgaaaatattggctaa

SEQ ID NO: 20001 - protein, 422 aa, Dehalococcoides sp. CBDB1
MTDNQPQNRVVITGIGIVSPLGLDTQTTWEGLINGRSGIDHISLFDASNLAVRFGGEVKDFDPANYISRKDIRRMDRFAQLAVAAGKQALENSGLTVDESTSQDIGVIVGSGIGGLSVLFEQIKVFLEQGPDRVSPFLVPMMIADMAGAQVSIQLGLKGSNFCTTSACSSGSDAIGTAFEKIRFGSAKIVLAGGAESIMNPVGFAGFSALKALSTRNEDPQTASRPFDANRDGFVISEGAAILVLEELQTAKARGANIIAEIIGYGGSSDAFHITQPVESGVEAARAINIALKTAGIKPEAVDYINAHGTSTPLNDKMETNAIKVAFGEHARKLAISSTKSMLGHLIGGAGAIEASICALTIKNGIIPPTINYTTPDPECDLDYTPNTARKAKVKVALNNSFGFGGHNSVLILREMGNENIG

SEQ ID NO: 20002 - DNA, 1233 bp, Thiobacillus denitrificans ATCC 25259
  CDS (1)..(1233): transl_table=11
ttgtccaaacgtcgtgtcgtcgtcaccgggctggggatcgtttctccagtcggaaacaccatcccggaagcctgggacaaccttgtcgcggggcgcccgggcatctcccggatcacccgtttcgatcccacgcccttcgcttcgcagatggcgggtgaggtacggaattttgatgtcgcacaatacctcaatccgaaggatgcgcgccgtatggatgtcttcatccagttcggcatggcggccgggatccaggcgattcgtgattcgggcatcgaagtcaccgaagccaattccgatcgtatcggtatcaacatcggctccggaatcggcggcttgccgctgatcgaggagacgcacggtctcctgatggaatcgggtccgcggaagatttcgcccttttttatccccggttccatcatcaacatgatttcgggcaacctgtcgatcctatacggcatcaacggccccaacctcgcggtcgtgacggcgtgcacgacgggcttgcacgccgtcggcctgtcggcccgcatgatccaggccggcgacaccgacgtgatgatcgcgggcggtgcggaatgtgcgacgtcgccgctcggcgtcggcggtttcgcggcggcgcgcgcgctgtcgacgcgcaacgacgatcccgcgacggcgagtcggccgtgggacaaggatcgcgacggcttcgtgctcggcgagggtgcgggcgtactcgtgctcgaggaatacgaacacgccaaggcgcgcggggcaaaaatctactccgaagtcgccggcttcggcatgagcggcgacgcctaccacatgaccgcaccgagcacggacggcccgcggcgctcgatggtgaacgcgatgcgcgacgccgggctcaaccccgatcagatccagtacatcaacgcgcacggcacctcgacgccgctcggcgacaagaacgaaaccgaggcgatcaaactcgcgctgggcgacgccgcgtacaaggccgtggtcaactcgaccaagtcgatgaccggccatctgctcggcggcgccggcggggtcgagtcggtattcagcgtgctcgcggtgcatcaccaggtctcgccgccgacgatcaacattttctcgcaggaccccgagtgcgatctcgactactgcgcgaacacggcccgcgacatgaagatcgacgcggcgctcaagaacaacttcgggttcggcggcaccaacggctcgctggtcttcaagcgcgtttga

SEQ ID NO: 20003 - protein, 410 aa, Thiobacillus denitrificans ATCC 25259
MSKRRVVVTGLGIVSPVGNTIPEAWDNLVAGRPGISRITRFDPTPFASQMAGEVRNFDVAQYLNPKDARRMDVFIQFGMAAGIQAIRDSGIEVTEANSDRIGINIGSGIGGLPLIEETHGLLMESGPRKISPFFIPGSIINMISGNLSILYGINGPNLAVVTACTTGLHAVGLSARMIQAGDTDVMIAGGAECATSPLGVGGFAAARALSTRNDDPATASRPWDKDRDGFVLGEGAGVLVLEEYEHAKARGAKIYSEVAGFGMSGDAYHMTAPSTDGPRRSMVNAMRDAGLNPDQIQYINAHGTSTPLGDKNETEAIKLALGDAAYKAVVNSTKSMTGHLLGGAGGVESVFSVLAVHHQVSPPTINIFSQDPECDLDYCANTARDMKIDAALKNNFGFGGTNGSLVFKRV

SEQ ID NO: 20004 - DNA, 1215 bp, Pseudomonas syringae pv. syringae B728a
  CDS (1)..(1215)
atgggcatgctttcgccactgggcaatgacgtgcccagcagttggcaaggcattctggcgggccgcagtggcattggccttatcgagcacacggacttgtcagccttcaccacccgcttcggcggctcggtcaagggtttcaacgtcgaagaatacctcgcgcccaaagaagcgcgccgcctcgatctctttattcagtatggccttgcggccagctttcaggccgtgcgtaatgcaggcctcgaagtcactgatgcaaaccgtgagcgcatcggcgttgccatggggtcgggcatcggtggtctgaccaatatcgaaaacagcagtcgtctgctgcacgagcagggtcctggacggatttcgccgttcttcgttcctggctcgatcatcaatatgatttccggtttcctgtcgatccacctgggcgcacagggacccaattactccatcgcgacggcttgcacgactgcaacccactgcatcggcatggcggctcgcaacatcgcctatgacgaagcggacgtgatgatcgccggtggcgctgaaatggccgcctgtggactcggtctgggcggcttcggtgcagcgcgtgcgctgtcgacccgcaacgatgacccgacccgcgccagtcgcccctgggacaagggccgtgatggctttgtcctgtccgacggtgccggtgccatggtgctcgaagagcttgagcacgccaaggcgcgtggcgcgaccatttatgcagagctggtcgggttcggcatgagcggcgacgcttatcacatgacttcgccacctgatgacggcgccggtgctgcacgctgcatcgtcaatgcgttgcgtgatgccaaggtcaatcccgatcaggtgcagtacatcaacgcacacggtacgtcgacgcctgcaggcgatctggccgaagcttctgcgatcaagtcggtattcggtgatcacgcctacaagctggcagtcagttcgaccaagtcgatgaccggccacctgctgggcgccgccggtgctgtcgaagcgatcttcagcgtcctggcaatggttgatcaggtggctccgccgaccatcaacctggatgagccaagcgaaggctgcgatctggacttcgtgcctcacgaagcgcgccgcatgccgatcgacgtcgttctgtcgaactccttcggctttggtggcaccaacggctcgctggtattccgtcggttcgccgagtaa

SEQ ID NO: 20005 - protein, 404 aa, Pseudomonas syringae pv. syringae B728a
MGMLSPLGNDVPSSWQGILAGRSGIGLIEHTDLSAFTTRFGGSVKGFNVEEYLAPKEARRLDLFIQYGLAASFQAVRNAGLEVTDANRERIGVAMGSGIGGLTNIENSSRLLHEQGPGRISPFFVPGSIINMISGFLSIHLGAQGPNYSIATACTTATHCIGMAARNIAYDEADVMIAGGAEMAACGLGLGGFGAARALSTRNDDPTRASRPWDKGRDGFVLSDGAGAMVLEELEHAKARGATIYAELVGFGMSGDAYHMTSPPDDGAGAARCIVNALRDAKVNPDQVQYINAHGTSTPAGDLAEASAIKSVFGDHAYKLAVSSTKSMTGHLLGAAGAVEAIFSVLAMVDQVAPPTINLDEPSEGCDLDFVPHEARRMPIDVVLSNSFGFGGTNGSLVFRRFAE

SEQ ID NO: 20006 - DNA, 1215 bp, Pseudomonas aeruginosa UCBPP-PA14
  CDS (1)..(1215)
atgggcatgctgtcgccgctgggcctggatgtcccgagcagttgggaaggtattctcgccggtcgcagcgggatcgccccgatcgagcatatggacctgtccgcctattccacccgcttcggtggttcggtcaagggtttcaatgtcgaggaatacctgtccgccaaggaagcccgcaagctcgacctgttcatccagtacggtctcgccgccagcttccaggccgttcgcgattccggcctggaggtcaccgacgccaatcgtgagcgtatcggcgtatccatgggttccggtatcggcggcctgaccaatatcgagaacaactgccgatccctgttcgagcaggggccgcggcgcatctcgccgttcttcgtgcccggttcgatcatcaacatggtttccggcttcctgtcgatccacctgggtctgcaggggcccaactacgccctcaccaccgcctgcaccaccggtacccacagcatcggcatggctgctcgcaacatcgcctatggcgaggccgacgtgatggtcgccggcggttccgaaatggctgcctgcggtctcggcctgggcggtttcggcgcggctcgcgcgctctccactcgcaacgacgagccgacccgtgccagccgtccgtgggaccgggatcgcgacggcttcgtcctgtccgacggttccggcgccctggtgctcgaagaactggagcacgcccgtgcccgcggcgcgcggatctatgccgagctggttggcttcggcatgagcggcgacgccttccacatgaccgcgccgccggaagatggcgccggtgccgcccgctgcatgaagaacgcgctgcgcgatgccggcctggatcctcgtcaggtcgattacatcaacgcccatggcacctccaccccggccggcgacatcgccgagatcgccgcggtgaagagcgtgttcggcgagcatgcccatgcgctgtcgatgagttcgaccaagtcgatgaccggccacctgttgggtgccgccggtgcggtggaggcgatcttcagcgtgctggccctgcgcgaccaggtcgccccgccgaccatcaacctggacaacccggacgaaggttgcgacctcgacctggtggcccacgaagccaagccgcgcaagatcgacgtggccctgtcgaactcgttcggtttcggcgggaccaacggcaccctggtgttccgcaggttcgccgactga

SEQ ID NO: 20007 - protein, 404 aa, Pseudomonas aeruginosa UCBPP-PA14
MGMLSPLGLDVPSSWEGILAGRSGIAPIEHMDLSAYSTRFGGSVKGFNVEEYLSAKEARKLDLFIQYGLAASFQAVRDSGLEVTDANRERIGVSMGSGIGGLTNIENNCRSLFEQGPRRISPFFVPGSIINMVSGFLSIHLGLQGPNYALTTACTTGTHSIGMAARNIAYGEADVMVAGGSEMAACGLGLGGFGAARALSTRNDEPTRASRPWDRDRDGFVLSDGSGALVLEELEHARARGARIYAELVGFGMSGDAFHMTAPPEDGAGAARCMKNALRDAGLDPRQVDYINAHGTSTPAGDIAEIAAVKSVFGEHAHALSMSSTKSMTGHLLGAAGAVEAIFSVLALRDQVAPPTINLDNPDEGCDLDLVAHEAKPRKIDVALSNSFGFGGTNGTLVFRRFAD

SEQ ID NO: 20008 - DNA, 1215 bp, Pseudomonas fluorescens PfO-1
  CDS (1)..(1215)
atgggtatgttgtcgccactgggcacggatgtgccgagcagttggcagggcattctggctggccgcagtggcattggtctgatcgaacacaccgacctttctgcctattccacccgctttggcggctcggtaaagggcttcaatgtcgaggaatacctgtcggtcaaggaagcgcgcaagctcgacctgttcattcagtacggtctggcggccggctttcaagccgtacgcaatgccggtctggaagtcaccgatgccaaccgtgaacgcatcggcgtggccatggggtcgggtatcggcggtctgaccaacatcgaagaaaccagccgcaccctgcacgagactggcccacgccggatttctccgttctttgtgcctggctcgatcatcaatatgatttccggtttcctgtccatccacctgggtgcacaggggcctaactatgccatcgccacggcgtgtaccaccggtacgcactgcatcggcatggcggcgcgcaacatcatgtacgacgaagccgacgtgatgattgccggcggtgccgagatggccgcgtgcggtctgggcatgggcggcttcggtgcttcccgtgcgctgtcgacccgcaacgacgagccgacccgcgccagccgtccgtgggacaagggccgtgacggcttcgtgctgtccgacggcgccggtgcgctggtgctcgaagagctcgagcacgccaaggcccgtggcgcgaccatctacgccgagctgatcggtttcggcaccagtggcgacgccttccacatgacttcgccacccgccgacggcgccggtgctgcacgctgcatcaccaacgcgctgcgcgatgcgaagatcaacgtcgatcaagttcaatacatcaacgcccacggcacttcgaccccggccggcgaccttgccgaagccaacgcgatcaagtcggtgttcggtgatcacgcctacaaactggcagtcagctccaccaagtccatgaccggtcacctgctgggtgcggcgggcgcggtcgaggcgatcttcagcgtcctggcgatcaacagccaggtggcgccaccgaccatcaacctcgaagagccggacgaaggctgcgacctcgatttcgtgccgcacaccgcgcgcaatatggatatcgatgtcgtgctgtccaactcgttcgggtttggcggcaccaacggcacgctggcgttccgtcggttcgccggctga

SEQ ID NO: 20009 - protein, 404 aa, Pseudomonas fluorescens PfO-1
MGMLSPLGTDVPSSWQGILAGRSGIGLIEHTDLSAYSTRFGGSVKGFNVEEYLSVKEARKLDLFIQYGLAAGFQAVRNAGLEVTDANRERIGVAMGSGIGGLTNIEETSRTLHETGPRRISPFFVPGSIINMISGFLSIHLGAQGPNYAIATACTTGTHCIGMAARNIMYDEADVMIAGGAEMAACGLGMGGFGASRALSTRNDEPTRASRPWDKGRDGFVLSDGAGALVLEELEHAKARGATIYAELIGFGTSGDAFHMTSPPADGAGAARCITNALRDAKINVDQVQYINAHGTSTPAGDLAEANAIKSVFGDHAYKLAVSSTKSMTGHLLGAAGAVEAIFSVLAINSQVAPPTINLEEPDEGCDLDFVPHTARNMDIDVVLSNSFGFGGTNGTLAFRRFAG

SEQ ID NO: 20010 - DNA, 1236 bp, Enterococcus faecium DO
  CDS (1)..(1236): transl_table=11
atgaatcgagtggtaattactggctatggagtcacttcacctattggaaatgacgcagacagctttttgaatagcttaaaagaggggacgaatggcatcgcaccgatcactaaatttgatgcttcagaaacagggattaccttagcgggtgaagtcaaagatttcccttacgataaatattttattaaaaaagatagcaaacgaatggatatgttttcgatctatggaatctacgctgctttagaagcaatggagatgagcggtttagataaagaaaaaatgaatcaagaccggtttggcgtcatcatcggatctgggatcggtggtcttccaacaatcgaaaaccaagttattcgtctacatgaaaaaggtgcaaaacgagtttctccaatgttcgtaccaatggcgattgccaacatggcagctggaaatattgctttgcgtgtaggtgcaaaaggtatttgtacagctatcgtaacagcttgtgctagcggaacgaattcaattggggaagcattccgtaacatcaaacatggctattctgatgtcattcttgctggaggaacagaagcaacgatttgtgagatggggattgctggatttgcagctttaacagcactctcagaatcaactgatcctaatcgtggttcgattccgtttgacgaaaatcggaatggttttgtgatgggtgaaggagcaggcgttctagttcttgaatctttagaacatgcacaagctcgcggtgccaaaatctatggagaaatcgttggatacggtgcaaactgtgacgcttaccatatgacagctcctactccagatggttctggtgcatctaaagcaatgaagcttgcgatggaagaagctggtgtacagccggaacaagtcggatatatcaatgctcacggaacaagtacaccagccaatgaccaggcagaagcaaaagcaatccaaatcgcattaggtgaaaatttcagagatacttacgtcagcagcacgaaatcgatgactggacatttattgggagcagccggcgggatcgaagccttggcaactttgctggcattagaacatcaatttatcccacctacgatcaatgtagaaaaacaagatcctgagattgacttgacagttgtcaaaaacgaaagcaaacctgcaagttttacttatgcaatgagtaattcattagggtttggcggacataatgcggttctgtgcatgaaacgctgggaggaataa

SEQ ID NO: 20011 - protein, 411 aa, Enterococcus faecium DO
MNRVVITGYGVTSPIGNDADSFLNSLKEGTNGIAPITKFDASETGITLAGEVKDFPYDKYFIKKDSKRMDMFSIYGIYAALEAMEMSGLDKEKMNQDRFGVIIGSGIGGLPTIENQVIRLHEKGAKRVSPMFVPMAIANMAAGNIALRVGAKGICTAIVTACASGTNSIGEAFRNIKHGYSDVILAGGTEATICEMGIAGFAALTALSESTDPNRGSIPFDENRNGFVMGEGAGVLVLESLEHAQARGAKIYGEIVGYGANCDAYHMTAPTPDGSGASKAMKLAMEEAGVQPEQVGYINAHGTSTPANDQAEAKAIQIALGENFRDTYVSSTKSMTGHLLGAAGGIEALATLLALEHQFIPPTINVEKQDPEIDLTVVKNESKPASFTYAMSNSLGFGGHNAVLCMKRWEE

SEQ ID NO: 20012 - DNA, 1308 bp, Neurospora crassa
  CDS (1)..(1308): n means a or g or c or t/u, s means g or c
atgagacgcgtggtagtgacaggcctcggtgccatcacgcccttggccgtcggcatccgtcccacctggcgccggctcttggactctcattcgggcatcgtcagcgtcgctgacctcgagccccaggacaaatggaaggagctcaccagcaccgtgggcggccttgttcctacgcctgcgaggaacaagcagaatgttgacgaacagcacacttggaaggctgcggactggttggagccttcggaccaganacgcatgtctctcttcgcccagtattctgtcgctgctactgaaatggccctgcaagatgctgggtggaagcccacgaggcaggaagaccttgaagccacaggtgtctgcatgggaagcggaatcggtaacttggatgacttttataacaccagcgtcacgtatgacaaagagggctacaagagggtctcccctctctttgttcccaagattnttatcaacctcggggctggccacatcgccatgcgctacggtttccgtgggcccaaccantctgccaccaccgcttgtaccaccggcgctcactccatcggtgatgcctcccgcttcattgcctttggcgacgctgatgttatggtcgccggcggctccgagtcctgcattcaccctttaacttttgctggctttggccggtctcgntcgctgtntaccgcgtacaaccacgatccgacatctgcctgccgaccctttgacaaggaccgcgccggcttcgtggtatccgagggtgctgctgtcctcattctagaggagctggagcacgccaagaggcgcggcgctaggatcttggccgagctgacggggtatggatgcagtggtgatgcacatcacatgacggcgccaagggatgatgggtcaggggcattcctgtctatgaacanggcgctcaaaaatgccgggtgtcaaccgggggacgtggactatatcaatgcccatgccacggggacggctgtangagatgcggctgangcgattgccattcggtcgctgatgatgggtgaagaangantggacgacgantccaggattacggtgaacancaccaagggagcgattggtcatcttcttggtgcggcgggggccattgaatctgtgttttcgattctggccattgctgaggganccataccccccactctcaacttgaccagtcccaatgtcggcgttggattcaactttgtccctgttcaggcgcagcaaaaggaagtcaaggtggccatgtccaacagctttggnttngggggcaccaatgcctccttggtattttcaaagttngagtag

SEQ ID NO: 20013 - protein, 435 aa, Neurospora crassa
  Xaa in the positions 84, 155, 174, 226, 303, 328, 332, 345, 346, 349, 356, 384, 422 and 434 is unknown
MRRVVVTGLGAITPLAVGIRPTWRRLLDSHSGIVSVADLEPQDKWKELTSTVGGLVPTPARNKQNVDEQHTWKAADWLEPSDQXRMSLFAQYSVAATEMALQDAGWKPTRQEDLEATGVCMGSGIGNLDDFYNTSVTYDKEGYKRVSPLFVPKIXINLGAGHIAMRYGFRGPNXSATTACTTGAHSIGDASRFIAFGDADVMVAGGSESCIHPLTFAGFGRSRSLXTAYNHDPTSACRPFDKDRAGFVVSEGAAVLILEELEHAKRRGARILAELTGYGCSGDAHHMTAPRDDGSGAFLSMNXALKNAGCQPGDVDYINAHATGTAVXDAAXAIAIRSLMMGEEXXDDXSRITVNXTKGAIGHLLGAAGAIESVFSILAIAEGXIPPTLNLTSPNVGVGFNFVPVQAQQKEVKVAMSNSFGXGGTNASLVFSKXE

SEQ ID NO: 20014 - DNA, 1425 bp, Perilla frutescens
  CDS (1)..(1425)
atgcaatccctccactccaccggtctccgcccatctccgctcgacccacttctcaaaccccaccgctcctccgccgcggctctgccgggaagcaatgccaggccccccgcaaagaagctcccattcagagtctccgccgcagccgccgtggcggcggcgcccaagcgcgagaccgacccgaagaagcgcgtggtgatcacggggatggggttggtgtccgttttcggaaacgacgtcgacgcctactacgagaagctgctgagcggggagagcggcatcactctcattgatagattcgatgcgtcgaagttcccgacccgcttcggcgggcagattcgcgggttcaaggcggagggatacattgatgggaagaatgatcggagattggatgattgcttgaggtactgcattgtcgccggaaagaaggcgctcgagggtgcagatcttggtggagagaagctcaataagattgataagatccgagctggtgttctggttgggacgggaatgggcggtcttacagttttctctgatggtgttaaggctctaatagagaaaggtcacaggaaaataactccgtttttcataccttatgctataacaaacatggcctcggctttgcttgcgattgatcttggcttgatgggacccaattattcgatatcaactgcttgtgccacctcaaattattgtttctatgctgctgccaatcacatccgtcggggtgaagctgatctgatgattgctggtggaactgaagccgcgatgattcctattggtttgggtggttttgtcgcttgcagagcattgtcacagagaaatgatgatccacaaactgcttctaggccctgggacaaggatcgagatggttttgttatgggtgaaggttctggagtcttggtgatggagagtttggaacatgcaatgaaacgaggggcgccaatcattgctgaatacttgggaggtgcagtaaattgtgatgcttatcacatgacagatcccagagctgatggactcggtgtctcgtcatgtattcaaagtgcccttgaagattctggcgtttcacctgaggaggttaactacataaatgctcatgccacttccaccattgttggtgatttagcagacgtaaatgctattaagaaggtattcaagaacacctcagggatcaaaataaatgcaaccaagtcgatgatagggcattgtcttggtgctgctggtggtttagaagctattgcatcagtaaaagcaattacaactggatggcttcatcccaccataaatcaatttaatccggagccttccataggctttgataccgttgcaaacgaaaaacagcagcatgaagtcaatgttgcaatctcaaattcctttggattcgggggccacaactctgttgtcgcgttttctgcattcaaaccgtga

SEQ ID NO: 20015 - protein, 474 aa, Perilla frutescens
MQSLHSTGLRPSPLDPLLKPHRSSAAALPGSNARPPAKKLPFRVSAAAAVAAAPKRETDPKKRVVITGMGLVSVFGNDVDAYYEKLLSGESGITLIDRFDASKFPTRFGGQIRGFKAEGYIDGKNDRRLDDCLRYCIVAGKKALEGADLGGEKLNKIDKIRAGVLVGTGMGGLTVFSDGVKALIEKGHRKITPFFIPYAITNMASALLAIDLGLMGPNYSISTACATSNYCFYAAANHIRRGEADLMIAGGTEAAMIPIGLGGFVACRALSQRNDDPQTASRPWDKDRDGFVMGEGSGVLVMESLEHAMKRGAPIIAEYLGGAVNCDAYHMTDPRADGLGVSSCIQSALEDSGVSPEEVNYINAHATSTIVGDLADVNAIKKVFKNTSGIKINATKSMIGHCLGAAGGLEAIASVKAITTGWLHPTINQFNPEPSIGFDTVANEKQQHEVNVAISNSFGFGGHNSVVAFSAFKP

SEQ ID NO: 20016 - DNA, 1593 bp, Perilla frutescens
  CDS (1)..(1593)
atggccgcatgcatgtccgtcacgtgtgagagagaatccggcgtttctgcgctgtcgacgacgtcgtctaattcacgccgcctcaccaaatgggccgcccaccgccgcaagagggttctcgccaaatgtgcgccgcgcattcggaatctagtggattcttctctctcccttgagccccgccaccacttgcataaatctcacgaatgtttcttcggcttcgaatcgagaaatgctccgatgcagcgcggccgccagaaactcctccacccctccgcctattctggagaaatgatggcagtagctgtaaatccagccatggaagtttcacccaagaagaaacctccaaccaagcaccgacgagtggtcgtgacaggtatgggtgtggagacaccacttggtagtgatccagatgtcttctataataatctgctagaaggagtcagtggaattagtgagatagaggcttttgattgctcgcagtttccaaccagaattgctggagaaatcaagtcattctcaacagatggctgggttgtacctaaactttccaagagaatggacaagttcatgctttacatgttgacagcgggcaagaaggctttggctgatggaggaattacagtagatgccatggatgaactaaataaagcaaaatgtggtgtgctaattggctctgctatgggtggaatgaaagttttttatgatgcgattgaagcattgcgggtctcatataggaagatgaatccattttgtgttccttttgcaactaccaacatgggttctgccatgcttgcaatggatctgggatggatgggcccaaactactcaatatctactgcttgtgcaacaagtaacttttgtatactgaatgctgctaaccacatcatcagaggtgaagctgacttgatgctttgtggtggctcagatgcagcaattataccaattggattgggaggctttgttgcatgcagagcactgtcacaaagaaacagtgatccaactaaagcctcacgtccctgggatagtaatcgtgatggatttgttatgggagaaggtgctggagtactgctcttggaggaactagaacatgcaaagagtagaggtgcaactatctatgctgagtttcttggaggaagcttcactagtgatgcttatcacatgacagagcctcatccacaaggaactggtgtcattttatgcttagagaaggctttggctcaatcaggagtatctaaagaagatgtgaattatataaatgcacacgcaacttctactccagctggtgatcttaaggagtatcaggctcttcttcattgttttggcaagaatccggagttgagagtgaactccacaaaatccatgattgggcacctacttggagcagctggtgctgtcgaggcggttgcaactgtgcaggcaatcaggactggctgggttcatccaaatattaatcttgaaaatccagatggtggtgtggatgcaaatgtgttagtgggaccaacaaaagaaagactcgacattaaggtggcattgtctaattcgtttgggtttggtggtcataactcatcgattttgtttgctccatacaagtag

SEQ ID NO: 20017 - protein, 530 aa, Perilla frutescens
MAACMSVTCERESGVSALSTTSSNSRRLTKWAAHRRKRVLAKCAPRIRNLVDSSLSLEPRHHLHKSHECFFGFESRNAPMQRGRQKLLHPSAYSGEMMAVAVNPAMEVSPKKKPPTKHRRVVVTGMGVETPLGSDPDVFYNNLLEGVSGISEIEAFDCSQFPTRIAGEIKSFSTDGWVVPKLSKRMDKFMLYMLTAGKKALADGGITVDAMDELNKAKCGVLIGSAMGGMKVFYDAIEALRVSYRKMNPFCVPFATTNMGSAMLAMDLGWMGPNYSISTACATSNFCILNAANHIIRGEADLMLCGGSDAAIIPIGLGGFVACRALSQRNSDPTKASRPWDSNRDGFVMGEGAGVLLLEELEHAKSRGATIYAEFLGGSFTSDAYHMTEPHPQGTGVILCLEKALAQSGVSKEDVNYINAHATSTPAGDLKEYQALLHCFGKNPELRVNSTKSMIGHLLGAAGAVEAVATVQAIRTGWVHPNINLENPDGGVDANVLVGPTKERLDIKVALSNSFGFGGHNSSILFAPYK

SEQ ID NO: 20018 - DNA, 1278 bp, Streptomyces roseofulvus
  CDS (1)..(1278): transl_table=11
gtgaaccgacaagtcgccgtcaccggcatcggcgtggtggctccgggagggatcgggcgcaagccgtactgggagcagctcacctccggacgcaccgccacgcgcgccatctccttcttcgacgcctcgcccttccgctcgcggatcgccgccgaggtcgacttcgaccccgcggcggcgggcctgagcccgcgcgaggtccgccgcatggaccgggccgcgcagttcgccgtcgtgagcgccagggagagcctcgccgacagcggactcgacgtcgccgacctcgacccccaccggatcggggtgagcatcggcagcgccgtgggcgggaccacctcgctggaacgcgagtacctcgccctcagcgacagcgggcgacagtgggaactcgacctctcctacctctcgccgcacctctacgacgccttcacccccagctcgctcgcccgcgaggtggccggggtgatcggcgcggaggggcccgcggcagtcgtctccaccggctgcacctccggcatcgactcgctcggccacgcccgcgacctcatcgccgagggcagcgccgacgtcgtgctcgcgggcggcaccgacacccccatctcgccgatcgccgtcgcctgcttcgacgccatcaaggccacctcgcccagcaacgacgacccggcgcacgcctcgcgccccttcgacagggaacgcaacggcttcgtcctcgcggagggcgccgccgtcctcgtgctggaggagctggggcacgcgcgggcccgcgacgcccacgtctacgctctcgtgtccggctacgccacgcgctgcaacgcgtaccacatgaccgggctcaccccgcacggcagggagatggccgaggcgatccggcacgcgctcgccgagagcgggaccgaccccgccgccgtggactacgtcaacgcccacggctccggcaccaagcagaacgaccggcacgagaccgccgccttcaaggccacgctcggcgagcgggccaggagcgtgccggtcagctccatcaagtcgatgatcggccactcgctcggtgccatcggttcgctggagatcgcggcctgggcgctcgccatggagtacggcgtggtgccgcccaccgccaacctcgacacgcccgaccccgagtgcgacctcgactacgtgccccacgaggcgcgcgagacgcgggtggacagggtcctgagcgtcggcagcggcttcggcggtttccagagcgccatggtcctcacccgggacacgggcgcccgcctcccgacggcctga

SEQ ID NO: 20019 - protein, 425 aa, Streptomyces roseofulvus
MNRQVAVTGIGVVAPGGIGRKPYWEQLTSGRTATRAISFFDASPFRSRIAAEVDFDPAAAGLSPREVRRMDRAAQFAVVSARESLADSGLDVADLDPHRIGVSIGSAVGGTTSLEREYLALSDSGRQWELDLSYLSPHLYDAFTPSSLAREVAGVIGAEGPAAVVSTGCTSGIDSLGHARDLIAEGSADVVLAGGTDTPISPIAVACFDAIKATSPSNDDPAHASRPFDRERNGFVLAEGAAVLVLEELGHARARDAHVYALVSGYATRCNAYHMTGLTPHGREMAEAIRHALAESGTDPAAVDYVNAHGSGTKQNDRHETAAFKATLGERARSVPVSSIKSMIGHSLGAIGSLEIAAWALAMEYGVVPPTANLDTPDPECDLDYVPHEARETRVDRVLSVGSGFGGFQSAMVLTRDTGARLPTA

SEQ ID NO: 20020 - DNA, 1467 bp, Capsicum chinense
  CDS (1)..(1467)
atgagtagtattactagtagttgttattctaatttgatattgaagaagaaagaatcaagaatcaatggaggatttcatttacagtataatggacttagagctattgaaagtgtacaaatgccagcaagctctgttgcttataagccaaaagttgtaaaatggggaagaatcagggtcatggcttctccagctgtctcagctcctaagagagagacggacccgaagaaaaggattgtcataaccggaatgggccttgtttcagtctttggaagtgatatcgataatttttacaacaaacttctcgagggacaaagtggaatcagtttaatagacagatttgatgcctcaagttacacagttaggttcgcgggacagattcgtgatttctcctctgaaggctacatagacggaaagaatgatcgtcgcttggatgactgctggagatattgtcttgttgctgggaaaagggccctcgaagatgctaaccttggccaacaagttcttgatactatggacaaaacaaggatcggtgtcttggttgggtcgagcatggggggttcaaaagttttcgccgatgcggtggaagccttggtgcaaagaggatacaagaaaattaatccatttttcattccttactcaatcactaacatgggatcagcattgttggctatagacactggactaatgggaccaacttactctatttcaacggcttgtgcaactgccaattactgcttttacgcatctgcaaatcacattagaagaggcgaagctgatatcatggtagcaggtggaacggacgcttttatttcggctattggtgttggtggtctcatagcttgtcgagccttgtctcaaagaaatgatgaatatgaaaaggcttcaaggccatgggacaggaatcgtgatggatttgtcattggtgaaggctccggtgtcctggtgatggaaaatttggagcatgccttgaaaagaggtgctcctatcatagcggaatacttgggaggtgctatcacgtgtgatgctcatcacataaccgatcctcgtgctgatggacttggagtttcgtcttgcatagtaatgagtttggtagatgcgggagtttccccagaagaggtgaactatataaatgctcatgcaacatctactcttgctggagatttggctgaggtcaatgccatcaagaaggtcttcaaggatacctcggaaatcaaaatgaacgggacaaagtcgatgattggtcatggactcggggcttctggtggacttgaagccattgcaaccatcaaggcgatcacaacaggatggcttcatccaaccatcaatcaatatgacttagaacctcaggttacaattgacaccgttccaaatgtgaagaagcaacatgaagtgaacgtcggtatctccaactcgttcggattcggagggcataactcagtggttgtttttgcaccctacaaaccttga

SEQ ID NO: 20021 - protein, 488 aa, Capsicum chinense
MSSITSSCYSNLILKKKESRINGGFHLQYNGLRAIESVQMPASSVAYKPKVVKWGRIRVMASPAVSAPKRETDPKKRIVITGMGLVSVFGSDIDNFYNKLLEGQSGISLIDRFDASSYTVRFAGQIRDFSSEGYIDGKNDRRLDDCWRYCLVAGKRALEDANLGQQVLDTMDKTRIGVLVGSSMGGSKVFADAVEALVQRGYKKINPFFIPYSITNMGSALLAIDTGLMGPTYSISTACATANYCFYASANHIRRGEADIMVAGGTDAFISAIGVGGLIACRALSQRNDEYEKASRPWDRNRDGFVIGEGSGVLVMENLEHALKRGAPIIAEYLGGAITCDAHHITDPRADGLGVSSCIVMSLVDAGVSPEEVNYINAHATSTLAGDLAEVNAIKKVFKDTSEIKMNGTKSMIGHGLGASGGLEAIATIKAITTGWLHPTINQYDLEPQVTIDTVPNVKKQHEVNVGISNSFGFGGHNSVVVFAPYKP

SEQ ID NO: 20022 - DNA, 1554 bp, Cuphea wrightii
  CDS (1)..(1554)
atggccgccgtctcctccccattctgtacgtggctcgttgccgcctgcatgtccacttcattcgacaacgacccacgttccctttccaacaagcgggtccgcctctcccgccgccggaggactctctcctcccattgctccctccgcggatccaccttccaatgcctcggggataacgtaggattcgattccctcttcggatccaatcacggccaccggaggctcggccgcgcttcccgttccggggaggccatggctgtggcaatgcaacctgcaccggaagtctccacaaaaaagaaacctgttaccaagcaaaggcgagtagttgtgacaggtatgggcgtagtgactcctctaggccatgaccccgatgttttctacaataatctcctagacggagtaagtggcataagtgagatagagaccttcgactgcactcagtttcccacgagaattgccggagagatcaagtctttctccacagatgggtgggttgccccgaagctctccaagaggatggacaaattcatgctttacatgctgactgcaggcaagaaagcattagcagatgctggaatcactgaagatgtgatgaaagagctcgataaaagaaagtgtggagttctcattggctccgggatgggcggtatgaagctattcaacgattccattgaggctctgaggatttcatataagaaaatgaatcccttttgtgtaccttttgctacgacgaatatgggatccgctatgcttgcaatggacttgggatggatgggacctaattattcgatatcaactgcatgtgctacaagtaacttctgtatactgaatgctgcgaatcacataatcagaggcgaagcggatatgatgctttgtggtggctcggatgcagccattatacctatcggtttgggaggtttcgttgcatgccgagctttgtcacagaggaataatgaccctaccaaagcttcgagaccatgggacagtaatcgtgatggatttgtgatgggagaaggagccggagtgttacttctcgaggagttagagcatgcaaagaaaagaggtgcaaccatttatgcggaatttctaggtgggagtttcacttgtgatgcctaccacatgaccgagcctcaccctgaaggagctggagtgatcctctgcatagagagggccttggctcagtcgggagtctcgaaagaagacgtaaattacataaatgcgcatgcaacttcaactcctgctggagatattaaggaatatcaagctctcgcccgcattttcagccaaaacagcgagttaagagtgaattccaccaaatcgatgatcggtcatcttcttggagctgctggcggcgtagaagccgttacagtagttcaggccataaggactggttggatccatccaaatattaatttggaaaacccggacgatggcgtggatgcaaaattgctcgtcggccctaagaaggagaaactgaaggtgaaggtcggtttgtccaattcattcgggttcggtggccataactcatccatactctttgccccttgcaattag

SEQ ID NO: 20023 - protein, 517 aa, Cuphea wrightii
MAAVSSPFCTWLVAACMSTSFDNDPRSLSNKRVRLSRRRRTLSSHCSLRGSTFQCLGDNVGFDSLFGSNHGHRRLGRASRSGEAMAVAMQPAPEVSTKKKPVTKQRRVVVTGMGVVTPLGHDPDVFYNNLLDGVSGISEIETFDCTQFPTRIAGEIKSFSTDGWVAPKLSKRMDKFMLYMLTAGKKALADAGITEDVMKELDKRKCGVLIGSGMGGMKLFNDSIEALRISYKKMNPFCVPFATTNMGSAMLAMDLGWMGPNYSISTACATSNFCILNAANHIIRGEADMMLCGGSDAAIIPIGLGGFVACRALSQRNNDPTKASRPWDSNRDGFVMGEGAGVLLLEELEHAKKRGATIYAEFLGGSFTCDAYHMTEPHPEGAGVILCIERALAQSGVSKEDVNYINAHATSTPAGDIKEYQALARIFSQNSELRVNSTKSMIGHLLGAAGGVEAVTVVQAIRTGWIHPNINLENPDDGVDAKLLVGPKKEKLKVKVGLSNSFGFGGHNSSILFAPCN

SEQ ID NO: 20024 - DNA, 1623 bp, Cuphea wrightii
  CDS (1)..(1623)
atggcggccgccgcttccatggttgcgtccccattctgtacgtggctcgtagcctcttgcatgtccacttcattcgacaacgacccacgttcgccgtccgtcaagcgtttcccccgccggaagagggttctctcccaacgcggatccacattccaatgcctcgtcgcctcatgcatcgacccttgtgatcaataccggtcctccgcctcccttagcttcctcggggataacggatttgcttcccttttcggatccaagccattcatgtccaatcgcggccaccggaggctccgccgtgcttcccattccggggaggccatggctgtggctctgcaaccggcacaggaagctggcacgaagaagaaacctgttatcaagcaaaggcgagtagttgttaccggaatgggcgtggttactcctctaggccatgaacctgatgttttctacaacaatcttctagatggagtaagcggcataagtgagatagagaccttcgactgcactcagtttcccacgagaattgccggagagatcaagtctttttccacagatgggtgggtggccccaaagctatccaagaggatggacaagttcatgctttacttgttgactgctggcaagaaagcattagcagatggtggaatcaccgatgaggtgatgaaagagcttgataaaagaaagtgtggagttctcattggctccggaatgggcggcatgaaggtgttcaacgatgccattgaagctctgagggtttcatacaagaagatgaatcccttttgtgtaccttttgctaccacaaatatgggatcagctatgcttgcaatggacttgggatggatgggtcctaactactcgatatcaactgcctgtgcaacaagtaatttctgtatactgaatgctgcaaaccacataatcagaggcgaagctgacatgatgctttgtggaggctcggatgcagtcattatacctattggtttgggaggttttgtggcgtgccgagctttgtcacagaggaatagtgaccctaccaaagcctcgagaccatgggatagtaatcgtgatggatttgtaatgggcgaaggagctggagtgttacttctcgaggagttagagcatgcaaagaaaagaggtgcaaccatttatgcggagtttttagggggaagtttcacttgcgatgcctatcacatgaccgagcctcaccctgaaggagctggagtgatcctctgcatagagaaggccttggctcaggccggagtctctaaagaggacgtgaattacataaatgcgcatgcaacttccacatccgctggagatatcaaggaataccaagctcttgcccggtgtttcggtcaaaacagtgagctgagagttaattccactaaatcaatgatcggtcatcttcttggagcagctggtggtgtagaagcagttaccgtagttcaggcgataaggaccgggtggatccatccaaatcttaatttggaagacccagacaaagctgtggatgcaaaattgctcgtcggacctaagaaggagagactgaatgtcaaggtcggtttgtccaattcattcgggttcggtggtcataactcatccatacttttcgccccttgcaatgtctaa

SEQ ID NO: 20025 - protein, 540 aa, Cuphea wrightii
MAAAASMVASPFCTWLVASCMSTSFDNDPRSPSVKRFPRRKRVLSQRGSTFQCLVASCIDPCDQYRSSASLSFLGDNGFASLFGSKPFMSNRGHRRLRRASHSGEAMAVALQPAQEAGTKKKPVIKQRRVVVTGMGVVTPLGHEPDVFYNNLLDGVSGISEIETFDCTQFPTRIAGEIKSFSTDGWVAPKLSKRMDKFMLYLLTAGKKALADGGITDEVMKELDKRKCGVLIGSGMGGMKVFNDAIEALRVSYKKMNPFCVPFATTNMGSAMLAMDLGWMGPNYSISTACATSNFCILNAANHIIRGEADMMLCGGSDAVIIPIGLGGFVACRALSQRNSDPTKASRPWDSNRDGFVMGEGAGVLLLEELEHAKKRGATIYAEFLGGSFTCDAYHMTEPHPEGAGVILCIEKALAQAGVSKEDVNYINAHATSTSAGDIKEYQALARCFGQNSELRVNSTKSMIGHLLGAAGGVEAVTVVQAIRTGWIHPNLNLEDPDKAVDAKLLVGPKKERLNVKVGLSNSFGFGGHNSSILFAPCNV

SEQ ID NO: 20026 - DNA, 1488 bp, Hordeum vulgare
  CDS (1)..(1488)
atggcggcagcggcgccaccgctctgcgcgtggctcgtcgccgcgggcgcgcacgcggactgcggggcggacgagcaccagcatcgccggacgcagtgcctcgacgccggctccggcgcgatgttcggcctcgaccgccgccccctcggggcgcggcgccgtgggcccgcgcgctctggaatggccatgtctgttgccttgcagcctgaaaggataactgtcgagaagaagagacctgatgttaaacaaaggagagtcgttgtcactggcatgggtgtagtgacgccactgggtcatgatcctgatgtgttttacaccaaccttcttgacggtcatagtggaataagcgagattgaaacgtttgactgctccaagttccccacgagaattgcaggagagataaaatccttctctacagaaggttgggttgtacccaagctatctaagcgaatggacaagttcatgctgtatttgataactgctggtaagaaagcattggaaaatggtggactcaccgaagaagtaaggaacgagttggataaaaccagatgtggggttctcattggctctgcgatgggcggcatgaaggtatttaatgatgcaattgaagcgttaagggtttcttacaggaaaatgaacccgttttgtgttccctttgctactactaatatgggttctgcaatacttgcaatggatctgggctggatgggaccaaattactctatttccactgcatgtgccaccagtaacttttgtatcctcaacgcagcaaaccatatcagaagaggggaagctgatgtcatgctttgtggtggttctgatgcgccactcatcccaattgggttgggaggttttgttgcctgcagagctctttcacagaggaacagtgacccaacaaaagcttcccggccctgggatatggaccgtgatggttttgttatgggagaaggggcaggtgtgctagtattggaagaacttgagcatgctaagcaaagaggtgcaacaatatatgctgaatttcttggtggaagcttcacatgcgatgcttaccatatgactgagccgcatcctgaaggaacggggatcactctctgcattgagaaggcactggctgattcaggggtagcaagggaagaaatcaactatgtgaatgcgcatgcaacatccacacaatcaggcgatttgaaggagtatgaagccattgttcgttgctttggccagaaccctcagctgagggtgaactcaacaaaatcaatgactgggcatcttataggagcagctggtggaatagaagctgttgcttgtgtacaagctataagaactggttgggtccatccaaatctgaatttggagaacccagaaaaagtagtggacgtgggcgtgttggtgggatcagagaaggagagatgcgaagtaaaggtggcgctgtcaaactcatttggatttggtgggcataactcatcaattctgtttgcccccttcaagtaa

SEQ ID NO: 20027 - protein, 495 aa, Hordeum vulgare
MAAAAPPLCAWLVAAGAHADCGADEHQHRRTQCLDAGSGAMFGLDRRPLGARRRGPARSGMAMSVALQPERITVEKKRPDVKQRRVVVTGMGVVTPLGHDPDVFYTNLLDGHSGISEIETFDCSKFPTRIAGEIKSFSTEGWVVPKLSKRMDKFMLYLITAGKKALENGGLTEEVRNELDKTRCGVLIGSAMGGMKVFNDAIEALRVSYRKMNPFCVPFATTNMGSAILAMDLGWMGPNYSISTACATSNFCILNAANHIRRGEADVMLCGGSDAPLIPIGLGGFVACRALSQRNSDPTKASRPWDMDRDGFVMGEGAGVLVLEELEHAKQRGATIYAEFLGGSFTCDAYHMTEPHPEGTGITLCIEKALADSGVAREEINYVNAHATSTQSGDLKEYEAIVRCFGQNPQLRVNSTKSMTGHLIGAAGGIEAVACVQAIRTGWVHPNLNLENPEKVVDVGVLVGSEKERCEVKVALSNSFGFGGHNSSILFAPFK

SEQ ID NO: 20028 - DNA, 1470 bp, Hordeum vulgare
  CDS (1)..(1470)
atgtcggcggtggcgccaccgctgtgcacttggatcgtcgccgcctgcttgtctgcaacctgcgtcgcagacgatgaggggaagcagcgcaactacatcggcggcgggcttttctgcacgcgccgccaccttgctgcgcgccgccgaggcggggcacgctctggagtgcccattgctgtttcctttcatcctgaaagaggagctgtggaaaacaacaaatctgaaaccaaacaacggagggtagttgtcactggcatgggtgtcgtgactccgttaggccatgagcctgatgagttttacaacaaccttctacagggtgtcagtggagtaagtgagatagaagcatttgactgttccagctatcccacgagaattgcaggagaaatcaaatccttctcaacagatggttgggttgcaccaaagttagctaagcgaatggataagttcatgcaatatttgatagttgctggtaagaaagcattggacaatggtggagtcactgaagatatcatgaacgagttggacaaatcgagatgtggagttctaattggatctggtatgggtggcatgaaggtttttagtgatgcaattgaagcattgagggtctcctacaggaagatgaacccattttgtgtaccttttgcaactacaaacatgggctctgcagtacttgcgatggatttgggctggatgggcccaaactactccatctctactgcttgcgccactagtaacttctgcattctgagtgcagctaatcatatcatgaggggggaaactgatttgatgctttgtggtggttctgatgctcccattataccaattggattgggaggttttgtggcatgtagagctctttcacagagaaatagtgatccaacaaaagcttctcggccttgggatgtggatcgtgatgggtttgtcatgggagaaggggctggtgtgcttcttttggaagaacttgagcatgcaaagcaaagaggtgcagaaatatatgccgaatttctgggtggaaactttacgtgcgatgcatatcatatgacggaaccacatcctgaagggaagggggttattctttgtgtcgaaaatgcactagctgatgcaggagtaacaaggcaagacattaactacgtaaatgcccatgctacatctacacagttgggcgatttgaaggaattcgaagctcttcgccgctgttttggccagaatcctcagctaagagtaaactcaacaaagtcgatgactggccacttgctaggtgctgcaggtggaatagaagctgtagctgctatacaagctataagaactggttggatccatccgaatatcaatctaaacaatccggagaaaaatgtggatgtcagcttgctggtgggatcacaaaaggagagatgtgacgtgaaagttgcgttgtcgaattcatttggattcggtgggcacaattcatcaattttatttgcacccttttga

SEQ ID NO: 20029 - protein, 489 aa, Hordeum vulgare
MSAVAPPLCTWIVAACLSATCVADDEGKQRNYIGGGLFCTRRHLAARRRGGARSGVPIAVSFHPERGAVENNKSETKQRRVVVTGMGVVTPLGHEPDEFYNNLLQGVSGVSEIEAFDCSSYPTRIAGEIKSFSTDGWVAPKLAKRMDKFMQYLIVAGKKALDNGGVTEDIMNELDKSRCGVLIGSGMGGMKVFSDAIEALRVSYRKMNPFCVPFATTNMGSAVLAMDLGWMGPNYSISTACATSNFCILSAANHIMRGETDLMLCGGSDAPIIPIGLGGFVACRALSQRNSDPTKASRPWDVDRDGFVMGEGAGVLLLEELEHAKQRGAEIYAEFLGGNFTCDAYHMTEPHPEGKGVILCVENALADAGVTRQDINYVNAHATSTQLGDLKEFEALRRCFGQNPQLRVNSTKSMTGHLLGAAGGIEAVAAIQAIRTGWIHPNINLNNPEKNVDVSLLVGSQKERCDVKVALSNSFGFGGHNSSILFAPF

SEQ ID NO: 20030 - DNA, 1608 bp, Ricinus communis
  CDS (1)..(1608)
atgtcggtcacgtgctcaaaggagaacagacacgcgttcttctcttcatcgacaccgggcaccaccagcagtcacagtcgtacaagaaggaggcctaaatataatagtatcagcacccctgcctctcaatctttctttaattctttatcatcttctggatcgagttttcaacaattaatgtcttcttgcttggccttcgagccttgtagtcattactacagctctaatggcctctttcctaacactcctcttcttcctaagcgccatcctagacttcatcatcgccttcctcgttctggggaagcaatggcagtggctgtgcaacctgaaaaggaggttgcaacaaataagaaacctcttatgaagcaaaggagagtagttgttactgggatgggtgttgtttcaccccttggtcatgatatagacgtctattacaataatcttcttgacggttctagtggtattagtcagattgattcctttgactgtgcccaatttcctacgaggattgctggagagatcaagtctttctcaactgatggatgggttgcaccaaaactttccaagagaatggataaattcatgctttacatgcttactgctggcaaaaaagccttggcagatggtggtattacagaggatatgatggatgaattggataaagctagatgtggagttttaattggttctgcaatgggtggcatgaaggttttcaatgatgcaattgaagcattaaggatctcgtataggaagatgaatcctttctgcgtaccttttgcgactacaaatatgggctctgccatgcttgcaatggaccttggttggatggggccaaactattcaatatctactgcttgtgctactagcaatttttgtatattgaatgccgcaaaccacatcattagaggcgaagctgatattatgctttgtggtggctcagatgcagcaattatacctattggcttgggaggttttgtggcatgcagagcgctctcacagaggaatgatgatcctacaaaagcttcacgaccttgggatatgaatcgggatggatttgtgatgggggaaggagctggtgttcttcttttagaagaactagaacatgctaagaaaagaggtgcaaatatttatgcggaatttcttggaggaagctttacatgtgatgcttatcacatgactgaaccgcgtccagatggagttggtgtcattctctgtatagaaaaggcattagcgcgatctggtgtatccaaggaggaagtaaactacataaatgcacatgctacgtctaccccagctggagaccttaaagaatatgaagctcttatgcgctgtttcagccaaaatcctgatttgagagtgaactctacgaagtctatgattggccatttactaggagcagctggtgctgtggaagctatagcaacaatacaggcgatacggacaggatgggttcatccaaacatcaacctggaaaacccagaagaaggcgtggacacaaaggtgctggttggcccaaagaaggagagattggacattaaggttgctctgtccaactcttttgggttcggtgggcacaactcatcgatcatttttgctccgtacaagtga

SEQ ID NO: 20031 - protein, 535 aa, Ricinus communis
MSVTCSKENRHAFFSSSTPGTTSSHSRTRRRPKYNSISTPASQSFFNSLSSSGSSFQQLMSSCLAFEPCSHYYSSNGLFPNTPLLPKRHPRLHHRLPRSGEAMAVAVQPEKEVATNKKPLMKQRRVVVTGMGVVSPLGHDIDVYYNNLLDGSSGISQIDSFDCAQFPTRIAGEIKSFSTDGWVAPKLSKRMDKFMLYMLTAGKKALADGGITEDMMDELDKARCGVLIGSAMGGMKVFNDAIEALRISYRKMNPFCVPFATTNMGSAMLAMDLGWMGPNYSISTACATSNFCILNAANHIIRGEADIMLCGGSDAAIIPIGLGGFVACRALSQRNDDPTKASRPWDMNRDGFVMGEGAGVLLLEELEHAKKRGANIYAEFLGGSFTCDAYHMTEPRPDGVGVILCIEKALARSGVSKEEVNYINAHATSTPAGDLKEYEALMRCFSQNPDLRVNSTKSMIGHLLGAAGAVEAIATIQAIRTGWVHPNINLENPEEGVDTKVLVGPKKERLDIKVALSNSFGFGGHNSSIIFAPYK

SEQ ID NO: 20032 - DNA, 1410 bp, Ricinus communis
  CDS (1)..(1410)
atgcaagccctgcagtccccgtctctccgaccatcccctctaaccccgctccataaaaatactcacaatgcagcaaaacgcccaactaaaaaggtctcctttatcaccgcatcatcaacaaataacaacacgacgatttcagctccaaagcgagagaaagaccccagaaaaagggtagtcataactggtacgggtttggtatctgtgtttgggaatgatgtcgatacttactacgataaattgcttgctggagaaagtgggatcggacttattgataggttcgatgcgtctaagtttcctactagatttggtggacagatcagggggtttaattcacaaggttatattgatgggaaaaatgatagaaggcttgatgattgtttgaggtattgcattgttgctggtaaaaaagctcttgagcatgctgatcttggtggtgataagttgtctaagattgataaagagcgagctggtgtgcttgttggaacagggatgggtggtcttacagtcttttcagatggtgttcaggccctaattgaaaaaggacacaggaaaattaccccattctttattccttatgctataacaaacatgggatctgccttgttagctattgaacttggtctcatgggtcctaattattcaatttcaactgcttgtgctacctccaattattgcttctatgctgctgccaatcatattcgcagaggtgaggctgaattgatgattgctggtggaactgaagccgccatcattccaatcggtttgggaggttttgtagcatgtagggccttatcacaaaggaatgatgatccacaaactgcctcaaggccatgggacaaagatcgagatggctttgttatgggtgaaggtgctggagtgttggtaatggagagtttggaacatgcaatgaaaaggggtgcaccaataattgctgagtacttgggaggtgctgttaattgtgatgcttatcacatgactgatccaagggctgatggacttggggtctcttcctgcattgagagaagtcttgaagatgccggtgtgtcacctgaggaggttaactatataaatgcacatgcaacttccactcttgctggtgaccttgctgagataaatgctattaaaaaagtattcaagaatacgtctgacatcaaaatcaatgcaaccaagtctatgataggacattgccttggtgctgctggaggtctggaagcaattgcctgtgtgaaggccattaccacaggatggttgcatcctacaattaatcaatttaacccagagccatcagttgaatttgacactgttgccaataagaagcagcagcacgaagtgaatgttgccatttcaaattcctttggattcggtggacacaactctgtggtagccttttctgcatttaaaccctga

SEQ ID NO: 20033 - protein, 469 aa, Ricinus communis
MQALQSPSLRPSPLTPLHKNTHNAAKRPTKKVSFITASSTNNNTTISAPKREKDPRKRVVITGTGLVSVFGNDVDTYYDKLLAGESGIGLIDRFDASKFPTRFGGQIRGFNSQGYIDGKNDRRLDDCLRYCIVAGKKALEHADLGGDKLSKIDKERAGVLVGTGMGGLTVFSDGVQALIEKGHRKITPFFIPYAITNMGSALLAIELGLMGPNYSISTACATSNYCFYAAANHIRRGEAELMIAGGTEAAIIPIGLGGFVACRALSQRNDDPQTASRPWDKDRDGFVMGEGAGVLVMESLEHAMKRGAPIIAEYLGGAVNCDAYHMTDPRADGLGVSSCIERSLEDAGVSPEEVNYINAHATSTLAGDLAEINAIKKVFKNTSDIKINATKSMIGHCLGAAGGLEAIACVKAITTGWLHPTINQFNPEPSVEFDTVANKKQQHEVNVAISNSFGFGGHNSVVAFSAFKP

SEQ ID NO: 20034 - DNA, 1269 bp, Pseudomonas syringae pv
  CDS (1)..(1269): transl_table=11
atgagcagaagaattgtggtgacaggcatgggcgcagtcacacccctaggggcaggggtggagttgacctggaaacgcctgctcgaaggggcttcgggcattggtacacttcctgtggagatgacgcagggattgccagtgacgattggcggccaggtgcccggcattgctgacgacccggaaggcggttttaatccggattcagtggtgggcgctaaagatcagcgtaagatggatcgatttatcgtcttcgctttggcagctgcaaatgaggccttgaatcaagccaactggtctccgcaagagcctcatgagcaggaaaggacagctaccattgtggcatctggcattggcggctttcctgcgatagctgatgcagttcgcacattggacagtaaaggccccaagcggctttcaccattcacaattccatccttcctatgcaacatggcagccggtcatatttccatcaagtttggactgaaaggaccgctcgggtcaccagttacggcgtgtgcagcgggtgtacaagcaattggagacgctgcacgcatgattttagctggcgaagtggatgtagctgtatgcggcggcgcagaagcttgcattcatcaagtcagcctcgctgggtttgctgctgcacgagcattgtcgactgggcacaatgactttcctcaaaaagcatcccgcccttttgatcaagatcgtgacggcttcgtcatgggggaaggggcaggaatacttgttatcgaggagctttcgcatgccctcgccagaggcgcaacgcctatcgccgaacttgtcggctacggtaccagcgccgatgcctatcacatgacctccggcccagaggatggcaatggcgcgttgcgttcaatgcggatggcactaaatcaggccggggtaacgccagcagagatacagcatttgaatgctcatgccacctccactccagtaggggacaagggtgagatcgctgctatcaatgctttgttcggagagcatccaagcccggccatcagcgcaacaaaatcagcgactggacatctcttaggcgcagctgggggaattgaagcaatcttcacagttctcgccctccgcgaccaggttgcacctggaacgctgaacgtggcccacctcgatccgactgcgtgtaatctcgatattgtccagggtaagtcccgaagctgcgccatggagtacgccctatcaaacggcttcggttttgggggggtgaacgcaagcgtgttgttcaaacgatgggggtga

SEQ ID NO: 20035 - protein, 422 aa, Pseudomonas syringae pv
MSRRIVVTGMGAVTPLGAGVELTWKRLLEGASGIGTLPVEMTQGLPVTIGGQVPGIADDPEGGFNPDSVVGAKDQRKMDRFIVFALAAANEALNQANWSPQEPHEQERTATIVASGIGGFPAIADAVRTLDSKGPKRLSPFTIPSFLCNMAAGHISIKFGLKGPLGSPVTACAAGVQAIGDAARMILAGEVDVAVCGGAEACIHQVSLAGFAAARALSTGHNDFPQKASRPFDQDRDGFVMGEGAGILVIEELSHALARGATPIAELVGYGTSADAYHMTSGPEDGNGALRSMRMALNQAGVTPAEIQHLNAHATSTPVGDKGEIAAINALFGEHPSPAISATKSATGHLLGAAGGIEAIFTVLALRDQVAPGTLNVAHLDPTACNLDIVQGKSRSCAMEYALSNGFGFGGVNASVLFKRWG

SEQ ID NO: 20036 - DNA, 1272 bp, Streptomyces glaucescens
  CDS (1)..(1272): transl_table=11
gtgagcccgaccaatcgcaccgtggtcgtcaccggtatcggcgcaaccacaccgctgggtggcgacgcagcctccacctgggagggcctggtcgccgggcgctccggcgtcaagcccctcgaacaggactgggccgccgaccaggcggtccggatcgccgcgccggtggccgtggagcccaccgaggtcctcccccggccgcaggcccgcaagctggaccggtcggcgcagttcgcgctggtcgccgccaaggaggcgtgggccgacgcgggcttcaccggcaaggccggcgaggactcgtccgtcgaccccgaccggctgggcgccgtcatcgcctccggcatcggcggtgtgacgaccctgctggaccagtacgacgtgctgaaggagaagggcgtccgccgcgtctccccgcacaccgtccccatgctcatgccgaacggcccgtcggccaacgtcggtctggccgtgaacgcccgtgcgggcgtccacacgccggtctccgcgtgcgcgtccggcgccgaggccatcggctacgccatcgagatgatccgcaccggccgtgccgacgtggtgatcgccggtggcaccgaggccgccatccacccgctgccgatcgccgcgttcggcaacatgatggcgatgtccaagaacaatgacgacccgcagggcgcgtcccggccgtacgacgtcgcccgggacggcttcgtcctcggcgagggcgccggcgtgatcgtcctggagtccgccgagcacgccgcacggcgcggggcccgggtgtacgccgaggcggtcgggcagggtatctccgccgacagccacgacatcgtgcagccggagccggagggccgcggcatcgcgcacgccctgcagaacctgctggagcggacggacctcgaaccggccgagatcatgcacgtcaacgcgcacgcgacgtcgacgccggccggtgacgtggccgagctgaaggcgctgcggaaggtgttcggcgacgaggccgaccacttcgcggtgtccgccaccaagtcgatgaccggtcacctgctcggcggcgccggcggtgtcgagtcggtcgcgaccgtcctcgcgctgtaccaccgggtggcgccgcccaccatcaacgtggacaacctcgaccccgaggccgaggcgaacgcggacatcgtccgcggtgaggcccgcaagctgcccgtcgagggccgtatcgcggccctgaacgactccttcgggttcggtgggcacaacgtggtgctggcgttccggacggtgtga

SEQ ID NO: 20037 - protein, 423 aa, Streptomyces glaucescens
MSPTNRTVVVTGIGATTPLGGDAASTWEGLVAGRSGVKPLEQDWAADQAVRIAAPVAVEPTEVLPRPQARKLDRSAQFALVAAKEAWADAGFTGKAGEDSSVDPDRLGAVIASGIGGVTTLLDQYDVLKEKGVRRVSPHTVPMLMPNGPSANVGLAVNARAGVHTPVSACASGAEAIGYAIEMIRTGRADVVIAGGTEAAIHPLPIAAFGNMMAMSKNNDDPQGASRPYDVARDGFVLGEGAGVIVLESAEHAARRGARVYAEAVGQGISADSHDIVQPEPEGRGIAHALQNLLERTDLEPAEIMHVNAHATSTPAGDVAELKALRKVFGDEADHFAVSATKSMTGHLLGGAGGVESVATVLALYHRVAPPTINVDNLDPEAEANADIVRGEARKLPVEGRIAALNDSFGFGGHNVVLAFRTV

SEQ ID NO: 20038 - DNA, 1269 bp, Streptomyces griseus
  CDS (1)..(1269): transl_table=11
gtggaacgccgggcagtgatcacgggaatcggtgtgtgcgcaccgggcggaaccggtgtggacagcttctgggagctgatgtgcgacggccggacggccacccgcggcatcaccctcttcgacccgtctccgtaccgctccagggtcgccgccgagatcgacttcgacccgcgggcgcacgggctgacgccgcaggagatccggcggatggaccgggccgcgcagttcggcgtggtgacggcacgggaggccttcgccgacagcgggctcgacggcgccgcgctcgatccgttccgtacgggagtcagcctcggcaccgcgatcggcgcggccggcggcctggacgcggagtaccgcgtggtcagcgacgacggccggctggagctggtcgaccaccggtacgcgaccccgcatctgtacgacctgttcgtgccgagctccttcgcgaccgaagtggcctgggccgtcggcgcggaaggaccggcgacggtggtgtccaccggctgcaccgccgggatcgacgcggtgggccacgcggtggaggcgatccgcgacggcagcgccgatgtgatggtcaccggcgcggtggacgcgccgatcaccccgctcacgatggcggccttcgacgcgatccgcgccaccacgtccctcaacgacgaggcggacaccgcctcccgccccttcgacgcgtcacgcaagggcttcgtcctcggtgagggggcggcggtgttcgtcctggaggaggcggagcacgcacggcgcagaggcgcgtacgtgtacgcggagatcgccggatacgcctcgcgcggcaacgccttccacatgaccggactgcggtccgacggagcggagctggccgccgcgatccgggcggcgctggacgaggcccggctcgacgcgtcggcggtggactacgtcaacgcgcacggttccggcacccgccagaacgaccggcacgagacggtcgcgctcaagtcggctctgggacagcacgcccaccgggtgccggtcagcgcgatcaagtcgatggtcgggcactcgctcggggcgatcggctccatcgagatcgccgcctgcgcactggccatgcggcaccacgtcatccctccgaccgccaatctgcacaccccggatcccgagtgcgatctcgactatgtcccgctgacggcccgcgcgcagcgcaccgatgccgtcctcaccatcggcagcggattcggcggcttccagagcgcgatggtgctggcccgtcccgacaggagcgccgcgtga

SEQ ID NO: 20039 - protein, 422 aa, Streptomyces griseus
MERRAVITGIGVCAPGGTGVDSFWELMCDGRTATRGITLFDPSPYRSRVAAEIDFDPRAHGLTPQEIRRMDRAAQFGVVTAREAFADSGLDGAALDPFRTGVSLGTAIGAAGGLDAEYRVVSDDGRLELVDHRYATPHLYDLFVPSSFATEVAWAVGAEGPATVVSTGCTAGIDAVGHAVEAIRDGSADVMVTGAVDAPITPLTMAAFDAIRATTSLNDEADTASRPFDASRKGFVLGEGAAVFVLEEAEHARRRGAYVYAEIAGYASRGNAFHMTGLRSDGAELAAAIRAALDEARLDASAVDYVNAHGSGTRQNDRHETVALKSALGQHAHRVPVSAIKSMVGHSLGAIGSIEIAACALAMRHHVIPPTANLHTPDPECDLDYVPLTARAQRTDAVLTIGSGFGGFQSAMVLARPDRSAA

SEQ ID NO: 20040 - DNA, 1293 bp, Streptomyces nogalater
  CDS (1)..(1293): transl_table=11
atgaaggaatccatcaaccgtcgcgtggtcatcaccggaatagggatcgtcgcgcccgatgccaccggggtgaaaccgttctgggatctgctgacggccggtcgcaccgcgacccggaccatcaccgccttcgatccctctccgttccgttcccgcatcgccgcggaatgcgatttcgacccgcttgccgaagggctgaccccccagcagatccggcgtatggaccgggccacgcagttcgcggtcgtcagcgcccgggaaagcctggaggacagcggactcgacctcggcgccctggacgcctcccgcaccggcgtggtcgtcggcagcgcggtcggctgcaccacgagcctggaagaggagtacgcggtcgtcagcgacagcggccggaactggctggtcgacgacggctacgccgtaccgcacctattcgactacttcgtgcccagctccatcgccgccgaggtggcacacgaccgcatcggcgcggagggccccgtcagcctcgtgtcgaccgggtgcacctcgggcctggacgccgtgggccgcgcggccgacctgatcgccgagggagcggcggatgtgatgctggccggtgcgaccgaggcgcccatctcccccatcaccgtggcgtgcttcgatgccatcaaggcgaccaccccccgcaacgacacgcccgccgaggcgtcccgtccgttcgaccgcaccaggaacgggttcgtactcggcgagggcgctgccgtgttcgtcctggaggagttcgaacacgcgcgccgccggggcgcgctcgtgtacgcggagatcgccgggttcgccactcgctgcaacgccttccacatgaccggtctgcgcccggacgggcgggagatggcggaggccatcggggtggcgctcgcccaggcgggcaaggcgccggctgacgtcgactacgtcaacgcccacggttccggcacccggcagaatgaccgtcacgagacggcggccttcaagcgcagtctcggcgaccacgcctaccgggtcccggtcagcagcatcaaatccatgatcgggcactcgctgggcgcgatcggctccctggagatcgccgcctccgtgctggccatcacacacgacgtggtgccgcccaccgccaatctgcacgagccggatcccgagtgcgatctggactacgtgccgctgcgggcgcgtgcgtgcccggtggacacggtgctcacggtgggcagcgggttcggcggtttccagagcgccatggtgctgtgcggtccgggctcgcggggaaggtcggccgcgtga

SEQ ID NO: 20041 - protein, 430 aa, Streptomyces nogalater
MKESINRRVVITGIGIVAPDATGVKPFWDLLTAGRTATRTITAFDPSPFRSRIAAECDFDPLAEGLTPQQIRRMDRATQFAVVSARESLEDSGLDLGALDASRTGVVVGSAVGCTTSLEEEYAVVSDSGRNWLVDDGYAVPHLFDYFVPSSIAAEVAHDRIGAEGPVSLVSTGCTSGLDAVGRAADLIAEGAADVMLAGATEAPISPITVACFDAIKATTPRNDTPAEASRPFDRTRNGFVLGEGAAVFVLEEFEHARRRGALVYAEIAGFATRCNAFHMTGLRPDGREMAEAIGVALAQAGKAPADVDYVNAHGSGTRQNDRHETAAFKRSLGDHAYRVPVSSIKSMIGHSLGAIGSLEIAASVLAITHDVVPPTANLHEPDPECDLDYVPLRARACPVDTVLTVGSGFGGFQSAMVLCGPGSRGRSAA

SEQ ID NO: 20042 - DNA, 1260 bp, Streptomyces peucetius
  CDS (1)..(1260): transl_table=11
gtgaaccggcggatcgtcatcaccgggatcggcgtggtggctcccggcgccgtcgggaccaagccgttctgggagctgctgctgtccggaaccaccgccacccgcgccatcagcactttcgacgccacgcccttccgttcccgtatcgccgccgagtgcgacttcgatccggtggcggcggggctgtccgcggagcaggcccggcgcctcgaccgggccgggcagttcgcgctggtcgccggtcaggaggcgctcgccgacagcgggctgcgaatcgatgaggactccgcgcaccgggtcggggtgtgcgtgggcaccgccgtcggctgcacgcagaaactggagtccgagtacgtcgctctcagcgcgggcggagcgcactgggtcgtggaccccggccgggggtcgcccgagctgtacgactacttcgtgccgagttccctcgccgccgaagtggcctggctcgccggggcggaggggcccgtgaacatcgtctcggccgggtgcacctcggggatcgactccatcgggtacgcctgcgagctcatccgcgaggggacggtggacgccatggtcgcgggaggcgtggacgcacccatcgcgccgatcacggtggcctgcttcgacgccatcagggcgacctccgaccacaacgacacccccgagaccgcctcgcgtcccttcagccgcagccgcaacggctttgtgctgggcgagggcggtgcgatcgtggtcctggaagaggcggaggcggccgtgcgcaggggcgcgcggatctacgccgagatcggcgggtacgcctcacgcggcaacgcgtaccacatgaccgggctgcgcgcagacggcgccgagatggcggcggcgatcaccgcggccctcgacgaggcccgccgcgacccctcggacgtggactacgtcaacgcccacggaacggcgacgaagcagaacgaccggcacgagacctccgcgttcaagcgctccctgggggagcacgcgtaccgggtgcccatcagctccatcaagtcgatgatcggtcactccctgggcgctgtcggctcgctcgaagtggcggcgaccgcactggccgtggagtacggggtgatcccgccgaccgcgaatctgcacgacccggatccggaactcgacctggactacgtgccgctgacggcacgagaaaagcgggtgcggcacgcgctgacggtgggcagcggcttcggcggcttccagagcgccatgctgctgagccgtctcgagaggtga

SEQ ID NO: 20043 - protein, 419 aa, Streptomyces peucetius
MNRRIVITGIGVVAPGAVGTKPFWELLLSGTTATRAISTFDATPFRSRIAAECDFDPVAAGLSAEQARRLDRAGQFALVAGQEALADSGLRIDEDSAHRVGVCVGTAVGCTQKLESEYVALSAGGAHWVVDPGRGSPELYDYFVPSSLAAEVAWLAGAEGPVNIVSAGCTSGIDSIGYACELIREGTVDAMVAGGVDAPIAPITVACFDAIRATSDHNDTPETASRPFSRSRNGFVLGEGGAIVVLEEAEAAVRRGARIYAEIGGYASRGNAYHMTGLRADGAEMAAAITAALDEARRDPSDVDYVNAHGTATKQNDRHETSAFKRSLGEHAYRVPISSIKSMIGHSLGAVGSLEVAATALAVEYGVIPPTANLHDPDPELDLDYVPLTAREKRVRHALTVGSGFGGFQSAMLLSRLER

SEQ ID NO: 20044 - DNA, 1278 bp, Streptomyces roseofulvus
  CDS (1)..(1278): transl_table=11
gtgaaccgacaagtcgccgtcaccggcatcggcgtggtggctccgggagggatcgggcgcaagccgtactgggagcagctcacctccggacgcaccgccacgcgcgccatctccttcttcgacgcctcgcccttccgctcgcggatcgccgccgaggtcgacttcgaccccgcggcggcgggcctgagcccgcgcgaggtccgccgcatggaccgggccgcgcagttcgccgtcgtgagcgccagggagagcctcgccgacagcggactcgacgtcgccgacctcgacccccaccggatcggggtgagcatcggcagcgccgtgggcgggaccacctcgctggaacccgagtacctcgccctcagcgacagcgggcgacagtgggaactcgacctctcctacctctcgccgcacctctacgacgccttcacccccagctcgctcgcccgcgaggtggccggggtgatcggcgcggaggggcccgcggcagtcgtctccaccggctgcacctccggcatcgactcgctcggccacgcccgcgacctcatcgccgagggcagcgccgacgtcgtgctcgcgggcggcaccgacacccccatctcgccgatcgccgtcgcctgcttcgacgccatcaaggccacctcgcccagcaacgacgacccggcgcacgcctcgcgccccttcgacagggaacgcaacggcttcgtcctcgcggagggcgccgccgtcctcgtgctggaggagctggggcacgcgcgggcccgcgacgcccacgtctacgctctcgtgtccggctacgccacgcgctgcaacgcgtaccacatgaccgggctcaccccgcacggcagggagatggccgaggcgatccggcacgcgctcgccgagagcgggaccgaccccgccgccgtggactacgtcaacgcccacggctccggcaccaagcagaacgaccggcacgagaccgccgccttcaaggccacgctcggcgagcgggccaggagcgtgccggtcagctccatcaagtcgatgatcggccactcgctcggtgccatcggttcgctggagatcgcggcctgggcgctcgccatggagtacggcgtggtgccgcccaccgccaacctcgacacgcccgaccccgagtgcgacctcgactacgtgccccacgaggcgcgcgagacgcgggtggacagggtcctgagcgtcggcagcggcttcggcggtttccagagcgccatggtcctcacccgggacacgggcgcccgcctcccgacggcctga

SEQ ID NO: 20045 - protein, 425 aa, Streptomyces roseofulvus
MNRQVAVTGIGVVAPGGIGRKPYWEQLTSGRTATRAISFFDASPFRSRIAAEVDFDPAAAGLSPREVRRMDRAAQFAVVSARESLADSGLDVADLDPHRIGVSIGSAVGGTTSLEPEYLALSDSGRQWELDLSYLSPHLYDAFTPSSLAREVAGVIGAEGPAAVVSTGCTSGIDSLGHARDLIAEGSADVVLAGGTDTPISPIAVACFDAIKATSPSNDDPAHASRPFDRERNGFVLAEGAAVLVLEELGHARARDAHVYALVSGYATRCNAYHMTGLTPHGREMAEAIRHALAESGTDPAAVDYVNAHGSGTKQNDRHETAAFKATLGERARSVPVSSIKSMIGHSLGAIGSLEIAAWALAMEYGVVPPTANLDTPDPECDLDYVPHEARETRVDRVLSVGSGFGGFQSAMVLTRDTGARLPTA

SEQ ID NO: 20046 - DNA, 1467 bp, Glycine max
  CDS (1)..(1467)
atggcttcgaccaccacctcctccctctgcacgtggctcgttgctgcttgcatgtcagtcacgtgccacgccgaccgcaccaaaacccctcacgcaatgttccgctcctccaaaaagtctcgctactctcaattcaacgtttgtcgatccactcattctggtaaaacaatggctgtagctttgcaacctacccaagagatcacgacaataaaaaaacctcccacgaagcaaaggcgagtggttgtgacaggattgggtgtggttacaccacttgggcatgagccagatatcttctacaataatttgcttgatggtgctagtggcataagcgagattgaaacatttgattgtgcagaatatccaacaaggattgctggtgaaatcaagtctttctcaactgatggctgggtagcaccaaaactttctaagagaatggataaatttatgctctatatgctgacagctggcaaaaaagccttggttgatggtggaattactgatgatgtaatggatgagttaaataaagaaaagtgtggagttctgattgggtcagcaatgggtggcatgaaggttttcaatgatgccatcgaagctttacgaatctcatataagaagatgaatcctttttgtgtaccttttgcaacaacaaatatgggttctgccatgcttgcaatggatctgggatggatgggccctaattattctatctctacagcttgtgctacaagtaacttttgtatattgaatgcagcaaaccatatcattagaggtgaagctgatgtgatgctttgtggaggctcagatgctgctattataccaattggtttgggaggctttgtggcatgcagggcactctcacaaaggaatactgatcctaccaaagcttcacgcccttgggacattaaccgtgatggatttgtcatgggtgaaggggctggagttttgcttttagaggaactggagcatgctaaggaaagaggtgcaaccatatatgctgaattccttggtggaagtttcacctgtgatgcatatcatgtgactgagccgcgtcctgatggggctggtgttatactgtgcattgaaaaggcattagctcagtctggagtatcaaaagaggatgtgaattacataaatgcacatgccacatccacaccagctggagatcttaaggagtaccaagctctaatgcattgttttggtcaaaaccccgagttaagagtgaattctacaaaatctatgattggtcatctactaggggcagctggcggtgtggaagctgtggccacaatacaggcaattaggacagggtgggttcatcccaatatcaacctagaaaacccagataacggagtggatgctaaagtgcttgttggctcaaagaaagagagactggatgtcaaggcagccttgtcgaattcatttggttttgggggtcacaattcttcaatcatatttgcaccatactag

SEQ ID NO: 20047 - protein, 488 aa, Glycine max
MASTTTSSLCTWLVAACMSVTCHADRTKTPHAMFRSSKKSRYSQFNVCRSTHSGKTMAVALQPTQEITTIKKPPTKQRRVVVTGLGVVTPLGHEPDIFYNNLLDGASGISEIETFDCAEYPTRIAGEIKSFSTDGWVAPKLSKRMDKFMLYMLTAGKKALVDGGITDDVMDELNKEKCGVLIGSAMGGMKVFNDAIEALRISYKKMNPFCVPFATTNMGSAMLAMDLGWMGPNYSISTACATSNFCILNAANHIIRGEADVMLCGGSDAAIIPIGLGGFVACRALSQRNTDPTKASRPWDINRDGFVMGEGAGVLLLEELEHAKERGATIYAEFLGGSFTCDAYHVTEPRPDGAGVILCIEKALAQSGVSKEDVNYINAHATSTPAGDLKEYQALMHCFGQNPELRVNSTKSMIGHLLGAAGGVEAVATIQAIRTGWVHPNINLENPDNGVDAKVLVGSKKERLDVKAALSNSFGFGGHNSSIIFAPY

SEQ ID NO: 20048 - DNA, 1470 bp, Glycine max
  CDS (1)..(1470)
atggcttcgaccaccacctcctccctctgcacgtggctcgtcgctgcttgcatgtcagtcacgtgcgacgccgaccgcaccagaacccctcacgcaatcttccgctcctccaaaaagtctcgcaagtctcaattcaacgtctctcgatccactcattctggtaaaacaatggctgtagctttgcaacctacccaagaggtcacaacaataaaaaaacctcctacaaagcaaaggcgagtagttgtgacaggattgggtgtggttacaccacttgggcatgagccagatatcttctacaataatttgcttgatggtgttagtggcataagtgagattgaaacatttgactgtgcagaatatccaacaaggattgctggtgaaatcaagtctttctcaactgatggctgggtagcaccaaaactttctaagagaatggataaatttatgctctatatgctgacagctggcaaaaaagccttggttgatggtggaattactgatgatgtaatggatgagttaaataaagataagtgtggagttctgattggctcagcaatgggtggcatgaaggttttcaatgatgccattgaagctttacgaatctcatataagaagatgaatcctttttgtgtaccttttgcaacaacaaatatgggttctgccatgcttgcaatggatctgggatggatgggccctaattattctatctctacagcttgtgctacaagtaacttttgtatattgaatgcagcaaaccatatcattagaggtgaagctgatgtgatgctttgtggtggctcagatgctgctattataccaattggtttgggaggctttgtggcatgcagggcactctcacaaaggaatactgatcctaccaaagcttcacgcccttgggacattaaccgtgatggatttgtcatgggagaaggggctggagttttgcttttagaagaactggagcatgctaagaaaagaggtgcaaccatatatgctgaattccttggtggaagtttcacctgtgatgcatatcatgtgactgagccgcgtcctgatggggctggtgttattctttgcattgaaaaggcattagctcagtctggagtatcaaaagaggatgtgaattacataaatgcacatgccacatccacaccagctggagatcttaaggagtaccaagctctaatgcattgttttggtcaaaaccccaagttacgagtgaattctacaaaatctatgattggtcatctactaggggcagctggcgctgtggaagctgtggccacaatacaggcaattaggacagggtgggttcatcccaatatcaacctagaaaagccagataatggagtggatgctaaagtgcttgttggctcaaagaaagagagactggatgtcaaggcagccttgtcgaattcatttggttttgggggtcacaattcttcaatcatatttgcaccttacaagtga

SEQ ID NO: 20049 - protein, 489 aa, Glycine max
MASTTTSSLCTWLVAACMSVTCDADRTRTPHAIFRSSKKSRKSQFNVSRSTHSGKTMAVALQPTQEVTTIKKPPTKQRRVVVTGLGVVTPLGHEPDIFYNNLLDGVSGISEIETFDCAEYPTRIAGEIKSFSTDGWVAPKLSKRMDKFMLYMLTAGKKALVDGGITDDVMDELNKDKCGVLIGSAMGGMKVFNDAIEALRISYKKMNPFCVPFATTNMGSAMLAMDLGWMGPNYSISTACATSNFCILNAANHIIRGEADVMLCGGSDAAIIPIGLGGFVACRALSQRNTDPTKASRPWDINRDGFVMGEGAGVLLLEELEHAKKRGATIYAEFLGGSFTCDAYHVTEPRPDGAGVILCIEKALAQSGVSKEDVNYINAHATSTPAGDLKEYQALMHCFGQNPKLRVNSTKSMIGHLLGAAGAVEAVATIQAIRTGWVHPNINLEKPDNGVDAKVLVGSKKERLDVKAALSNSFGFGGHNSSIIFAPYK

SEQ ID NO: 20050 - DNA, 1299 bp, Streptomyces spiramyceticus
  CDS (1)..(1299): transl_table=11
atgtcagcgacggactcagctgtgggcgcccagcgccgggtggtcatcaccggcataggtgtcgtggcgcccggaggcacgggcaccaaagcgttctgggacctcatcacgtcgggtcgcaccgcgaccggacgcatctcctacttcgaccccgcgccgttccgctcccaggtggcggccgagtgcaccttcgaccccgccctccagggcctgacgccccgcgagatccggcgcatggaccgggcggcccagttcgcggtcgtatcggcccgggaagcggtgcaggacagcggcctcgacttcggcagccccgacccggcacgcatcggagtgaccatcggcagcgcggtcggcgccacgatgggcctcgaagaggagtacgtcgtcctgagcgacagcggacgcaagtggctcgtcgacaactcctacggagtgccgcatctgtacggacacttcgtgcccagcagcatggccgccgaggtcgcctgggccgtcggcgccgaaggccccgccgccgtcgtctcggccggctgcacctccggcatcgactcggtcggctacgcccgggaactcatcgccgagggcagcgtggacatcatggtcgccggcgccaccgacgccccgatctcacccatcgcggtcgcctgcttcgacgccatcaaggcgaccaccccgcgcaacgaggacgcggaacacgcctcccggccgttcgacaagagccgcaacggcttcgtactcggcgaagggtccgccgtcttcgtcctggaggaatacgggcacgcacgccggcgcggcgcccacatctacgccgagatcgccgggttcgggtcccgctgcaacgccttccacatgaccggactgcgcccggacggccgcgagatggccgtcgccatcgacaccgccctggccgaggcccggatgaacgccgaggaggtgtcgtacatcaacgcgcacggctccgggaccaagcagaacgaccggcacgagaccgccgccttcaagcgcagcctcgggcaccacgcgtacgacgtgccggtcagctcgatcaagtcgatggtcggccactccctcggagcgatcggctccatcgagatcgcggcctgtgcgctggccatcgaacacggtgtggtgccgcccaccgccaacctgcacacgcccgaccctgagtgcgacctggactacgtacccctggtggcccgcgaacagcgcgtggacaccgccctcacagtcggcagcggcttcggcggattccagagcgccatggtgctgacccgtcccgaggagaggaccggggcatga

SEQ ID NO: 20051 - protein, 432 aa, Streptomyces spiramyceticus
MSATDSAVGAQRRVVITGIGVVAPGGTGTKAFWDLITSGRTATGRISYFDPAPFRSQVAAECTFDPALQGLTPREIRRMDRAAQFAVVSAREAVQDSGLDFGSPDPARIGVTIGSAVGATMGLEEEYVVLSDSGRKWLVDNSYGVPHLYGHFVPSSMAAEVAWAVGAEGPAAVVSAGCTSGIDSVGYARELIAEGSVDIMVAGATDAPISPIAVACFDAIKATTPRNEDAEHASRPFDKSRNGFVLGEGSAVFVLEEYGHARRRGAHIYAEIAGFGSRCNAFHMTGLRPDGREMAVAIDTALAEARMNAEEVSYINAHGSGTKQNDRHETAAFKRSLGHHAYDVPVSSIKSMVGHSLGAIGSIEIAACALAIEHGVVPPTANLHTPDPECDLDYVPLVAREQRVDTALTVGSGFGGFQSAMVLTRPEERTGA

SEQ ID NO: 20052 - DNA, 1218 bp, Saccharopolyspora erythraea
  CDS (1)..(1218): transl_table=11
gtgaccggcatgggcgtggtcagcccgctgggggtcggcaccgagcagttccacgccaaccagcagctcggccgcagcgccgtccggcgcgtcaccgcctacgacccgggcgacgacccggtgcgcatcgcggccgaggtggacctgcccgagcagttccagttcacccggcgcgaccagctgcgcaccgaccggtgcacgcagctggcgatcgtcgccgcccggctgggcgtcgaggaggccaagctcgacctcgccgcgtccgacacctcgcgcatcggcgtggtcatcggctccggcatgggcggcgtggggacctgggagcgcaactgcctggccctgcacgagtcgggggtgcgggcgatgcgcaccaagaccgtcccgatgtcgatgatcaacgacccgtcggcgtccatcgcgatccgctacggcaccaccggcccctgcacgacggtcaccaccgcctgcgcctcgggcgccgacgcactggtggcggcggcgcagatgatccgcctcggcgaggccgacgtggtgctggcgggcggcgccgaggcgccgctgtcgcgcagcgtcctggccggcttcgcgcgcctcggcgcgctgtcggaggacaacgacgcgcccgagagcgcgtgccgtccgttcagcgccgaccggacgggcttcgtcatgggcgaaggcgcggccgtgctggtcctggagtccgccgagcacgccaccgcgcgcggcgcgcaggtgcgggcgcggatggccggctacgggcgctccgccgacgcctaccacgtgacgatgccgcaccccgaggccgccggcgcgcgggccgccatcgtcgcggcgctgcgcgacgccggtgcccagccgtccgacgtcgacttcgtcaacgcccacggcaccggcaccgccctcaacgaccacgccgaagccctcgccatgcgcgcggtgttcggcaccggcgtggagcggatcccggtcaccgcgaccaagtcgctcaccgggcactcgctcggcgcggcgggggcggtcgaggccgtggccaccgtgcaggcggtgtccagcggggtcatcccgcccacggccaacctccgggtgcccgatcccgagctcggcatcgacgtggtccacggcgggccgcgcgaggcgcgcatcaacctggcgctgtcgaactcgttcgccttcggcgggcacaacgtcgtgctcgccttcgccccacccctgtag

SEQ ID NO: 20053 - protein, 405 aa, Saccharopolyspora erythraea
MTGMGVVSPLGVGTEQFHANQQLGRSAVRRVTAYDPGDDPVRIAAEVDLPEQFQFTRRDQLRTDRCTQLAIVAARLGVEEAKLDLAASDTSRIGVVIGSGMGGVGTWERNCLALHESGVRAMRTKTVPMSMINDPSASIAIRYGTTGPCTTVTTACASGADALVAAAQMIRLGEADVVLAGGAEAPLSRSVLAGFARLGALSEDNDAPESACRPFSADRTGFVMGEGAAVLVLESAEHATARGAQVRARMAGYGRSADAYHVTMPHPEAAGARAAIVAALRDAGAQPSDVDFVNAHGTGTALNDHAEALAMRAVFGTGVERIPVTATKSLTGHSLGAAGAVEAVATVQAVSSGVIPPTANLRVPDPELGIDVVHGGPREARINLALSNSFAFGGHNVVLAFAPPL

SEQ ID NO: 20054 - DNA, 1269 bp, Streptomyces griseoruber
  CDS (1)..(1269): transl_table=11
atggtccgagacacgccccgcagggcagtgatcaccggcatcggcgtgaccgcaccggggggcatcggggccgacgcgttctggcagcgactggtcagcggcaggcccgcgacccggacgatcagccggttcgacgcgagcggccatcggtgccgggtcgccgccgagtgcgacttcgacccgctggagcagggtctgacccgccagcaggcgcggcggaccgaccgcgtggtgcagctcgccctggccgccgcgcgggaggcgctggaggacagcggcctgaccgtcgacggcgagcgcaccggagtggcgctgggcagcgcggtcggcggaacgaccaccatggagcaggagtacgccgtgcagtccgccgagggccgcgactggctggtcgacccctcgtacgccgtaccgcacctgtacgactacttcgtgcccacctcgctggccgccgaggtggcgctgctgaccggggcgctgggcccggcctcggtgatctcgaccgggtgcacgtcgggcatcgactccgtcggctacgccgccgagatgatccgggagggaaccgccgacgtcatggtcaccggcgcctccgacgcgcccatctcaccgatcaccctgacctgcttcgacgtcatcaaggccacctccgcccgcaacgacgacccggagacggcctgccgccccttcgaccgcacccgcaccgggctggtgctgggcgagggcgcgagcgtgctggtactggaggagtacgagcacgccaagcggcgcggcgcccgcatctacggggagatcgccggctacgcctcccggtgcaacgcctaccacatgaccggtctgaaggcggacggtctggagatgtccgaggcgatcgacgcggcgctcgacgaggcccggctgaacccggtggacatcgactacgtcaacgcccacggctccggcacccggcagaacgaccggcacgagaccgccgcggtcaagcgcagcctgggcgagcacgcctaccgcacgccgatgagcggcatcaaggcgatcgtggggcactcgctcggcgcgatcggctcgatcgagatcgcggcgtgcgcgctgtccctgcggcacggggtggtggtgcccacggccaatctcgacgagcccgaccccgagtgcgacctggactacgtcccgcacaccgcgcgggagcggcgactggacgcggtgctcacggtgggcagcggtttcggcgggttccagagcgccatggtgctgacggctccgggacggcccgcatga

SEQ ID NO: 20055 - protein, 422 aa, Streptomyces griseoruber
MVRDTPRRAVITGIGVTAPGGIGADAFWQRLVSGRPATRTISRFDASGHRCRVAAECDFDPLEQGLTRQQARRTDRVVQLALAAAREALEDSGLTVDGERTGVALGSAVGGTTTMEQEYAVQSAEGRDWLVDPSYAVPHLYDYFVPTSLAAEVALLTGALGPASVISTGCTSGIDSVGYAAEMIREGTADVMVTGASDAPISPITLTCFDVIKATSARNDDPETACRPFDRTRTGLVLGEGASVLVLEEYEHAKRRGARIYGEIAGYASRCNAYHMTGLKADGLEMSEAIDAALDEARLNPVDIDYVNAHGSGTRQNDRHETAAVKRSLGEHAYRTPMSGIKAIVGHSLGAIGSIEIAACALSLRHGVVVPTANLDEPDPECDLDYVPHTARERRLDAVLTVGSGFGGFQSAMVLTAPGRPA

SEQ ID NO: 20056 - DNA, 1398 bp, Oryza sativa
  CDS (1)..(1398)
atgcagagcctcctcctccccaccttcgccgcggcctccgccgcccccccgcggagggggcgcgtgcctcccgccggtcgcgcctcggtctccgtgcgcgcgtccgcgtccgcggcggcggtggcgccgaggagggagacggatccgaggaagagggtggtgatcacggggatggggctggtgtccgtgttcgggaacgacgtcgacgcctactacgaccgcctcctcgccggggagagcgggattggccccatcgaccgcttcgacgcctccaacttccccacccgcttcgccggccagatccggggcttctcctccgagggctacatcgacggcaagaacgaccgccgcctcgacgactgcctccgctactgcatcgtcagcggcaagaaggccctcgagtccgccggcctcgccctcggctccaaatccatggacaagattgaaaagactcgggctggtgtacttgtgggcaccggtatgggtggtcttacagtgttctctgatggtgttcagaatcttattgagaaggggcacagaaagataactccattcttcattccgtatgccataacaaacatgggatctgcccttcttggaatggacattggtttcatgggtccaaactactccatctcaactgcatgtgctacctcgaactactgtttctatgctgcagcaaaccatattcgcagaggcgaagccgatgtgatgattgctggtggcactgaagccgcaattattccgattggtgtcggtgggtttgtcgcgtgtagagcactttcacagaggaacgatgaccccaaaacagcatcaagaccttgggaccaagaccgtgatggttttgtcatgggtgaaggagctggagtactggtcatggagagcctagaacatgcaatgaagcgtgacgcaccaataattgcggagtatttaggaggtgccgtgaactgtgatgcttaccatatgactgacccgagatctgatggccttggtgtttcgtcttgcattaagcaaagtcttgcagatgctggcgttgcaccggaggaggtcaactacataaatgctcatgcaacgtccaccctagctggtgatctggcagaggtgaacgccattaggcaagtcttcaaggatccatcagagattaaaataaatgcaaccaagtccatgattggacattgccttggtgcggctggtggcttggaagccattgcaactgttaaagctataaccactggatgggtccatccaagcataaaccagtttaacccggagccagctgttgaatttgacacggtacctaatgtaaaaaagcaacatgaagtgaatgttggtatctcgaattcctttggatttggtggacacaattcagttgtagtatttgcaccatttaagccttaa

SEQ ID NO: 20057 - protein, 465 aa, Oryza sativa
MQSLLLPTFAAASAAPPRRGRVPPAGRASVSVRASASAAAVAPRRETDPRKRVVITGMGLVSVFGNDVDAYYDRLLAGESGIGPIDRFDASNFPTRFAGQIRGFSSEGYIDGKNDRRLDDCLRYCIVSGKKALESAGLALGSKSMDKIEKTRAGVLVGTGMGGLTVFSDGVQNLIEKGHRKITPFFIPYAITNMGSALLGMDIGFMGPNYSISTACATSNYCFYAAANHIRRGEADVMIAGGTEAAIIPIGVGGFVACRALSQRNDDPKTASRPWDQDRDGFVMGEGAGVLVMESLEHAMKRDAPIIAEYLGGAVNCDAYHMTDPRSDGLGVSSCIKQSLADAGVAPEEVNYINAHATSTLAGDLAEVNAIRQVFKDPSEIKINATKSMIGHCLGAAGGLEAIATVKAITTGWVHPSINQFNPEPAVEFDTVPNVKKQHEVNVGISNSFGFGGHNSVVVFAPFKP

SEQ ID NO: 20058 - DNA, 1254 bp, Treponema hyodysenteriae
  CDS (1)..(1254): transl_table=11
atgagtgaacgtagagttgtaattacggggcttggaatagtaagttcgctaggaaatgatgtaaaaacattttgggataatttgcttaatggtgtttcaggtatcaaaacattaagtaaatatttcgatcctgaaaaagagcagcttattaccaaaatcggtgctgaagctttaccagttgagggcgactattattctgataaaaaaatgttaagaagattagacccttttattaattttggaatatatgccgctcatcatgcatttaagcaggctggtatagaaccgaaaacaggctttgatcctttaagagccggttgtgttcttggtagcggtattggcggtatgactactcttttatctaaccatcaagttttacttaatgacggacctggcagagtatcacctttctttgtacctatgcaaataatcaatatgacacctggtttaatatctatggaatatggtatgaacggacctaactacagtacagttactgcatgtgcttcttcaaaccactctataggtttaggttataaacatattaaagataatgaagctgatattatggtagttggaggttctgaagctactataaatcctcttactatagctggtttcaataatgctagagctttatctactagaaatgatgatcctgctaaagcatcaagaccttttgataaaggaagagacggatttgttatagctgaaggtgctggtatattaatacttgaagagtatgaacatgctaagaaaagaaatgctaatatacttgctgaagtttgcggttatggatttactgcagatgctaatcatatcactgcacctttagaggatggtgctatgggagcaagagctatgtctttagctattgaaagtgctaagatttcacctgataaaatcagctatgttaatactcatggtacttctactcctgttggagatattgctgaaatcaaagctattaaaaaggctttaggcgaagatcatgctaaaaaaataaaaattaattcaacaaaatctatgacaggacatgctttaggagctgcaggcggtatagaagctattgccactattatgagtatgattgaaggtaaagttcaccctactatcaatgtagaagaacaagatcctcaatgtgatttagatgttgttgctaacactgctcaggattataaaatagaatatgctataagcaattcttttggattcggcggtcataatgcttctatagtattcaaaagaatataa

SEQ ID NO: 20059 - protein, 417 aa, Treponema hyodysenteriae
MSERRVVITGLGIVSSLGNDVKTFWDNLLNGVSGIKTLSKYFDPEKEQLITKIGAEALPVEGDYYSDKKMLRRLDPFINFGIYAAHHAFKQAGIEPKTGFDPLRAGCVLGSGIGGMTTLLSNHQVLLNDGPGRVSPFFVPMQIINMTPGLISMEYGMNGPNYSTVTACASSNHSIGLGYKHIKDNEADIMVVGGSEATINPLTIAGFNNARALSTRNDDPAKASRPFDKGRDGFVIAEGAGILILEEYEHAKKRNANILAEVCGYGFTADANHITAPLEDGAMGARAMSLAIESAKISPDKISYVNTHGTSTPVGDIAEIKAIKKALGEDHAKKIKINSTKSMTGHALGAAGGIEAIATIMSMIEGKVHPTINVEEQDPQCDLDVVANTAQDYKIEYAISNSFGFGGHNASIVFKRI

SEQ ID NO: 20060 - DNA, 1269 bp, Rhizobium sp
  CDS (1)..(1269): transl_table=11
atgcgtcgtgtcgtcgtaacaggaatgggagcggtcagtccgctcggtgccaacgtcagcagcacttggagccgcctgctcgcgggcaagtctggcatccaccgtcttcctgacgaggtcgtcggcgatctgcccgccaaggtcggaggcgttgtccccttcctggaagaggatgccgaagctggcttcgatccggacagggtcttgccgccgaaggatcagcgcaaggtcgaccgattcatcctcttcgcaatggcggcggcagacgaagcccttgcgcaagcccggtggagacctgtctcggaagaggaccgcctcagaacggcgacgatcatagcctccgggatcggaggctttccagcgatcacggatgcggtgcgcaccgtcgatcagaaagggccgcggcgcctttcacccttcaccattccatcgttcctggtgaacctcgcggcaggccaggtatccatccgacatggtctcaagggaccgctgggagctcctgtgacagcatgtgcggccggcgtccaggcaatcggtgacgcggcccggatgatccgggcgaacgaggctgacattgccgtctgtggcggcacggaagcgtgcatgaacaccgtaagcctcgggggcttcgccgccgcccgggctctttcaaccgggttcaatgaaagccctgccctcgcgtccagaccattcgacatgatgcgtgacggtttcgtaatgggtgaaggcgcgggagtcttggtgctcgaatccctgagccatgcgctggctcgcggggccgagccgctggctgaactggtgggctatggaacaacggcggatgcctatcatgttacctccggtcccgaggacggatccggcgccgcaagagcgatgcaaattgccatcgggcaggcaggtatttccccgcatgagatccaacatctcaacgctcacgccacatcgaccccgctcggcgatcgcggagaaatcggggctatcaagacagtgttcggttcgacagcagggatcgcagtcagtggcacgaagtccgcaaccgggcacctccttggcgccgcgggtgggctggaggcaatcttcacgatcctggcactcagggatcaggtcgcaccgcccacgctgaacctgaatgcgcccgatcccgctggcgacggaatcgacttcgtcgcgagcaagtcccggccactacagatggactatgcaatcaccaacggatttgggttcggaggcgtgaatgcgagtgccctgttccggcgttggagcgaatga

SEQ ID NO: 20061 - protein, 422 aa, Rhizobium sp
MRRVVVTGMGAVSPLGANVSSTWSRLLAGKSGIHRLPDEVVGDLPAKVGGVVPFLEEDAEAGFDPDRVLPPKDQRKVDRFILFAMAAADEALAQARWRPVSEEDRLRTATIIASGIGGFPAITDAVRTVDQKGPRRLSPFTIPSFLVNLAAGQVSIRHGLKGPLGAPVTACAAGVQAIGDAARMIRANEADIAVCGGTEACMNTVSLGGFAAARALSTGFNESPALASRPFDMMRDGFVMGEGAGVLVLESLSHALARGAEPLAELVGYGTTADAYHVTSGPEDGSGAARAMQIAIGQAGISPHEIQHLNAHATSTPLGDRGEIGAIKTVFGSTAGIAVSGTKSATGHLLGAAGGLEAIFTILALRDQVAPPTLNLNAPDPAGDGIDFVASKSRPLQMDYAITNGFGFGGVNASALFRRWSE

SEQ ID NO: 20062 - DNA, 1305 bp, Plasmodium yoelii yoelii
  CDS (1)..(1305)
atgaaaatttctttaaatttcctctttttctgctttttggttcaccaaacttccagagttgtatgcacaggtgttggtgttgtaaatggagttggaattggaataaatcaattttgggagaacatacttaatggctataattcgattgacaaagtaaccaaatttgatgtaacaggaatgtcatgcggaatagctagcacaatagataaaaaaaattttaacccacctgattattatacaaataaaaaggatgcaaatcgtaatgacgattgtacccattatgctatagctgcaactagattagcaatagatgatgctaaaatagatttaaacaaaattgatagtaataaaattggaacaattattggaagtggtattggtggattagattttttagaaagagaaatgaaaataatgtatgaaaagggtcataaaagggtaagtccatatttaatacccgcaatgattgcaaatacaccatcagggcttgtatctattgaaaataatttaagaggaatttctattggtatgctaagtgcatgtgcaacatcaggaaatactattggtgaggcatatcgatatataaaatataaagaatatgacgttatgatatgtggaggaactgaagctagtgttactccgattagttttgctggatttaatgcattaagagcaatggctgttggatataatgataatcctaaaaaggcttgtagaccttttgatttaaaaagaagtggatttgttatgggtgaaggatcaggtgttttaatactagaatcatatgaacatgcaataaaaagaaatgcaaaaatttatggagaaattttagcatattcttcggaaagtgatgcatttcatataacatcccctgaacctaatggtttaggattaacaaattctataaataaggtaataaaaaatgccaacataagtggatccgatattaaatatataaatgcccatggaacatcaactaaattaaatgatcaaatagaaacaaaagtttttaagaatgtttttaaagatcatgcatacaagttacatatatcatcaacgaaaagtatgacaggtcattgtataggagcagcaggagcgattgaatctattatatgcttaaaaactatgcaaacaaatattatacctccaacaattaattatgaacataaagatgatgagtgtgatctaaattatacacctaataaatgtatatcctcaaaacaaaatattgatttttcattaaatactaatttagggtttgggggacataatacagcactattattcaaaaaaattacaaaataa

SEQ ID NO: 20063 - protein, 434 aa, Plasmodium yoelii yoelii
MKISLNFLFFCFLVHQTSRVVCTGVGVVNGVGIGINQFWENILNGYNSIDKVTKFDVTGMSCGIASTIDKKNFNPPDYYTNKKDANRNDDCTHYAIAATRLAIDDAKIDLNKIDSNKIGTIIGSGIGGLDFLEREMKIMYEKGHKRVSPYLIPAMIANTPSGLVSIENNLRGISIGMLSACATSGNTIGEAYRYIKYKEYDVMICGGTEASVTPISFAGFNALRAMAVGYNDNPKKACRPFDLKRSGFVMGEGSGVLILESYEHAIKRNAKIYGEILAYSSESDAFHITSPEPNGLGLTNSINKVIKNANISGSDIKYINAHGTSTKLNDQIETKVFKNVFKDHAYKLHISSTKSMTGHCIGAAGAIESIICLKTMQTNIIPPTINYEHKDDECDLNYTPNKCISSKQNIDFSLNTNLGFGGHNTALLFKKITK

SEQ ID NO: 20064 - DNA, 1275 bp, Streptomyces murayamaensis
  CDS (1)..(1275): transl_table=11
gtgacaacgcctcgcagggtggtcatcaccgggatggaggtcctcgcccccggtggcatcggcaccaagaacttctggagcctcctcagcgagggccgcacggcgacccgggggatcacgttcttcgaccccacgccgttccgctcgcgggtggccgccgagatcgacttcgacccgtacgagcacggtctgagcccgcaggaggtccgccgcatggaccgggccggccagttcgcggtcgtcgcctcgcgcggcgcggtcgccgacagcggtctggagctcgccggcctcgacccgtaccgggtcggtgtcacggtcggcagcgcggtcggcgccaccatgggcctggacgaggagtaccgggtcgtcagcgacggcggccggctcgacctcgtggaccaccagtacgcggccccgcacctctacaaccacctggtgccgagctcgttcgcggccgaggtggcctgggcggtcggcgccgagggccccagcaccgtggtctccacgggctgcacctccggcatcgactcggtcggctacgccgtcgagctgatccgcgagggctccgccgacgtcatgatcgccggatcctcggacgcgccgatctcgccgatcaccatggcgtgcttcgacgcgatcaaggccacgacgaaccgttacgacgagcccgagacggcctcgcggccgttcgacaactcgcgcaacggcttcgtcctgggcgagggcaccgcgttcttcgtcctggaggagctggagagcgccgtcaagcgaggcgcccacatctacgcggagatcgccggctacgccacgcgctccaacgcgtaccacatgaccggactgcgccccgacggcgcggagatggccgaggcgatccgcgtggcgctggacgaggcgcggatgaacggcgacgagatcgactacatcaacgcccacggctccggcaccaagcagaacgaccgccacgagacggcggcggtcaagcggatcctcggtgaccacgcctaccggacgccgatgagctccatcaagtcgatggtggggcactcgctcggcgcgatcggctccatcgagatcgccgcgtccgcgctcgccatggagtacaacgtcgtaccgcccacggccaacctgcacacgcccgaccccgagtgcgacctggactacgtcccgttgaccgcccgcgaccgcaagaccgacgcggtcctctcggtcggcagcggcttcggtggattccagagtgccgtggtgctcgcccgtcccgagaggaagctcgcatga

SEQ ID NO: 20065 - protein, 424 aa, Streptomyces murayamaensis
MTTPRRVVITGMEVLAPGGIGTKNFWSLLSEGRTATRGITFFDPTPFRSRVAAEIDFDPYEHGLSPQEVRRMDRAGQFAVVASRGAVADSGLELAGLDPYRVGVTVGSAVGATMGLDEEYRVVSDGGRLDLVDHQYAAPHLYNHLVPSSFAAEVAWAVGAEGPSTVVSTGCTSGIDSVGYAVELIREGSADVMIAGSSDAPISPITMACFDAIKATTNRYDEPETASRPFDNSRNGFVLGEGTAFFVLEELESAVKRGAHIYAEIAGYATRSNAYHMTGLRPDGAEMAEAIRVALDEARMNGDEIDYINAHGSGTKQNDRHETAAVKRILGDHAYRTPMSSIKSMVGHSLGAIGSIEIAASALAMEYNVVPPTANLHTPDPECDLDYVPLTARDRKTDAVLSVGSGFGGFQSAVVLARPERKLA

SEQ ID NO: 20066 - DNA, 1446 bp, Dictyostelium discoideum
  CDS (1)..(1446)
atgagcaataataataacagtttaaatgacaattttattaataacaatataaaaaataatgaatatttaaaattaaaaagagttgttgtaactgggatgggtattgtatctccattaggtgtaggaataaaatataattgggataaattaataaatggtgagagtggaattaaaagatttgaaggatttgaagatagtagaattgattgcccatcaaaagttgtagcaagagtaccaaaaggtgaaggtataggtgagtttaattcaaatactatgataccatcacaagtgaaattggcaagctctgatttcataaaatatgcaatcgttgcaactgatgaagctattaaagattcaaaactagataaattcattgaatcaaatgaaaaacttcaagaaagaattggagtatgtattggttctggtacaggttcaatggaagaaattatctcagcaaatgaaaagatttcaaataaattaaataacaataacaataacagtgatagtggtagtggtagtggtagtggtggtggtggtggtaaagtttcagcatattttataccaaaaattttaattaatgaagcatctggtataattagtattttacataaagcgaaaggacctaatatgtcaattgttagtgcatgtgcaactgggtctcattgtattggcgaatcatttagaaagataaaatatggtgaagtggacgcaatgatatgtggtggtactgaagcgagtataaattcagtttcaatgattggtttctcacgtatgaaagcattatcaaccaaatataataatcatattaatccatcatcaagtagtagaccattcgatgaaggtagggatggatttgtaatgggtgaaggctctggaatattaatattggaagagtatgaacatgctttaaaaagaggtgcaaatatttattgtgaaatcactggttatggttcaactggcgatgcccatcatatttcagctccaaattctgatggaaacggtccgttaaggtcaatgaatttagcattactagaatctggtttaccaaattcctctcatatcgattatataaatgctcatgcaacttcaacgccattaggtgatggtattgaatgtactgctgttaaaaacttttataataataataataataataataataataataataataataataataaagaaattataatgagctcaaataaaggttcaattggtcatttgttgggtgctgctggaagtgttgaatcaatattttcaattttatcattatataataatattataccaccaactttaaatttagaaaatccatcaaaagattgtcagggtataaatttagtacaatttaaatctcaatcaaaaccaattagaaatgttttaaaaaattcatttggatttggtggaacaaattgttctttaattttttcaaaaataaattaa

SEQ ID NO: 20067 - protein, 481 aa, Dictyostelium discoideum
MSNNNNSLNDNFINNNIKNNEYLKLKRVVVTGMGIVSPLGVGIKYNWDKLINGESGIKRFEGFEDSRIDCPSKVVARVPKGEGIGEFNSNTMIPSQVKLASSDFIKYAIVATDEAIKDSKLDKFIESNEKLQERIGVCIGSGTGSMEEIISANEKISNKLNNNNNNSDSGSGSGSGGGGGKVSAYFIPKILINEASGIISILHKAKGPNMSIVSACATGSHCIGESFRKIKYGEVDAMICGGTEASINSVSMIGFSRMKALSTKYNNHINPSSSSRPFDEGRDGFVMGEGSGILILEEYEHALKRGANIYCEITGYGSTGDAHHISAPNSDGNGPLRSMNLALLESGLPNSSHIDYINAHATSTPLGDGIECTAVKNFYNNNNNNNNNNNNNNNKEIIMSSNKGSIGHLLGAAGSVESIFSILSLYNNIIPPTLNLENPSKDCQGINLVQFKSQSKPIRNVLKNSFGFGGTNCSLIFSKIN

SEQ ID NO: 20068 - DNA, 1248 bp, Heliobacillus mobilis
  CDS (1)..(1248): transl_table=11
atgaaaaaacgcgtggtcattacgggcgtcggtgtcgtgtcacccgtagggacaggcaaggaaaagttttgggactccttgacctccggtgtttccggcatcggccctgtgacccgttttgacgccaccgacctcccgacgcgagttgcggcggaagtaaaggattttgatccgaccaagtttttggaccggaaagaagctcgtcgtatggaccggtttgcccagtacgccgtagcggcgtcgaaaatggccatggaagattccggtctcgatatggagaaggccgaccgcgaacgggctggtgtcatcttaggttgcggtatcggcggcatggagaccttcgaagatcaagccaaggtgatgatcaacaaagggaacggtcgtatcagtcccttttttgtcccgatgatgatctccaacatggctgccggccatatatccatgcaattgaacttgaagggaccgagtgaaacggtggtcaccgcctgtgcttcggcaacgaacgcttgtggcagcgctctccgccttctacagcatggtgattgtgatgtggtccttacgggggggaccgaggcttccatcatccagttgtcttttgccggcttctgcgccatgaaagccatgtccacactgaatgacgacccagcaaaagccagccgcccctttgaccgcgatcgcagcggctttgtcatgggcgaaggcgccgggattctcgtctttgaggaactggaacatgctctagcccggggtgctcatatctatgcggaagtcgtcggttacggctcttcctgtgacgcttatcatatcaccgatccggcgcccaatggagaaggagctgcccgagctatgcagggcgctttaaaggatgctggtctaaagccggaagatatcgattacatcaatgctcacggtacagcgactgaaaagaacgattattacgaaacactggcgatcaaatcagtttttggcgatcatgcccagaaagtggctatcagctcgaccaaatcgatgacaggccacctgcttggcgctgccggaggcatcgaactgatcgctactgccttagccattcatgatggtatcattcccccgacgatcaacttggataaccctggtgagggctgtgatttggattatgttccccatgaagcgcgcaaaataccggtagaagccgcaatctccaacactttcggttttgggggacataacgccaccgtcgctctttgcaaataccggcctggggaatag

SEQ ID NO: 20069 - protein, 415 aa, Heliobacillus mobilis
MKKRVVITGVGVVSPVGTGKEKFWDSLTSGVSGIGPVTRFDATDLPTRVAAEVKDFDPTKFLDRKEARRMDRFAQYAVAASKMAMEDSGLDMEKADRERAGVILGCGIGGMETFEDQAKVMINKGNGRISPFFVPMMISNMAAGHISMQLNLKGPSETVVTACASATNACGSALRLLQHGDCDVVLTGGTEASIIQLSFAGFCAMKAMSTLNDDPAKASRPFDRDRSGFVMGEGAGILVFEELEHALARGAHIYAEVVGYGSSCDAYHITDPAPNGEGAARAMQGALKDAGLKPEDIDYINAHGTATEKNDYYETLAIKSVFGDHAQKVAISSTKSMTGHLLGAAGGIELIATALAIHDGIIPPTINLDNPGEGCDLDYVPHEARKIPVEAAISNTFGFGGHNATVALCKYRPGE

SEQ ID NO: 20070 - DNA, 1626 bp, Arabidopsis thaliana
  CDS (1)..(1626)
atggtgggtgcgtcttcctcttacgcatctccgttatgtacctggtttgttgctgcttgcatgtccgtctctcacggtggaggagatagccgtcaggctgttgctcttcaatctggtgggcggagtcggcgaaggaggcagcttagcaaatgctctgtcgcttctggatccgctagcattcaggctctcgtgacttcttgtttggattttggtccttgtactcactacaacaacaacaatgcattgtcttctctctttggatcgaatagtgtttctttgaatcgaaaccagaggagattgaatcgtgctgctagctccggtggagccatggcagtgatggagatggaaaaggaagctgcggttaacaagaaaccacctacggagcagcgtcgagttgtagtgacaggcatgggagttgaaacatcattgggtcatgacccacataccttctatgagaatttgctacaaggcaacagtggtattagccagattgaaaattttgattgttctgaatttcctacgcgaattgcgggagagatcaaaagcttctcgactgaaggatgggttgctccaaaactttctaaaaggatggacaaattcatgctctatcttctcacagctggtaagaaagctttggctgatggtggggttactgatgaagtaatggcagagtttgacaaaaccaaatgtggagttttgattggctcggcaatgggaggaatgaaggtcttttacgatgctattgaagctctgagaatctcttacaagaagatgaatcctttttgtgtaccttttgcgacaacaaacatgggttctgctatgcttgccatggatctgggatggatggggccaaactattctatttcaactgcttgtgccacaagcaacttttgcattctgaattcagcaaaccacattattaaaggtgaagctgatgtaatgctctgtggtggctcagatgcagttattattccaatagggttgggaggttttgttgcatgccgggctctttcacaaaggaataatgatcccacaaaagcttcacgtccttgggataccaatcgagatggtttcgtgatgggagagggagctggagttctacttttggaagaactcgagcatgctaagaaaagaggtgcaactatctacgcagagttcctcggtgggagtttcacatgtgatgcctatcacatgaccgagcctcaccctgatggggctggtgttattctctgtattgagagagcgttagctagtgctgggatttccaaggaacaaataaattacataaatgcacatgcaacctcaacgcatgctggagatattaaggaataccaagcccttgctcactgttttggccaaaatcctgagcttaaggtaaattccacaaaatctatgattggacacttgctgggagttgctggggccgtggaggctgttgcaactgtgcaggcgatacggaccggatgggttcatccaaatatcaacctcgagaatccagacagtggagtggatacaaagctgctggtgggtcctaagaaggagagactggacattaaagcagccttgtcaaattcattcgggtttggtggtcataactccagcatcatttttgctccttacaagtga

SEQ ID NO: 20071 - protein, 541 aa, Arabidopsis thaliana
MVGASSSYASPLCTWFVAACMSVSHGGGDSRQAVALQSGGRSRRRRQLSKCSVASGSASIQALVTSCLDFGPCTHYNNNNALSSLFGSNSVSLNRNQRRLNRAASSGGAMAVMEMEKEAAVNKKPPTEQRRVVVTGMGVETSLGHDPHTFYENLLQGNSGISQIENFDCSEFPTRIAGEIKSFSTEGWVAPKLSKRMDKFMLYLLTAGKKALADGGVTDEVMAEFDKTKCGVLIGSAMGGMKVFYDAIEALRISYKKMNPFCVPFATTNMGSAMLAMDLGWMGPNYSISTACATSNFCILNSANHIIKGEADVMLCGGSDAVIIPIGLGGFVACRALSQRNNDPTKASRPWDTNRDGFVMGEGAGVLLLEELEHAKKRGATIYAEFLGGSFTCDAYHMTEPHPDGAGVILCIERALASAGISKEQINYINAHATSTHAGDIKEYQALAHCFGQNPELKVNSTKSMIGHLLGVAGAVEAVATVQAIRTGWVHPNINLENPDSGVDTKLLVGPKKERLDIKAALSNSFGFGGHNSSIIFAPYK

SEQ ID NO: 20072 - DNA, 1272 bp, Streptomyces galilaeus
  CDS (1)..(1272): transl_table=11
atgaccgcccgccgggtggtgatcaccgggctgggagtgatcgctccgggcggcatcggcaccaaggccttctgggaacgcatcgtctccggtgtctccgcgaccaggaccatcacggccttcgacgcctccgagttccgctcccggatggccgcggagtgcgacttcgacggcgtccgctcgggcctgaccgtccgtgacaccgcacggctggaccgtgccacccagttcgcggtggtcgccgcgcgcgaggcgctcgccgacagcggtatcgagatcgacgagaggaacgcccaccgcaccggggtcagcctcggctccgccgtggggtgcacccagaagctggaggaggagtacgtcgcgcgcagtgacggcgggcagcggtggctggtcgatcacgccgcgggcaccccgtacctgtacgactacttcgtaccgagttcgatggcggccgaagtggcgtgggaggccggcgccgagggccccgcggcgctcgtctcggcgggctgcacctccggtctcgactccctcgggcacgcgctcgacctcatcagggagggcgccgtcgacatcatgatcgccggtggcagcgacgcgcccatcgcacccatcaccgtggcctgtttcgacgccatcaaggcgacctcgccgcgcaacgacaccccggagcacgcctcgcggcccttcgacaggacccgcagcggcttcgtgctcggcgagggcgcggccgtactcgtcctggaggagcgggagtcggccctgcggcgcggagcacagatctacgccgagatcgcgggctacgccggtcgggccaacgcccaccacatgaccggactgcgccccgacggactggagatgtccgccgccatcaccggcgccctcgacgacgcccgcatcgaccgcgaagccgtcggttacgtcaacgcccacggcacggcgacccggcagaacgacatccacgagacggccgcgatcaagcacagcctgggcgagcacgcccgccgggtcccggtcagctccatcaaggcggtcatcggtcactcgctgggcgccgtcggctccatcgaggccgtcgcctccgccctggtgatccggcacggagtggtgccgcccacggcgggactgcacgagcccgatccccagctcgacctcgactacgttccgctgatcgcgcgcgaccaggccaccgacaccgtgctgacggtgggcagcggtttcggcggattccagagcgcgatggtgctcaccagcgccgaagggggccgctcatga

SEQ ID NO: 20073 - protein, 423 aa, Streptomyces galilaeus
MTARRVVITGLGVIAPGGIGTKAFWERIVSGVSATRTITAFDASEFRSRMAAECDFDGVRSGLTVRDTARLDRATQFAVVAAREALADSGIEIDERNAHRTGVSLGSAVGCTQKLEEEYVARSDGGQRWLVDHAAGTPYLYDYFVPSSMAAEVAWEAGAEGPAALVSAGCTSGLDSLGHALDLIREGAVDIMIAGGSDAPIAPITVACFDAIKATSPRNDTPEHASRPFDRTRSGFVLGEGAAVLVLEERESALRRGAQIYAEIAGYAGRANAHHMTGLRPDGLEMSAAITGALDDARIDREAVGYVNAHGTATRQNDIHETAAIKHSLGEHARRVPVSSIKAVIGHSLGAVGSIEAVASALVIRHGVVPPTAGLHEPDPQLDLDYVPLIARDQATDTVLTVGSGFGGFQSAMVLTSAEGGRS

SEQ ID NO: 20074 - DNA, 1617 bp, Cuphea lanceolata
  CDS (1)..(1617)
atggcggcggcctcttccatggctgcgtcaccgttctgtacgtggctcgtagctgcttgcatgtccacttccttcgaaaacaacccacgttcgccctccatcaagcgtctcccccgccggaggagggttctctcccattgctccctccgtggatccaccttccaatgcctcgtcacctcacacatcgacccttgcaatcagaactgctcctccgactcccttagcttcatcggggttaacggattcggatccaagccattccggtccaatcgcggccaccggaggctcggccgtgcttcccattccggggaggccatggctgtggctctgcaacctgcacaggaagtcgccacgaagaagaaacctgctatcaagcaaaggcgagtagttgttacaggaatgggtgtggtgactcctctaggccatgaacctgatgttttctacaacaatctcctagatggagtaagcggcataagtgagatagagaacttcgacagcactcagtttcccacgagaattgccggagagatcaagtctttttccacagatggctgggtggccccaaagctctccaagaggatggacaagctcatgctttacttgttgactgctggcaagaaagcattagcagatgctggaatcaccgatgatgtgatgaaagagcttgataaaagaaagtgtggagttctcattggctccggaatgggcggcatgaagttgttctacgatgcgcttgaagccctgaaaatctcttacaggaagatgaaccctttttgtgtaccttttgccaccacaaatatgggatcagctatgcttgcaatggatctgggatggatgggtccaaactactctatttcaactgcctgtgcaacaagtaatttctgtatactgaatgctgcaaaccacataatcagaggcgaagctgacatgatgctttgtggtggctcggatgcggtcattatacctatcggtttgggaggttttgtggcgtgccgagctttgtcacagaggaataatgaccctaccaaagcttcgagaccatgggatagtaatcgtgatggatttgtaatgggcgaaggagctggagtgttacttctcgaggagttagagcatgcaaagaaaagaggtgcaaccatttatgcagaatttttagggggcagtttcacttgcgatgcctaccacatgaccgagcctcaccctgaaggagctggagtgatcctctgcatagagaaggccatggctcaggccggagtctctagagaagatgtaaattacataaatgcccatgcaacttccactcctgctggagatatcaaagaataccaagctctcgcccactgtttcggccaaaacagcgagctgagagtgaattccactaaatcgatgatcggtcatcttcttggagcagctggtggcgtagaagcagttactgtaattcaggcgataaggactgggtggatccatccaaatcttaatttggaagacccggacaaagccgtggatgcaaaatttctcgtgggacctgagaaggagagactgaatgtcaaggtcggtttgtccaattcatttgggttcggtgggcataactcgtctatactcttcgccccttacaattag

SEQ ID NO: 20075 - protein, 538 aa, Cuphea lanceolata
MAAASSMAASPFCTWLVAACMSTSFENNPRSPSIKRLPRRRRVLSHCSLRGSTFQCLVTSHIDPCNQNCSSDSLSFIGVNGFGSKPFRSNRGHRRLGRASHSGEAMAVALQPAQEVATKKKPAIKQRRVVVTGMGVVTPLGHEPDVFYNNLLDGVSGISEIENFDSTQFPTRIAGEIKSFSTDGWVAPKLSKRMDKLMLYLLTAGKKALADAGITDDVMKELDKRKCGVLIGSGMGGMKLFYDALEALKISYRKMNPFCVPFATTNMGSAMLAMDLGWMGPNYSISTACATSNFCILNAANHIIRGEADMMLCGGSDAVIIPIGLGGFVACRALSQRNNDPTKASRPWDSNRDGFVMGEGAGVLLLEELEHAKKRGATIYAEFLGGSFTCDAYHMTEPHPEGAGVILCIEKAMAQAGVSREDVNYINAHATSTPAGDIKEYQALAHCFGQNSELRVNSTKSMIGHLLGAAGGVEAVTVIQAIRTGWIHPNLNLEDPDKAVDAKFLVGPEKERLNVKVGLSNSFGFGGHNSSILFAPYN

SEQ ID NO: 20076 - DNA, 1371 bp, Coriandrum sativum
  CDS (1)..(1371)
atgcaatctcttcttcaatcttccttcactccaacattccgcctcccgaaaccctgccatcacatccctagaccacctcgaaagttgtcggttttcgcaacctcagcctctccgaaacgcgaaaaagatcctaagaaacgagttgtcgtaaccggtctcggtgtggtttcggtgtttggaaatgacgtggatacttattatgacaagcttcttgcaggcgaatccggtgtggattttattgatagatttgatgcatccgaatttccgacacgattcgcagcacagatccgagcattttcatccgaagggtacatagatagcaagaatgatcggagacttgacaattgtttgcgttacaacatcgttgctggtaaaaaagcacttgaaaatgctggtcttggtgaagacatgcggtccaagattgacaaggagcgtgctggtgtgctcgttggaagtggtatggggggtattactgcattttgtgatggtgtggagaatctgatcacaaaaggttacaagaaaatatctccatttttcataccgtatactataaccaacatgggctctgcattgcttgctattgatcttggcttcatgggaccaaactattctattgttgctgcttgtgccacctcaaattatgcgttttatgctgctgcgaatcacattcgtagtggtgaggctgatttgatgcttgctggtggagccgaagctgctattgtccctgttggactgggcgggttcacttcgtgcagagcaatgtctcagagaaatgataatcccaaggcggcttctaggccttgggacaaagatagagatggtttagttatgggtgaaggcgctggagtcttggtgatggagagtttggttcatgcaatgaagcgaggtgcaccgataattgctgaatacttagggggtgcagtcacctgtgatgctcatcatatgactgatcccagacctgatgggggaggggtttcgatgtgcattcaaagtggccttcaagaagctggggtggtttcgcctgaggaggtcaattacatcaatgcacatgcaacttcaactttagctggagatcttaaagaggttactgctatcaaacaagttttgggccagattaaagcaaatgcaaccaagtctatgaatgcccactgcttgggggctgcttctggcttggaagccgtggcaacagtgaaggccatagctacagggtggctgcaccctactatcaatcaagtgaaccttgaacctgaagttgattttgacacagttgcaaataagaaacagcagcatgaagtgaatgttggcatctcaaattcatttggatttggtggacacaactcagtggtggtattttctgcattcaacccatga

SEQ ID NO: 20077 - protein, 456 aa, Coriandrum sativum
MQSLLQSSFTPTFRLPKPCHHIPRPPRKLSVFATSASPKREKDPKKRVVVTGLGVVSVFGNDVDTYYDKLLAGESGVDFIDRFDASEFPTRFAAQIRAFSSEGYIDSKNDRRLDNCLRYNIVAGKKALENAGLGEDMRSKIDKERAGVLVGSGMGGITAFCDGVENLITKGYKKISPFFIPYTITNMGSALLAIDLGFMGPNYSIVAACATSNYAFYAAANHIRSGEADLMLAGGAEAAIVPVGLGGFTSCRAMSQRNDNPKAASRPWDKDRDGLVMGEGAGVLVMESLVHAMKRGAPIIAEYLGGAVTCDAHHMTDPRPDGGGVSMCIQSGLQEAGVVSPEEVNYINAHATSTLAGDLKEVTAIKQVLGQIKANATKSMNAHCLGAASGLEAVATVKAIATGWLHPTINQVNLEPEVDFDTVANKKQQHEVNVGISNSFGFGGHNSVVVFSAFNP

SEQ ID NO: 20078 - DNA, 1236 bp, Xanthomonas albilineans
  CDS (1)..(1236): transl_table=11
atgagccgtcgcgtcgtggtaaccggcatgggtctggtgtcgccgttgggcaatgatctggccagcagctgggacgggatcgtcaatgggcgttcgggcatcggtccgattacccttatcgatgcatctcagttcgccacccgcatcgtcggtgaaatcaaggatttcgatccgaccaagttcctgtctgccaaagacgtcagaaagatggattcgttcatccactacggcgtcgccgcctcgttcatggcactggacgatgccggccttgagatcaccgatgccaatgccgaacgcatcggcgccatcctcggttcgggcatcggcggcgtgctcggcatcgaagagcagaccctcaagttgcaggagggtggcccgcgcaaggtctcgcctttctatgtgcccagtaccatcatcaacatgctgccgggccaggtaagcattatgaagggactgaaggggccgaccttctcggcggtttccgcctgcgccacctccaatcattccattggcaccgcgatgcgcatgattcagtacggcgatgccgacgtgatgctggctggcggtgccgagcggggatcctcgccgactgcgatcgccggcttttcctcgatgcgggcgatgtccacccgcaacgatgatcccgctgcggcctcgcggccatgggataaggaccgcgacggtttcgtgatgggggatggcgccggcgtgctggtgctggaagagtacgagcatgccaaggcgcgtggcgcgcgcatctatgccgaattggctggcttcggcgccagctccgatgctttccacatgacctcgccgagcgaagacggtgaaggcgctgcgcgcagcatgcgcgcggcgatgcgcgatgccgggctcaatccagaccagatcgattatctcaatgcgcacggcacctctacgcctgcgggcgatctggccgagaccatcgcgatgaagcgcgcgctcggcgatcatgcctacaagctcatgattagttccaccaagtcgatgattgggcatctgctcggcgcggctggtggtgccgaggcgatcttctcggtgatggcactccacacgggcatcatcccgccgaccatcaacctggacgaaccgggcgagggttgcgatctggactacgtgccgaacgtggcgcgcgagaagaagatcgacgtggcgatgtccaatgggttcggcttcggcgggaccaacgggactttggtgttcaagcggatctga

SEQ ID NO: 20079 - protein, 411 aa, Xanthomonas albilineans
MSRRVVVTGMGLVSPLGNDLASSWDGIVNGRSGIGPITLIDASQFATRIVGEIKDFDPTKFLSAKDVRKMDSFIHYGVAASFMALDDAGLEITDANAERIGAILGSGIGGVLGIEEQTLKLQEGGPRKVSPFYVPSTIINMLPGQVSIMKGLKGPTFSAVSACATSNHSIGTAMRMIQYGDADVMLAGGAERGSSPTAIAGFSSMRAMSTRNDDPAAASRPWDKDRDGFVMGDGAGVLVLEEYEHAKARGARIYAELAGFGASSDAFHMTSPSEDGEGAARSMRAAMRDAGLNPDQIDYLNAHGTSTPAGDLAETIAMKRALGDHAYKLMISSTKSMIGHLLGAAGGAEAIFSVMALHTGIIPPTINLDEPGEGCDLDYVPNVAREKKIDVAMSNGFGFGGTNGTLVFKRI

SEQ ID NO: 20080 - DNA, 1272 bp, Streptomyces maritimus
  CDS (1)..(1272): transl_table=11
gtgagccgacacgtagtcataactggcctgagcgtcctcgcacccggttcgacggatacagagggcttctggaagatgatcacagcggggcgcagcgcgatccgcaggatcacggcattcgaccccacgccgttccgttcccaggtggcgggagaggtcgatctcgatccgctggcctgtgggttcagccgccgcgaggtccggcgtctggaccgggccagcctgctggccgtggcctgcgccagacgggcggtggcggaagccgggatcacctccggtacgagtatcgaccctggccgcatcggtgtgagcgtgggcaacgcggtgggatccgccacaagtatcgagaacgagtacgtcgtgctgtccgacgagggacgccagtggctggtcgaccagaagtaccagtccccccacctgttcgactacttcgtcccgggttccctcgcccgcgagaccgcctgggcggccggtgccgaaggaccggtgtcggtcatctcggccggctgcacctctggcatcgacgccctcggccatgcctgccagctcatccaggagggcagtgccgacgtgatggtcgccggcgccaccgatgctcccgtcaccccgatcgcggtggcctgcttcgatgcgatcaaggccaccacgcgccgtaacgacgatcccgaacacgcgccgcggcccttcgaccgcacccgggacggattcgccatcgccgagggcgcggccatgctggtcctggaggacagcgaacacgcccggcggcgcggagccgacatttacggcaccatcaccggatacgccgcgcactcgaacgcgtaccacatgacgggcctgtcccgggacggcaatgagatggcccgcgccatcacgaccgccctggacgaggcccgcaccgaccccacggccgtcgggtacatcaacgcccacggctctggcacgaaacagaacgacctgcatgaaaccgaggcgttcaagaaggccctgggcgagcacgcttacaacgtcccggtcagctccatcaagtcgatgatcgggcattccctgggcgcgatcggcgcgatcgaggttgcaacctgcgcgctggccatccgcaacggagtggtgccccccaccgcgaacctccatgagcccgacccggactgcgacctggactacgtcccccttgaggcgcgtgatgtggaccttgacgtcgtcctgaccgtgggcagcgggttcggggggttccagagcgccatgatcgtggagaagtggcgaggaggccacgtatga

SEQ ID NO: 20081 - protein, 423 aa, Streptomyces maritimus
MSRHVVITGLSVLAPGSTDTEGFWKMITAGRSAIRRITAFDPTPFRSQVAGEVDLDPLACGFSRREVRRLDRASLLAVACARRAVAEAGITSGTSIDPGRIGVSVGNAVGSATSIENEYVVLSDEGRQWLVDQKYQSPHLFDYFVPGSLARETAWAAGAEGPVSVISAGCTSGIDALGHACQLIQEGSADVMVAGATDAPVTPIAVACFDAIKATTRRNDDPEHAPRPFDRTRDGFAIAEGAAMLVLEDSEHARRRGADIYGTITGYAAHSNAYHMTGLSRDGNEMARAITTALDEARTDPTAVGYINAHGSGTKQNDLHETEAFKKALGEHAYNVPVSSIKSMIGHSLGAIGAIEVATCALAIRNGVVPPTANLHEPDPDCDLDYVPLEARDVDLDVVLTVGSGFGGFQSAMIVEKWRGGHV

SEQ ID NO: 20082 - DNA, 1272 bp, Streptomyces galilaeus
  CDS (1)..(1272): transl_table=11
atgacggcccgccgggtggtgatcaccggcctgggagtgatcgccccgggtggcatcggcaccaaggcgttctgggaacgcgtcgtctccggcgtctccgcgaccaggaccatcacggccttcgacgcgtccgggttccgctcccggatggccgcggagtgcgacttcgacggcgtccgctcgggcctgaccgtccgtgacaccgcacggctggaccgtgccacccagttcgcggtggtcgccgcgcgcgaggcgctcgccgacagcggcatcgagatcgacgagaggaacgcccaccgcaccggggtcagcctcggctccgccgtggggtgcacccagaagctcgaggaggagtacgtcgcgcgcagtgacggcgggcagcggtggctggtcgatcacgccgccggcacaccgtacctgtacgactacttcgtgccgagttcgatggcggccgaagtggcgtgggaggccggcgccgagggccccgccgcgctcgtctcggcgggctgcacctccggtctcgactccctcgggcacgcgctcgacctcatcagggagggcaccgtcgacatcatgatcgccggtggcagcgacgcgcccatcgcacccatcaccgtggcctgtttcgacgccatcaaggcgacctcgccgcgcaacgacaccccggagcacgcctcgcggcccttcgacaggacccgcagcggcttcgtgctcggcgagggtgcggccgtactcgtcctggaggagcgggagtccgccctgcggcgcggagcacagatctacgccgagatcgcgggctacgccgggcgtggcaacgcccaccacatgaccggactgcgccccgacggactggagatgtccgccgccatcaccggcgccctcgacgacgcccgcatcgaccgcgaagccgtcggttacgtcaacgcgcacggtacggccacccggcagaacgacatccacgagacggccgcgatcaagcacagcctgggcgagcacgcccaccgggtcccggtcagctccatcaaggcggtcatcggtcactcgctcggcgccgtcggctccatcgaggccgtcgcctccgccctggtgatccggcacggagtggtgccgcccacggcgggactgcacgagcccgatccccagctcgacctcgactacgttccgctgaccgcgcgcgatcaggccaccgacaccgtgctgacggtgggcagcggattcggcggattccagagcgccatggtgctcaccagcgccgaagggagccgctcatga

SEQ ID NO: 20083 - protein, 423 aa, Streptomyces galilaeus
MTARRVVITGLGVIAPGGIGTKAFWERVVSGVSATRTITAFDASGFRSRMAAECDFDGVRSGLTVRDTARLDRATQFAVVAAREALADSGIEIDERNAHRTGVSLGSAVGCTQKLEEEYVARSDGGQRWLVDHAAGTPYLYDYFVPSSMAAEVAWEAGAEGPAALVSAGCTSGLDSLGHALDLIREGTVDIMIAGGSDAPIAPITVACFDAIKATSPRNDTPEHASRPFDRTRSGFVLGEGAAVLVLEERESALRRGAQIYAEIAGYAGRGNAHHMTGLRPDGLEMSAAITGALDDARIDREAVGYVNAHGTATRQNDIHETAAIKHSLGEHAHRVPVSSIKAVIGHSLGAVGSIEAVASALVIRHGVVPPTAGLHEPDPQLDLDYVPLTARDQATDTVLTVGSGFGGFQSAMVLTSAEGSRS

SEQ ID NO: 20084 - DNA, 1635 bp, Brassica napus
  CDS (1)..(1635)
atgccgacgcgtccaaacactcaagtgagagagagagagagatcagataatctttctcgttttctccaccttcatccgagtatgacgatgggtggtgcgtctttatgcgattcgctagtggctgcttgcatgtcctccgcctcgcactcaagcgtagagcgactgactcaattcgacactaggagtagtagcatctggcctcgccggagtagactggttaacaactgctcgctccatggatcccaggcgagttcccgtaacaacaatgcctcgtcttccctcttcgaatcgaataacacttccttcaatccaaagcagaggagattcaatcgagcatcaacctctgggcaagtcactacactagagatggagaaggacgcaatggtaaacaagccacgccgagttgttgtcactggcatgggagttgaaacaccactaggtcacgaccctcatactttttatgacaacttgctacaaggcaaaagtggtataagccatatagagagtttcgactgttctgcatttcccactagaatcgctggggagattaaatctttttcgaccgaaggattggttgctcctaaactttccaaaaggatggacaagtttatgctttaccttctaacagccggcaagaaggcgttggaggatggtggggtgactgaggatgtgatggcagagttcgacaaatcaagatgtggtgttttgattggctcagcaatgggaggcatgaaggtcttttacgatgcacttgaagctttgaaaatctcttacaggaagatgaatcctttttgtgtaccttttgccaccacaaacatgggttccgctatgcttgccttggatctgggatggatgggtccaaactactctatttcaaccgcatgtgccacgggaaacttctgtattctcaatgcggcaaaccacattactagaggtgaagctgatgtaatgctctgtggtggctctgactcagttattattccaatagggttgggaggttttgttgcctgccgggctctttcagaaaataatgatgatcccaccaaagcttctcgtccttgggatagtaaccgagatggttttgttatgggagagggagccggagttctacttttagaagaacttgagcatgccaagaaaagaggagcaactatatacgcagagttccttgggggtagtttcacatgtgatgcatatcatattaccgaaccacgtcctgatggtgctggtgtcattctcgctatcgagaaagcgttagctcatgccgggatttctaaggaagacataaattacgtgaatgctcatgctacctctacaccagctggagaccttaaggagtaccacgccctttctcactgttttggccaaaatcctgagctaagggtaaactcaacaaaatctatgattggacacttgctgggagcttctggggccgtggaggctgttgcaaccgttcaggcaataaagacaggatgggttcatccaaatatcaacctcgagaatccagacaaagcagtggatacaaagcttctggtgggtcttaagaaggagagactggatatcaaagcagctttgtcaaactctttcggctttggtggccagaactctagcatcattttcgctccttacaaatga

SEQ ID NO: 20085 - protein, 544 aa, Brassica napus
MPTRPNTQVRERERSDNLSRFLHLHPSMTMGGASLCDSLVAACMSSASHSSVERLTQFDTRSSSIWPRRSRLVNNCSLHGSQASSRNNNASSSLFESNNTSFNPKQRRFNRASTSGQVTTLEMEKDAMVNKPRRVVVTGMGVETPLGHDPHTFYDNLLQGKSGISHIESFDCSAFPTRIAGEIKSFSTEGLVAPKLSKRMDKFMLYLLTAGKKALEDGGVTEDVMAEFDKSRCGVLIGSAMGGMKVFYDALEALKISYRKMNPFCVPFATTNMGSAMLALDLGWMGPNYSISTACATGNFCILNAANHITRGEADVMLCGGSDSVIIPIGLGGFVACRALSENNDDPTKASRPWDSNRDGFVMGEGAGVLLLEELEHAKKRGATIYAEFLGGSFTCDAYHITEPRPDGAGVILAIEKALAHAGISKEDINYVNAHATSTPAGDLKEYHALSHCFGQNPELRVNSTKSMIGHLLGASGAVEAVATVQAIKTGWVHPNINLENPDKAVDTKLLVGLKKERLDIKAALSNSFGFGGQNSSIIFAPYK

SEQ ID NO: 20086 - DNA, 1302 bp, Brassica napus
  CDS (1)..(1302)
atggctgttgcgatggatatggaaaaggaagccaaggttgacaacaaacctcctacggagcagcgccgggttgttgtgacaggcatgggagttgaaacatcactaggtcatgaccctgacaccttttatgagaatctcctacaaggcaacagtggtattagccagattgagaattttgattgttctgcttttcctacgagaattgctggagagatcaagtcattctcgactgaagggtgggttgctccaaaactctcaaagaggatggacaagttcatgctctatcttctcactgctggcaagaaggctttggttgatggtggggtaaccgaagaagtcatggcagagtttgacaaagccaaatgcggagtcttgattggctctgcaatgggaggcatgaaggtctttcaagatgctattgaagctatgaagatctcttacaagaagatgaatcctttctgtgtgcctttcgcgacaacgaacatgggttctgctatgcttgctttggatctgggatggatggggccaaactattctatctcaactgcttgtgcaacaagcaacttttgcattctcaattcagcaaaccacattatcaaaggagaagctgatgtaatgctctgtggtggctcggattcagttattattccaatagggttgggaggttttgttgcatgccgtgctctttctcaaaggaataatgatcccacaaaagcttcacgcccttgggatagcaaccgagatggtttcgtgatgggagagggagctggagttttgcttttggaagagcttgaacatgctaagaaaagaggagcaacaatctatgcagagttccttggtgggagtttcacatgtgatgcctatcacatgaccgagcctcgccctgatggtgctggtgtgattctgtgtattgagagagcattggctgatgctgggatttccaaagaacagataaactatataaatgcacatgcaacctctacaccagctggagaccttaaggagtaccaagcccttgctcactgctttggccaaaatcctgagataaaagttaattccacaaaatctatgattggacacttgctgggagctgctggggccgttgaagctgtcgcaactgtgcaggccataaggaccggatgggttcatccaaatatcaaccttgagagtccagacaatggagtggatacaaatttgctggtgggtcctgagaaggagagattggacattaaagcagccttgtcaaattcattcgggtttggtggccacaactccagcatcatttttgctccttacaagtga

SEQ ID NO: 20087 - protein, 433 aa, Brassica napus
MAVAMDMEKEAKVDNKPPTEQRRVVVTGMGVETSLGHDPDTFYENLLQGNSGISQIENFDCSAFPTRIAGEIKSFSTEGWVAPKLSKRMDKFMLYLLTAGKKALVDGGVTEEVMAEFDKAKCGVLIGSAMGGMKVFQDAIEAMKISYKKMNPFCVPFATTNMGSAMLALDLGWMGPNYSISTACATSNFCILNSANHIIKGEADVMLCGGSDSVIIPIGLGGFVACRALSQRNNDPTKASRPWDSNRDGFVMGEGAGVLLLEELEHAKKRGATIYAEFLGGSFTCDAYHMTEPRPDGAGVILCIERALADAGISKEQINYINAHATSTPAGDLKEYQALAHCFGQNPEIKVNSTKSMIGHLLGAAGAVEAVATVQAIRTGWVHPNINLESPDNGVDTNLLVGPEKERLDIKAALSNSFGFGGHNSSIIFAPYK

SEQ ID NO: 20088 - DNA, 1467 bp, Glycine max
  CDS (1)..(1467)
atggcttcgaccaccacctcctccctctgcacgtggctcgttgctgcttgcatgtcagtcacgtgccacgccgaccgcaccaaaacccctcacgcaatgttccgctcctccaaaaagtctcgctactctcaattcaacgtttgtcgatccactcattctggtaaaacaatggctgtagctttgcaacctacccaagggatcacgacaataaaaaaacctcccacgaagcaaaggcgagtggttgtgacaggattgggtgtggttacaccacttgggcatgagccagatatcttctacaataatttgcttgatggtgctagtggcataagcgagattgaaacatttgattgtgcagatatcccaacaaggattgctggtgaaatcaagtctttctcaactgatggctgggtagcaccaaaactttctaagagaatggataaatttatgctctatatgctgacagctggcaaaaaagccttggttgatggtggaattactgatgatgtaatggatgagttatataaagacaagcgtggagttctgattgggtcagcaatgggtggcatgaaggttttcaatgatgccatcgaagctttacgaatctcatataagaagatgaatcctttttgtgtaccttttgcaacaacacatatgggttctgccatgcttgcaatggatctgggatggatgggccctaattattctatctctacagcttgtgctacaagtaacttttgtatattgaatgcagcaaaccatatcattagaggtgaagctgatgtgatgctttgtggaggctcagatgctgctattataccaattggtttgggaggctttgtggcatgcagggcactctcacaaaggaatactgatcctaccaaagcttcacgcccttgggacattaaccgtgatggatttgtcatgggtgaaggggctggagttttgcttttagaggaactggagcatgctaaggaaagaggtgcaacaatattggctgaattccttggtggaagtttcacctgtgatgcatatgatgtgactgagccgcgtcctgatggggctggtgttatactgtgcattgaaaaggcattagctcagtctggagtatcaaaagaggatgtgaattacataaatgcacatgccacatccacaccagctggagatcttaaggagtaccaagctctaatgcattgttttggtcaaaaccccgagttaagagtgaatctaacaaaatctatgattggtcatctactaggggcagctggcggtgtggaagctgtggccacaatacaggcaattaggacagggtgggttcatcccaatatcaacctagaaaacccagataacggagtggatgctaaagtgcttgttggctcaaagaaagagagactggatgtcaaggcagccttgtcgaattcatttggttttgggggtcacaattcttcaatcatatttgcaccatactag

SEQ ID NO: 20089 - protein, 488 aa, Glycine max
MASTTTSSLCTWLVAACMSVTCHADRTKTPHAMFRSSKKSRYSQFNVCRSTHSGKTMAVALQPTQGITTIKKPPTKQRRVVVTGLGVVTPLGHEPDIFYNNLLDGASGISEIETFDCADIPTRIAGEIKSFSTDGWVAPKLSKRMDKFMLYMLTAGKKALVDGGITDDVMDELYKDKRGVLIGSAMGGMKVFNDAIEALRISYKKMNPFCVPFATTHMGSAMLAMDLGWMGPNYSISTACATSNFCILNAANHIIRGEADVMLCGGSDAAIIPIGLGGFVACRALSQRNTDPTKASRPWDINRDGFVMGEGAGVLLLEELEHAKERGATILAEFLGGSFTCDAYDVTEPRPDGAGVILCIEKALAQSGVSKEDVNYINAHATSTPAGDLKEYQALMHCFGQNPELRVNLTKSMIGHLLGAAGGVEAVATIQAIRTGWVHPNINLENPDNGVDAKVLVGSKKERLDVKAALSNSFGFGGHNSSIIFAPY

SEQ ID NO: 20090 - DNA, 1410 bp, Glycine max
  CDS (1)..(1410)
atgcaagcgcttcattcccccaccctccgcacttctcccttggaccctcttcggggccccaacaatgccgccgccaagcgacgcgcctcctctgccaagcgcgtgttcttcgtgtccgccacggtggcgccgaaggtgtccgccccgcagcggcagaaggactcgaagaagcgcgtggttatcacgggaatggggctcgcgtcggtgttcgggaacgacgtggaggggtactacgagaagcttctcgccggcgagagcggcatcacccccatcgaccgcttcgacgcctccaagtttcccacgcgcttcggcggccagatccgcggcttctccgccgagggctacatcgacggcaagaacgaccgccgcctcgacgactgcctccgctactgcattgtcgccggcaaaaaggccctcgaaaacgccgaccttgccccagacaaccactccaagattgataaggagcgtgctggtgttcttgtaggctccggaatgggaggtttaacggtgttttctgacggtgttcaggctctgattgagaaggggcacaggaagataacgccgttttttattccgtatgccattactaacatgggttcggctttgcttgggatagaccttgggttcatgggtcccaactattctatatccacggcttgtgctacctccaactattgcttttatgctgcggcgaaccatattcggagaggggaggctgatttgatgattgcgggtgggactgaggctgccattattccaattgggttagggggtttcgttgcttgcagggcgctttcgcagaggaatgatgaccccaaaactgcttccaggccgtgggataaggaccgtgatggctttgttatgggcgaaggtgctggagttttggtaatggagagcttggaacatgccatgaagcgaggcgcacctattattgctgaatacttgggaggtgctgttaactgtgatgcttatcacatgactgatccaaggtctgatggacttggtgtgtctacatgcattcagagcagccttgaagatgcgggtgtgtcaccagaggaggtcaactacataaatgcacatgcaacttccactcttgctggagacttggcagagatcaatgctattaaaaaggttttcaaggacacttctggaatcaaaattaatgcaaccaagtctatgatagggcactgccttggtgcagctgggggtttggaagccattgccacagtgaaagccataacaacaggatggctgcatccaacaatcaatcaatttaacccagaacctgcagttgattttgatacagtggcaaatgtcaagcagcagcatgaaatcaacgttgccatttcaaattcatttggattcggtggacacaactctgtggtagcattttctgctttcaggccttga

SEQ ID NO: 20091 - protein, 469 aa, Glycine max
MQALHSPTLRTSPLDPLRGPNNAAAKRRASSAKRVFFVSATVAPKVSAPQRQKDSKKRVVITGMGLASVFGNDVEGYYEKLLAGESGITPIDRFDASKFPTRFGGQIRGFSAEGYIDGKNDRRLDDCLRYCIVAGKKALENADLAPDNHSKIDKERAGVLVGSGMGGLTVFSDGVQALIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDKDRDGFVMGEGAGVLVMESLEHAMKRGAPIIAEYLGGAVNCDAYHMTDPRSDGLGVSTCIQSSLEDAGVSPEEVNYINAHATSTLAGDLAEINAIKKVFKDTSGIKINATKSMIGHCLGAAGGLEAIATVKAITTGWLHPTINQFNPEPAVDFDTVANVKQQHEINVAISNSFGFGGHNSVVAFSAFRP

SEQ ID NO: 20092 - DNA, 1410 bp, Glycine max
  CDS (1)..(1410)
atgcaagcgcttcactctcccaccctccgcgcttctcccttggaccctcttcgtggccccaacaatgccgccgccaaccgccgctcctccagcgccaagcgcgtgttcttcgtctccgccacggtggcgccgaaggtgtccgccccgcagcgacagaaggaccccaagaagcgcgttgtgatcaccggaatgggcctcgcgtcggtgttcggtaacgacgtggagggttactacgagaagctcctcgccggcgagagcggcatcaccgccatcgaccgcttcgacgcctccaagttccccacgcgtttcggcggccagatccgcggcttctctgccgagggctacatcgacggcaagaacgaccgccgcctcgacgactgcctccgctactgcattgtcgccggcaaaaaggccctcgaaaacgccgaccttgcccccgacaaccactccaagattgataaggagcgtgctggtgttcttgtaggctctggaatgggaggcttaacggtgttttctgacggtgttcaggctctgattgagaaggggcacaggaagataacgccgtttttcattccttatgcaattactaacatgggttcggctttgcttgggatagaccttggattcatgggtcccaactactctatatccacggcttgtgctacttccaattattgcttttatgctgcggcgaaccatattcggagaggggaggctgatttgatgatagccggtgggactgaggctgccattattcctattgggttagggggttttgttgcttgcagagcgctttctcagaggaacgacgaccctaaaaccgcttccaggccatgggataaggaacgtgatggctttgttatgggtgaaggtgctggagttttggtaatggagagcttggagcatgctatgaagcgaggcgcacctattattgctgaatatttgggaggagctgttaactgtgatgcttatcacatgactgatccaaggtctgatggacttggtgtgtctacatgcattcagagcagccttgaagatgccggtgtgtcaccagaggaggtcaactacataaatgcacatgcaacttccactcttgctggagacttggcagaaattaatgctattaaaaaggttttcaaggacacttctggcatcaaaattaatgccaccaagtctatgatagggcactgccttggtgcagctgggggtttagaagccattgccacagtgaaagccataacaacaggatggctgcatccaacaatcaatcaatttaacccagaacctgcagttgattttgatacagtggcaaatgtcaagcagcagcatgaaatcaacgttgccatttcaaattcatttggattcggtggacacaactctgtggtggcattttctgctttcaagccttga

SEQ ID NO: 20093 - protein, 469 aa, Glycine max
MQALHSPTLRASPLDPLRGPNNAAANRRSSSAKRVFFVSATVAPKVSAPQRQKDPKKRVVITGMGLASVFGNDVEGYYEKLLAGESGITAIDRFDASKFPTRFGGQIRGFSAEGYIDGKNDRRLDDCLRYCIVAGKKALENADLAPDNHSKIDKERAGVLVGSGMGGLTVFSDGVQALIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDKERDGFVMGEGAGVLVMESLEHAMKRGAPIIAEYLGGAVNCDAYHMTDPRSDGLGVSTCIQSSLEDAGVSPEEVNYINAHATSTLAGDLAEINAIKKVFKDTSGIKINATKSMIGHCLGAAGGLEAIATVKAITTGWLHPTINQFNPEPAVDFDTVANVKQQHEINVAISNSFGFGGHNSVVAFSAFKP

SEQ ID NO: 20094 - DNA, 1722 bp, Elaeis guineensis var
  CDS (1)..(1722)
atggcgggatactcggtggcggcgccgctgtgcacgtggttggtggcagcgtgcgtgacggcgtcgggtggaaaggaggggcctttggcggcgccggcgccggcggtcggggaggcgaggcggttgagccggtcggcgaggaggcggagggcggcggcgctccgcctcgacgcccgggattcctctggaggactgatgtcggcgctccgtggatcggggatccaggggctgatgagctcctgcctcgccttcgagccctgcgcggagttctacggctctaagggcgcgtcggctttcttcggagagagtggcttctccctctttgggacgtcgaaggcggagactacgagaaggcagcgaagggccgcgcgcgcctcttgcgtctcgggcaaagcaatggcagtagctgtgcagcctgctaaggaaattgcagaaaagaagagaacccatacaaagaagaggagagtggtcgtgacagggatgggtgtggtgactccactgggcgttgatcctggtatcttctacaataaccttcttgatggtgtcagtggtataagtcaaattgaaacatttgactgtaccaactatccaacaagaattgcaggagaaattaaatctttttcaacagatggattggtggcacctaaattatctaaacgaatggacaaattcatgctctatttacttattgctggaaagaaagcattagccaatggtggggttactgaagaggtcatgagtcagcttgacaaggcaaaatgcggagtgctcataggctctgcgatgggtggaatgaaggtttttaatgatgccatcgaagctttaagggtctcatataagaagatgaatccattttgtgttccatttgcaacgacaaacatgggttctgcaatccttgccatggatctgggttggatgggcccaaattactctatttcaactgcttgtgctacaagcaatttctctatcctgaatgcagcaaaccatataataagaggggaagctgatgtgatgctttgtggtggatcagatgctgctattataccaattggactggggggttttgttgcttgcagagcactctcgcagagaaatagtgatccgactaaagcgtcacggccttgggacattgatcgtgatggattcgtgatgggggagggggctggcgtgcttctactggaagaattagagcatgctaagcaaagaggagcaaatatctatgctgaatttcttgggggaagcttcacatgtgatgcttaccacatgactgagccacatcctgagggggcaggcattgctctttgcattgagaacgcattagcacaagcaggggtagccaaagaagatgttaattatgtaaatgctcatgcaacttcaacacctgctggtgacctaaaagagtatcaagctctcattcgttgttttgggcagaatcctgagctgagagtgaactctacaaaatcaatgattggtcacctactaggagcttctggtgcggtggaagctgttgctgcaattcaggcaattcgaacagggtgggtccatccaaatgtcaatctcgaaaacccagaaaaaagtgtggatataaatgtgctggtgggctcgagaaaggaaaggttggatgtgaaggtggcattatcaaactcattcgggtttggtggtcacaactcgtctatcttgtttgcacctacaaatagtcatggaaagaacttcagatgttaa

SEQ ID NO: 20095 - protein, 573 aa, Elaeis guineensis var
MAGYSVAAPLCTWLVAACVTASGGKEGPLAAPAPAVGEARRLSRSARRRRAAALRLDARDSSGGLMSALRGSGIQGLMSSCLAFEPCAEFYGSKGASAFFGESGFSLFGTSKAETTRRQRRAARASCVSGKAMAVAVQPAKEIAEKKRTHTKKRRVVVTGMGVVTPLGVDPGIFYNNLLDGVSGISQIETFDCTNYPTRIAGEIKSFSTDGLVAPKLSKRMDKFMLYLLIAGKKALANGGVTEEVMSQLDKAKCGVLIGSAMGGMKVFNDAIEALRVSYKKMNPFCVPFATTNMGSAILAMDLGWMGPNYSISTACATSNFSILNAANHIIRGEADVMLCGGSDAAIIPIGLGGFVACRALSQRNSDPTKASRPWDIDRDGFVMGEGAGVLLLEELEHAKQRGANIYAEFLGGSFTCDAYHMTEPHPEGAGIALCIENALAQAGVAKEDVNYVNAHATSTPAGDLKEYQALIRCFGQNPELRVNSTKSMIGHLLGASGAVEAVAAIQAIRTGWVHPNVNLENPEKSVDINVLVGSRKERLDVKVALSNSFGFGGHNSSILFAPTNSHGKNFRC

SEQ ID NO: 20096 - DNA, 1248 bp, Vibrio marinus
  CDS (1)..(1248): transl_table=11
gtggctaataatagaagagttgtaattacaggattaggaattgtttcaccggttggcaacacagttgcaactgcatgggaagcgattaaatctggtatcagcggcattgaaaatattgagcactttgataccactaatttttcaacaaagtttgctggcttagttaatgactttgacgcagaatctgtcggaattaatcgtaaagactgccgtaaaatggatttattcattcagtatggtattgcagctgcagagcaagctttaacagactctggcttagagattactgaacagaatgcaacacgtattggtaccgctatcggctctggtatcggtggtttaggtcttattgaacaaaacgtacatagttttggtaaaggcggggcaccgaaagtaagcccattttttgtccctgctacaatcgtgaatatggttgcagggcatgtttcaattcgtaataatcttaaaggcccaaatattgccattgcgacagcatgtacgtctggtacgcactgtattggccaatctgcacgtatgatcgcatatggtgatgcagatgtaatggttgccggtggtgccgagaaagcatcgactgaaatgggcttggctggttttggttctgctaaggcactttcaacccgtaatgacgacccgcagaaagcaagtcgaccttgggacaaagaccgcgatggctttgtactaggtgatggcgccggtgtattagtgatggaagagtatgaacacgccgttgctcgtggtgctactatttatgctgaattagctggttttggtatgagtggcgatgcatttcacatgacatcaccacctgaagacggtgcaggcgctgcattatcaatgaataatgcgattgctgacgcaggtattaccgcagataaagtgggttatgtgaacgctcatggtacatcaacacctgctggtgataaagctgaaacagccgctgtaaaatcagtgtttggtgaacatgcctatacacttgcagttagctctacaaaatcaatgaccggtcatctattaggtgctgctggtgcaattgaagctatcttcactattttggcattgaaagatcaaatattaccgccaacaattaacttggaaaatccaagcgaaggttgtgatcttgattatgtaactgacggtgctcgccccgtgaatatggaatacgcattatccaattcatttggtttcggcggtactaacggttctctgctatttaaaaaagcagactaa

SEQ ID NO: 20097 - protein, 415 aa, Vibrio marinus
MANNRRVVITGLGIVSPVGNTVATAWEAIKSGISGIENIEHFDTTNFSTKFAGLVNDFDAESVGINRKDCRKMDLFIQYGIAAAEQALTDSGLEITEQNATRIGTAIGSGIGGLGLIEQNVHSFGKGGAPKVSPFFVPATIVNMVAGHVSIRNNLKGPNIAIATACTSGTHCIGQSARMIAYGDADVMVAGGAEKASTEMGLAGFGSAKALSTRNDDPQKASRPWDKDRDGFVLGDGAGVLVMEEYEHAVARGATIYAELAGFGMSGDAFHMTSPPEDGAGAALSMNNAIADAGITADKVGYVNAHGTSTPAGDKAETAAVKSVFGEHAYTLAVSSTKSMTGHLLGAAGAIEAIFTILALKDQILPPTINLENPSEGCDLDYVTDGARPVNMEYALSNSFGFGGTNGSLLFKKAD

SEQ ID NO: 20098 - DNA, 1260 bp, Streptomyces rochei
  CDS (1)..(1260): transl_table=11
atgagacgggtcgtcatcaccgggatcggggtggtcgcgccgggcggcgtcggcaccgcggacttctgggcgctgctgaccgaggggcgtaccgccacccgccgtatcaccctcttcgacgcctcctcgttccgctcccggatcgccgccgaggccgacttcgaccccgccgggcacggtttcgctcccgacgaggcgcgccgcctggaccgcgtcgcgcagttcgccctggtcgcggcgcgggaggcggtcgccgacagcgggctcgtgctcgccgccgagggggagcgcaccggggtgagcctgggcaccgcggtcggatgcagcagcggcctcgacgagacctacgcacacgtcagcgagtcgggcagccgctggctgctggatccgcacggccgaggccggctcggggactacctcgtgcccagctcggtcgccgccgaggtcgcccgcgacagcgcgctgggctcggtcgccgtcgtgtccacgggctgcacctcgggactcgacgcgctcggccacgcgaccgagctgatccgcgagggcagcgccgacatcatggtggcgggcggcgcggaagcccccatcacccccatcaccctcgcctcgttcgacgccatccgcgccacctcggcgcgcaacgacgagcccgagaccgcctcccgcccctacgaccgcacccgcgacgggttcgtgctcggcgagggcagcgcggtgctcgtcctggaggagcacgaccgggcggtacggcgcggcgcccgcatctacccggaggtgagcgggttcgccactcgctccaacgcctatcacatgaccggactgcgcccggacggcggggagatggccgaggccatccgggtcgccctggacgaggcccgcctgaaccccgcggacgtccactacgtcaacgcccacggttcggggaccaagcagaacgaccggcacgagacggccgcgttcaaggcgagcctcgggcagcacgcccaccgggtgccggtcagctccgtcaagtcgatgatcgggcactcgctcggcgccatcggcgcgctcgaaatcgccgccagcgcgctggccatcgcccatgacacggtgccgcccaccgccaacctgcacgaggccgacccggcctgcgacctcgactacacgccgctgaccgcacgcgagcagcgcaccgacacggtgctcagcgtcggcagcggcttcggcggtttccagagcgcgatggtgctcaccagccggcacacgggggcggccgcgtga

SEQ ID NO: 20099 - protein, 419 aa, Streptomyces rochei
MRRVVITGIGVVAPGGVGTADFWALLTEGRTATRRITLFDASSFRSRIAAEADFDPAGHGFAPDEARRLDRVAQFALVAAREAVADSGLVLAAEGERTGVSLGTAVGCSSGLDETYAHVSESGSRWLLDPHGRGRLGDYLVPSSVAAEVARDSALGSVAVVSTGCTSGLDALGHATELIREGSADIMVAGGAEAPITPITLASFDAIRATSARNDEPETASRPYDRTRDGFVLGEGSAVLVLEEHDRAVRRGARIYPEVSGFATRSNAYHMTGLRPDGGEMAEAIRVALDEARLNPADVHYVNAHGSGTKQNDRHETAAFKASLGQHAHRVPVSSVKSMIGHSLGAIGALEIAASALAIAHDTVPPTANLHEADPACDLDYTPLTAREQRTDTVLSVGSGFGGFQSAMVLTSRHTGAAA

SEQ ID NO: 20100 - DNA, 1689 bp, Arabidopsis thaliana
  CDS (1)..(1689)
atggtgggtgcgtcttcctcttacgcatctccgttatgtacctggtttgttgctgcttgcatgtccgtctctcacggtggaggagatagccgtcaggctgttgctcttcaatctggtgggcggagtcggcgaaggaggcagcttagcaaatgctctgtcgcttctggatccgctagcattcaggctctcgtcacttcttgtttggattttggtccttgtactcactacaacaacaacaatgcattgtcttctctctttggatcgaatagtgtttctttgaatcgaaaccagaggagattgaatcgtgctgctagctccggtggagccatggcagtgatggagatggaaaaggaagctgcggttaacaagaaaccacctacggagcagcgtcgagttgtagtgacaggcatgggagttgaaacatcattgggtcatgacccacataccttctatgagaatttgctacaaggcaacagtggtattagccagattgaaaattttgattgttctgaatttcctacgaatatctttctttgttttacctttgtcaagcgaattgcgggagagatcaaaagcttctcgactgaaggatgggttgctccaaaactttctaaaaggatggacaaattcatgctctatcttctcacagctggtaagaaagctttggctgatggtggggttactgatgaagtaatggcagagtttgacaaaaccaaatgtggagttttgattggctcggcaatgggaggaatgaaggtcttttacgatgctattgaagctctgagaatctcttacaagaagatgaatcctttttgtgtaccttttgcgacaacaaacatgggttctgctatgcttgccatggatctgggatggatggggccaaactattctatttcaactgcttgtgccacaagcaacttttgcattctgaattcagcaaaccacattattaaaggtgaagctgtaagtatcctccatacacttggaaattcgacagatgtaatgctctgtggtggctcagatgcagttattattccaatagggttgggaggttttgttgcatgccgggctctttcacaaaggaataatgatcccacaaaagcttcacgtccttgggataccaatcgagatggtttcgtgatgggagagggagctggagttctacttttggaagaactcgagcatgctaagaaaagaggtgcaactatctacgcagagttcctcggtgggagtttcacatgtgatgcctatcacatgaccgagcctcaccctgatggggctggtgttattctctgtattgagagagcgttagctagtgctgggatttccaaggaacaaataaattacataaatgcacatgcaacctcaacgcatgctggagatattaaggaataccaagcccttgctcactgttttggccaaaatcctgagcttaaggtaaattccacaaaatctatgattggacacttgctgggagctgctggggccgtggaggctgttgcaactgtgcaggcgatacggaccggatgggttcatccaaatatcaacctcgagaatccagacagtggagtggatacaaagctgctggtgggtcctaagaaggagagactggacattaaagcagccttgtcaaattcattcgggtttggtggtcataactccagcatcatttttgctccttacaagtga

SEQ ID NO: 20101 - protein, 562 aa, Arabidopsis thaliana
MVGASSSYASPLCTWFVAACMSVSHGGGDSRQAVALQSGGRSRRRRQLSKCSVASGSASIQALVTSCLDFGPCTHYNNNNALSSLFGSNSVSLNRNQRRLNRAASSGGAMAVMEMEKEAAVNKKPPTEQRRVVVTGMGVETSLGHDPHTFYENLLQGNSGISQIENFDCSEFPTNIFLCFTFVKRIAGEIKSFSTEGWVAPKLSKRMDKFMLYLLTAGKKALADGGVTDEVMAEFDKTKCGVLIGSAMGGMKVFYDAIEALRISYKKMNPFCVPFATTNMGSAMLAMDLGWMGPNYSISTACATSNFCILNSANHIIKGEAVSILHTLGNSTDVMLCGGSDAVIIPIGLGGFVACRALSQRNNDPTKASRPWDTNRDGFVMGEGAGVLLLEELEHAKKRGATIYAEFLGGSFTCDAYHMTEPHPDGAGVILCIERALASAGISKEQINYINAHATSTHAGDIKEYQALAHCFGQNPELKVNSTKSMIGHLLGAAGAVEAVATVQAIRTGWVHPNINLENPDSGVDTKLLVGPKKERLDIKAALSNSFGFGGHNSSIIFAPYK

SEQ ID NO: 20102 - DNA, 1605 bp, Cuphea hookeriana
  CDS (1)..(1605)
atggcgaccgcttcttgcatggttgcgtcccctttctgtacgtggctcgtagctgcatgcatgcccacttcatccgacaacgacccacgttccctttcccacaagcggctccgcctctcccgtcgccggaggactctctcctcccattgctccctccgcggatccaccttccaatgcctcgatccttgcaaccagcaacgcttcctcggggataacggattcgcttccctcttcggatccaagcctcttcgttcaaatcgcggccacctgaggctcggccgcacttcccattccggggaggtcatggctgtggctatgcaacctgcacaggaagtctccacaaataagaaacctgctaccaagcaaaggcgagtagttgtgacaggtatgggcgtggtgactcctctaggccatgaccccgatgtttactacaacaatctcctagacggaataagtggcataagtgagatagagaacttcgactgctctcagtttcccacgagaattgccggagagatcaagtctttttccacagatggctgggtggccccaaagttctccgagaggatggacaagttcatgctttacatgctgactgcaggcaagaaagcattagcagatggtggaatcactgaagatgcgatgaaagagctcaataaaagaaagtgtggagttctcattggctccggattgggcggtatgaaggtattcagcgattccattgaagctctgaggacttcatataagaagatcagtcccttttgtgtacctttttctaccacaaatatgggatccgctattcttgcaatggacttgggatggatgggccctaactattcgatatcaactgcctgtgcaacaagtaacttctgtatactgaatgctgcgaaccacataatcaaaggcgaagcagacatgatgctttgtggtggctcggatgcggccgttttacctgttggtttgggaggtttcgtagcatgccgagctttgtcacagaggaataatgaccctaccaaagcttcgagaccatgggacagtaatcgtgatggatttgtgatgggagaaggagctggagttttacttcttgaggagttagagcatgcaaagaaaagaggtgcaaccatttatgcggaatttctaggtgggagtttcacttgcgacgcctaccacatgaccgagcctcaccctgaaggagctggtgtgatcctctgcatagagaaggccttggctcagtccggagtctcgagggaagacgtaaattacataaatgcgcatgcaacttccactcctgctggagatatcaaggaataccaagctctcgcccactgtttcggccaaaacagtgagctgagagtgaattccaccaaatcgatgatcggtcaccttcttggaggagctggtggcgtagaagcagttgcagtagttcaggcaataaggacaggatggatccatccaaatattaatttggaagacccggacgaaggcgtggatgcaaaactgctcgtcggccctaagaaggagaaactgaaggtcaaggtcggtttgtccaattcatttgggttcggcggccataactcatccatactatttgccccctgcaactag

SEQ ID NO: 20103 - protein, 534 aa, Cuphea hookeriana
MATASCMVASPFCTWLVAACMPTSSDNDPRSLSHKRLRLSRRRRTLSSHCSLRGSTFQCLDPCNQQRFLGDNGFASLFGSKPLRSNRGHLRLGRTSHSGEVMAVAMQPAQEVSTNKKPATKQRRVVVTGMGVVTPLGHDPDVYYNNLLDGISGISEIENFDCSQFPTRIAGEIKSFSTDGWVAPKFSERMDKFMLYMLTAGKKALADGGITEDAMKELNKRKCGVLIGSGLGGMKVFSDSIEALRTSYKKISPFCVPFSTTNMGSAILAMDLGWMGPNYSISTACATSNFCILNAANHIIKGEADMMLCGGSDAAVLPVGLGGFVACRALSQRNNDPTKASRPWDSNRDGFVMGEGAGVLLLEELEHAKKRGATIYAEFLGGSFTCDAYHMTEPHPEGAGVILCIEKALAQSGVSREDVNYINAHATSTPAGDIKEYQALAHCFGQNSELRVNSTKSMIGHLLGGAGGVEAVAVVQAIRTGWIHPNINLEDPDEGVDAKLLVGPKKEKLKVKVGLSNSFGFGGHNSSILFAPCN

SEQ ID NO: 20104 - DNA, 1641 bp, Cuphea pulcherrima
  CDS (1)..(1641)
atgcctgccgcctcttccctgctcgcttcccctctctgtacgtggctccttgccgcctgcatgtctacctccttccacccctccgaccctcttccgccttccatctcctctcctcgccgacgcctctcccgccgccggattctctcccaatgcgccccactaccttctgcttcctccgccctccgcggatccagtttccataccctcgtcacctcttacctcgcctgcttcgagccctgccatgactactatacatccgcatccttgttcggatccagacccattcgcaccacccgcaggcaccggaggctcaatcgagcttccccttccagggaggcaatggccgtggctctgcaacctgaacaggaagttaccacaaagaagaagccaagtatcaaacagcggcgagtagttgtgactggaatgggtgtggtgactcctctaggccatgaccctgatgttttctacaataatctgcttgatggaacgagtggcataagcgagatagagacctttgattgtgctcaatttcctacgagaattgctggagagatcaagtctttctccacagatggttgggtggccccgaagctctctaagaggatggacaagttcatgctatacatgctgaccgctggcaagaaagcattaacagatggtggaatcaccgaagatgtgatgaaagagctagataaaagaaaatgcggagttctcattggctcagcaatgggtggaatgaaggtattcaatgatgccattgaagccctaaggatttcatataagaagatgaatcccttttgtgtacctttcgctaccacaaatatgggatcagctatgcttgcaatggacttgggatggatggggcccaactactcgatatctactgcttgtgcaacgagtaacttttgtataatgaatgctgcgaaccatataatcagaggcgaagcagatgtgatgctttgcgggggctcagatgcggtaatcatacctattggtatgggaggttttgttgcatgccgagctttgtcccagagaaattccgaccctactaaagcttcaagaccatgggacagtaatcgtgatggatttgttatgggggaaggagctggagtgctactactagaggagttggagcatgcaaagaaaagaggtgcgactatttacgcagaatttctaggtgggagtttcacttgcgatgcctaccacatgaccgagcctcaccctgatggagctggagtgattctctgcatagagaaggctttggctcagtcaggagtctctagggaagacgtaaattacataaatgcccatgccacatccactccggctggagatatcaaagagtaccaagctcttatccactgtttcggccaaaacagagagttaaaagttaattcaaccaaatcaatgattggtcaccttctcggagcagccggtggtgtggaagcagtttcagtagttcaggcaataaggactgggtggatccatccgaatattaatttggaaaacccagatgaaggcgtggatacaaaattgctcgtgggtcctaagaaggagagactgaacgttaaggtcggtttgtctaattcatttgggtttggtgggcacaactcgtccatactcttcgccccttacatctag

SEQ ID NO: 20105 - protein, 546 aa, Cuphea pulcherrima
MPAASSLLASPLCTWLLAACMSTSFHPSDPLPPSISSPRRRLSRRRILSQCAPLPSASSALRGSSFHTLVTSYLACFEPCHDYYTSASLFGSRPIRTTRRHRRLNRASPSREAMAVALQPEQEVTTKKKPSIKQRRVVVTGMGVVTPLGHDPDVFYNNLLDGTSGISEIETFDCAQFPTRIAGEIKSFSTDGWVAPKLSKRMDKFMLYMLTAGKKALTDGGITEDVMKELDKRKCGVLIGSAMGGMKVFNDAIEALRISYKKMNPFCVPFATTNMGSAMLAMDLGWMGPNYSISTACATSNFCIMNAANHIIRGEADVMLCGGSDAVIIPIGMGGFVACRALSQRNSDPTKASRPWDSNRDGFVMGEGAGVLLLEELEHAKKRGATIYAEFLGGSFTCDAYHMTEPHPDGAGVILCIEKALAQSGVSREDVNYINAHATSTPAGDIKEYQALIHCFGQNRELKVNSTKSMIGHLLGAAGGVEAVSVVQAIRTGWIHPNINLENPDEGVDTKLLVGPKKERLNVKVGLSNSFGFGGHNSSILFAPYI

SEQ ID NO: 20106 - DNA, 1329 bp, Saccharomyces cerevisiae
  CDS (1)..(1329)
atgtcaagaagagtggttatcacaggattgggctgtgtaacgccgttgggaagatcattaagtgagtcatgggggaatctgctctcttccaaaaatggactcacaccaatcacatctttgcccaactataatgaggactacaaactcagagaaaaaagtatcccatcaacgataacagtggggaagattccagagaattttcaaaacgaaaattcagccatcaataaactgctgttcactagccaggatgagagaagaacctcaagctttatcaagctagcactacgtacaacttatgaagcgcttcacaatgctggtctcttgaacccaaatgatataaccatcaatacatctctgtgcaatctggatcactttggttgcctgataggttctggtataggatccattcaagacatataccaaacttctctacaattccataacgacaataaaagaataaatccatatttcgtccctaaaatccttacaaatatggcagctggtaatgtttccatcaagtttaaccttagaggattatcccatagtgtttccacagcatgcgcaacaggtaataactccattggcgatgcattcaattttattcggttaggcatgcaagacatctgtgtcgccggtgcaagtgaaacgagtttgcatccgttaagtttagcaggtttcatcagagcaaagtcgattactacaaacgggatctctagaccctttgatacacaacgttctggattcgtacttggtgaaggatgcggaatgattgtcatggaatcgctagaacatgctcaaaagagaaatgcaaacataatttctgagctcgtgggctatggtttaagcagtgatgcctgccatattacctcccctcctgctgatggaaatggtgccaaaagagcaatagagatggctctaaaaatggctagattagaaccaactgatgttgactacgtcaatgcacatgctacatcaactttactaggcgataaagcagagtgtctggcagtagcctcagcactcttaccaggaagatccaaaagcaagccactgtacatatccagtaacaaaggtgcaattggccatcttttaggtgcagctggcgccgtagaaagtatatttacaatttgttccttgaaggatgataagatgccgcataccttaaacctggacaatgttctgactctagaaaataacgaggccgataagctacatttcataagagacaaacctattgtgggagctaatccgaagtacgcattatgcaacagcttcggatttggaggagttaacacatctcttctcttcaagaaatgggaagggagttaa

SEQ ID NO: 20107 - protein, 442 aa, Saccharomyces cerevisiae
MSRRVVITGLGCVTPLGRSLSESWGNLLSSKNGLTPITSLPNYNEDYKLREKSIPSTITVGKIPENFQNENSAINKLLFTSQDERRTSSFIKLALRTTYEALHNAGLLNPNDITINTSLCNLDHFGCLIGSGIGSIQDIYQTSLQFHNDNKRINPYFVPKILTNMAAGNVSIKFNLRGLSHSVSTACATGNNSIGDAFNFIRLGMQDICVAGASETSLHPLSLAGFIRAKSITTNGISRPFDTQRSGFVLGEGCGMIVMESLEHAQKRNANIISELVGYGLSSDACHITSPPADGNGAKRAIEMALKMARLEPTDVDYVNAHATSTLLGDKAECLAVASALLPGRSKSKPLYISSNKGAIGHLLGAAGAVESIFTICSLKDDKMPHTLNLDNVLTLENNEADKLHFIRDKPIVGANPKYALCNSFGFGGVNTSLLFKKWEGS

SEQ ID NO: 20108 - DNA, 1251 bp, Mycobacterium leprae
  CDS (1)..(1251): transl_table=11
gtgaccatgccttccactgctaatggcggtttccccagtgttgtggtgaccgctgtcacagcaacgacgtcaatctcgccggacatcgaaagcacgtggaagggtctgttggccggcgagagcggcatccacgtactcgaagacgagtacatcaccaagtgggacctgccagtcaagatcggcggccacctcaaggagccagtcgatagccacatgagccgcctggacctgcggcgcatgtcgtacgtccagcggatgagcaagctgctcagcggtcgactatgggagtccaccggcagcccggaggtcgatcccgaccggttcaccgtcgtggtcggcaccggtctgggcggcgccgagcgaatcgtggaaagctacgacctgatgaacgcgggcggaccccgtaaggtgtccccgctcgccgttcagatgatcatgcccaacggcgccgcagcgaccgtcgggctacagcttggggcatgcgccggggtgatgacaccggtgtcggcctgctcgtcgggctctgaggcaatcgcacacgcctggcgccagatcatcatgggagatgcagatgtcgccgtctgtggcggtgtcgagggcccgatcgaggcgctgcctatcgcggcgttctcgatgatgcgagccatgtcgacccgtaacgacgaccccgagggggcatctcggccattcgacaaaaatcgtgacgggtttgtgttcggcgaagccggagccctgatgctcatcgagactgaggagcacgccaaggctcgcggcgccaagccgctggctcggttgcttggtgcaggcatcacctcggacgcctttcatatggtggcacccgcggccgacggcgtgcgagcagggcgggcaatgacccggtcgctggagctggcgggtttgtcggcgaaggacgtggaccacgtcaacgcgcacgggacagcaacgccgatcggcgacagcgcggaggccaacgccatcagggtcgccggttgcgaacaggctgcggtgtatgcgccaaagtcagcactgggccactccatcggcgcggtcggcgcgcttgagtctgtcctgacggtgctggcccttcgcgacggtgtcatcccacccacactgaactaccaaaccccagatcccgagatcgacctagacattgtcgcaggtgaacctcgctacggcgactaccgttacgcgatcaataactccttcgggttcggtggccacaacgtggcgctcgcttttgggcgctactaa

SEQ ID NO: 20109 - protein, 416 aa, Mycobacterium leprae
MTMPSTANGGFPSVVVTAVTATTSISPDIESTWKGLLAGESGIHVLEDEYITKWDLPVKIGGHLKEPVDSHMSRLDLRRMSYVQRMSKLLSGRLWESTGSPEVDPDRFTVVVGTGLGGAERIVESYDLMNAGGPRKVSPLAVQMIMPNGAAATVGLQLGACAGVMTPVSACSSGSEAIAHAWRQIIMGDADVAVCGGVEGPIEALPIAAFSMMRAMSTRNDDPEGASRPFDKNRDGFVFGEAGALMLIETEEHAKARGAKPLARLLGAGITSDAFHMVAPAADGVRAGRAMTRSLELAGLSAKDVDHVNAHGTATPIGDSAEANAIRVAGCEQAAVYAPKSALGHSIGAVGALESVLTVLALRDGVIPPTLNYQTPDPEIDLDIVAGEPRYGDYRYAINNSFGFGGHNVALAFGRY

SEQ ID NO: 20110 - DNA, 1221 bp, Haemophilus influenzae
  CDS (1)..(1221): transl_table=11
atgagaagaactgtaattacaggctttgggattatttcaagtatcggtaacaacaaagaagaagtattggcttcattaaaagcagggaaatcaggtattgaagttgtgcctgagtttgtagaaatgaatatgcgtagccatgttgccggaacaatcaaattaaacccaagcgagcacattgatcgtaaagtgttccgttttatgggtgatgcagcggcttatgcttatctttctatgcgtgaagcgattgaggatgctggcttaacagaagatcaagtttctaatgatcgtactggtttagtgattggtgcgggtacgggttctgcacataaccagttagtggcttgtgatgcggtgcgtggtcctagaggtgtaaaggcgattggtccttacgcagtaacgaaaacaatggcatcaagtgtttctgcctgtttagctactccttataaaatccgtggtgtgaactattcaatgagttctgcttgtgcaacctctgcacattgtatcggtcatgcggttgagttaattcaattaggcaaacaagatgtggtttttgcaggtggtgcggaagaattatcttgggaatgtgcaactgaatttgatgcgatgggtgccgtttcaactaaatacaatgaaacgccagaaaaagcatctcgtgcttatgacgcaaatcgtgacggtttcgttattgcaggtggtggtgctgttgtggttgtggaagaattagaacatgcacttgctcgtggtgcaaaaatttacgctgaaattgtaggttatggcgcaacttctgatggttacgatatggttgcaccaagtggtgaaggtgcagagcgttgtatgaaacaagcaatggcaactgtcgataccccaattgattacattaatgtacatggcacatctacaccagtaggtgacgtgaaagaattaggtgcaatcaaaaatgtatttggtgacaaaatcccagcgatttcttcaactaaatcaatgactggtcactctttaggtgcggcgggtgcacacgaagcaatttacacgttattaatgttggataatgattttattgcaccaagtattaatatcgaaaccttagatgaagccgctgaaggttgcaacatcgttactgagacgaaagaaaatgcaggattacaaactgtcatgtcaaacagctttggttttggtggtacaaatgcgacattaatttttaaacgttataacggttaa

SEQ ID NO: 20111 - protein, 406 aa, Haemophilus influenzae
MRRTVITGFGIISSIGNNKEEVLASLKAGKSGIEVVPEFVEMNMRSHVAGTIKLNPSEHIDRKVFRFMGDAAAYAYLSMREAIEDAGLTEDQVSNDRTGLVIGAGTGSAHNQLVACDAVRGPRGVKAIGPYAVTKTMASSVSACLATPYKIRGVNYSMSSACATSAHCIGHAVELIQLGKQDVVFAGGAEELSWECATEFDAMGAVSTKYNETPEKASRAYDANRDGFVIAGGGAVVVVEELEHALARGAKIYAEIVGYGATSDGYDMVAPSGEGAERCMKQAMATVDTPIDYINVHGTSTPVGDVKELGAIKNVFGDKIPAISSTKSMTGHSLGAAGAHEAIYTLLMLDNDFIAPSINIETLDEAAEGCNIVTETKENAGLQTVMSNSFGFGGTNATLIFKRYNG

SEQ ID NO: 20112 - DNA, 1266 bp, Rhizobium meliloti
  CDS (1)..(1266): transl_table=11
atgagacgtgtcgttatcaccggtaccggcatggtatctcctctgggttgcggaaccgaagtcagctgggcgcgtcttctgaccggcgacaacgcggcccgcaaggtcaccgagttcgaggtcgaggaccttcccgccaagattgcctgccgcattcccttcggcgatggcagcgacggcacgttcaatgccgacgactggatggagcccaaggaacagcgcaaggtcgatcctttcatcgtctatgcgatggccgctgccgacatggcgctggcggatgccggctggaaacccgaaagcgacgaagaccagatttcgaccggcgtcctgatcggctccggcatcggcgggctggaaggtatcgtcgatgcgggttacaccctgcgcgacaagggcccgcggcgtatttccccgttcttcattcccggccggctgatcaatctcgcagccggtcaggtttccatccgccacaagctgcggggtcccaaccattccgtcgtgacggcctgctcgaccggcgcgcatgcgatcggcgacgccagccggctgatcgcgctcggggatgcggacgtgatggtggccggtggtacggaatctccgatctgccggatatcgctcgcaggattcgccgcctgcaaggcgctctcgacacagcacaacgacaatcccgagaaggcctcgcggccctatgacgccgatcgtgacggcttcgtcatgggcgagggtgcgggcatcgtcgttctggaagaactggagcacgcaagggcgcgcggtgccaagatctacgcagaagtgatcggttacggcctgtccggcgacgccttccacatcactgctccgtccgaagacggcgaaggcgcttaccgctgcatgcagatggcgctgaagcgcgcgggcgtcacggctgcggacatcgactatatcaacgctcacggaacatcgacgatggccgacacgatcgagctcggcgcggtcgaacggctggtcggcgacagcgcgtcgaggatctccatgtcctcgacgaagtcggccatcggacatttgctcggcgcagccggcgcggtcgaagccatcttctcggcgctcgcaattcgcgacaatatagccccgccgacgctcaacctggacaacccttccgtcgagacgaagatcgatctcgtgccgcatgtcgcgcgcaagcgcgagatcaatgtggccctgtcgaactcgttcggtttcggcggcaccaacgcgtcgttgattctgcgccgttacaccggccattga

SEQ ID NO: 20113 - protein, 421 aa, Rhizobium meliloti
MRRVVITGTGMVSPLGCGTEVSWARLLTGDNAARKVTEFEVEDLPAKIACRIPFGDGSDGTFNADDWMEPKEQRKVDPFIVYAMAAADMALADAGWKPESDEDQISTGVLIGSGIGGLEGIVDAGYTLRDKGPRRISPFFIPGRLINLAAGQVSIRHKLRGPNHSVVTACSTGAHAIGDASRLIALGDADVMVAGGTESPICRISLAGFAACKALSTQHNDNPEKASRPYDADRDGFVMGEGAGIVVLEELEHARARGAKIYAEVIGYGLSGDAFHITAPSEDGEGAYRCMQMALKRAGVTAADIDYINAHGTSTMADTIELGAVERLVGDSASRISMSSTKSAIGHLLGAAGAVEAIFSALAIRDNIAPPTLNLDNPSVETKIDLVPHVARKREINVALSNSFGFGGTNASLILRRYTGH

SEQ ID NO: 20114 - DNA, 1251 bp, Synechocystis sp
  CDS (1)..(1251): transl_table=11
atggcaaatttggaaaagaaacgtgttgttgtaacgggattgggagccatcacccccatcggtaatactctccaagactattggcaaggcttaatggagggtcgtaacggcattggccccattacccgtttcgatgctagtgaccaagcctgccgttttggaggggaagtaaaggattttgatgctacccagtttcttgaccgcaaagaagctaaacggatggaccggttttgccattttgctgtttgtgccagtcaacaggcaattaacgatgctaagttggtgattaacgaactcaatgccgatgaaatcggggtattgattggcacgggcattggtggtttgaaagtactggaagatcaacaaaccattctgttggataagggtcctagccgttgcagtccttttatgatcccgatgatgatcgccaacatggcctctgggttaaccgccatcaacttaggggccaagggtcccaataactgtacggtgacggcctgtgcggcgggttccaatgccattggagatgcgtttcgtttggtgcaaaatggctatgctaaggcaatgatttgcggtggcacggaagcggccattaccccgctgagctatgcaggttttgcttcggcccgggctttatctttccgcaatgatgatcccctccatgccagtcgtcccttcgataaggaccgggatggttttgtgatgggggaaggatcgggcattttgatcctagaagaattggaatccgccttggcccggggagcaaaaatttatggggaaatggtgggctatgccatgacctgtgatgcctatcacattaccgccccagtgccggatggtcggggagccaccagggcgatcgcctgggccttaaaagacagcggattgaaaccggaaatggtcagttacatcaatgcccatggtaccagcacccctgctaacgatgtgacggaaacccgtgccattaaacaggcgttgggaaatcatgcctacaatattgcggttagttctactaagtctatgaccggtcacttgttgggcggctccggaggtatcgaagcggtggccaccgtaatggcgatcgccgaagataaggtaccccccaccattaatttggagaaccccgaccctgagtgtgatttggattatgtgccggggcagagtcgggctttaatagtggatgtagccctatccaactcctttggttttggtggccataacgtcaccttagctttcaaaaaatatcaatag

SEQ ID NO: 20115 - protein, 416 aa, Synechocystis sp
MANLEKKRVVVTGLGAITPIGNTLQDYWQGLMEGRNGIGPITRFDASDQACRFGGEVKDFDATQFLDRKEAKRMDRFCHFAVCASQQAINDAKLVINELNADEIGVLIGTGIGGLKVLEDQQTILLDKGPSRCSPFMIPMMIANMASGLTAINLGAKGPNNCTVTACAAGSNAIGDAFRLVQNGYAKAMICGGTEAAITPLSYAGFASARALSFRNDDPLHASRPFDKDRDGFVMGEGSGILILEELESALARGAKIYGEMVGYAMTCDAYHITAPVPDGRGATRAIAWALKDSGLKPEMVSYINAHGTSTPANDVTETRAIKQALGNHAYNIAVSSTKSMTGHLLGGSGGIEAVATVMAIAEDKVPPTINLENPDPECDLDYVPGQSRALIVDVALSNSFGFGGHNVTLAFKKYQ

SEQ ID NO: 20116 - DNA, 1245 bp, Vibrio cholerae
  CDS (1)..(1245)
atgtccaagcgtcgcgttgttgtcactggcatgggtatgttgtcaccggtaggcaacactgtagagtcatcttggaaagccttgttggccggccaaagcggcatcgtcaacattgagcacttcgacactaccaatttttctactcgtttcgcaggcctggtaaaaggttttgactgcgaacagtacatgtcaaaaaaagatgctcgcaaaatggatttgtttatccagtatggtatcgctgcgggcattcaggctttggaagattcaggcctagaagttaatgaagaaaatgctgcgcgtattggcgttgcgattggttcgggtatcggcggccttgagctgattgaaaccggacatcaagctttaatcgagaaaggcccacgtaaggttagccctttcttcgttccctcaactattgtcaacatgattgccggtaacttgtctatcatgcgtggcttacgtggtcccaatattgcgatctctaccgcctgtaccacgggcttgcacaatatcggccatgcagcacgtatgattgcttacggtgatgcggatgcgatggttgcaggtggtgcagaaaaagcgtcaacgccactgggcatggcgggttttggtgcggcgaaagcactctcaactcgtaatgatgaaccgcaaaaagcgtctcgtccttgggataaagaccgtgatggtttcgtgctcggtgacggtgccggcatcatggtgcttgaagagtacgaacacgcgaaagcgcgtggcgcgaaaatttacgcagaagtggttggcttcggtatgtcaggtgatgcttatcatatgacttcaccgagtgaagacggctctggcggtgcgctggcgatggaagcggccatgcgtgatgcaggcgtgactggtgagcagattggttatgttaatgctcacggtacatctacccctgcgggcgatgtggctgaagtgaaaggcattaaacgtgcgttgggtgaagcagggactaagcaagttctggtttcttctaccaagtccatgacgggtcacttattaggtgctgcaggttctgtcgaagcgatcatcactgtgatgtctttggtggatcaaatggttccaccgaccatcaatctggataatcctgaagaaggtttgggtgtcgatttagtaccgcatgttgcccgtaaagttgagagtatggaatacgccatgtgtaactcgtttggctttggtggtactaacggtagcttgattttcaagcgcatgtaa

SEQ ID NO: 20117 - protein, 414 aa, Vibrio cholerae; identical to SEQ ID NO: 19655

SEQ ID NO: 20118 - DNA, 1248 bp, Vibrio harveyi
  CDS (1)..(1248)
atgtccaagcgtcgtgtagttgtcactggcatgggtatgttgtcaccggtaggcaacacagtagaatcatcttggaaagccctgctagaaggtcaaagcggtatcgtaaacatcgagcacttcgatgcaacgaacttctcgactcgttttgctggtcttgtaaaagattttgattgcacagagtacatgtctaagaaagatgctcgtaaaatggatttgtttatccagtacggcattgctgcgggtatccaagcattggatgactctggcttagaaattaccgaagaaaacgcggctcgagttggtgtagcaatcggctcaggcattggcggtctagacctaatcgaagcaggtcactcagcgctagttgagaaaggtcctcgcaaagttagcccattttttgttccttcgaccatcgtaaacatggttgcgggtaatctatctatcatgcgtggtcttcgtggtcctaacatcgcgatctctactgcatgtactacaggtcttcacaacatcggtcacgcggctcgtatgattgcatacggtgatgcggaagctatggttgctggtggtgcagaaaaagcatctactccacttggtatggcaggcttcggtgctgcaaaagcactatcgactcgtaacgatgaaccgcaaaaagcatcacgtccttgggataaaggtcgtgacggcttcgttctaggtgacggtgcgggcgtgatggttcttgaagagtacgaacacgcaaaagcgcgcggtgctaagatctacgcagagcttgttggcttcggtatgtctggtgacgcttaccacatgacttctccaagtgaagatggctctggtggcgcactggcaatggaagcggcgatgcgtgacgcaaacatcacaggtactcaagttggttacgtgaacgctcacggtacatcaacaccagcaggtgatgtggctgaaatcaagggtgtgaaacgcgcacttggtgaagaaggctctaagcaggttcttgtctcttctactaaatctatgactggtcaccttttaggtgcagcaggctcagtagaagcaattatcacggttctttcattggtagatcaaattgttccaccaacgattaacctagatgatccagaagaaggtttagatatcgaccttgtgccgcatactgcgcgcaaagttgatatggaatacgcaatctgtaactcgttcggcttcggcggtactaacggttcgcttgtattcaaaaaaatcgctgagtaa

SEQ ID NO: 20119 - protein, 415 aa, Vibrio harveyi
MSKRRVVVTGMGMLSPVGNTVESSWKALLEGQSGIVNIEHFDATNFSTRFAGLVKDFDCTEYMSKKDARKMDLFIQYGIAAGIQALDDSGLEITEENAARVGVAIGSGIGGLDLIEAGHSALVEKGPRKVSPFFVPSTIVNMVAGNLSIMRGLRGPNIAISTACTTGLHNIGHAARMIAYGDAEAMVAGGAEKASTPLGMAGFGAAKALSTRNDEPQKASRPWDKGRDGFVLGDGAGVMVLEEYEHAKARGAKIYAELVGFGMSGDAYHMTSPSEDGSGGALAMEAAMRDANITGTQVGYVNAHGTSTPAGDVAEIKGVKRALGEEGSKQVLVSSTKSMTGHLLGAAGSVEAIITVLSLVDQIVPPTINLDDPEEGLDIDLVPHTARKVDMEYAICNSFGFGGTNGSLVFKKIAE

SEQ ID NO: 20120 - DNA, 1272 bp, Streptomyces coelicolor
  CDS (1)..(1272): transl_table=11
atgacccggcgccgggtcgccgtcacgggcataggcgtcgtcgccccgggcgggatcggcacgccccagttctggaggctgctgtccgagggccgtacggcgacgcgccgcatctccctgttcgacccgtccgggctgcgctcgcagatcgccgccgagtgcgacttcgagccgtccgaccacgggctcggcctcgccaccgcccagcgctgcgacaggtacgtgcagttcgcgctggtggccgcctcggaggcggtccgggacgcgaacctcgacatgaaccgcgaggacccctggcgggccggtgccacgctcggcacggcggtcggcggcaccacccggctggagcacgactacgtcctggtcagcgagcgcggctcgcgctgggacgtcgacgaccggcgctccgaaccgcacctggagcgcgcgttcaccccggccaccctctcctccgcggtcgccgaggagttcggggtgcgcgggccggtgcagaccgtctccaccgggtgcacgtccggcctcgacgccgtcgggtacgcctaccacgcggtcgccgagggacgcgtcgacgtgtgcctggcgggcgcggcggactcgccgatatcgccgatcaccatggcctgcttcgacgccatcaaggcgacctcgccgaacaacgacgaccccgcgcacgcctcccggcccttcgacgcggaccgcaacggcttcgtgatgggcgagggcgcggcggtgctggtcctggaggacctggagcacgcccgggcccggggcgcggacgtgtactgcgaggtctccggctacgccaccttcggcaacgcctaccacatgaccgggctcaccaaggagggcctggagatggcgcgggccatcgacacggcgctggacatggcggaactcgacgggtcggcgatcgactacgtcaacgcgcacggctccggcacccagcagaacgaccggcacgagaccgcggccgtcaaacgctcgctgggcgagcacgcctacgcgacgccgatgagctccatcaagtccatggtgggccactcgctcggcgcgatcggctccatcgaactggccgcgtgcgtcctggcgatggcccaccaggtggtgccgcccaccgccaactacacgacccccgaccccgagtgcgacctggactacgtgccgcgcgaggcacgggagcggacgctgcggcacgtgctgtcggtgggcagcggcttcggcggcttccagtccgcggtcgtactgagcggcagtgaaggagggctgcgatga

SEQ ID NO: 20121 - protein, 423 aa, Streptomyces coelicolor
MTRRRVAVTGIGVVAPGGIGTPQFWRLLSEGRTATRRISLFDPSGLRSQIAAECDFEPSDHGLGLATAQRCDRYVQFALVAASEAVRDANLDMNREDPWRAGATLGTAVGGTTRLEHDYVLVSERGSRWDVDDRRSEPHLERAFTPATLSSAVAEEFGVRGPVQTVSTGCTSGLDAVGYAYHAVAEGRVDVCLAGAADSPISPITMACFDAIKATSPNNDDPAHASRPFDADRNGFVMGEGAAVLVLEDLEHARARGADVYCEVSGYATFGNAYHMTGLTKEGLEMARAIDTALDMAELDGSAIDYVNAHGSGTQQNDRHETAAVKRSLGEHAYATPMSSIKSMVGHSLGAIGSIELAACVLAMAHQVVPPTANYTTPDPECDLDYVPREARERTLRHVLSVGSGFGGFQSAVVLSGSEGGLR

SEQ ID NO: 20122 - DNA, 1269 bp, Streptomyces halstedii
  CDS (1)..(1269): transl_table=11
atgagccgccgggtcgtcgtcaccggcataggcgtcgtcgccccgggcggcatcggcgcggcccggttctgggacctgctggccggcgggcgtacggcgacgcgccggatctccctgttcgacccggcgcgcctgcgctcgcagatcgccgccgagtgcgacttcgacccgtccgcgcacggcctggacgacgagacggtccggcggtgcgaccggtacgtgcagttcgcgctggtcgccaccgccgaggcggtccgcgacgcgggcctggacaccacgcgcgaggacccctggcgcatgggggccgtcctcggcacggcggtcggcggcaccacccgcctggagcacgactacgtcctggtcagcgagggcggctcgcgctgggacgtggaccaccggcgggccgagccgcacctgcaccgcgccttcgcccccagcacgctcgcctccaccgtcgccgagaccttcggcgcgcagggcccggtgcagaccgtctccaccggctgcacgtccgggctggacgcggtggggtacgcctaccacgccatcgccgagggccgtgccgacgtgtgcctggcgggcgcctcggactcgccgatatcgccgatcaccatggcgtgcttcgacgccatcaaggcgacctcgcccagcaacgacgacccggagcacgcctcccgccccttcgacgcccgccgcaacgggttcgtgatgggcgagggcggcgcggtgctcgtgctggaggagctggagcacgcccgggcccgcggcgcggacgtctactgcgagctcgccggctacgccaccttcggcaacgcccaccacatgaccgggctcacccgggagggcctggagatggcgcgggccatcgacaccgcgctggacatggcccgcctggacggcacggacatcgactacgtcaacgcgcacggctccggcacccagcagaacgaccggcacgagaccgcggcggtcaagcggtcgctgggcgagcacgcgtaccggaccccgatgagctcgatcaagtcgatggtgggccactcgctcggcgcgatcggctcgatcgaggtcgtcgcctgcgtcctcgccctggcgcaccaggtggtgccgcccacggccaactacgagacaccggaccccgagtgcgacctggactacgtgccgcgcgaggcacgcgagcgggagctgcgcagcgtgctgtcggtgggcagcggcttcggcggcttccagtccgcggtcgtgctgaccggaccggagaggaggctgagatga

SEQ ID NO: 20123 - protein, 422 aa, Streptomyces halstedii
MSRRVVVTGIGVVAPGGIGAARFWDLLAGGRTATRRISLFDPARLRSQIAAECDFDPSAHGLDDETVRRCDRYVQFALVATAEAVRDAGLDTTREDPWRMGAVLGTAVGGTTRLEHDYVLVSEGGSRWDVDHRRAEPHLHRAFAPSTLASTVAETFGAQGPVQTVSTGCTSGLDAVGYAYHAIAEGRADVCLAGASDSPISPITMACFDAIKATSPSNDDPEHASRPFDARRNGFVMGEGGAVLVLEELEHARARGADVYCELAGYATFGNAHHMTGLTREGLEMARAIDTALDMARLDGTDIDYVNAHGSGTQQNDRHETAAVKRSLGEHAYRTPMSSIKSMVGHSLGAIGSIEVVACVLALAHQVVPPTANYETPDPECDLDYVPREARERELRSVLSVGSGFGGFQSAVVLTGPERRLR

SEQ ID NO: 20124 - DNA, 1422 bp, Arabidopsis thaliana
  CDS (1)..(1422)
atgcaagctcttcaatcttcatctctccgtgcttctcctccaaacccacttcgcttaccatcaaatcgtcaatcacatcagctaattaccaatgcgagacctttgcgaagacaacaacgttccttcatctccgcatcagcatccactgtctccgctcctaaacgcgaaacagatccgaagaaacgagttgtcattactggtatgggtctcgtctctgtgtttggtaacgatgttgatgcttactacgagaaattgttgtctggtgagagtggaatcagtttgattgatcgtttcgatgcttccaagttccctactcgattcggtggtcagatccgtgggtttagctctgaaggttatattgatggcaagaatgagcgtaggcttgatgattgtttgaaatattgcattgttgctggtaaaaaagctcttgaaagtgccaatcttggtggtgataagcttaacacgattgataagaggaaagctggagtactagttgggactggaatgggaggtttaactgtgttttcagaaggtgttcagaatttgattgagaagggtcataggaggattagtccattttttataccttatgctataacaaatatgggttctgctttgttggcgattgatcttggtcttatgggtcctaactattcgatttcaactgcttgtgctacttcgaattactgcttttacgctgctgcgaatcacattcgtcgtggtgaagctgatatgatgattgctggtgggactgaggctgctattattcctattgggttgggaggttttgttgcttgtagggcattgtcccagagaaatgatgaccctcaaactgcttccaggccgtgggataaagcaagagatgggtttgttatgggtgaaggagctggtgttctggtgatggaaagcttggaacatgcaatgaaacgtggtgctccaattgtagcagaatatcttggaggtgctgttaattgtgatgctcaccatatgactgatccaagagctgatggtcttggggtttcttcatgcattgaaagatgcctggaagatgctggtgtatcacctgaggaggtaaattacatcaatgcacatgcaacttccactcttgctggtgatcttgctgagattaatgccattaaaaaggtattcaagagcacttcagggatcaaaatcaacgccaccaagtctatgataggtcactgcctcggtgcagctggaggtctagaagccatcgccaccgtgaaggctatcaacactggatggctgcatccttccatcaaccaatttaacccagaacaagctgtggactttgacacggtcccaaacgagaagaagcaacacgaggttgatgttgccatatcaaactcgttcgggttcggtggacacaactcggtagtcgccttctctgccttcaaaccctga

SEQ ID NO: 20125 - protein, 473 aa, Arabidopsis thaliana
MQALQSSSLRASPPNPLRLPSNRQSHQLITNARPLRRQQRSFISASASTVSAPKRETDPKKRVVITGMGLVSVFGNDVDAYYEKLLSGESGISLIDRFDASKFPTRFGGQIRGFSSEGYIDGKNERRLDDCLKYCIVAGKKALESANLGGDKLNTIDKRKAGVLVGTGMGGLTVFSEGVQNLIEKGHRRISPFFIPYAITNMGSALLAIDLGLMGPNYSISTACATSNYCFYAAANHIRRGEADMMIAGGTEAAIIPIGLGGFVACRALSQRNDDPQTASRPWDKARDGFVMGEGAGVLVMESLEHAMKRGAPIVAEYLGGAVNCDAHHMTDPRADGLGVSSCIERCLEDAGVSPEEVNYINAHATSTLAGDLAEINAIKKVFKSTSGIKINATKSMIGHCLGAAGGLEAIATVKAINTGWLHPSINQFNPEQAVDFDTVPNEKKQHEVDVAISNSFGFGGHNSVVAFSAFKP

SEQ ID NO: 20126 - DNA, 1389 bp, Hordeum vulgare
  CDS (1)..(1389)
atgcacgcccacgccgcccacgccctcggcctccgcgtccctccccccgcgttcccccgccgccgcgctcgcccgcgccggcgccccgccgcggccgtccttgccacctcggcggcgcctcagagggagacggaccccaggaagcgggtggtgatcacggggatggggctggcgtcggtgttcgggagcgacgtggacacattctacgaccggctcctggccggggagagcggcgtcgggccgatcgaccggttcgacgccagcagtttccccacgaggttcgccgggcagatacgggggttctcgtcggaggggtacatcgacggcaagaacgaccggaggctcgacgactgcatccggtactgcatcctcagcggcaagaaggcgctcgagagtgccgggctgggcgcaggctccgacgcgcacgtcaagcttgatgtggggcgggctggtgttcttgtggggactggcatgggtggcctttcagtattctccgatggtgttcagaaccttattgagaagggatacagaaaaatttcacctttctttatcccatatgctataactaatatgggttcagccttgcttgccatagatgttggtttcatgggccccaactactcaatttcaactgcgtgtgcaacctccaactactgcttttatgctgccgcaaaccatattcgtcgtggtgaagctgatatcatcgtcgctggtggaactgaagctgccatcattccaattggccttggaggttttgtagcgtgtagagcactatcacaaaggaatgatgacccaataactgcatgtaggccatgggataaagagcgagatggctttgttatgggtgaaggtgccggtgtactggttatggagagcctggagcacgcaatgaagcgcgatgcaccgataatagctgaatacttgggaggtgcggtcaactgtgatgcttaccatatgactgatcctagagcagatggactgggtgtatcatcttgtatcacaatgagtctcagagatgcaggtgttgcaccagaggaggtgaactacatcaatgcacacgcaacttcgacacttgctggtgacttggctgaagtaagagccatcaaacaagtcttcaagaatccatctgagattaagatcaattctacaaagtccatgataggccattgcctgggtgcggcgggtgggctagaagctattgccactatcaagtccataactacaggatgggtgcatcctaccattaaccaatttaacccggagcctgaagttgattttgatacagtagctaacgaaaagaagcagcatgaagtgaatgttggtatttctaactcattcggatttggagggcacaattccgtggtagtattcgcgccattcaagccgtga

SEQ ID NO: 20127 - protein, 462 aa, Hordeum vulgare
MHAHAAHALGLRVPPPAFPRRRARPRRRPAAAVLATSAAPQRETDPRKRVVITGMGLASVFGSDVDTFYDRLLAGESGVGPIDRFDASSFPTRFAGQIRGFSSEGYIDGKNDRRLDDCIRYCILSGKKALESAGLGAGSDAHVKLDVGRAGVLVGTGMGGLSVFSDGVQNLIEKGYRKISPFFIPYAITNMGSALLAIDVGFMGPNYSISTACATSNYCFYAAANHIRRGEADIIVAGGTEAAIIPIGLGGFVACRALSQRNDDPITACRPWDKERDGFVMGEGAGVLVMESLEHAMKRDAPIIAEYLGGAVNCDAYHMTDPRADGLGVSSCITMSLRDAGVAPEEVNYINAHATSTLAGDLAEVRAIKQVFKNPSEIKINSTKSMIGHCLGAAGGLEAIATIKSITTGWVHPTINQFNPEPEVDFDTVANEKKQHEVNVGISNSFGFGGHNSVVVFAPFKP

SEQ ID NO: 20128 - DNA, 1386 bp, Arabidopsis thaliana
  CDS (1)..(1386)
atggcgacatctaatctccgtagacacttgagcgcaagtcgcctccgcttaaaccgcttcatctctacttcttcttcttatcattcacatcgccgtgttgttgtcactggtctaggcatggtgactccacttggtagaggcgttgaaacaacgtggaggcgtttaattgatggagaatgtgggattagaggattgactcttgatgatctcaagatgaagtcttttgatgaagagacaaagttatatacttttgatcagctttcttctaaagttgctgcttttgtgccttatggatcaaaccctggtgaatttgatgaagccctttggctaaactctaaggcagttgcgaattttatcggatatgctgtatgtgctgccgatgaagctttgagagatgcagagtggttaccaactgaagaagaagaaaaagagagaacaggagtctctattggtggtggaattggaagtatatgtgatattgtggaggcagcgcagctgatttgtgaaaagaggctgcggcggcttagtccgtttttcattccaaaaatattggtaaacatggcatctggtcatgtgagcatgaagtatggatttcaggggccaaatcatgctgctgtgacagcttgcgcaactggtgcacattctataggcgatgccactaggatgattcaatttggagatgcagatgttatggtggctggtggaactgagtctagcattgatgctctgtccgtagctggattctctagatcaagggctttgtcaactaaattcaattcttctccacaagaagcttcacggccttttgattgtgaccgggatggttttgtgataggggaaggttcaggggttatagtattagaggaatatgagcatgcaaaaagacgaggagcaaaaatttatgctgagctttgtggatatgggatgtcaggcgatgcacaccatattactcaacctcctgaagatggaaaaggagctgttttggccatgacgcgtgccttaagacagtctggtctgtgtccaaaccaaattgattatgtaaacgcacatgcaacatcaaccccaataggcgatgccgtggaagcgagagctatcaagacggtattctctgaacatgctacttcaggcaccttggcattctcctccaccaagggggctactggtcatcttcttggagcagctggagcagtggaagctattttcagtatccttgctatacatcacggggttgctcctatgacgctgaatgtcaagaatccagatcccatcttcgacaagaggttcatgcctttaaccacttcgaaaaagatgttagttaggacagcaatgtcgaattcgtttggctttggaggaacaaatgcatctttgctctttgcctctatctaa

SEQ ID NO: 20129 - protein, 461 aa, Arabidopsis thaliana
MATSNLRRHLSASRLRLNRFISTSSSYHSHRRVVVTGLGMVTPLGRGVETTWRRLIDGECGIRGLTLDDLKMKSFDEETKLYTFDQLSSKVAAFVPYGSNPGEFDEALWLNSKAVANFIGYAVCAADEALRDAEWLPTEEEEKERTGVSIGGGIGSICDIVEAAQLICEKRLRRLSPFFIPKILVNMASGHVSMKYGFQGPNHAAVTACATGAHSIGDATRMIQFGDADVMVAGGTESSIDALSVAGFSRSRALSTKFNSSPQEASRPFDCDRDGFVIGEGSGVIVLEEYEHAKRRGAKIYAELCGYGMSGDAHHITQPPEDGKGAVLAMTRALRQSGLCPNQIDYVNAHATSTPIGDAVEARAIKTVFSEHATSGTLAFSSTKGATGHLLGAAGAVEAIFSILAIHHGVAPMTLNVKNPDPIFDKRFMPLTTSKKMLVRTAMSNSFGFGGTNASLLFASI

SEQ ID NO: 20130 - DNA, 24 bp, Artificial sequence
  (1)..(24): primer
atgtctaagcgtcgtgtagttgtg

SEQ ID NO: 20131 - DNA, 27 bp, Artificial sequence
  (1)..(27): primer
ttagatctttttaaagatcaaagaacc

SEQ ID NO: 20132 - protein, 494 aa, Artificial sequence
  Variant (10)..(10): xaa in position 10 is any amino acid
  Variant (16)..(21): xaa in position 16 to 21 is any amino acid
  Variant (23)..(24): xaa in position 23 to 24 is any amino acid
  Variant (26)..(27): xaa in position 26 to 27 is any amino acid
  Variant (29)..(30): xaa in position 29 to 30 is any amino acid
  Variant (33)..(34): xaa in position 33 to 34 is any amino acid
  Variant (36)..(45): xaa in position 36 to 45 is any amino acid
  Variant (46)..(57): xaa in position 46 to 57 is any or no amino acid
  Variant (60)..(60): xaa in position 60 is any amino acid
  Variant (62)..(69): xaa in position 62 to 69 is any amino acid
  Variant (70)..(86): xaa in position 70 to 86 is any or no amino acid
  Variant (88)..(89): xaa in position 88 to 89 is any amino acid
  Variant (94)..(97): xaa in position 94 to 97 is any amino acid
  Variant (101)..(101): xaa in position 101 is any amino acid
  Variant (104)..(105): xaa in position 104 to 105 is any amino acid
  Variant (108)..(109): xaa in position 108 to 109 is any amino acid
  Variant (111)..(117): xaa in position 111 to 117 is any amino acid
  Variant (118)..(131): xaa in position 118 to 131 is any or no amino acid
  Variant (133)..(133): xaa in position 133 is any amino acid
  Variant (136)..(136): xaa in position 136 is any amino acid
  Variant (145)..(157): xaa in position 145 to 157 is any amino acid
  Variant (158)..(172): xaa in position 158 to 172 is any or no amino acid
  Variant (174)..(179): xaa in position 174 to 179 is any or no amino acid
  Variant (181)..(181): xaa in position 181 is any amino acid
  Variant (183)..(184): xaa in position 183 to 184 is any amino acid
  Variant (187)..(188): xaa in position 187 to 188 is any amino acid
  Variant (190)..(191): xaa in position 190 to 191 is any amino acid
  Variant (193)..(193): xaa in position 193 is any amino acid
  Variant (196)..(196): xaa in position 196 is any amino acid
  Variant (200)..(201): xaa in position 200 to 201 is any amino acid
  Variant (203)..(204): xaa in position 203 to 204 is any amino acid
  Variant (206)..(211): xaa in position 206 to 211 is any amino acid
  Variant (215)..(215): xaa in position 215 is any amino acid
  Variant (217)..(220): xaa in position 217 to 220 is any amino acid
  Variant (223)..(223): xaa in position 223 is any amino acid
  Variant (225)..(227): xaa in position 225 to 227 is any amino acid
  Variant (229)..(230): xaa in position 229 to 230 is any amino acid
  Variant (232)..(232): xaa in position 232 is any amino acid
  Variant (234)..(244): xaa in position 234 to 244 is any or no amino acid
  Variant (246)..(246): xaa in position 246 is any amino acid
  Variant (249)..(249): xaa in position 249 is any amino acid
  Variant (252)..(252): xaa in position 252 is any amino acid
  Variant (254)..(254): xaa in position 254 is any amino acid
  Variant (255)..(255): xaa in position 255 is any or no amino acid
  Variant (257)..(258): xaa in position 257 to 258 is any amino acid
  Variant (260)..(260): xaa in position 260 is any amino acid
  Variant (265)..(265): xaa in position 265 is any amino acid
  Variant (267)..(267): xaa in position 267 is any amino acid
  Variant (272)..(272): xaa in position 272 is any amino acid
  Variant (273)..(274): xaa in position 273 to 274 is any or no amino acid
  Variant (276)..(277): xaa in position 276 to 277 is any or no amino acid
  Variant (279)..(279): xaa in position 279 is any or no amino acid
  Variant (281)..(282): xaa in position 281 to 282 is any or no amino acid
  Variant (289)..(290): xaa in position 289 to 290 is any amino acid
  Variant (292)..(292): xaa in position 292 is any amino acid
  Variant (307)..(308): xaa in position 307 to 308 is any amino acid
  Variant (312)..(313): xaa in position 312 to 313 is any amino acid
  Variant (317)..(317): xaa in position 317 is any amino acid
  Variant (319)..(319): xaa in position 319 is any amino acid
  Variant (323)..(323): xaa in position 323 is any amino acid
  Variant (325)..(325): xaa in position 325 is any amino acid
  Variant (327)..(327): xaa in position 327 is any amino acid
  Variant (329)..(329): xaa in position 329 is any amino acid
  Variant (332)..(332): xaa in position 332 is any amino acid
  Variant (336)..(336): xaa in position 336 is any amino acid
  Variant (338)..(338): xaa in position 338 is any amino acid
  Variant (339)..(340): xaa in position 339 to 340 is any or no amino acid
  Variant (342)..(342): xaa in position 342 is any amino acid
  Variant (344)..(346): xaa in position 344 to 346 is any amino acid
  Variant (347)..(347): xaa in position 347 is any or no amino acid
  Variant (349)..(350): xaa in position 349 to 350 is any amino acid
  Variant (353)..(354): xaa in position 353 to 354 is any amino acid
  Variant (356)..(356): xaa in position 356 is any amino acid
  Variant (358)..(363): xaa in position 358 to 363 is any or no amino acid
  Variant (365)..(365): xaa in position 365 is any amino acid
  Variant (375)..(376): xaa in position 375 to 376 is any amino acid
  Variant (377)..(377): xaa in position 377 is any or no amino acid
  Variant (379)..(380): xaa in position 379 to 380 is any amino acid
  Variant (382)..(383): xaa in position 382 to 383 is any amino acid
  Variant (386)..(389): xaa in position 386 to 389 is any amino acid
  Variant (391)..(392): xaa in position 391 to 392 is any amino acid
  Variant (393)..(406): xaa in position 393 to 406 is any or no amino acid
  Variant (408)..(408): xaa in position 408 is any or no amino acid
  Variant (410)..(410): xaa in position 410 is any amino acid
  Variant (415)..(416): xaa in position 415 to 416 is any amino acid
  Variant (419)..(419): xaa in position 419 is any amino acid
  Variant (430)..(431): xaa in position 430 to 431 is any amino acid
  Variant (433)..(433): xaa in position 433 is any amino acid
  Variant (436)..(441): xaa in position 436 to 441 is any amino acid
  Variant (446)..(452): xaa in position 446 to 452 is any amino acid
  Variant (453)..(459): xaa in position 453 to 459 is any or no amino acid
  Variant (461)..(462): xaa in position 461 to 462 is any amino acid
  Variant (464)..(473): xaa in position 464 to 473 is any amino acid
  Variant (474)..(480): xaa in position 474 to 480 is any or no amino acid
  Variant (484)..(484): xaa in position 484 is any amino acid
  Variant (490)..(490): xaa in position 490 is any amino acid
  Variant (492)..(493): xaa in position 492 to 493 is any amino acid
RRVVVTGLGXVSPLGXXXXXXWXXLXXGXXGIXXIXXXXXXXXXXXXXXXXXXXXXXAGXVXXXXXXXXXXXXXXXXXXXXXXXXXKXXRRMDXXXXYALXAAXXALXXAXXXXXXXXXXXXXXXXXXXXXRXGVXIGSGIGGLXXXXXXXXXXXXXXXXXXXXXXXXXXXXRXXXXXXVXPXXVPXXIXXMXAGXVSIXXGXXGXXXXXXTACXTXXXXIGXAXXXIXXGXAXXXXXXXXXXXDXMVXGGXEXXIXXLXLAGFXAXRALSXXXNXXDXPXXASRPFDXXRXGFVMGEGAGVLVLEXXEHAXXRGAXIXAELXGXGXSXDAXHMTXPXXXGXGXXXXMXXALXXAXIXXXXXXVXYINAHGTSTXXXDXXEXXAIXXXXGXXXXXXXXXXXXXXXXLXVXSTKSXXGHXLGAAGAVEAIXXVXAIXXXXXXPTINXXXXXXXXXXXXXXLXXVXXXXXXXXXXXXXXXXXLSNXFGFGGXNXXL

SEQ ID NO: 20133 - protein, 31 aa, Artificial sequence
  Variant (2)..(2): xaa in position 2 is any amino acid
  Variant (3)..(3): xaa in position 3 is any or no amino acid
  Variant (5)..(5): xaa in position 5 is Ile or Val
  Variant (8)..(8): xaa in position 8 is any amino acid
  Variant (10)..(11): xaa in position 10 to 11 is any amino acid
  Variant (12)..(12): xaa in position 12 is Ala, Ser or Thr
  Variant (13)..(14): xaa in position 13 to 14 is any amino acid
  Variant (15)..(15): xaa in position 15 is Ala or Gly
  Variant (16)..(16): xaa in position 16 is any amino acid
  Variant (17)..(17): xaa in position 17 is Asp, Glu, Gly, Asn, Ser or Thr
  Variant (18)..(27): xaa in position 18 to 27 is any amino acid
  Variant (29)..(30): xaa in position 29 to 30 is any amino acid
  Variant (31)..(31): xaa in position 31 is Ala or Gly
RXXVXTGXGXXXXXXXXXXXXXXXXXXGXXX

SEQ ID NO: 20134 - protein, 10 aa, Artificial sequence
  Variant (2)..(4): xaa in position 2 to 4 is any amino acid
  Variant (6)..(6): xaa in position 6 is Ala, Cys, Asn, Ser, Thr or Val
  Variant (7)..(8): xaa in position 7 to 8 is any amino acid
  Variant (10)..(10): xaa in position 10 is Ala, Cys, Asp, Gly, Asn or Ser
GXXXGXXXGX

SEQ ID NO: 20135 - protein, 45 aa, Artificial sequence
  Variant (2)..(5): xaa in position 2 to 5 is any amino acid
  Variant (6)..(6): xaa in position 6 is Asp or Asn
  Variant (7)..(7): xaa in position 7 is any amino acid
  Variant (8)..(8): xaa in position 8 is Ala, Gly, Ile, Leu, Pro or Val
  Variant (9)..(9): xaa in position 9 is Ala, Gly, Pro, Ser or Thr
  Variant (10)..(10): xaa in position 10 is Ala or Gly
  Variant (11)..(12): xaa in position 11 to 12 is any amino acid
  Variant (13)..(13): xaa in position 13 is Ala, Gly, Ser or Thr
  Variant (14)..(14): xaa in position 14 is Ile, Leu, Met or Val
  Variant (15)..(19): xaa in position 15 to 19 is any amino acid
  Variant (21)..(25): xaa in position 21 to 25 is any amino acid
  Variant (26)..(27): xaa in position 26 to 27 is any or no amino acid
  Variant (29)..(30): xaa in position 29 to 30 is any or no amino acid
  Variant (32)..(33): xaa in position 32 to 33 is Ala, Ser or Thr
  Variant (34)..(34): xaa in position 34 is Ala, Gly or Ser
  Variant (35)..(36): xaa in position 35 to 36 is any amino acid
  Variant (37)..(37): xaa in position 37 is Ala, Cys, Asn, Ser or Thr
  Variant (38)..(38): xaa in position 38 is Phe, Ile, Leu, Met or Val
  Variant (39)..(40): xaa in position 39 to 40 is any amino acid
  Variant (41)..(41): xaa in position 41 is Ala, Gly or Ser
  Variant (42)..(44): xaa in position 42 to 44 is any amino acid
  Variant (45)..(45): xaa in position 45 is Ile, Leu or Val
PXXXXXXXXXXXXXXXXXXGXXXXXXXAXXCXXXXXXXXXXXXXX

SEQ ID NO: 20136 - protein, 37 aa, Artificial sequence
  Variant (2)..(6): xaa in position 2 to 6 is any amino acid
  Variant (8)..(8): xaa in position 8 is Asp, Asn or Ser
  Variant (12)..(12): xaa in position 12 is Ile, Leu or Met
  Variant (13)..(13): xaa in position 13 is Ala, Gly or Ser
  Variant (14)..(14): xaa in position 14 is Asp, Glu or Gly
  Variant (16)..(16): xaa in position 16 is Ala, Cys, Gly or Ser
  Variant (17)..(17): xaa in position 17 is Ala or Gly
  Variant (18)..(18): xaa in position 18 is any amino acid
  Variant (19)..(19): xaa in position 19 is Phe, Ile, Leu, Met or Val
  Variant (20)..(20): xaa in position 20 is Ile, Leu, Met or Val
  Variant (21)..(21): xaa in position 21 is Phe, Ile, Leu, Met or Val
  Variant (23)..(23): xaa in position 23 is Ala, Asp, Glu, Ser or Thr
  Variant (24)..(26): xaa in position 24 to 26 is any amino acid
  Variant (28)..(29): xaa in position 28 to 29 is any amino acid
  Variant (31)..(31): xaa in position 31 is any amino acid
  Variant (33)..(33): xaa in position 33 is any amino acid
  Variant (34)..(34): xaa in position 34 is Ile, Pro or Val
  Variant (35)..(36): xaa in position 35 to 36 is any amino acid
RXXXXXRXGFVXXXGXXXXXXEXXXXAXXRXAXXXXE

SEQ ID NO: 20137 - protein, 23 aa, Artificial sequence
  Variant (2)..(2): xaa in position 2 is Ile, Leu or Val
  Variant (3)..(3): xaa in position 3 is Asn or Ser
  Variant (4)..(4): xaa in position 4 is Ala, Cys, Thr or Val
  Variant (6)..(6): xaa in position 6 is Ala or Gly
  Variant (7)..(7): xaa in position 7 is Ser or Thr
  Variant (8)..(8): xaa in position 8 is Ala, Gly or Ser
  Variant (10)..(11): xaa in position 10 to 11 is any amino acid
  Variant (12)..(12): xaa in position 12 is any or no amino acid
  Variant (14)..(15): xaa in position 14 to 15 is any amino acid
  Variant (17)..(18): xaa in position 17 to 18 is any amino acid
  Variant (19)..(22): xaa in position 19 to 22 is any or no amino acid
YXXXHXXXTXXXDXXEXXXXXXA

SEQ ID NO: 20138 - protein, 32 aa, Artificial sequence
  Variant (3)..(3): xaa in position 3 is Gly or Ser
  Variant (4)..(5): xaa in position 4 to 5 is any amino acid
  Variant (8)..(8): xaa in position 8 is any or no amino acid
  Variant (10)..(10): xaa in position 10 is any or no amino acid
  Variant (12)..(12): xaa in position 12 is Ala or Gly
  Variant (13)..(13): xaa in position 13 is Ala, Ser or Thr
  Variant (15)..(15): xaa in position 15 is Ala, Gly, Asn, Ser or Val
  Variant (16)..(16): xaa in position 16 is any amino acid
  Variant (18)..(30): xaa in position 18 to 30 is any amino acid
  Variant (31)..(31): xaa in position 31 is any or no amino acid
TKXXXGHXLXGXXGXXEXXXXXXXXXXXXXXP

SEQ ID NO: 20139 - DNA, 1758 bp, Escherichia coli K12
  CDS (1)..(1758): transl_table=11
atggaaaattcacgcatccctggggaacatttttttaccaccagtgataatacagcgttgttttatcggcactggcccgctttacagcccggggcgaaaaaggtcatcgtcttatttcatcgcgggcatgaacattctggtcgtctacaacatctcgttgatgaactggcgatgccagatactgctttttatgcctgggatgcccgagggcatggaaaaagttcggggccgcgtggttatagcccatctcttgcgcgttcagtgcgggatgtcgatgaatttgtccgttttgctgccagcgacagccaggttggactggaagaggtggtagtgatcgcgcaaagcgtcggcgcagtgctggttgccacatggattcatgattatgcacctgcaattcgcgggctggtgctggcttctccggcctttaaggttaaattgtatgtgccgctggcacgtcctgcgctggcgttatggcatcgtctgcgtggtctgttttttattaattcctatgtgaaaggacgctatttgacccacgatcggcaacggggggcgagtttcaataatgatccgctgatcacacgggcgattgccgttaatatcttgctcgatctctacaaaacgtctgaacgtattattagagatgcggcggcgattacgctccccacgcaacttctgatatcaggcgatgactatgtggtgcatcgccaaccgcagattgatttttatcagagattacgtagccctctgaaagagctgcatctgctgccaggcttttatcacgacacgttgggtgaagagaacagggcgctggcatttgaaaaaatgcaaagctttattagtcgtttatatgctaacaaatcgcaaaaatttgattatcagcatgaagactgcacaggaccatcagcggatcgatggcggctactttctggtggacccgtgccattatcgccggttgatttagcgtatcgctttatgcgaaaggcgatgaaattgttcgggacgcactcttcgggcctgcatctcggaatgagcaccggctttgattcaggcagttcgctggattatgtctatcaaaatcaaccgcaaggtagtaacgcattcgggcgtttagtcgacaaaatctacctgaacagtgttggctggcgcggtattcgccagcgcaaaacccatttacaaatactgattaaacaagccgttgccgatctccacgccaaaggtttagccgtccgcgtggttgacattgccgcagggcatgggcgctatgtactggatgcgctggcaaacgagcctgccgtaagcgatattttgttacgtgattacagcgagttaaatgttgcacaggggcaagagatgattgctcaacggggaatgtctgggcgggtgcgttttgaacagggcgatgcgtttaacccggaggaactcagcgcgttaactccgcggcctacgctggcgattgtctctggcctgtatgagctttttcccgaaaatgagcaggtaaaaaactcactcgcaggtcttgccaatgccatcgaaccgggcggcattctcatctacaccgggcagccgtggcaccctcaactggagatgattgccggggtgttaaccagtcataaagatggtaaaccgtgggtaatgcgcgtgcgttcgcaaggggagatggattcactcgtgcgtgatgccggatttgataaatgcacacaacggattgatgagtggggtatttttacggtttcgatggcggtgcgtcgtgataactga

SEQ ID NO: 20140 - protein, 585 aa, Escherichia coli K12
MENSRIPGEHFFTTSDNTALFYRHWPALQPGAKKVIVLFHRGHEHSGRLQHLVDELAMPDTAFYAWDARGHGKSSGPRGYSPSLARSVRDVDEFVRFAASDSQVGLEEVVVIAQSVGAVLVATWIHDYAPAIRGLVLASPAFKVKLYVPLARPALALWHRLRGLFFINSYVKGRYLTHDRQRGASFNNDPLITRAIAVNILLDLYKTSERIIRDAAAITLPTQLLISGDDYVVHRQPQIDFYQRLRSPLKELHLLPGFYHDTLGEENRALAFEKMQSFISRLYANKSQKFDYQHEDCTGPSADRWRLLSGGPVPLSPVDLAYRFMRKAMKLFGTHSSGLHLGMSTGFDSGSSLDYVYQNQPQGSNAFGRLVDKIYLNSVGWRGIRQRKTHLQILIKQAVADLHAKGLAVRVVDIAAGHGRYVLDALANEPAVSDILLRDYSELNVAQGQEMIAQRGMSGRVRFEQGDAFNPEELSALTPRPTLAIVSGLYELFPENEQVKNSLAGLANAIEPGGILIYTGQPWHPQLEMIAGVLTSHKDGKPWVMRVRSQGEMDSLVRDAGFDKCTQRIDEWGIFTVSMAVRRDN

SEQ ID NO: 20141 - DNA, 1761 bp, Pseudomonas aeruginosa PAO1
  CDS (1)..(1761): transl_table=11
atgcgcgacgtacaggaattgcgtttcaccacccacgacggggtagagctcttctaccgccactggccggccagccgcccggcgccggacggcacgcgccaggcggtgctgctgttccaccgcggccatgagcactccgggcggatcgcccacctggtcgacgaactcgacctgccggaacacgacttcttcgcctgggacgcccgtggccacggcctctcgccaggcgcccgcggcgacagcccgagctttgccaccagcgtgcgcgacgtacagaccttcgtcgaccatatccaggccgtccacggtatcgccgaagagcggatggcggtggtggcgcagagcgtcggcgcggtgctggtttccacctgggcccacgactacgcgccgaaggtgcgcgcactggtgctggcttcgccggcgttccaggtcaagctctacgtgccgttcgcccgcagcgggctgaaactgatgcgcctgtggcgcggcaatttcttcgtcaacagctatgtcaaggcacgcttcctcagtcacgacccggagcggatcgcctcctacgacagcgacccgctgatcgccaaggcgatctcggtgaacgtcctgctcggcctctacgaagctgccgagcgggtggtagcggacgcacaggcgatccagattcccacccaactgctgatttccggggccgacttcgtcgtccatcgtgcgccgcaggagcgcttcttcgagcgtctcggcagcctgcgcaaggaaaagcacatcctgcccggcttcttccacgacacccttggcgagcgcgatcgtcacctggccgtcggccgtgcccggcgcttcctcctcgaggcattcgccacggcacctgaacgaccgagcctgcttgatgccgaccgcctgggtcatacctgcgccgaggccgaggcgctggccgcgccgttgccgaagaactcgccgcgcgatctctactggcgcgccacccgtgccgggctgcgcctgggcagcctgtggtcggacggggtcaagctgggcttcgacaccggcttcgattccggcagcaccctcgactatgtctaccgcaaccagccctgcggcagcggcccgctgggtcgcctgatcgaccgcaactacctggactccatcggctggcgcggcatccgccagcgcaagctgcacgtcgaggaactgctgcgcctggccatgcagcggttgcgcgaggagcagcgcgaggtgcgcatcgtcgacatcgccgccggccacggccgctacatcctcgaagccctgcaaggcgtcgagccgctgccggaaagcatcctcctgcgcgactacagcgagatcaacgtgcgtgacggcagcgccctgatcgaaagcaagggcctcgccggcatcgcccgcttcgtcaagggcgatgccttcgatcgcgccgacctggcggcgctgcaaccgaagccgagcctcggggtggtttccgggctctacgagctgttcgccgacaaccgcatggtcggcgactccctcgccggcctcggcgaggcgctggaggagggcggctacctggtctacaccggacagccctggcacccgcagctggaactgatcgcccgcgcgctgaccagccaccgccagggccaggcctgggtgatgcggcgccggacccaggcggaaatggaccagctggtggccgccgccggcttccgcaagatcacccagcgggtcgaccagtggggcatcttcagcgtatcgctggcgcagaaggtcgcccgctga

SEQ ID NO: 20142 - protein, 586 aa, Pseudomonas aeruginosa PAO1
MRDVQELRFTTHDGVELFYRHWPASRPAPDGTRQAVLLFHRGHEHSGRIAHLVDELDLPEHDFFAWDARGHGLSPGARGDSPSFATSVRDVQTFVDHIQAVHGIAEERMAVVAQSVGAVLVSTWAHDYAPKVRALVLASPAFQVKLYVPFARSGLKLMRLWRGNFFVNSYVKARFLSHDPERIASYDSDPLIAKAISVNVLLGLYEAAERVVADAQAIQIPTQLLISGADFVVHRAPQERFFERLGSLRKEKHILPGFFHDTLGERDRHLAVGRARRFLLEAFATAPERPSLLDADRLGHTCAEAEALAAPLPKNSPRDLYWRATRAGLRLGSLWSDGVKLGFDTGFDSGSTLDYVYRNQPCGSGPLGRLIDRNYLDSIGWRGIRQRKLHVEELLRLAMQRLREEQREVRIVDIAAGHGRYILEALQGVEPLPESILLRDYSEINVRDGSALIESKGLAGIARFVKGDAFDRADLAALQPKPSLGVVSGLYELFADNRMVGDSLAGLGEALEEGGYLVYTGQPWHPQLELIARALTSHRQGQAWVMRRRTQAEMDQLVAAAGFRKITQRVDQWGIFSVSLAQKVAR

SEQ ID NO: 20143 - DNA, 1764 bp, Yersinia pestis CO92
  CDS (1)..(1764): transl_table=11
atgagtcaggaagtgcgtttatttcaagaaggcatgttcaccgccagcgatgaaacatcgttgtattttcgccactggtctgccacggaaggtaacagcaagaaagttattgtgttgtttcatcgcgggcatgaacactcggggcgtctgcaacatattgtggatgaactgatgatgcccgatacccatttttacgcgtgggatgcgcgtggacacgggcagtcgccaggggctcgtggctacagccccagccttgctcgctcggttttagacgtggatgagtttgtgcgttttgtggcacaggatgcgcaggtcaacctcgacgatatcgtggtgattgcgcaaagcgtgggggccgtgctggtatcaacctgggttcatgactacgcgccgaaaatccgtggcatggtgctggcgtccccggcatttaaggtcaagctgtatgtgccgtttgcccgcctggggctgggattaatgcagcgtatacgtggcctgttttacgtgaattcctacgtgaaagggaaattcctcagccacgaccccgagcgcatcgccagctttgagcaggacaaattaatcacgcgccagatcgccgtcaatattttgctcgatctctacaaaacggctgaacgtattgtttcagactcgacggcgattactctcccgacccagttgcttatttccggcgatgattttgtggtgcatgagaaaccgcaaaaacaattttatgccggtcttcgcagcgcgataaaagagcaacatattctgccgggtttctatcacgacacgctgggtgaaaaagaccgctctattgcttttgataaaatgaaaaactttatcgaccgactctatgcaactgcgccttatgcctttgattatagccatgaagatcgctggagtccgagtgccgatgcgtatcgtgaattgcaggctccaccaaaatcacgctcgctggaagggatgttttatgctgcgctaagtttcggcatgaagaccatcgggcgacagtccaaagggatgctcctgggttatgaaacaggttttgactccggcagtacgctggattacgtctatcgtaatcagcctgaaggtaatggcattctggggcgtatgattgaccacaactatctgaacagcgttggctggcgtggtattcgcgtgcgtaaagtgaatatccagcagatgattgaacaggccgttgcgaagattcagctcagtcacatgccggtgcgagtggtcgatatcgccgccggacatggccgctatgtgctggatgcactggaaaaacagcagggtatcgaaagtatactgctgcgtgattacagcgatttgaatgtagaaaaaggtcaggcgatgatcgaagagcgtgggctaagccacgtcgctcagttcagaaaaggcaacgccttcgactatgattcccttgccacgctcgatcctgctccgacgctgggcattgtttccgggctgtatgagctcttcccggataacgacttaatcaaaacgtcgttggccgggctggctgcggctattccaccaggcggcatgctggtatacaccgggcaaccgtggcacccacagttaaaaaccatcgcgtataccttaaccagccatcaaaacgggatcccgtggatgatgcgtgtgcgcagccagaaagagatggacacgctggtggagcaggccggctttgaaaaatgccatcaggtgattgatgagtttggcattttcaccgtgtcgctggcggtgagaaagcagcatggttga

SEQ ID NO: 20144 - protein, 587 aa, Yersinia pestis CO92
MSQEVRLFQEGMFTASDETSLYFRHWSATEGNSKKVIVLFHRGHEHSGRLQHIVDELMMPDTHFYAWDARGHGQSPGARGYSPSLARSVLDVDEFVRFVAQDAQVNLDDIVVIAQSVGAVLVSTWVHDYAPKIRGMVLASPAFKVKLYVPFARLGLGLMQRIRGLFYVNSYVKGKFLSHDPERIASFEQDKLITRQIAVNILLDLYKTAERIVSDSTAITLPTQLLISGDDFVVHEKPQKQFYAGLRSAIKEQHILPGFYHDTLGEKDRSIAFDKMKNFIDRLYATAPYAFDYSHEDRWSPSADAYRELQAPPKSRSLEGMFYAALSFGMKTIGRQSKGMLLGYETGFDSGSTLDYVYRNQPEGNGILGRMIDHNYLNSVGWRGIRVRKVNIQQMIEQAVAKIQLSHMPVRVVDIAAGHGRYVLDALEKQQGIESILLRDYSDLNVEKGQAMIEERGLSHVAQFRKGNAFDYDSLATLDPAPTLGIVSGLYELFPDNDLIKTSLAGLAAAIPPGGMLVYTGQPWHPQLKTIAYTLTSHQNGIPWMMRVRSQKEMDTLVEQAGFEKCHQVIDEFGIFTVSLAVRKQHG

SEQ ID NO: 20145 - DNA, 1701 bp, Fusobacterium nucleatum subsp. nucleatum ATCC 25586
  CDS (1)..(1701): transl_table=11
atggaaaatttctattttaatacttttgatggaaataaaattttttatagaatatggaatttcgagaaaaacaaaaaaactttaattatcattcatagaggacatgaacattcagagagattaagtgaattaacacaaaatgaaaaatttttaaaatataatatttttgcctatgatttaagaggacatggctatacagaagttaaatcttctcctaatgctatggattatgttagggatttagattcttttataaaacatctaaaaaatgaataccaaataaaagaagaagatattttcattgttgcaaatagtataggtggagtaatactttctgcctatgttcatgattttgcaccaaatatagcaggtatggctttacttgcacctgcttttgaaataaaactttatattccttttgctaaacaacttgttacattgcttactaaaataaaaaaagatgctaaagttatgagttatgtaaaagcaaaagttttaactcatgatattgaagaacaaaataaatataattctgataaacttatcaataaagaaattaatgctaaactattaattgatttagctgatatgggaaaaagattggttgaagattcaatggcaatagaattacctacaataatattttctgctgaaaaagattatgttgtaaaaaattctgccgaaaaaagatttttcttaaatttatcatctaaaaaaagagagtttatagaacttgaaaatttttatcatggaataatctttgaaaaagaaagagaaaaagtatataaaatgttggatgattttatacaagatattttcaaaaatcaaaatacttcacttgatgtttctcctagagaattttcaagaaaggagtatgagaggataggcttggaagaatatcctctaagtgaaaaaatattttattctattcaaaaattctctatgaaaacttttgggtttttaagcaaaggaatgagtttaggcttaaaatatggctttgactctgggatttctcttgattatatttataaaaatcaagctgatggaaaattattactaggaaaatttatagatagattttatctaaatcaaatcggatgggcaggtgtaagagaaagaaaaaagaacttgcttactttaatagaagaaaagataaataatttaggtgaagaaaatgttaaaatcttagatgtagctggtggaactggaaattatttatttgatataaaagaaaaatatccaaatgtacagattttaataaatgagtttaaaaaatcaaatattgaagttggagaagaagttattaagaaaaacaattgggaaaatatatcttttgtaaactatgattgttttaataaggaaacttataaaaaaataaattacacacccaatatagttataatctcaggagtttttgaactctttgaagataataatatgcttgaaaatactatatcaggagtggcagaaatcttagataaaaatggtactgttatttacacaggtcaaccttggcaccctcaattaaagcaaatagctttagttcttaatagccataaaggacatggtaaatcttggcttatgagaagaagaagtgaaaaagagttagatagcttatttgaaaattataatttaaagaaagaaaaaatgctaattgataatgatggaatttttacagtttcattagcagaattgaggtaa

SEQ ID NO: 20146 - protein, 566 aa, Fusobacterium nucleatum subsp. nucleatum ATCC 25586
MENFYFNTFDGNKIFYRIWNFEKNKKTLIIIHRGHEHSERLSELTQNEKFLKYNIFAYDLRGHGYTEVKSSPNAMDYVRDLDSFIKHLKNEYQIKEEDIFIVANSIGGVILSAYVHDFAPNIAGMALLAPAFEIKLYIPFAKQLVTLLTKIKKDAKVMSYVKAKVLTHDIEEQNKYNSDKLINKEINAKLLIDLADMGKRLVEDSMAIELPTIIFSAEKDYVVKNSAEKRFFLNLSSKKREFIELENFYHGIIFEKEREKVYKMLDDFIQDIFKNQNTSLDVSPREFSRKEYERIGLEEYPLSEKIFYSIQKFSMKTFGFLSKGMSLGLKYGFDSGISLDYIYKNQADGKLLLGKFIDRFYLNQIGWAGVRERKKNLLTLIEEKINNLGEENVKILDVAGGTGNYLFDIKEKYPNVQILINEFKKSNIEVGEEVIKKNNWENISFVNYDCFNKETYKKINYTPNIVIISGVFELFEDNNMLENTISGVAEILDKNGTVIYTGQPWHPQLKQIALVLNSHKGHGKSWLMRRRSEKELDSLFENYNLKKEKMLIDNDGIFTVSLAELR

SEQ ID NO: 20147 - DNA, 1761 bp, Xanthomonas axonopodis pv. citri str. 306
  CDS (1)..(1761): transl_table=11
atgcgcacagtgctagagcgcgagttcgtcagtttcgatggtgtgccgctgttctaccggcactggccgttgcacgatgccgtcgcgaccggcacgcccagggcggtggtgctgctgcatcgtggccatgagcactccggccgtgtgatgcatcttgccgaagaactcgacatgcccgatgcgcagttctttgcctgggatgcacgcggcaacggtcgctcgcccggcgtgcgtggcgatgcgccgggcttcgaggcgctggtgcgcgatctggacagcttcatcgcgcatcttcgcgccacccacggcatcgccgtgcaggacatcgtggtgattgcgcagagtgtgggcgcggtggtggctgccacctgggtacacgattacgccccgccgctgcgcgcgctggtgctggcatcgccggcgttcaaggtgaagttgtatgtgccgttcgcacgcgccgggttggcgttgctgcatgcgctgcgcggtaacttcttcgtcaacagctacgtcaagccgcaatggctgacgcatgatccggcgcgcgtggaaagctatcgcaccgatccgttgatcacccgcccgatttcggtgcgcgtattgctcggtctgtacgcggccgccgatcgcgtggtggacgatgcacaggcgatcaccgtgccgacccagttgctggtctccggcgcggatgttgtggtgcatcgcggcccgcaggatcgcttctacgaaaacctgcgctcgccgatcaagcagcgccactggctgccggggtttttccacgacaccctgggcgaacgcgatcgcgcgattgccatcgcgcacattcgccagttcgtccaagtgcggtttgcgcaaccgccggtgcgcgccgcgctgcgcaatgcccaccgtgccggccccagtttcgaagaggccgaacggctggcctggccaccgcagcgcaacagcctgcaggacctgcgctggcgcggcgtgcgtgccggcctgcgcctgggtggcaagctctccgagggcatcgcgcttggtctgcagaccggtttcgattccggcagcacattggactacatctaccgcaatcaggcgcatggtcgcgggccgctgggccgcatgatcgaccgcacgtatctcaacgcgatcggttggcgcggcatccgcatccgcggcagccatctgggcgaattgctgcgcgaggcagcggcgcgcttgcgtggcgccggcaagccggtacgcgtcctggacatcgctgccggacacggccgctatgtgctccaggcgctgggcagcggcgcacagcgtgccgatgcaatcgtgctgcgcgacttcagcccgcccaacgtgacccagggcactgcgctgatccaggcgctgggcgctggcgacatcgcccgtttcgaacaaggcgatgcgttcgacccggcagcattggcgtccgtgcaaccggctccgacgctggcggtggtctcgggcctgtacgaattgtttgccgataacgaccaggtcgcgcgctcgctggccggcctggccgcggcggtgcagccgggcggttatctgctttacaccggtcagccctggcatccgcagctggaattcattgcgcgcgcgctgaccagtcaccgcgatggcgtggcctgggtgatgcgccggcggagccagcaggagatggatggcctggtggaagcggcgggctttcgcaaggtggcgcaacgcatcgatgcgttcggcatcttcaccgtgtcgatggcgcagcgggtcgacgcatga

SEQ ID NO: 20148 - protein, 586 aa, Xanthomonas axonopodis pv. citri str. 306
MRTVLEREFVSFDGVPLFYRHWPLHDAVATGTPRAVVLLHRGHEHSGRVMHLAEELDMPDAQFFAWDARGNGRSPGVRGDAPGFEALVRDLDSFIAHLRATHGIAVQDIVVIAQSVGAVVAATWVHDYAPPLRALVLASPAFKVKLYVPFARAGLALLHALRGNFFVNSYVKPQWLTHDPARVESYRTDPLITRPISVRVLLGLYAAADRVVDDAQAITVPTQLLVSGADVVVHRGPQDRFYENLRSPIKQRHWLPGFFHDTLGERDRAIAIAHIRQFVQVRFAQPPVRAALRNAHRAGPSFEEAERLAWPPQRNSLQDLRWRGVRAGLRLGGKLSEGIALGLQTGFDSGSTLDYIYRNQAHGRGPLGRMIDRTYLNAIGWRGIRIRGSHLGELLREAAARLRGAGKPVRVLDIAAGHGRYVLQALGSGAQRADAIVLRDFSPPNVTQGTALIQALGAGDIARFEQGDAFDPAALASVQPAPTLAVVSGLYELFADNDQVARSLAGLAAAVQPGGYLLYTGQPWHPQLEFIARALTSHRDGVAWVMRRRSQQEMDGLVEAAGFRKVAQRIDAFGIFTVSMAQRVDA

SEQ ID NO: 20149 - DNA, 1764 bp, Yersinia pestis KIM
  CDS (1)..(1764): transl_table=11
atgagtcaggaagtgcgtttatttcaagaaggcatgttcaccgccagcgatgaaacatcgttgtattttcgccactggtctgccacggaaggtaacagcaagaaagttattgtgttgtttcatcgcgggcatgaacactcggggcgtctgcaacatattgtggatgaactgatgatgcccgatacccatttttacgcgtgggatgcgcgtggacacgggcagtcgccaggggctcgtggctacagccccagccttgctcgctcggttttagacgtggatgagtttgtgcgttttgtggcacaggatgcgcaggtcaacctcgacgatatcgtggtgattgcgcaaagcgtgggggccgtgctggtatcaacctgggttcatgactacgcgccgaaaatccgtggcatggtgctggcgtccccggcatttaaggtcaagctgtatgtgccgtttgcccgcctggggctgggattaatgcagcgtatacgtggcctgttttacgtgaattcctacgtgaaagggaaattcctcagccacgaccccgagcgcatcgccagctttgagcaggacaaattaatcacgcgccagatcgccgtcaatattttgctcgatctctacaaaacggctgaacgtattgtttcagactcgacggcgattactctcccgacccagttgcttatttccggcgatgattttgtggtgcatgagaaaccgcaaaaacaattttatgccggtcttcgcagcgcgataaaagagcaacatattctgccgggtttctatcacgacacgctgggtgaaaaagaccgctctattgcttttgataaaatgaaaaactttatcgaccgactctatgcaactgcgccttatgcctttgattatagccatgaagatcgctggagtccgagtgccgatgcgtatcgtgaattgcaggctccaccaaaatcacgctcgctggaagggatgttttatgctgcgctaagtttcggcatgaagaccatcgggcgacagtccaaagggatgcgcctgggttatgaaacaggttttgactccggcagtacgctggattacgtctatcgtaatcagcctgaaggtaatggcattctggggcgtatgattgaccacaactatctgaacagcgttggctggcgtggtattcgcgtgcgtaaagtgaatatccagcagatgattgaacaggccgttgcgaagattcagctcagtcacatgccggtgcgagtggtcgatatcgccgccggacatggccgctatgtgctggatgcactggaaaaacagcagggtatcgaaagtatactgctgcgtgattacagcgatttgaatgtagaaaaaggtcaggcgatgatcgaagagcgtgggctaagccacgtcgctcagttcagaaaaggcaacgccttcgactatgattcccttgccacgctcgatcctgctccgacgctgggcattgtttccgggctgtatgagctcttcccggataacgacttaatcaaaacgtcgttggccgggctggctgcggctattccaccaggcggcatgctggtatacaccgggcaaccgtggcacccacagttaaaaaccatcgcgtataccttaaccagccatcaaaacgggatcccgtggatgatgcgtgtgcgcagccagaaagagatggacacgctggtggagcaggccggctttgaaaaatgccatcaggtgattgatgagtttggcattttcaccgtgtcgctggcggtgagaaagcagcatggttga

SEQ ID NO: 20150 - protein, 587 aa, Yersinia pestis KIM
MSQEVRLFQEGMFTASDETSLYFRHWSATEGNSKKVIVLFHRGHEHSGRLQHIVDELMMPDTHFYAWDARGHGQSPGARGYSPSLARSVLDVDEFVRFVAQDAQVNLDDIVVIAQSVGAVLVSTWVHDYAPKIRGMVLASPAFKVKLYVPFARLGLGLMQRIRGLFYVNSYVKGKFLSHDPERIASFEQDKLITRQIAVNILLDLYKTAERIVSDSTAITLPTQLLISGDDFVVHEKPQKQFYAGLRSAIKEQHILPGFYHDTLGEKDRSIAFDKMKNFIDRLYATAPYAFDYSHEDRWSPSADAYRELQAPPKSRSLEGMFYAALSFGMKTIGRQSKGMRLGYETGFDSGSTLDYVYRNQPEGNGILGRMIDHNYLNSVGWRGIRVRKVNIQQMIEQAVAKIQLSHMPVRVVDIAAGHGRYVLDALEKQQGIESILLRDYSDLNVEKGQAMIEERGLSHVAQFRKGNAFDYDSLATLDPAPTLGIVSGLYELFPDNDLIKTSLAGLAAAIPPGGMLVYTGQPWHPQLKTIAYTLTSHQNGIPWMMRVRSQKEMDTLVEQAGFEKCHQVIDEFGIFTVSLAVRKQHG

SEQ ID NO: 20151 - DNA, 1758 bp, Escherichia coli CFT073
  CDS (1)..(1758): transl_table=11
atggaaaattcacgcatccctggggagcatttttttaccaccagtgataatacagcgttgttttatcggcactggcccactttactgccaggggcgaaaaaggtcatcgtcttatttcatcgcggtcatgaacattctggtcgtctacaacatatcgttgatgaactggcgatgccagatactgctttttatgcatgggatgcccgagggcatggacaaacttcggggccgcgtggttatagtccgtctcttgcgcgttcagtgcaggatgttgatgaatttgtccgttttgctgccagcgacagccaggtcggactggaagaggtggttgtgatcgcgcaaagcgtcggcgcagtgatggttgccacatgggttcatgattatgcgcctgctattcgcggactagtgctggcatctccggcctttaaggttaaattgtatgtgccgctggcacgtcctgggctggcgttatggcatcgtctgcgtggtctgttttttattaattcctatgtgaaagggcgttatctgacccacgatcggcaacgggtggcgagtttcaataatgatccgctgatcacacgggcgattgccgtcaatatcttgctcgatctctataaaacgtctgaacgtattgttagcgatgcggcggcgattacgctccccacgcaacttctgatatcaggcgatgactatgtggtgcatcgccaaccgcagattgatttttatcagcgtttacgtagtcctctgaaagagctgcatctgctgccaggcttttatcacgacacgttgggtgaagagaacagggcgcaggcatttgaaaaaatgcaaagctttatcagccgtttatatgctaacaagtcgcaaaaatttgattatcagcatgaagaccgcacaggaccatcagcggatcgatggcggctcctttctggtggacccgtgccgttatcgccggttgatttggcgtatcgctttatgcgaaaggcgatgaaactgttcggggcgcactctgcgggcctgcatctcggaatgagtaccggctttgattcaggcagttcgctggattatgtctatcaaaatcaaccgcaaggcagtaacgcattcgggcgctttatcgacaaaatctacctgaacagtgttggctggcgcggtattcgccagcgcaaaacccatttacaaatgctgattaaacaagccgttgcccatctccacgccaaaggtttagccgtccgcgtggttgacattgccgcagggcatgggcgctatgtactggatgcgctggcaaacgagcccgccataagcgaaattttgttacgtgattacagtgaggtaaatgttgcacaagggcaagagatgattgcccaacggggaatgtctgggcgggtgcgttttgaacagggcgatgcgtttaacccggaggaactcagcgcgttaactccgcggcctacgctggcgattgtctctggcctgtatgagcttttccccgaaaatgagcaggtaaaaaactcactcgcaggtcttgccaatgccatcgatccgggtggcattctcatctacaccgggcagccgtggcacccacaactggagctgattgccggggtgttaaccagtcataaagatggtaaaccgtgggtaatgcgcgtgcgttcgcaaggggagatggattcgctcgtgcatgatgccggattcgataaatgcacacaacggattgatgtgtggggcatttttacggtttcgatggcggtgcgtcgtgataactga

SEQ ID NO: 20152 - protein, 585 aa, Escherichia coli CFT073
MENSRIPGEHFFTTSDNTALFYRHWPTLLPGAKKVIVLFHRGHEHSGRLQHIVDELAMPDTAFYAWDARGHGQTSGPRGYSPSLARSVQDVDEFVRFAASDSQVGLEEVVVIAQSVGAVMVATWVHDYAPAIRGLVLASPAFKVKLYVPLARPGLALWHRLRGLFFINSYVKGRYLTHDRQRVASFNNDPLITRAIAVNILLDLYKTSERIVSDAAAITLPTQLLISGDDYVVHRQPQIDFYQRLRSPLKELHLLPGFYHDTLGEENRAQAFEKMQSFISRLYANKSQKFDYQHEDRTGPSADRWRLLSGGPVPLSPVDLAYRFMRKAMKLFGAHSAGLHLGMSTGFDSGSSLDYVYQNQPQGSNAFGRFIDKIYLNSVGWRGIRQRKTHLQMLIKQAVAHLHAKGLAVRVVDIAAGHGRYVLDALANEPAISEILLRDYSEVNVAQGQEMIAQRGMSGRVRFEQGDAFNPEELSALTPRPTLAIVSGLYELFPENEQVKNSLAGLANAIDPGGILIYTGQPWHPQLELIAGVLTSHKDGKPWVMRVRSQGEMDSLVHDAGFDKCTQRIDVWGIFTVSMAVRRDN

SEQ ID NO: 20153 - DNA, 1758 bp, Pseudomonas syringae pv. tomato str. DC3000
  CDS (1)..(1758): transl_table=11
atgcgtgatgtgaatgatcagcgcttcaccacccacgatggcgtggagctgttctaccgccactggcctgttgcacacccgacgcccggtgcgccacggcaagcggtgttgctgtttcatcgcggccacgagcattccgggcgaattgcgcatctggttgatgaactggacctgccaggctttgattttttcgcctgggatgcccgcggtcacggccagtcgcccggggcccgtggtgacagcccgagctttgcgaccagcgttcgcgacgtgcagaccttcgtcgatcacctgcgcgtcacgtttgatattgccgaagagaacatggcggtgatcgcgcaaagcgtaggcgccgtcattgcagcgacatgggcgcacgactacgcaccgaagatccgcgcactggtcctcgcctcccccgccttcaaggtcaagctgtacgtacctttcgcccgcacggggctggcgctgctgcgcaggttcaagggcaatttcttcgtcaacagctacgtcaaggcgcgcttcctgagccacgatccgcaacgtatcgcgtcctacgacagcgacccgctgatcaccaaggccatttcagtgaatgtactgctgggcctgtatgaagccgccgaccgtgtggttgccgatgcccaggcgatccagatcccgacccaattgctgatttccggctcggatttcgtcgtgcatcgcgcgccgcaggagcgttttttcgaacaactgggcagcttgcgcaaggagaaacacatcctgccagggttcttccacgacacgttgggcgagcgcgaccgtcacttggcgctgagccgcgcgcggcgctttgttttgcagagttttgaaacgccgatgcaccgcccgtcgttgctggacgctgaccggctgggcgcaacctgtgcggagtccgaagagctggccgcgccgttgccgcacaattcgttgcgcgacctgtactggcgcatgacccacgccagcatgcgccttggcagcaagttatccacaggggtgaaactgggtttcgacactggtttcgattctggcagcacgcttgattacgtctatcgcaaccgacccgccggcaaaggcgcgctgggtcgcatgatcgacaagaactacctgcaatcgatcggctggcgtggcattcgccaacgcaagctgcatgccgaagaactgctgcgcctggccatggcgcatttgcgcaatcagggcaaaccggtacgcatcgtggacatcgccgccgggcacgggcgctacattctggagtcgttgcggggcgtagagccgctgccggaatccattctgctgcgcgactacagcgacatcaatgtgcgcgacggcagcctgctgatagagcagaaagatctggaagacatcgcgcgcttcgtcaagggcgatgcctttgaccgcaacgacctggcgacgctggaccccaaaccgacgctggcggtggtgtcggggctgtacgagttgttttccagcaaccagatggtcggcgattcgctggccgggctggcggcagccgtcgaaccgggcggttatctggtgtacaccgggcagccgtggcacccgcaactggagctgatcgcccgcgccctgaccagccatcgcgaaggccaggcctgggtaatgcgccgtcgcagtcagtcagagatggaccaactggtggaagccgcaggctttcgcaagatcacccagcgtgtggatgaatgggggattttcactgtgtccctcgcgcagcgcatccagtga

SEQ ID NO: 20154 - protein, 585 aa, Pseudomonas syringae pv. tomato str. DC3000
MRDVNDQRFTTHDGVELFYRHWPVAHPTPGAPRQAVLLFHRGHEHSGRIAHLVDELDLPGFDFFAWDARGHGQSPGARGDSPSFATSVRDVQTFVDHLRVTFDIAEENMAVIAQSVGAVIAATWAHDYAPKIRALVLASPAFKVKLYVPFARTGLALLRRFKGNFFVNSYVKARFLSHDPQRIASYDSDPLITKAISVNVLLGLYEAADRVVADAQAIQIPTQLLISGSDFVVHRAPQERFFEQLGSLRKEKHILPGFFHDTLGERDRHLALSRARRFVLQSFETPMHRPSLLDADRLGATCAESEELAAPLPHNSLRDLYWRMTHASMRLGSKLSTGVKLGFDTGFDSGSTLDYVYRNRPAGKGALGRMIDKNYLQSIGWRGIRQRKLHAEELLRLAMAHLRNQGKPVRIVDIAAGHGRYILESLRGVEPLPESILLRDYSDINVRDGSLLIEQKDLEDIARFVKGDAFDRNDLATLDPKPTLAVVSGLYELFSSNQMVGDSLAGLAAAVEPGGYLVYTGQPWHPQLELIARALTSHREGQAWVMRRRSQSEMDQLVEAAGFRKITQRVDEWGIFTVSLAQRIQ

SEQ ID NO: 20155 - DNA, 1764 bp, Yersinia pseudotuberculosis IP 32953
  CDS (1)..(1764): transl_table=11
atgagtcaggaagtgcgtttatttcaagaaggcatgttcaccgccagcgatgaaacatcgttgtattttcgccactggtctgccacggaaggtaacagcaagaaagttattgtgttgtttcatcgcgggcatgaacactcggggcgtctgcaacatattgtggatgaactgatgatgcccgatacccatttttacgcgtgggatgcgcgtggacacgggcagtcgccaggggctcgtggctacagccccagccttgctcgctcggttttagacgtggatgagtttgtgcgttttgtggcacaggatgcgcaggtcaacctcgacgatatcgtggtgattgcgcaaagcgtgggggccgtgctggtatcaacctgggttcatgactacgcgccgaaaatccgtggcatggtgctggcgtccccggcatttaaggtcaagctgtatgtgccgtttgcccgcctggggctgggattaatgcagcgtatacgtggcctgttttacgtgacttcctacgtgaaagggaaattcctcagccacgaccccgagcgcatcgccagctttgagcaggacaaattaatcacgcgccagatcgccgtcaatattttgctcgatctctacaaaacggctgaacgtattgtttcagactcgacggcgattactctcccgacccagttgcttatttccggcgatgattttgtggtgcatgagaaaccgcaaaaacaattttatgccggtcttcgcagcgcgataaaagagcaacatattctgccgggtttctatcacgacacgctgggtgaaaaagaccgctctattgcttttgataaaatgaaaaactttatcgaccgactctatgcaactgcgccttatgcctttgattatagccatgaagatcgctggagtccgagtgccgatgcgtatcgtgaattgcaggctccaccaaaatcacgctcgctggaagggatgttttatgctgcgctaagtttcggcatgaagaccatcgggcgacagtccaaagggatgcgcctgggttatgaaacaggttttgactccggcagtacgctggattacgtctatcgtaatcagcctgaaggtaatggcattctggggcgtatgattgaccacaactatctgaacagcgttggctggcgtggtattcgcgtgcgtaaagtgaatatccagcagatgattgaacaggccgttgcgaagattcagctcagtcacatgccggtgcgagtggtcgatatcgccgccggacatggccgctatgtgctggatgcactggaaaaacagcagggtatcgaaagtatactgctgcgtgattacagcgatttgaatgtagaaaaaggtcaggcgatgatcgaaaagcgtgggctaagccacgtcgctcagttcagaaaaggcaacgccttcgactatgattcccttgccacgctcgatcctgctccgacgctgggcattgtttccgggctgtatgagctcttcccggataacgacttaatcaaaacgtcgttggccgggctggctgcggctattccaccaggcggcatgctggtatacaccgggcaaccgtggcacccacagttaaaaaccatcgcgtataccttaaccagccatcaaaacgggatcccgtggatgatgcgtgtgcgcagccagaaagagatggacacgctggtggagcaggccggctttgaaaaatgtcatcaggtgattgatgagtttggcattttcaccgtgtcgctggcggtgagaaagcagcatggttga

SEQ ID NO: 20156 - protein, 587 aa, Yersinia pseudotuberculosis IP 32953
MSQEVRLFQEGMFTASDETSLYFRHWSATEGNSKKVIVLFHRGHEHSGRLQHIVDELMMPDTHFYAWDARGHGQSPGARGYSPSLARSVLDVDEFVRFVAQDAQVNLDDIVVIAQSVGAVLVSTWVHDYAPKIRGMVLASPAFKVKLYVPFARLGLGLMQRIRGLFYVTSYVKGKFLSHDPERIASFEQDKLITRQIAVNILLDLYKTAERIVSDSTAITLPTQLLISGDDFVVHEKPQKQFYAGLRSAIKEQHILPGFYHDTLGEKDRSIAFDKMKNFIDRLYATAPYAFDYSHEDRWSPSADAYRELQAPPKSRSLEGMFYAALSFGMKTIGRQSKGMRLGYETGFDSGSTLDYVYRNQPEGNGILGRMIDHNYLNSVGWRGIRVRKVNIQQMIEQAVAKIQLSHMPVRVVDIAAGHGRYVLDALEKQQGIESILLRDYSDLNVEKGQAMIEKRGLSHVAQFRKGNAFDYDSLATLDPAPTLGIVSGLYELFPDNDLIKTSLAGLAAAIPPGGMLVYTGQPWHPQLKTIAYTLTSHQNGIPWMMRVRSQKEMDTLVEQAGFEKCHQVIDEFGIFTVSLAVRKQHG

SEQ ID NO: 20157 - DNA, 1764 bp, Xanthomonas campestris pv. campestris str. 8004
  CDS (1)..(1764): transl_table=11
atgcgcacagttgtagagcgcgagttcgccagtttcgacggtgcgcccctgttttatcggcactggccggtgcaggccgctgccgatgccgcaacgccgcccaaggccgtggtgttgctgcaccgtgggcacgagcattccgggcgggtgatgcacctggccgaagaattgcagctgccggacgcgcagttctttgcctgggatgcgcgcggcaacgggcgctcgcccggcgcgcgcggcgacgcgcccggcttcgatgcgctagtgcgcgacctggacagtttcattgcgcacatcggtgccacccacggcatcgcggtgcaggacatcgtggtgatcgcgcagagcgtgggcgcggtggtggcatccacctgggtgcacgattacgcgccgccgctgcgcgcgctggtgctggcctcgccggcgttcaaggtcaagttgtatgtgccgtttgcacgcgcggggctggcgctgatgcaggcgctgcgcggcaacttcttcgtcaacagctatgtcaagccgcagtggctgacgcatgatccggcgcgcgtggacagctaccgtaccgatccgttgatcacccggccgatttcggtgcgtgtgctgctggggctgtatgcggcgggcgaccgcgtggtggccgatgcgcaggcgatcaccgtgccgacccagttgctggtctccggcgcggatttcgttgtgcatcgcggcccgcaggaccgcttctatgagaacctgcgctcgccgatcaagcaacggcattttctgcccgggttcttccacgacaccttgggtgagcgcgaccgtgcgatagcgattgcgcagatccgtcagttcgtcagcgagcgctttgcgcagccaccggtgcgcgcggacctgcgcgacgcgcatcgtgcgggaccgagtttcgaagaagccgaacgcctggcctggccgtcgcaacgcaacagcctgcaagacctgcgctggcgcggtgtgcgtgcgggcctgcggctgggtggcacattgtccgaaggcatcgcgctgggcctgcagaccggcttcgattccggcagcacgctggattacatctatcgcaaccaggcgcgtgggcgcgggccgctcggccgcatgatcgaccgcaattacctcaacgccatcggctggcgcggcatccgcatccgtggcgcgcatctgggcgaattgctgcgcgcaaccgccacccgcctgcgccaggccgggcaaccggtgcgcgtgttggacatcgctgccgggcatggccgctacgtgctggaagcgctgggcagcggcgcgcaacgcgccgatgcgatcgtgctgcgcgacttcagcccgctcaatgtcacccagggtgcggcgttgatccaggcgctgggtgcaggcgacatcgcgcgcttcgagcagggcgatgcgttcgatccagtctcggtgggcgcggtggacccggcgcccacgctggctgtggtgtcgggcctgtacgaactgtttgccgacaacgaccaggtggcgcgctcgctcgctggcgtggccgcggcggtgccgcccggcggctatctgctctacaccgggcagccctggcatccgcagctggaattcattgcgcgcgcactcaccagtcatcgcgatggcgtggcctgggtgatgcgccggcgcagccagcaggagatggacggcctggtggaagcggccgggtttcgcaaggtggaccagcgcatcgacgcgttcggcatcttcaccgtgtcgctggcgcagcggatcaacgcatga

SEQ ID NO: 20158 - protein, 587 aa, Xanthomonas campestris pv. campestris str. 8004
MRTVVEREFASFDGAPLFYRHWPVQAAADAATPPKAVVLLHRGHEHSGRVMHLAEELQLPDAQFFAWDARGNGRSPGARGDAPGFDALVRDLDSFIAHIGATHGIAVQDIVVIAQSVGAVVASTWVHDYAPPLRALVLASPAFKVKLYVPFARAGLALMQALRGNFFVNSYVKPQWLTHDPARVDSYRTDPLITRPISVRVLLGLYAAGDRVVADAQAITVPTQLLVSGADFVVHRGPQDRFYENLRSPIKQRHFLPGFFHDTLGERDRAIAIAQIRQFVSERFAQPPVRADLRDAHRAGPSFEEAERLAWPSQRNSLQDLRWRGVRAGLRLGGTLSEGIALGLQTGFDSGSTLDYIYRNQARGRGPLGRMIDRNYLNAIGWRGIRIRGAHLGELLRATATRLRQAGQPVRVLDIAAGHGRYVLEALGSGAQRADAIVLRDFSPLNVTQGAALIQALGAGDIARFEQGDAFDPVSVGAVDPAPTLAVVSGLYELFADNDQVARSLAGVAAAVPPGGYLLYTGQPWHPQLEFIARALTSHRDGVAWVMRRRSQQEMDGLVEAAGFRKVDQRIDAFGIFTVSLAQRINA

SEQ ID NO: 20159 - DNA, 1758 bp, Pseudomonas fluorescens Pf-5
  CDS (1)..(1758): transl_table=11
atgcgcgacgctcaacaccagacgttccgaacccatgacggtgtcgaactgttctaccgccactggccagccactgaagtggcccctggcgaaccgcggcaagcggtgatgctgttccaccgcggtcacgaacactccgggcgcattgcccacctggtggaagagctgaacctgccccagttcgatttcttcgcctgggacgcccgtggccatggccagtcgccgggcgcccgtggcgacagcccgagcttcgctaccagcgtgcgcgacgtgcagaccttctgtgatcacctgggcagcgctcatgggatcgccgaggaaaacatcgccgtggtggcccagagtgtgggcgcggtgatcgcgtccacctgggtccacgactacgcgccgcgcatccgctccctggtgctggcctcgccggcgttcaaggtcaagctgtacgtgcccttcgcccggcccggcctggccctgatgcggcgctttcgtggcaacttcttcgtcaacagctacgtcaaggcgcgcttcctgagccacgacccggagcgggtccgcagctatgacagcgacccgctgatcaccaaggcgatctcggtgaatgtactgctgggcctgtatgaagcggcagaccgggtggtagccgacgcccaggcgatccaggtgccgacccagttgctgatctccggctccgacttcgtggtgcatcgcaagccccaggagcagttcttcgagcgcctgggcagcctgcacaaggaaaagcacatcctcccgggcttcttccacgacaccctgggggaaaagaaccgggcgccggccatggccagcatccgtcgcttcatcctgcagaatttcgagcgcccgctgaaccgccctgccctgctggacgccgaccgcctgggcgttacctgcgccgagtccgaagccctggccgcgccgctgccgcacaattccctgcgcgacctgtactggcgcgccacccgcgccagcatgcgcctgggcagccagctgtcggcgggggtcaagctgggcttcgacaccggtttcgactccggcagcaccctggactacgtctaccgcaaccgccccaccgggcattccgcactgggccggatgatcgaccagaactacctgaactccatcggctggcgcggcatccgccagcgcaagctgcatgtggaagaactgctgcgcctggccatggaaaaactccgtgagcaaaacagcgaagtgcgcatcgtcgatatcgccgccggccacggccgctacatcctcgaagccctgcaaggggtcagcccgctgccggaatcgatcctgctgcgcgactacagcgatatcaacgtgcgcgacggcagtgcgctgatccaggaaaaaggcctgggggacatcgcccgcttcgtcaaaggcaacgccttcgaccgcgaggacctcgcagccctggacccgaaacccaccctggcggtggtctccgggctctatgagctgttcgccgacaaccagatggtcggcggctccctggcgggcctggccagtgccgtggagcccggcggctacctggtgtacaccggccagccgtggcacccgcagctggaactgatcgcccgcgccctgaccagccaccgcgaaggccaggcctgggtcatgcgccgccgcacccaggcggagatggaccaactggtggaggccgccggctttcgcaaggtcaccatgcgtgtggatgaatgggggattttcagcgtatccctggcgcaacgggtgcaatga

SEQ ID NO: 20160 - protein, 585 aa, Pseudomonas fluorescens Pf-5
MRDAQHQTFRTHDGVELFYRHWPATEVAPGEPRQAVMLFHRGHEHSGRIAHLVEELNLPQFDFFAWDARGHGQSPGARGDSPSFATSVRDVQTFCDHLGSAHGIAEENIAVVAQSVGAVIASTWVHDYAPRIRSLVLASPAFKVKLYVPFARPGLALMRRFRGNFFVNSYVKARFLSHDPERVRSYDSDPLITKAISVNVLLGLYEAADRVVADAQAIQVPTQLLISGSDFVVHRKPQEQFFERLGSLHKEKHILPGFFHDTLGEKNRAPAMASIRRFILQNFERPLNRPALLDADRLGVTCAESEALAAPLPHNSLRDLYWRATRASMRLGSQLSAGVKLGFDTGFDSGSTLDYVYRNRPTGHSALGRMIDQNYLNSIGWRGIRQRKLHVEELLRLAMEKLREQNSEVRIVDIAAGHGRYILEALQGVSPLPESILLRDYSDINVRDGSALIQEKGLGDIARFVKGNAFDREDLAALDPKPTLAVVSGLYELFADNQMVGGSLAGLASAVEPGGYLVYTGQPWHPQLELIARALTSHREGQAWVMRRRTQAEMDQLVEAAGFRKVTMRVDEWGIFSVSLAQRVQ

SEQ ID NO: 20161 - DNA, 1776 bp, Ralstonia eutropha JMP134
  CDS (1)..(1776): transl_table=11
gtggaacgtacgccgatcgagtcctcgtttgccacccatgacgggcaggaactgttctaccggcactggccggctgcgagtcgtcagccacgcggtgccgtgctgctgttccaccgcggacatgaacattccgggcgcgttgcgcatcttgtggacgagttggacttgcctgaccatgccttcttcgcgtgggatgcacgcggccacgggcgctcgcccggcgagcgtggctacagcccgggactcgcctgttcggtgcgcgatatccagaccttcgtcgaccatatcgcgaccatgcatggtatcggcgtggatcgcattgccgtggtggcgcaaagcgtcggtgccgtgcttgctgcgacctgggtgcacgactatgcgccgcgcatccgctgtctggtcgtggcgtcaccggcgttcaaggtcaagctctacgtgccattcgcgcggcccggcctgaagctgatgcagcagatgcgcggcaagttcttcgtcaacagctacgtcaaggcgaaattcctgacacacgatccgcagcgcgtggccagctacaacgctgatccgctcattactcggccaatcgcggtcaatatgctgctcgatctctacgatgccggcgagcgcatcgtggccgatgcagcggcgattacggttcccacgcaactgctgatttccggcgcggactgggtcgtgcatcgtggtccgcaggacgcgttcttcgatcggctgggggcgcgcgtgaaggagcgcatcgtgctcgatggtttctaccacgacacgcttggcgaacgcgatcgcgcatccgccgtggccgccgcgcggcgtttcatcgttcgcgagttcgatacaccgtcggagccggtgtcgctgctgggcgccgaccggcgggggcctttcaaggacgaggccgaccggctcgccgtgccgctgtccgctggcagtcctgcgggcctgtattggggcatggtgcgtggagggctgcgctttggcggcatgttgtccgaaggcgtacggctcggccaccagaccggttttgattcgggttcgacgctcgactacgtctatcgcaacaaggcgacgggccgcttcggcattggccaggcggtcgaccgcaactacctggacgcgattggctggcgtggcatccggcagcgcaagctgcatgtcgaggaactgatcggcgaggccattcgccgcctgcaggccatgggcgagccggtgcgcatcgtggatattgccgccggccacgggcgttatgtgctggaggcgctgacctcgcaaagcggcaacatcgacggcaacgcggtggagagcatcctgctgcgtgactacagcgacctcaatgtcgagcagggacggaacctgatccgccgcaagggcctcgatccgatcgcgcgcttcgaaaagggcgatgcgttcgatggcgacagccttgccgcgctgaatccggcgccgacgctggccatcgtttccgggctctatgaactgttcggggacaacgagatggtcggatgctcgctgcgcggactggcacaggcggtgcgtcccggcggctatctggtctatacgggacagccgtggcatccgcaactcgagttcatcgcacgcgcgctaaccagccaccgtgccggatccgcgtgggtcatgcgccgccgctcgcaggccgagatggatgaactcgtgcgccacgccggtttcgaaaagctcgcgcagcgcatcgacccgtggggcatcttcacggtcagcctggcgcgccggaaaggcgagggcgcctga

SEQ ID NO: 20162 - protein, 591 aa, Ralstonia eutropha JMP134
MERTPIESSFATHDGQELFYRHWPAASRQPRGAVLLFHRGHEHSGRVAHLVDELDLPDHAFFAWDARGHGRSPGERGYSPGLACSVRDIQTFVDHIATMHGIGVDRIAVVAQSVGAVLAATWVHDYAPRIRCLVVASPAFKVKLYVPFARPGLKLMQQMRGKFFVNSYVKAKFLTHDPQRVASYNADPLITRPIAVNMLLDLYDAGERIVADAAAITVPTQLLISGADWVVHRGPQDAFFDRLGARVKERIVLDGFYHDTLGERDRASAVAAARRFIVREFDTPSEPVSLLGADRRGPFKDEADRLAVPLSAGSPAGLYWGMVRGGLRFGGMLSEGVRLGHQTGFDSGSTLDYVYRNKATGRFGIGQAVDRNYLDAIGWRGIRQRKLHVEELIGEAIRRLQAMGEPVRIVDIAAGHGRYVLEALTSQSGNIDGNAVESILLRDYSDLNVEQGRNLIRRKGLDPIARFEKGDAFDGDSLAALNPAPTLAIVSGLYELFGDNEMVGCSLRGLAQAVRPGGYLVYTGQPWHPQLEFIARALTSHRAGSAWVMRRRSQAEMDELVRHAGFEKLAQRIDPWGIFTVSLARRKGEGA

SEQ ID NO: 20163 - DNA, 1713 bp, Fusobacterium nucleatum subsp. vincentii ATCC 49256
  CDS (1)..(1713): transl_table=11
ttgggaggagacatggaaaatttattttttaatacttttgatggaaataaaattttttatagagtatggaattttgaaaaaaataaaaaaactttaattattattcatagagggcatgaacattcagagagattaagtgaattaacacaagatgaaaaatttttaaaatataatatttttgcttatgatttaagaggacatggctatacagaagctaagacttctcctaatgctatggattatgttagagatttagatttttttgtaaaacatataaaaagtgaatatcaaataaaagaagaagatatttttattgtagcaaatagcataggtggtgttatactttctgcctatgttcatgattttgcaccaaatatagcaggtattgcattacttgcacctgcttttgaaataaaactttatattccttttgcaaaacaacttataacattacttactaaaataaaaaaagatgctaaggttatgagttatgttaaagcaaaagttttaactcatgatgttgaagaacaaaataaatataataatgataaacttataaataaagaaattaatgccaaacttttaattgatttagctaatatgggcaaaagattggttgaagattctatggcaatagaactacctacaataatattttctgctgaaaaagactatgttgtaaaaaattctgcacaaaagaaattctttttaaatttatcatctaaaaaaagagaatttatagaacttgaaaatttttatcatggaataatttttgaaaaagaaaggcaaaaagtatataaaatgttggatgattttatacaagatgttttcaaaaataaaaatattacacttgatgtttctcccagagaattttcaagaaaggagtatgaaaggatagccttaggagaatatcctctaagtgaaaaaatattttattctatacaaaaattttcaatgaaaacttttggatttttaagtaaaggtatgagtttaggattaagatatggctttgactctggaatttctcttgattatatttataaaaatcaagctgatgaaaaattattactaggaaaatttatagatagattttatctaaatcaaattggctgggcaggtgttagggaaaggaaaaagaacttgcttactttaatagaagaaaagataaataatttaggtgaagaaaatgttaaaatcttagatgttgctggtggaactgggaattatttatttgatataaaagaaaaatatccaaagatacatattttaataaatgagtttaaaaaatcaaatattgaagttggagaagaagttattaagaaaaataattggaaaaatatatcttttgtaaactatgactgttttgatagagagacttataaaaaaatagattacacacctaatatagttataatctcaggagtttttgagctttttgaagataataatatgcttgaaaatactatttcaggagtagcagaaattttagagaaaaatggtgctgttatttacacaggtcagccttggcaccctcaattaaagcaaatagccttagttcttaatagccataaaggaaacgataaatcttggcttatgagaagaagaagtgaaaaagagctagatggtttatttgaaaaatataatttgaataaagaaaaaatgctaattgataataatggaatttttacagtttcattagcagaattgaggtag

SEQ ID NO: 20164 - protein, 570 aa, Fusobacterium nucleatum subsp. vincentii ATCC 49256
MGGDMENLFFNTFDGNKIFYRVWNFEKNKKTLIIIHRGHEHSERLSELTQDEKFLKYNIFAYDLRGHGYTEAKTSPNAMDYVRDLDFFVKHIKSEYQIKEEDIFIVANSIGGVILSAYVHDFAPNIAGIALLAPAFEIKLYIPFAKQLITLLTKIKKDAKVMSYVKAKVLTHDVEEQNKYNNDKLINKEINAKLLIDLANMGKRLVEDSMAIELPTIIFSAEKDYVVKNSAQKKFFLNLSSKKREFIELENFYHGIIFEKERQKVYKMLDDFIQDVFKNKNITLDVSPREFSRKEYERIALGEYPLSEKIFYSIQKFSMKTFGFLSKGMSLGLRYGFDSGISLDYIYKNQADEKLLLGKFIDRFYLNQIGWAGVRERKKNLLTLIEEKINNLGEENVKILDVAGGTGNYLFDIKEKYPKIHILINEFKKSNIEVGEEVIKKNNWKNISFVNYDCFDRETYKKIDYTPNIVIISGVFELFEDNNMLENTISGVAEILEKNGAVIYTGQPWHPQLKQIALVLNSHKGNDKSWLMRRRSEKELDGLFEKYNLNKEKMLIDNNGIFTVSLAELR

SEQ ID NO: 20165 - DNA, 1791 bp, Ralstonia eutropha JMP134
  CDS (1)..(1791)
atggagacgcactgcgtggaacgtacgccgatcgagtcctcgtttgccacccatgacgggcaggaactgttctaccggcactggccggctgcgagtcgtcagccacgcggtgccgtgctgctgttccaccgcggacatgaacattccgggcgcgttgcgcatcttgtggacgagttggacttgcctgaccatgccttcttcgcgtgggatgcacgcggccacgggcgctcgcccggcgagcgtggctacagcccgggactcgcctgttcggtgcgcgatatccagaccttcgtcgaccatatcgcgaccatgcatggtatcggcgtggatcgcattgccgtggtggcgcaaagcgtcggtgccgtgcttgctgcgacctgggtgcacgactatgcgccgcgcatccgctgtctggtcgtggcgtcaccggcgttcaaggtcaagctctacgtgccattcgcgcggcccggcctgaagctgatgcagcagatgcgcggcaagttcttcgtcaacagctacgtcaaggcgaaattcctgacacacgatccgcagcgcgtggccagctacaacgctgatccgctcattactcggccaatcgcggtcaatatgctgctcgatctctacgatgccggcgagcgcatcgtggccgatgcagcggcgattacggttcccacgcaactgctgatttccggcgcggactgggtcgtgcatcgtggtccgcaggacgcgttcttcgatcggctgggggcgcgcgtgaaggagcgcatcgtgctcgatggtttctaccacgacacgcttggcgaacgcgatcgcgcatccgccgtggccgccgcgcggcgtttcatcgttcgcgagttcgatacaccgtcggagccggtgtcgctgctgggcgccgaccggcgggggcctttcaaggacgaggccgaccggctcgccgtgccgctgtccgctggcagtcctgcgggcctgtattggggcatggtgcgtggagggctgcgctttggcggcatgttgtccgaaggcgtacggctcggccaccagaccggttttgattcgggttcgacgctcgactacgtctatcgcaacaaggcgacgggccgcttcggcattggccaggcggtcgaccgcaactacctggacgcgattggctggcgtggcatccggcagcgcaagctgcatgtcgaggaactgatcggcgaggccattcgccgcctgcaggccatgggcgagccggtgcgcatcgtggatattgccgccggccacgggcgttatgtgctggaggcgctgacctcgcaaagcggcaacatcgacggcaacgcggtggagagcatcctgctgcgtgactacagcgacctcaatgtcgagcagggacggaacctgatccgccgcaagggcctcgatccgatcgcgcgcttcgaaaagggcgatgcgttcgatggcgacagccttgccgcgctgaatccggcgccgacgctggccatcgtttccgggctctatgaactgttcggggacaacgagatggtcggatgctcgctgcgcggactggcacaggcggtgcgtcccggcggctatctggtctatacgggacagccgtggcatccgcaactcgagttcatcgcacgcgcgctaaccagccaccgtgccggatccgcgtgggtcatgcgccgccgctcgcaggccgagatggatgaactcgtgcgccacgccggtttcgaaaagctcgcgcagcgcatcgacccgtggggcatcttcacggtcagcctggcgcgccggaaaggcgagggcgcctga

SEQ ID NO: 20166 - protein, 596 aa, Ralstonia eutropha JMP134
METHCVERTPIESSFATHDGQELFYRHWPAASRQPRGAVLLFHRGHEHSGRVAHLVDELDLPDHAFFAWDARGHGRSPGERGYSPGLACSVRDIQTFVDHIATMHGIGVDRIAVVAQSVGAVLAATWVHDYAPRIRCLVVASPAFKVKLYVPFARPGLKLMQQMRGKFFVNSYVKAKFLTHDPQRVASYNADPLITRPIAVNMLLDLYDAGERIVADAAAITVPTQLLISGADWVVHRGPQDAFFDRLGARVKERIVLDGFYHDTLGERDRASAVAAARRFIVREFDTPSEPVSLLGADRRGPFKDEADRLAVPLSAGSPAGLYWGMVRGGLRFGGMLSEGVRLGHQTGFDSGSTLDYVYRNKATGRFGIGQAVDRNYLDAIGWRGIRQRKLHVEELIGEAIRRLQAMGEPVRIVDIAAGHGRYVLEALTSQSGNIDGNAVESILLRDYSDLNVEQGRNLIRRKGLDPIARFEKGDAFDGDSLAALNPAPTLAIVSGLYELFGDNEMVGCSLRGLAQAVRPGGYLVYTGQPWHPQLEFIARALTSHRAGSAWVMRRRSQAEMDELVRHAGFEKLAQRIDPWGIFTVSLARRKGEGA

SEQ ID NO: 20167 - DNA, 1761 bp, Pseudomonas aeruginosa UCBPP-PA14
  CDS (1)..(1761)
atgcgcgacgtacaggaattgcgtttcaccacccacgacggggtagaactcttctaccgccactggccggccagccgcccggcgccggacggcacgcgccaggcggtgttgctgttccaccgcggccatgagcactccgggcggatcgcccacctggtcgacgaactcgacctgccggaacacgacttcttcgcctgggacgcccgtggccacggcctctcgccaggcgcccgcggcgacagcccgagcttcgccaccagcgtgcgcgacgtacagaccttcgtcgaccatatccaggccgtccacggtatcgccgaagagcggatggcggtggtggcgcagagcgtcggcgcggtgctggttgccacctgggcccacgactacgcgccgaaggtgcgcgcactggtgctggcttcgccggcgttccaggtcaagctctacgtgccgttcgcccgcagcgggctgaaactgatgcgcctgtggcgcggcaatttcttcgtcaacagctatgtcaaggcacgcttcctcagtcacgacccgcagcggatcgcctcctacgacagcgacccgctgatcgccaaggcgatctcggtgaacgtcctgctcggcctctacgaagctgccgagcgggtggtagcggacgcacaggcgatccagattcccacccaactgctgatttccggggccgacttcgtcgtccatcgtgcgccgcaggagcgcttcttcgagcgtctcggcagcctgcgcaaggaaaagcacatcctgcccggcttcttccacgacacccttggcgagcgcgatcgtcacctggccgtcggccgtgcccggcgcttcctcctcgaggcattcgccacggtccccgaacgaccgagcctgctcgatgccgaccgcctgggtcatacctgcgccgaggccgaggcgctggccgcgccgttgccgaagaactcgccgcgcgatctctactggcgcgccacccgtgccggcctgcgcctgggcagcctgtggtcggacggggtcaagctgggcttcgacaccggtttcgattccgggagcaccctcgactatgtctaccgcaaccagcccagcggcagcggcccgctgggtcgcctgatcgaccgcaactacctggactccatcggctggcgcggcatccgccagcgcaagctgcacgccgaggagctgctgcgcctggccatgcagcggttgcgcgaggagcagcgcgaggtgcgcatcgtcgacatcgccgccggccacggccgctacatcctcgaagccctgcaaggcgtcgagccgctgccggaaagcatccttctgcgcgactacagcgagatcaacgtgcgtgacggcagcgccctgatcgaaagcaagggcctcgccggcatcgcccgctttgtcaagggcgacgccttcgatcgcgccgacctggcggcgctgcaaccgaagccgagcctcggggtggtttccgggctctacgagctgttcgccgacaaccgcatggtcggcgactccctcgccggcctcggcgaggcgctggaggagggcgcctacctggtctacaccggacagccctggcacccgcagctggaactgatcgcccgcgcgctgaccagccaccgccagggccaggcctgggtgatgcggcgccggacccaggcggaaatggaccagctggtggccgccgccggcttccgcaagatcacccagcgggtcgaccagtggggcatcttcagcgtatcgctggcgcagaaggtcgcccgctga

SEQ ID NO: 20168 - protein, 586 aa, Pseudomonas aeruginosa UCBPP-PA14
MRDVQELRFTTHDGVELFYRHWPASRPAPDGTRQAVLLFHRGHEHSGRIAHLVDELDLPEHDFFAWDARGHGLSPGARGDSPSFATSVRDVQTFVDHIQAVHGIAEERMAVVAQSVGAVLVATWAHDYAPKVRALVLASPAFQVKLYVPFARSGLKLMRLWRGNFFVNSYVKARFLSHDPQRIASYDSDPLIAKAISVNVLLGLYEAAERVVADAQAIQIPTQLLISGADFVVHRAPQERFFERLGSLRKEKHILPGFFHDTLGERDRHLAVGRARRFLLEAFATVPERPSLLDADRLGHTCAEAEALAAPLPKNSPRDLYWRATRAGLRLGSLWSDGVKLGFDTGFDSGSTLDYVYRNQPSGSGPLGRLIDRNYLDSIGWRGIRQRKLHAEELLRLAMQRLREEQREVRIVDIAAGHGRYILEALQGVEPLPESILLRDYSEINVRDGSALIESKGLAGIARFVKGDAFDRADLAALQPKPSLGVVSGLYELFADNRMVGDSLAGLGEALEEGAYLVYTGQPWHPQLELIARALTSHRQGQAWVMRRRTQAEMDQLVAAAGFRKITQRVDQWGIFSVSLAQKVAR

SEQ ID NO: 20169 - DNA, 1758 bp, Burkholderia cepacia R18194
  CDS (1)..(1758)
atggcccgcgaggccgacttcatcacgcacgacggcgaaacgctgttctatcgtcactggcccgccacgggcgcgcgctgccgcggcgcaatcgtgttgctgcatcgcggccacgaacactcggcgcgcgtcgcgcacctcgtcgacgagctcgacctgcccgatttcgcattcttcgcgtgggatgcgcgcggccacggccgctcgcccggcgcgcgcggctacagcccgagcgcggccgcgtcggtgcgcgacctgcagaccttcgttgaacatatccgcgacacgcacggcatcgcgatcgaggacatggccgtggtcggccagagcgtcggcgcggtgctcgcggccacctgggcgcacgattatgcgccgccgatccgcgcgctcgtcgtcgcgtcgccggcgttccacatcaagctctacgtaccgttcgcgcggccgggcctgcggctgatgcacaagctgcgcgggctgttctacgtgaacagctacgtgaagccgaaattcctcacgcacgatcccgagcggatcgcgagctatgcgtccgacccgctgatcacgcggccgatcgcggtcaacatgctgctcgacctgcacgataccgcgcagcggatcgtcgccgacgcggccgcgatcaccgtgccgacgcagctgctgatctcgggcgccgactgggtcgtgcatcgcggcccgcaggaccgcttcttcgagcgcctcggcgccgcgcgcaaggagcgcatcgtgctgccgggcttctatcacgacacgctcggcgaacgcgaccgcgcgcaggcgctcgcaccgctgcgtgcattcgtgctgcgggaattcgatgcgccgagcccgcgcgtgtcgctcgccgacgccgaccggcgcggcgcgttccacgacgaatacgcggcgctcggccgcccgcccgcgaatgcgttcgcgcgggcgtactgggcgctcacgcgcgccggcctgaaggccggcggcgcgctgtcggacggcatcgcgctcgggctgcggctcggcttcgattcgggctcgacgctcgactacgtgtaccgcaaccgcgcgcaggggcgtctcggcgtcggcgcgctgatcgatcgcacctatctcgattcgccaggctgggtcggcatccgccagcgcaaggtgcatctgcaggaactgatcggcgcggcgatcggccgcctgcgcggccacggcgcgccggtgcggatcgtcgacatcgcggccgggcacgggcgctacgtgctcgacgcgatcgcgtcggccgccgagcgcgacggcgcggcgcccgacgacatcacgctgcgcgactacagcccgccgaacgtcgaggccgggcgcgtgctgattgcgcagcgcggcctcgatccgattgcgcgcttcgagcgcggcgacgcgttcgacgaggcgtcgctcgcgacgctcgagccgcgtccgacgctcgcgatcgtgtcgggcctctacgagctgttcggcgagaacgcgctgatcgagcgctcgctgcgcgggctcgcgcaggccgtgccgccgggcggctatctcgtctatacggggcagccgtggcatccgcagctcgaattcatcgcgcgcgcgctgaacaatcaccgcggcgaagcgacctgggtgatgcgccggcgctcgcaggccgagatggacgaactcgtcgcgcgcgcgggcttccgcaagctcgaccagcggatcgacgaaatgggcatcttcacggtcagcctcgcgcagcgggtcgacgcgtcatga

SEQ ID NO: 20170 - protein, 585 aa, Burkholderia cepacia R18194
MAREADFITHDGETLFYRHWPATGARCRGAIVLLHRGHEHSARVAHLVDELDLPDFAFFAWDARGHGRSPGARGYSPSAAASVRDLQTFVEHIRDTHGIAIEDMAVVGQSVGAVLAATWAHDYAPPIRALVVASPAFHIKLYVPFARPGLRLMHKLRGLFYVNSYVKPKFLTHDPERIASYASDPLITRPIAVNMLLDLHDTAQRIVADAAAITVPTQLLISGADWVVHRGPQDRFFERLGAARKERIVLPGFYHDTLGERDRAQALAPLRAFVLREFDAPSPRVSLADADRRGAFHDEYAALGRPPANAFARAYWALTRAGLKAGGALSDGIALGLRLGFDSGSTLDYVYRNRAQGRLGVGALIDRTYLDSPGWVGIRQRKVHLQELIGAAIGRLRGHGAPVRIVDIAAGHGRYVLDAIASAAERDGAAPDDITLRDYSPPNVEAGRVLIAQRGLDPIARFERGDAFDEASLATLEPRPTLAIVSGLYELFGENALIERSLRGLAQAVPPGGYLVYTGQPWHPQLEFIARALNNHRGEATWVMRRRSQAEMDELVARAGFRKLDQRIDEMGIFTVSLAQRVDAS

SEQ ID NO: 20171 - DNA, 1770 bp, Burkholderia vietnamiensis G4
  CDS (1)..(1770): transl_table=11
atgagcgcacgcacggcccgcgaggccgacttcatcgcgcacgacggcaccgcgctgttctatcgtcactggcccgccaccgcgccgcgctgccgcggcgcgatcgtgctgctgcatcgcggtcacgagcattcggcgcgtgtagcgcacctcgtcgacgagctcgacctgcccgacttcgcgttcttcgcatgggacgcgcgcggccacggccgctcgcccggcacgcgcggctacagtccgggcgcggccgcgtcggtgcgcgatctgcagagcttcgtcgagcacattcgcgacacgcacggcgtcgcgatcgaggacatcgccgtcgtcggacagagcgtcggcgcggtgctcgcagccgcgtgggcgcacgactatgcgccgccgatccgctgcctcgtgctcgcgtcgcccgcgttccacatcaagctgtacgtaccgttcgcgcggccgggcttgcggctgatgcacaagctgcgcggcctgttctacgtgaacagctacgtgaagccgaaattcctcacgcacgacccgcagcggatcgcgagctatgcggccgatccgctggtcacgcggccgatcgcggtcaacatgctgctcgatctgcacgacaccgcgcagcggatcgtcgccgatgcggccgcgatcacggtgccgacccagctgctgatctcgggcgccgactgggtcgtgcatcgcgctccgcaggatcgcttcttcgagcggctcggcgccgcgcgcaaggagcgcatcgtgctgccgggcttctatcacgatacgctcggcgagcgcgaccgcacgcaggcgctcgcgccgctgcgcgcgttcgtgctgcgcgaattcgacacgccgggcccgcgcgtgtcgctcgccgacgccgaccggcgcggcgcgttccatgacgaatacgtggcgctccgcgccgcgccggcgagcccgttcgcgcgcgcgtactgggcgttcgtgcgggccggcctgaaggcgggcggcgcactgtcggacggcatcgcgctcgggctgcggctcggcttcgattcgggctcgacgctcgactacgtgtaccgcaatcgcgcgcaggggcgcttcggcatcggcgcgctgatcgatcgcacctatctagactcgccgggctgggccggcattcgccggcgcaagctgcacctgcaggagctgatcggtgcggcgatcggccggctgcgcagccggggcgaaccggtgcgcatcgtcgacatcgcggccggccacgggcgctacgtgctcgacgcgatcgcgacggccgccgagcgcgacggcgcggcgcccgacgacatcctgctgcgcgactacagcgcgccgaacgtcgatgccgggcgcgtgctgatcgcgcagcgcggcctcgagccgatcgcgcgcttcgagcgcggcgatgcgttcgacgacgcgtcgctcgcgacgctcgaaccgcgtccgacgctcgcgatcgtgtcgggactgtacgagctgttcggcgacaacgcgctcgtcgagcgctcgctgcgcgggctcgcgcaggccgtgccgcccggcgggtatctcgtctatacggggcagccgtggcatccgcagctcgaattcatcgcgcgcgtgttgaacaatcaccgcggcgaggcgacgtgggtgatgcgccgccgctcgcaggccgagatggacgagctcgtcgcgcgcgcgggctttcgcaagctcgaccagcgcatcgacgcgatgggcatcttcacggtcagcctggcccagcgggtcgacgcgcaatga

SEQ ID NO: 20172 - protein, 589 aa, Burkholderia vietnamiensis G4
MSARTAREADFIAHDGTALFYRHWPATAPRCRGAIVLLHRGHEHSARVAHLVDELDLPDFAFFAWDARGHGRSPGTRGYSPGAAASVRDLQSFVEHIRDTHGVAIEDIAVVGQSVGAVLAAAWAHDYAPPIRCLVLASPAFHIKLYVPFARPGLRLMHKLRGLFYVNSYVKPKFLTHDPQRIASYAADPLVTRPIAVNMLLDLHDTAQRIVADAAAITVPTQLLISGADWVVHRAPQDRFFERLGAARKERIVLPGFYHDTLGERDRTQALAPLRAFVLREFDTPGPRVSLADADRRGAFHDEYVALRAAPASPFARAYWAFVRAGLKAGGALSDGIALGLRLGFDSGSTLDYVYRNRAQGRFGIGALIDRTYLDSPGWAGIRRRKLHLQELIGAAIGRLRSRGEPVRIVDIAAGHGRYVLDAIATAAERDGAAPDDILLRDYSAPNVDAGRVLIAQRGLEPIARFERGDAFDDASLATLEPRPTLAIVSGLYELFGDNALVERSLRGLAQAVPPGGYLVYTGQPWHPQLEFIARVLNNHRGEATWVMRRRSQAEMDELVARAGFRKLDQRIDAMGIFTVSLAQRVDAQ

SEQ ID NO: 20173 - DNA, 1770 bp, Burkholderia cenocepacia AU 1054
  CDS (1)..(1770): transl_table=11
atgagcgcacgcacggcccgcgaggccgacttcatcacgcacgacggcgaaacgctgttctatcgtcactggcccgcgacgggcgcacgctgccgcggcgccatcgtgctgctgcatcgcgggcacgaacactcggcgcgcgtcgcgcacctcgtcgacgagctcgacctgccggatttcgcgttttttgcgtgggacgcacgcggccacggccgctcgccgggcgcgcgtggctacagcccgagcgcggccgcgtcggtgcgcgacctgcagaccttcgtcgagcatatccgcgacacgcacggcatcgcgatcgaggagatggcggtagtcggccagagcgtcggcgcggtgctcgcggcgacctgggtacacgactacgcgccgccgatccgcgcgctcgtggtcgcgtcgccggcgttccacatcaagctctacgtgccgttcgcgcggccggggctgcggctgatgcacaagctgcgcgggctgttctacgtgaacagctacgtgaagccgaaattcctcacgcacgatcccgagcggatcgcgagctacgcgtccgatccgctgatcacgcggccgatcgcggtcaacatgctgctcgacctgcacgataccgcgcagcgcatcgtcgccgacgcggccgcgatcaccgtgccgacgctgttgctgatctcgggcgccgactgggtcgtgcatcgcggcccgcaggaccgcttcttcgagcggctcggcgcggcgcgcaaggagcgcatcgtgctgccgggcttctatcacgacacgctcggcgagcgcgaccgcgcgcaggcgctcgcgccgctgcgggcgttcgtgctgcgcgagttcgatgcgccgagcccgcgcgtgtcgctcgccgatgccgaccggcgcggcgcgttccatgacgaatacgcggcgctctcccggccgccggcgaacgtgttcgcacgggcgtactgggcgctcacgcgcgccggcctgaaagccggcggcgcgctgtcggacggcatcgcgctcgggttgcggctcggcttcgattcgggctcgacgctcgactacgtgtaccgcaaccgcgcgcaggggcggctgggcatcggcgcgctgatcgaccgcacgtatctcgattcgccgggctgggtcggcatccgccagcgcaaggtgcatctgcaggagctgatcggcgcggcgatcggccggctgcgcgggaacggcacgccggtgcggatcgtcgacatcgccgccggccacgggcgctacgtgctcgatgcgatcgcgctggccgccgagcgcgatggcgcggcgcccgacgacatcacgctgcgcgactacagtccgccgaacgtcgaggccgggcgcgtgctgatcgcgcagcgcggcctcgagccgatcgcgcgcttcgagcgcggcgacgcgttcgacgaggcgtcgctcgcgacgctcgagccgcggccgacgctggcgatcgtgtcgggcctgtacgagctgttcggcgagaacgcgctgatcgagcgctcgctgcgcgggctcgcgcaggccgtaccgccgggcggctatctcgtctatacggggcagccgtggcatccgcagctcgaattcatcgcgcgtgcgctgaacaaccatcgcggcgagtcgacctgggtgatgcgtcgccgttcgcaggccgaaatggacgaactcgtcgcgcgggcggggttccgcaagctcgaccagcggatcgacgagatgggcatcttcacggtcagcctcgcgcagcgggtcgatgcgtcatga

SEQ ID NO: 20174 - protein, 589 aa, Burkholderia cenocepacia AU 1054
MSARTAREADFITHDGETLFYRHWPATGARCRGAIVLLHRGHEHSARVAHLVDELDLPDFAFFAWDARGHGRSPGARGYSPSAAASVRDLQTFVEHIRDTHGIAIEEMAVVGQSVGAVLAATWVHDYAPPIRALVVASPAFHIKLYVPFARPGLRLMHKLRGLFYVNSYVKPKFLTHDPERIASYASDPLITRPIAVNMLLDLHDTAQRIVADAAAITVPTLLLISGADWVVHRGPQDRFFERLGAARKERIVLPGFYHDTLGERDRAQALAPLRAFVLREFDAPSPRVSLADADRRGAFHDEYAALSRPPANVFARAYWALTRAGLKAGGALSDGIALGLRLGFDSGSTLDYVYRNRAQGRLGIGALIDRTYLDSPGWVGIRQRKVHLQELIGAAIGRLRGNGTPVRIVDIAAGHGRYVLDAIALAAERDGAAPDDITLRDYSPPNVEAGRVLIAQRGLEPIARFERGDAFDEASLATLEPRPTLAIVSGLYELFGENALIERSLRGLAQAVPPGGYLVYTGQPWHPQLEFIARALNNHRGESTWVMRRRSQAEMDELVARAGFRKLDQRIDEMGIFTVSLAQRVDAS

SEQ ID NO: 20175 - DNA, 1800 bp, Burkholderia ambifaria AMMD
  CDS (1)..(1800): transl_table=11
atgattcgaacaacgaaacgagagaaacgcatgagcgcacgcacggcccgcgaggctgacttcatcacgcacgacggcgaaacgctgttctatcgtcactggcccgcgacgggcccgcgctgccgcggcgcgatcgtgctgctgcatcgcggccacgaacattcggcgcgcgtcgcgcatctcgtcgacgagctcgacctgccggacttcgcgttcttcgcatgggatgcgcgcggccacggccgctcgcccggcgcgcgcggctacagcccgagcgcggccgcgtcggtgcgcgacctgcagatcttcgtcgagcatatccgcgacacgcacggcatcgcgatcgaggacatcgccgtggtcgggcagagcgtcggcgcggtgctcgcggccacctgggtacacgattacgcgccgccgatccgctgcctcgtggtcgcgtcgccggcgttccacatcaagctctacgtgccgttcgcgcggccggggctgcggctgatgcacaagctgcgcgggctgttctacgtgaacagctacgtgaaaccgaaattcctcacgcatgaccccgaacggatcgcgagctatgcggccgatccgctgatcacgcggccgatcgccgtcaacatgctgctcgacctgcacgacaccgcgaagcggatcgtcgccgatgcggccgcgatcaccgtgccgacgcagctgctgatctccggcgccgactgggtcgtccatcgcggcccgcaagaccgcttcttcgagcggctcggcgccgtgcgcaaggagcgcatcgtgctgcccggcttctatcacgacacgctcggcgagcgcgaccgcgcgcaggcgctcgcgccgctgcgcaccttcgtgctgcgcgagttcgatacgccgagcccgcgcgtgtcgctcgccgacgccgaccggcgcggcgcattccacgacgaatacgcggcgctcggccggccgcccgcgaacccgttcgcccgcgcgtactgggcgatcacgcgggcggggctgaaggcaggcggcgcgctgtcggacggcatcgcgctcgggttgcggctcggcttcgattcgggctcgacgctcgactacgtgtaccgcaaccgcgcgcagggccggctcggcgtcggcgcgctgatcgaccgcacctatctcgattcgccgggctgggtcggcatccgtcagcgcaaggtgcatctgcaggagctgatcggcgcggcgatcgggcggctgcgcggcctcggcgaacccgtgcggatcgtcgacatcgcggccgggcacggacgctatgtgctcgacgcgatcgcgacggccgccgaacgcgacggcgcggcgcccgacgacatcacgctgcgcgactacagcccgccgaacgtcgaggccggacgcgtgctgatcgcgcagcgcggcctcgagccgatcgcgcgcttcgagcgcggcgacgcgttcgacgaggcgtcgctcgcgacgctcgagccgcgcccgacgctcgcgatcgtgtcggggctgtatgaactgttcggcgagaacgcgctgatcgagcgctcgctgcgcgggctcgcgcaggcggtgccgcccggcggctatctcgtctatacggggcagccgtggcatccgcagctcgaattcatcgcgcgtgcgctgaacaaccatcgcggcgacgcgacctgggtgatgcgccgccgctcgcaggccgagatggacgagctcgtcgcgcgcgccggtttccgcaagctcgaccagcgcatcgacgagatgggcatcttcacggtgagcctcgcgcagcgggtcgacgcgtcgtga

SEQ ID NO: 20176 - protein, 599 aa, Burkholderia ambifaria AMMD
MIRTTKREKRMSARTAREADFITHDGETLFYRHWPATGPRCRGAIVLLHRGHEHSARVAHLVDELDLPDFAFFAWDARGHGRSPGARGYSPSAAASVRDLQIFVEHIRDTHGIAIEDIAVVGQSVGAVLAATWVHDYAPPIRCLVVASPAFHIKLYVPFARPGLRLMHKLRGLFYVNSYVKPKFLTHDPERIASYAADPLITRPIAVNMLLDLHDTAKRIVADAAAITVPTQLLISGADWVVHRGPQDRFFERLGAVRKERIVLPGFYHDTLGERDRAQALAPLRTFVLREFDTPSPRVSLADADRRGAFHDEYAALGRPPANPFARAYWAITRAGLKAGGALSDGIALGLRLGFDSGSTLDYVYRNRAQGRLGVGALIDRTYLDSPGWVGIRQRKVHLQELIGAAIGRLRGLGEPVRIVDIAAGHGRYVLDAIATAAERDGAAPDDITLRDYSPPNVEAGRVLIAQRGLEPIARFERGDAFDEASLATLEPRPTLAIVSGLYELFGENALIERSLRGLAQAVPPGGYLVYTGQPWHPQLEFIARALNNHRGDATWVMRRRSQAEMDELVARAGFRKLDQRIDEMGIFTVSLAQRVDAS

SEQ ID NO: 20177 - DNA, 23 bp, Artificial sequence
  (1)..(23): primer
atggaaaattcacgcatccctgg

SEQ ID NO: 20178 - DNA, 24 bp, Artificial sequence
  (1)..(24): primer
ttagttatcacgacgcaccgccat

SEQ ID NO: 20179 - protein, 589 aa, Artificial sequence
  Variant (2)..(4): xaa in position 2 to 4 is any amino acid
  Variant (6)..(7): xaa in position 6 to 7 is any amino acid
  Variant (9)..(11): xaa in position 9 to 11 is any amino acid
  Variant (13)..(15): xaa in position 13 to 15 is any amino acid
  Variant (22)..(29): xaa in position 22 to 29 is any amino acid
  Variant (30)..(35): xaa in position 30 to 35 is any or no amino acid
  Variant (39)..(39): xaa in position 39 is any amino acid
  Variant (50)..(50): xaa in position 50 is any amino acid
  Variant (53)..(53): xaa in position 53 is any amino acid
  Variant (57)..(57): xaa in position 57 is any amino acid
  Variant (60)..(62): xaa in position 60 to 62 is any amino acid
  Variant (73)..(73): xaa in position 73 is any amino acid
  Variant (75)..(75): xaa in position 75 is any amino acid
  Variant (77)..(77): xaa in position 77 is any amino acid
  Variant (80)..(80): xaa in position 80 is any or no amino acid
  Variant (83)..(87): xaa in position 83 to 87 is any amino acid
  Variant (89)..(89): xaa in position 89 is any amino acid
  Variant (92)..(93): xaa in position 92 to 93 is any amino acid
  Variant (96)..(97): xaa in position 96 to 97 is any amino acid
  Variant (99)..(103): xaa in position 99 to 103 is any amino acid
  Variant (105)..(106): xaa in position 105 to 106 is any amino acid
  Variant (108)..(108): xaa in position 108 is any amino acid
  Variant (110)..(110): xaa in position 110 is any amino acid
  Variant (121)..(121): xaa in position 121 is any amino acid
  Variant (125)..(125): xaa in position 125 is any amino acid
  Variant (131)..(131): xaa in position 131 is any amino acid
  Variant (134)..(134): xaa in position 134 is any amino acid
  Variant (143)..(143): xaa in position 143 is any amino acid
  Variant (153)..(153): xaa in position 153 is any amino acid
  Variant (156)..(156): xaa in position 156 is any amino acid
  Variant (159)..(161): xaa in position 159 to 161 is any amino acid
  Variant (164)..(164): xaa in position 164 is any amino acid
  Variant (173)..(173): xaa in position 173 is any amino acid
  Variant (180)..(181): xaa in position 180 to 181 is any amino acid
  Variant (184)..(184): xaa in position 184 is any amino acid
  Variant (187)..(188): xaa in position 187 to 188 is any amino acid
  Variant (190)..(190): xaa in position 190 is any amino acid
  Variant (193)..(193): xaa in position 193 is any amino acid
  Variant (195)..(195): xaa in position 195 is any amino acid
  Variant (199)..(199): xaa in position 199 is any amino acid
  Variant (203)..(203): xaa in position 203 is any amino acid
  Variant (206)..(207): xaa in position 206 to 207 is any amino acid
  Variant (209)..(209): xaa in position 209 is any amino acid
  Variant (213)..(213): xaa in position 213 is any amino acid
  Variant (216)..(216): xaa in position 216 is any amino acid
  Variant (219)..(219): xaa in position 219 is any amino acid
  Variant (229)..(229): xaa in position 229 is any amino acid
  Variant (235)..(236): xaa in position 235 to 236 is any amino acid
  Variant (239)..(240): xaa in position 239 to 240 is any amino acid
  Variant (243)..(244): xaa in position 243 to 244 is any amino acid
  Variant (246)..(246): xaa in position 246 is any amino acid
  Variant (248)..(249): xaa in position 248 to 249 is any amino acid
  Variant (252)..(254): xaa in position 252 to 254 is any amino acid
  Variant (256)..(256): xaa in position 256 is any amino acid
  Variant (269)..(270): xaa in position 269 to 270 is any amino acid
  Variant (272)..(277): xaa in position 272 to 277 is any amino acid
  Variant (280)..(282): xaa in position 280 to 282 is any amino acid
  Variant (284)..(295): xaa in position 284 to 295 is any amino acid
  Variant (298)..(307): xaa in position 298 to 307 is any amino acid
  Variant (309)..(310): xaa in position 309 to 310 is any amino acid
  Variant (312)..(317): xaa in position 312 to 317 is any amino acid
  Variant (318)..(321): xaa in position 318 to 321 is any or no amino acid
  Variant (323)..(328): xaa in position 323 to 328 is any amino acid
  Variant (331)..(335): xaa in position 331 to 335 is any amino acid
  Variant (337)..(337): xaa in position 337 is any amino acid
  Variant (340)..(340): xaa in position 340 is any amino acid
  Variant (343)..(345): xaa in position 343 to 345 is any amino acid
  Variant (360)..(362): xaa in position 360 to 362 is any amino acid
  Variant (364)..(366): xaa in position 364 to 366 is any amino acid
  Variant (369)..(370): xaa in position 369 to 370 is any amino acid
  Variant (373)..(374): xaa in position 373 to 374 is any amino acid
  Variant (377)..(377): xaa in position 377 is any amino acid
  Variant (379)..(379): xaa in position 379 is any amino acid
  Variant (382)..(382): xaa in position 382 is any amino acid
  Variant (386)..(386): xaa in position 386 is any amino acid
  Variant (389)..(390): xaa in position 389 to 390 is any amino acid
  Variant (392)..(393): xaa in position 392 to 393 is any amino acid
  Variant (396)..(397): xaa in position 396 to 397 is any amino acid
  Variant (400)..(401): xaa in position 400 to 401 is any amino acid
  Variant (403)..(406): xaa in position 403 to 406 is any amino acid
  Variant (407)..(408): xaa in position 407 to 408 is any or no amino acid
  Variant (427)..(433): xaa in position 427 to 433 is any amino acid
  Variant (434)..(440): xaa in position 434 to 440 is any or no amino acid
  Variant (448)..(449): xaa in position 448 to 449 is any amino acid
  Variant (452)..(453): xaa in position 452 to 453 is any amino acid
  Variant (455)..(456): xaa in position 455 to 456 is any amino acid
  Variant (459)..(461): xaa in position 459 to 461 is any amino acid
  Variant (463)..(465): xaa in position 463 to 465 is any amino acid
  Variant (468)..(468): xaa in position 468 is any or no amino acid
  Variant (470)..(471): xaa in position 470 to 471 is any amino acid
  Variant (473)..(473): xaa in position 473 is any amino acid
  Variant (477)..(479): xaa in position 477 to 479 is any amino acid
  Variant (482)..(482): xaa in position 482 is any amino acid
  Variant (484)..(484): xaa in position 484 is any amino acid
  Variant (486)..(486): xaa in position 486 is any amino acid
  Variant (500)..(500): xaa in position 500 is any amino acid
  Variant (503)..(504): xaa in position 503 to 504 is any amino acid
  Variant (506)..(507): xaa in position 506 to 507 is any amino acid
  Variant (510)..(510): xaa in position 510 is any amino acid
  Variant (514)..(514): xaa in position 514 is any amino acid
  Variant (517)..(518): xaa in position 517 to 518 is any amino acid
  Variant (521)..(521): xaa in position 521 is any amino acid
  Variant (534)..(535): xaa in position 534 to 535 is any amino acid
  Variant (538)..(539): xaa in position 538 to 539 is any amino acid
  Variant (541)..(542): xaa in position 541 to 542 is any amino acid
  Variant (545)..(548): xaa in position 545 to 548 is any amino acid
  Variant (549)..(549): xaa in position 549 is any or no amino acid
  Variant (554)..(554): xaa in position 554 is any amino acid
  Variant (558)..(558): xaa in position 558 is any amino acid
  Variant (562)..(562): xaa in position 562 is any amino acid
  Variant (565)..(566): xaa in position 565 to 566 is any amino acid
  Variant (570)..(570): xaa in position 570 is any amino acid
  Variant (572)..(573): xaa in position 572 to 573 is any amino acid
  Variant (575)..(575): xaa in position 575 is any amino acid
  Variant (578)..(579): xaa in position 578 to 579 is any amino acid
  Variant (588)..(588): xaa in position 588 is any amino acid
RXXXEXXFXXXDXXXLFYRHWXXXXXXXXXXXXXXIVLXHRGHEHSGRVXHLXDELXLPXXXFFAWDARGHGXSXGXRGXSPXXXXXVXDVXXFVXXIXXXXXIXXEXIXVVAQSVGAVLXATWXHDYAPXIRXLVLASPAFXVKLYVPFARXGLXLMXXXRGXFFVNSYVKXKFLTHDXXRIXSYXXDXLIXRXIAVXMLLXLYXXAXRIVXDAXAIXVPTQLLISGXDFVVHXXPQXXFFXXLXSXXKEXXXLXGFYHDTLGERDRXXAXXXXXXFIXXXFXXXXXXXXXXXXDRXXXXXXXXXXLXXPXXXXXXXXXXWXXXXXXLKXXXXXSXGIXLGXXXGFDSGSTLDYVYRNXXXGXXXLGXXIDXXYLXSXGWXGIRXRKXXLXXLIXXAIXXLXXXXXXVRIVDIAAGHGRYVLDALXXXXXXXXXXXXXXILLRDYSXXNVXXGXXLIXXXGXXXIAXFXXGXAFDXXXLAXLXPXPTLAIVSGLYELFXDNXXVXXSLXGLAXAVXXGGXLVYTGQPWHPQLXXIAXXLXXHRXXXXXWVMRXRSQXEMDXLVXXAGFXKXXQXIDXXGIFTVSLAXR

SEQ ID NO: 20180 - protein, 9 aa, Artificial sequence
  Variant (8)..(8): xaa in position 8 is Ala or Gly
HRGHEHSXR

SEQ ID NO: 20181 - protein, 96 aa, Artificial sequence
  Variant (5)..(5): xaa in position 5 is any amino acid
  Variant (6)..(6): xaa in position 6 is Ile, Leu or Val
  Variant (8)..(8): xaa in position 8 is Ala, Cys, Gly or Ser
  Variant (9)..(9): xaa in position 9 is Leu or Met
  Variant (11)..(11): xaa in position 11 is Leu or Val
  Variant (17)..(17): xaa in position 17 is any amino acid
  Variant (18)..(18): xaa in position 18 is Ile or Val
  Variant (24)..(24): xaa in position 24 is Phe or Leu
  Variant (27)..(27): xaa in position 27 is any amino acid
  Variant (30)..(30): xaa in position 30 is any amino acid
  Variant (32)..(35): xaa in position 32 to 35 is any amino acid
  Variant (36)..(36): xaa in position 36 is Lys or Arg
  Variant (38)..(38): xaa in position 38 is any amino acid
  Variant (40)..(40): xaa in position 40 is Phe or Tyr
  Variant (41)..(41): xaa in position 41 is Ile or Val
  Variant (42)..(42): xaa in position 42 is Asn or Thr
  Variant (47)..(47): xaa in position 47 is Ala, Gly or Pro
  Variant (48)..(48): xaa in position 48 is any amino acid
  Variant (49)..(49): xaa in position 49 is Phe, Trp or Tyr
  Variant (51)..(51): xaa in position 51 is Ser or Thr
  Variant (54)..(54): xaa in position 54 is any amino acid
  Variant (55)..(55): xaa in position 55 is Ala, Glu or Gln
  Variant (57)..(57): xaa in position 57 is Ile or Val
  Variant (58)..(58): xaa in position 58 is any amino acid
  Variant (60)..(60): xaa in position 60 is Phe or Tyr
  Variant (61)..(61): xaa in position 61 is any amino acid
  Variant (62)..(62): xaa in position 62 is Ala, Asn, Gln, Ser or Thr
  Variant (64)..(64): xaa in position 64 is any amino acid
  Variant (66)..(66): xaa in position 66 is Ile or Val
  Variant (67)..(67): xaa in position 67 is Ala or Thr
  Variant (68)..(68): xaa in position 68 is Lys or Arg
  Variant (69)..(69): xaa in position 69 is any amino acid
  Variant (71)..(71): xaa in position 71 is Ala or Ser
  Variant (73)..(73): xaa in position 73 is Asn or Arg
  Variant (74)..(74): xaa in position 74 is Ile, Met or Val
  Variant (77)..(77): xaa in position 77 is Asp or Gly
  Variant (79)..(79): xaa in position 79 is His or Tyr
  Variant (80)..(80): xaa in position 80 is any amino acid
  Variant (81)..(81): xaa in position 81 is Ala or Thr
  Variant (82)..(82): xaa in position 82 is Ala, Gly or Ser
  Variant (83)..(83): xaa in position 83 is any amino acid
  Variant (85)..(85): xaa in position 85 is Ile or Val
  Variant (87)..(87): xaa in position 87 is Ala, Asp or Ser
  Variant (89)..(89): xaa in position 89 is Ala or Ser
  Variant (90)..(90): xaa in position 90 is Ala, Gln or Thr
  Variant (93)..(93): xaa in position 93 is Gln or Thr
  Variant (94)..(94): xaa in position 94 is Ile, Leu or Val
DYAPXXRXXVXASPAFXXKLYVPXARXGLXLXXXXXGXFXXXSYVKXXXLXHDXXRXXSXXXDXLXXXXIXVXXLLXLXXXXXRXVXDXXAIXXPT

SEQ ID NO: 20182 - protein, 53 aa, Artificial sequence
  Variant (2)..(2): xaa in position 2 is any amino acid
  Variant (4)..(4): xaa in position 4 is any amino acid
  Variant (5)..(5): xaa in position 5 is any or no amino acid
  Variant (7)..(7): xaa in position 7 is any or no amino acid
  Variant (9)..(9): xaa in position 9 is any amino acid
  Variant (10)..(10): xaa in position 10 is Asp, Glu, Gln, Arg or Ser
  Variant (11)..(11): xaa in position 11 is any amino acid
  Variant (18)..(18): xaa in position 18 is Ser or Thr
  Variant (22)..(22): xaa in position 22 is Ile or Val
  Variant (24)..(24): xaa in position 24 is Gln or Arg
  Variant (26)..(26): xaa in position 26 is any amino acid
  Variant (27)..(27): xaa in position 27 is Ala or Pro
  Variant (28)..(28): xaa in position 28 is any amino acid
  Variant (30)..(31): xaa in position 30 to 31 is any amino acid
  Variant (32)..(32): xaa in position 32 is Ala, Gly, Ile or Pro
  Variant (33)..(33): xaa in position 33 is Phe, Ile, Leu or Val
  Variant (35)..(36): xaa in position 35 to 36 is any amino acid
  Variant (37)..(37): xaa in position 37 is Ile or Val
  Variant (39)..(39): xaa in position 39 is His, Lys or Arg
  Variant (40)..(40): xaa in position 40 is any amino acid
  Variant (43)..(43): xaa in position 43 is Asp, Asn or Gln
  Variant (44)..(44): xaa in position 44 is Ala or Ser
  Variant (45)..(45): xaa in position 45 is Ile, Pro or Val
  Variant (48)..(48): xaa in position 48 is any amino acid
  Variant (52)..(52): xaa in position 52 is any amino acid
SXGXXLXGXXXGFDSGSXLDYXYXNXXXGXXXXGXXXDXXYLXXXGWXGIRXR

SEQ ID NO: 20183 - protein, 93 aa, Artificial sequence
  Variant (7)..(7): xaa in position 7 is Ala, Gly, Pro or Ser
  Variant (8)..(8): xaa in position 8 is Asp, Glu or Ser
  Variant (10)..(11): xaa in position 10 to 11 is any amino acid
  Variant (12)..(12): xaa in position 12 is Ile or Val
  Variant (13)..(14): xaa in position 13 to 14 is any amino acid
  Variant (17)..(17): xaa in position 17 is any amino acid
  Variant (20)..(20): xaa in position 20 is Ala or Gly
  Variant (21)..(21): xaa in position 21 is Ala, Glu, Asn, Gln or Ser
  Variant (23)..(23): xaa in position 23 is Ile, Leu or Val
  Variant (24)..(24): xaa in position 24 is any amino acid
  Variant (25)..(25): xaa in position 25 is Glu or Pro
  Variant (27)..(27): xaa in position 27 is Ala or Gly
  Variant (28)..(28): xaa in position 28 is any amino acid
  Variant (30)..(30): xaa in position 30 is Ile, Leu or Val
  Variant (41)..(41): xaa in position 41 is Glu or Lys
  Variant (42)..(42): xaa in position 42 is any amino acid
  Variant (45)..(45): xaa in position 45 is any amino acid
  Variant (46)..(46): xaa in position 46 is Ala, Thr or Val
  Variant (48)..(48): xaa in position 48 is Asn or Thr
  Variant (49)..(49): xaa in position 49 is Asn or Ser
  Variant (51)..(51): xaa in position 51 is any amino acid
  Variant (52)..(52): xaa in position 52 is Ala, Asp, Glu, Gly, Asn or Gln
  Variant (53)..(53): xaa in position 53 is Asp, Glu or Gly
  Variant (54)..(54): xaa in position 54 is any amino acid
  Variant (55)..(55): xaa in position 55 is Ala, Pro or Thr
  Variant (57)..(57): xaa in position 57 is Met or Val
  Variant (60)..(60): xaa in position 60 is any amino acid
  Variant (62)..(62): xaa in position 62 is Ser or Thr
  Variant (64)..(64): xaa in position 64 is any amino acid
  Variant (68)..(68): xaa in position 68 is Glu, Gly, Gln, Ser or Thr
  Variant (71)..(72): xaa in position 71 to 72 is any amino acid
  Variant (76)..(76): xaa in position 76 is Asp, Glu or Arg
  Variant (78)..(81): xaa in position 78 to 81 is any amino acid
  Variant (82)..(82): xaa in position 82 is Ile or Val
  Variant (84)..(85): xaa in position 84 to 85 is any amino acid
  Variant (89)..(89): xaa in position 89 is Ser or Thr
  Variant (92)..(92): xaa in position 92 is Leu or Met
GLYELFXXNXXXXXSLXGLXXAXXXGXXLXYTGQPWHPQLXXIAXXLXXHXXXXXWXMRXRXQXEMDXLVXXAGFXKXXXXXDXXGIFXVSXA

SEQ ID NO: 20184 - DNA, 582 bp, Escherichia coli K12
  CDS (1)..(582): transl_table=11
atgactgactacctgttactgtttgtcggaactgtactggtcaataactttgtactggtcaagtttctcggtctctgtccgtttatgggggtttccaaaaaactggaaaccgcgatgggcatggggctggcaacaacgtttgtgatgacgctggcgtctatttgcgcctggcttatcgatacgtggattttgatcccacttaatctgatttacctgcgcaccctggcatttattctggtgattgctgtggtcgtgcagttcaccgagatggtggtgcgcaaaaccagcccggtgctttaccgtctgctggggatttttttgccgcttatcaccaccaactgtgcagtgctcggcgtggcgttgctgaatatcaatctcgggcacaatttcttgcagtcggcgctgtacggtttttccgccgctgtcggtttctcgctggtgatggtgctcttcgccgccatccgcgaacgccttgctgtggctgatgtcccggcaccttttcgcggtaatgccattgcgttaattaccgcaggtcttatgtctctggcctttatgggctttagtggtttggtgaagttgtaa

SEQ ID NO: 20185 - protein, 193 aa, Escherichia coli K12
MTDYLLLFVGTVLVNNFVLVKFLGLCPFMGVSKKLETAMGMGLATTFVMTLASICAWLIDTWILIPLNLIYLRTLAFILVIAVVVQFTEMVVRKTSPVLYRLLGIFLPLITTNCAVLGVALLNINLGHNFLQSALYGFSAAVGFSLVMVLFAAIRERLAVADVPAPFRGNAIALITAGLMSLAFMGFSGLVKL

SEQ ID NO: 20186 - DNA, 603 bp, Thermotoga maritima MSB8
  CDS (1)..(603): transl_table=11
atgagccgcttgagagaattaactaaggggatcataaaagagaatcccacttatgttcaggttcttggaatgtgtcccacactcgccgtcaccacgagtgccatcaacggtctggggatggggcttgctacgacagccgttctcaccatgtcaaacgtggttatttcactgataagaaagatcgttcctgataagatcagaattcctatattcatcgttgttatcgcgtctttcgttaccatgatagatctcctcatgcacggttttgcctacgatctgtggaagaccctgggacttttcattcctctcatagtggtgaactgtatcataatgggaagggcggaatcgttcgcttccaagcatggtgttctggattccatgctcgatggcctgggagtgggtctcggtttcacaggttcgcttgttctccttggaagcgtcagagaactcttcggtaacggtacgatcttcggttacaaagtgtgggagttgaagatatttcttgaaattcttccaccgggagcctacataacactcggtcttctctctgcactcttcacctacatcggcatcaggagaaagaaaagaggtgaagcgaaatga

SEQ ID NO: 20187 - protein, 200 aa, Thermotoga maritima MSB8
MSRLRELTKGIIKENPTYVQVLGMCPTLAVTTSAINGLGMGLATTAVLTMSNVVISLIRKIVPDKIRIPIFIVVIASFVTMIDLLMHGFAYDLWKTLGLFIPLIVVNCIIMGRAESFASKHGVLDSMLDGLGVGLGFTGSLVLLGSVRELFGNGTIFGYKVWELKIFLEILPPGAYITLGLLSALFTYIGIRRKKRGEAK

SEQ ID NO: 20188 - DNA, 642 bp, Vibrio cholerae O1 biovar eltor str. N16961
  CDS (1)..(642): transl_table=11
ttgttattgctttggcaaagcaggataatgccgggatcggaagcaaacatttatataactatgaccgaatatcttttgttgttaatcggcaccgtgctggtcaataactttgtactggtgaagtttttgggcttatgtccttttatgggcgtatcaaaaaaactagagaccgccattggcatggggttggcgacgacattcgtcctcaccttagcttcggtgtgcgcttatctggtggaaagttacgtgttacgtccgctcggcattgagtatctgcgcaccatgagctttattttggtgatcgctgtcgtagtacagttcaccgaaatggtggtgcacaaaaccagtccgacactctatcgcctgctgggcattttcctgccactcatcaccaccaactgtgcggtattaggggttgcgctgctcaacatcaacgaaaatcacaactttattcaatcgatcatttatggttttggcgctgctgttggcttctcgctggtgctcatcttgttcgcttcaatgcgtgagcgaatccatgtagccgatgtccccgctccctttaagggcgcatccattgcgatgatcaccgcaggtttaatgtctttggcctttatgggctttaccggattggtgaaactgtaa

SEQ ID NO: 20189 - protein, 213 aa, Vibrio cholerae O1 biovar eltor str. N16961
MLLLWQSRIMPGSEANIYITMTEYLLLLIGTVLVNNFVLVKFLGLCPFMGVSKKLETAIGMGLATTFVLTLASVCAYLVESYVLRPLGIEYLRTMSFILVIAVVVQFTEMVVHKTSPTLYRLLGIFLPLITTNCAVLGVALLNINENHNFIQSIIYGFGAAVGFSLVLILFASMRERIHVADVPAPFKGASIAMITAGLMSLAFMGFTGLVKL

SEQ ID NO: 20190 - DNA, 729 bp, Pasteurella multocida subsp. multocida str. Pm70
  CDS (1)..(729): transl_table=11
atgaacgacactttcgcaaaacagaccgcactttctgacgctaaagacgatgtcatggaccagcaatctacattagcgaatacatccactccgtcggtctggaaaacacttttctggcaaggagtatggaaaaataattcaacccttgtgcaactcttgggcttatgtccattattagctgtatccaacagtgtcacaaatgcgttggggttaggcattgcaacgctattcgtgctgatttgtagtaacacagtagtctctttattccgcaaacaaattccgcacgaaatccgtattccaatttatgtgatgattattgccacgaccgtcacggtggtgcaattactgatgaatgcctatacttattcactctatcaatccttgggtatttttattccactgatcgtcactaactgtattgtgattgggcgtgctgaagcctttgcttcaaaaaatccgctttcccatgcgatgtttgatggctttgccatggggttaggcatgtgtttaagcttagtctttttaggggcaatccgtgaaattctcggtaatggcaccttgtttgacggcattgagcatttacttggtgattgggcaaaaggattgcgtattgaattatttcatctcgatagccatttcttgttggcgattttaccaccgggcgcctttattggtttaggactcattttagccattaaaaatgtcattgatcagcgtaacaaagcatga

SEQ ID NO: 20191 - protein, 242 aa, Pasteurella multocida subsp. multocida str. Pm70
MNDTFAKQTALSDAKDDVMDQQSTLANTSTPSVWKTLFWQGVWKNNSTLVQLLGLCPLLAVSNSVTNALGLGIATLFVLICSNTVVSLFRKQIPHEIRIPIYVMIIATTVTVVQLLMNAYTYSLYQSLGIFIPLIVTNCIVIGRAEAFASKNPLSHAMFDGFAMGLGMCLSLVFLGAIREILGNGTLFDGIEHLLGDWAKGLRIELFHLDSHFLLAILPPGAFIGLGLILAIKNVIDQRNKA

SEQ ID NO: 20192 - DNA, 669 bp, Clostridium perfringens str. 13
  CDS (1)..(669): transl_table=11
ttgaaagttttatttgaaagattaaaaaatggtatagttactgaaaatcctatatttgttcaagtattagctatgtgtccaaccctagcagttacttcaagtgttgaaaatgccgtgggcatgggaatagcttctacagtggttttaattttttctaatatgataatttcagccttaagaaagtttataccaaataaaataagaattcctgcatatatagttataattgcatcctttgttactgtggttgatatgttaatgaatgcttatgttcaatcattatataaatccttaggaattttcatacctcttatagtagttaactgcgttatattagggagagctgaggcttatgcttcaaataacaaaatcctaccatctatttttgatgccattggaatgggaattggatttactatagcgttattttctataggaacttttagagaaatattaggggctggaacatttttgggaatgaacatcatgccagagggatttaagcctgctactattatgatattagctccaggagcatttttaaccttaggagcattaatgactttcttaaattatagaaacataaagaaagctaaaaacgaaggtaaaaaagctaaatgtttagaacataattgtagtacttgttctggatgcggtaaaaattcttaa

SEQ ID NO: 20193 - protein, 222 aa, Clostridium perfringens str. 13
MKVLFERLKNGIVTENPIFVQVLAMCPTLAVTSSVENAVGMGIASTVVLIFSNMIISALRKFIPNKIRIPAYIVIIASFVTVVDMLMNAYVQSLYKSLGIFIPLIVVNCVILGRAEAYASNNKILPSIFDAIGMGIGFTIALFSIGTFREILGAGTFLGMNIMPEGFKPATIMILAPGAFLTLGALMTFLNYRNIKKAKNEGKKAKCLEHNCSTCSGCGKNS

SEQ ID NO: 20194 - DNA, 576 bp, Clostridium perfringens str. 13
  CDS (1)..(576): transl_table=11
atggaattatttctgatttttattggagctatgcttgttaataactttgttttatcacaatttttaggaatatgttcatttataggagtttcaaaaaagaaggaagctgcagtaggaatgggacttgcagttacctttgtaatggtattagctagtataatttcttggcttgtttataacttgattttagataagtttaatataacttatttgaaaacaatagtttttgttcttgttatagcttccttggttcaatttgttgagatggttgttaaaaaatatagtcctagtttatataaagcattaggtatatttttacctttaataactacaaattgtgctgttttaggaatggccgttactaatgttgaagaagtatataatcttattcaatcaatagtacatgctttaggggctgctggaggatatatgcttgctatagtattaatgtcatttttaagagaaaagatagatgacaatgaagaaatacatccttattttagagggttaccaataactctttttacagcagcacttatgtctatagcctttttaggattccaaggacttatataa

SEQ ID NO: 20195 - protein, 191 aa, Clostridium perfringens str. 13
MELFLIFIGAMLVNNFVLSQFLGICSFIGVSKKKEAAVGMGLAVTFVMVLASIISWLVYNLILDKFNITYLKTIVFVLVIASLVQFVEMVVKKYSPSLYKALGIFLPLITTNCAVLGMAVTNVEEVYNLIQSIVHALGAAGGYMLAIVLMSFLREKIDDNEEIHPYFRGLPITLFTAALMSIAFLGFQGLI

SEQ ID NO: 20196 - DNA, 585 bp, Fusobacterium nucleatum subsp. nucleatum ATCC 25586
  CDS (1)..(585): transl_table=11
atgagtataggtggattatttagtataattattacttcaatatttataaataacataatatttgctaagttcttaggttgctgtccatttatgggagtttctaaaaaggttgactcatcattaggaatggggatggctgttaccttcgttattacaatagcttcaggagtaacttggatagtttacagaaagatattagaacctcttggtttaggatatttacaaacaatagcttttatattaataatagcttctcttgtacaattcgttgaaatggcaattaaaaagacatcaccaagtctatataaagcacttggagtatttttaccattaatcacaacaaactgtgctgttctaggggttgctataataaatatccaagaaggatataattttatagaaacaatagtaaatggttttggagttgcagtaggtttctcactagcattgttacttttagctggaatcagagaaagattagaatatgcaaacattcctaaaaacttcaaaggagttccaatagcatttatcacagctggacttttagctatggcatttatgggatttagtggaatgcaaatttaa

SEQ ID NO: 20197 - protein, 194 aa, Fusobacterium nucleatum subsp. nucleatum ATCC 25586
MSIGGLFSIIITSIFINNIIFAKFLGCCPFMGVSKKVDSSLGMGMAVTFVITIASGVTWIVYRKILEPLGLGYLQTIAFILIIASLVQFVEMAIKKTSPSLYKALGVFLPLITTNCAVLGVAIINIQEGYNFIETIVNGFGVAVGFSLALLLLAGIRERLEYANIPKNFKGVPIAFITAGLLAMAFMGFSGMQI

SEQ ID NO: 20198 - DNA, 618 bp, Fusobacterium nucleatum subsp. nucleatum ATCC 25586
  CDS (1)..(618): transl_table=11
atgaaaaaattaggagtacttacagctggaatatttaaagaaaatccagtgtttgttttaatgttaggactttgtcctacacttggggtaacaagtagtgcaataaatggtttttcaatgggacttgcagttatagcagttcttgcttgttcaaatggattgatatctctttttaagaaatttataccagatgaagtaagaatacctgcatttataatgataatagctacacttgttacagtagttgatatggttatgaatgcttatacacctgacttatataaggtattaggattatttatacctttaatagttgttaactgtatagttcttggaagagcagaaagttttgcatctaaaaatggtgttattgattctatacttgatggtattggatctggaataggatttactttatctttaactttcttaggttcagtaagagaaattttaggaaatggttcagtatttggaatttcattagttcctgctaactttacacctgctttaatatttatattagcacctggtggatttattacaatagggataattatggcttgtataaatatgaaaaaagaaagagatgcaaagaaaaagaaggtgactaaaaaatga

SEQ ID NO: 20199 - protein, 205 aa, Fusobacterium nucleatum subsp. nucleatum ATCC 25586
MKKLGVLTAGIFKENPVFVLMLGLCPTLGVTSSAINGFSMGLAVIAVLACSNGLISLFKKFIPDEVRIPAFIMIIATLVTVVDMVMNAYTPDLYKVLGLFIPLIVVNCIVLGRAESFASKNGVIDSILDGIGSGIGFTLSLTFLGSVREILGNGSVFGISLVPANFTPALIFILAPGGFITIGIIMACINMKKERDAKKKKVTKK

SEQ ID NO: 20200 - DNA, 642 bp, Methanosarcina acetivorans C2A
  CDS (1)..(642): transl_table=11
atgtatccgcacaggagggctgatatgaatcctataagtgaatttatacgcggaattactaaagacaaccctacctttgggcttgtgctcgggctctgtccgactctagcagtcacaacatccgtggaaaacgggatcggtatggccatgggtacactgttcgtgttggtaggttcgaacatgatggtttctgcgatccgaaaaggaattccgggaacagtcaggcttcccgttgaaattattgtcattgcaactttcgttacgatcgttgacatggtgatggaagcatttacacctgacctgtacacatctctcggcgtgttcattcctttgatcgtggtcaattgtattgttattggaagggctgaggcctacgccctgaagaatggggtcttttattcgattatcgatgctcttggtgagggtacgggttttctgctcgtgttaatcctcatcggaggaatcagagaactgctggggaccggcataattgatccgttcggaatgactctcatcaacctgagtggtgtaataaaccctgcaatgttcatgaccatgtctccgggtgccttcctcacaattgcagtgttgatgaccattgtgaactatcgcaggcagcagaaagctgcaaagggtggttaa

SEQ ID NO: 20201 - protein, 213 aa, Methanosarcina acetivorans C2A
MYPHRRADMNPISEFIRGITKDNPTFGLVLGLCPTLAVTTSVENGIGMAMGTLFVLVGSNMMVSAIRKGIPGTVRLPVEIIVIATFVTIVDMVMEAFTPDLYTSLGVFIPLIVVNCIVIGRAEAYALKNGVFYSIIDALGEGTGFLLVLILIGGIRELLGTGIIDPFGMTLINLSGVINPAMFMTMSPGAFLTIAVLMTIVNYRRQQKAAKGG

SEQ ID NO: 20202 - DNA, 600 bp, Methanosarcina acetivorans C2A
  CDS (1)..(600): transl_table=11
gtggttaaaatggcagaatctctatttacaatctttcttgaaggagtgttcatcaagaactttcttctcattcagttcctgggtctatgttcttttgtgggcgtgaccaaggacttgaaaagtgcttcagggatgtcgggcgctgtagtcttcgtcatggcgatggcagcaaccgtatcctttgctctgtataatttcattttagtacccctcaagctggagttcctgcggactatcgctttcatcgtggttatcgcagcacttgtgcagcttgtagagtttatcgtcaggaaacatgtgcctgccctctaccgttccctcgggatctacctgcctctgattaccaccaactgtgcggtgctcggggctgtgctcctcaatgtcatgaacgattacgatctcgctcagagcgttgtcttcggagttgccgcagggcttggctatacggttgctatgctgatgatggctgcaataagggaaaggagcgacctggtagaagtgccgaagtccgtaggaaggggtgtaacatacgccttcttcattgcgactattatgtcaatgtctttcgtgaacttcttcggggtgattccgcttgagtag

SEQ ID NO: 20203 - protein, 199 aa, Methanosarcina acetivorans C2A
MVKMAESLFTIFLEGVFIKNFLLIQFLGLCSFVGVTKDLKSASGMSGAVVFVMAMAATVSFALYNFILVPLKLEFLRTIAFIVVIAALVQLVEFIVRKHVPALYRSLGIYLPLITTNCAVLGAVLLNVMNDYDLAQSVVFGVAAGLGYTVAMLMMAAIRERSDLVEVPKSVGRGVTYAFFIATIMSMSFVNFFGVIPLE

SEQ ID NO: 20204 - DNA, 603 bp, Yersinia pestis KIM
  CDS (1)..(603): transl_table=11
ttgacgatggaacattatatcagtctgttggtccgcgcagtgtttgtggagaatatggcgttagcgttctttctgggaatgtgtactttcctggccgtctctaaaaaagtgtcaacggcctttggcttaggcattgcggtaacggttgttctgggcatctccgtgccagccaataatttggtttataacctggttctacgagatggcgcattggttgaaggggttgaccttagcttcctgaatttcattaccttcattggggtcattgccgccattgttcaggtgttggagatgatcctcgatcgttacttccctgcgttatataacgcgctgggtatttttctgccgctaatcaccgtgaactgcgccatctttggtggcgtgtcgtttatggcacagcgtgattacaacttccctgaatccatcgtttatggctttggttctggtatggggtggatgctggcgattgttgcattagcggggatccgcgaaaaaatgaaatatgccaatgtgcctgcgggcttacaggggctagggatcacctttatctcaaccggattgatggcattaggttttatgtctttcgccggtgtgaacctataa

SEQ ID NO: 20205 - protein, 200 aa, Yersinia pestis KIM
MTMEHYISLLVRAVFVENMALAFFLGMCTFLAVSKKVSTAFGLGIAVTVVLGISVPANNLVYNLVLRDGALVEGVDLSFLNFITFIGVIAAIVQVLEMILDRYFPALYNALGIFLPLITVNCAIFGGVSFMAQRDYNFPESIVYGFGSGMGWMLAIVALAGIREKMKYANVPAGLQGLGITFISTGLMALGFMSFAGVNL

SEQ ID NO: 20206 - DNA, 645 bp, Yersinia pestis KIM
  CDS (1)..(645): transl_table=11
ttgtcgtcgggccgtcaattttggataataggcggcttttatttttttaggtcccgcaatgcaatgactgaatacctgctcctatttgtcggcacagttttggtaaataactttgttctggtcaagtttcttggcctgtgcccgtttatgggcgtctctaaaaaactggaaaccgccattggtatgggtctggcgaccactttcgtgctgacattggcatcggtttgcgcctggatggtcaatagctttattttgctgccactcggcctgatctatttgcgaacactggccttcattttagttatcgctgtcgtggtgcaattcaccgagttggtggtccgcaaaaccagcccgacactttaccgcttgctgggtatctttctccccctgatcaccaccaattgtgccgttttaggggtcgcactactcaatgtgaatcaatcgcataatttcatgcaatccgcggtctatggttttagtgctgctgcgggtttctctttggtcatggtgttatttgccgctattcgtgagcgcctggctgtggcggatgtccctgcgcccttccgtgggtcttctatcgccttaatcactgccgggctgatgtctctggcctttatgggctttaccggtttggtgaagttctaa

SEQ ID NO: 20207 - protein, 214 aa, Yersinia pestis KIM
MSSGRQFWIIGGFYFFRSRNAMTEYLLLFVGTVLVNNFVLVKFLGLCPFMGVSKKLETAIGMGLATTFVLTLASVCAWMVNSFILLPLGLIYLRTLAFILVIAVVVQFTELVVRKTSPTLYRLLGIFLPLITTNCAVLGVALLNVNQSHNFMQSAVYGFSAAAGFSLVMVLFAAIRERLAVADVPAPFRGSSIALITAGLMSLAFMGFTGLVKF

SEQ ID NO: 20208 - DNA, 624 bp, Yersinia pestis KIM
  CDS (1)..(624): transl_table=11
atggacgatttaggagtgtgtgtaatgaccgagagttatttgaccatttttattagagctgtttttgttgaaaatatggcattaaatttctttcttggaatgtgcacatttctggcaatatctaaaaaagtagaaacagcctttggccttgggttgacagttacagccctgctggcgatagcaacacctctcaataatcttatttacacctatatactcagagagaatgctctgattgatggagtggatcttagttttcttgatttcattaccttcatcggggtgcttgcggcattagtccaaatacttgaaatggtacttgagcgatttttgccaagcttacatcacaccctgggggcctttttaccactactgacgatccactgtgcaatatttggtgcaaccatttttatggttcagcgagaatatacgttcaccgaatcttttgtttacgggactggctgtggtttaggttggatgctggccattatatccatggcaggtttacgagaaaaaatgaagtactctaacattccaaaagggttgcaagggctcggcatcgtctttatgacggcagggctgatgtccttaggatttatgtcattttcaggtattcggctctaa

SEQ ID NO: 20209 - protein, 207 aa, Yersinia pestis KIM
MDDLGVCVMTESYLTIFIRAVFVENMALNFFLGMCTFLAISKKVETAFGLGLTVTALLAIATPLNNLIYTYILRENALIDGVDLSFLDFITFIGVLAALVQILEMVLERFLPSLHHTLGAFLPLLTIHCAIFGATIFMVQREYTFTESFVYGTGCGLGWMLAIISMAGLREKMKYSNIPKGLQGLGIVFMTAGLMSLGFMSFSGIRL

SEQ ID NO: 20210 - DNA, 696 bp, Shigella flexneri 2a str. 301
  CDS (1)..(696): transl_table=11
gtgagcgaaattaaagacgttattgttcaggggttgtggaaaaacaactctgcactggtccaactgctcggcctttgtccgctattggcggtcacatccactgccactaacgctctgggtttaggacttgcgactacgctggtactgacgctgaccaacctgaccatttcgacgctgcgtcactggacgccagccgagatccgcattcccatttacgtgatgatcatcgcctcggtggtcagcgctgtacagatgctgatcaacgcctacgcctttggcctgtatcaatcattagggatttttattccgctgattgtcactaactgtatcgttgtgggccgcgctgaagccttcgccgccaaaaaaggtccggcgctttcggcactggacggcttttcaattggtacgggcgcaacctgcgccatgttcgtgctgggttcactacgcgaaattatcggcaatggcacgttgtttgacggtgcagatgcgctgttaggtagctgggcaaaagtattacgcgtggagattttccacaccgactcccctttcctgctggcgatgctgccaccaggtgcatttattggcttgggactgatgctggcaggaaaatacctgattgatgaaagaatgaaaaagcgccgtgctgaagcagctgccgaacgtgcattgccaaacggtgaaacagggaatgtctga

SEQ ID NO: 20211 - protein, 231 aa, Shigella flexneri 2a str. 301
MSEIKDVIVQGLWKNNSALVQLLGLCPLLAVTSTATNALGLGLATTLVLTLTNLTISTLRHWTPAEIRIPIYVMIIASVVSAVQMLINAYAFGLYQSLGIFIPLIVTNCIVVGRAEAFAAKKGPALSALDGFSIGTGATCAMFVLGSLREIIGNGTLFDGADALLGSWAKVLRVEIFHTDSPFLLAMLPPGAFIGLGLMLAGKYLIDERMKKRRAEAAAERALPNGETGNV

SEQ ID NO: 20212 - DNA, 621 bp, Shewanella oneidensis MR-1
  CDS (1)..(621): transl_table=11
atgagcaacagtttatccatgcgggacatgctagcaggccctgtgtttgctaataaccccgtagcgatgcaagtactgggcgtatgctcggcgctggcggtgagtaactccatgcagaccgcggtggtgatgacactcgcggtgaccttcgtactggtgttctccaacctgattatctctgctattcgcaactttatccctaatagtgtgcggattattgcccagatgacagtaattgcctccttggtcattattgttgacatggtattgcaggatgtggcttatgagttatctaagcaactgtctgtatttgttgggttaattatcactaactgtatcatcatgggccgtgcagaagcctttgcgatgaagtatccaccgcacttagctgtggtcgatgccgtgggtaacgcagcgggttacggtttagtgctgatcagtgtggcctttgtgcgtgagttgttaggcacgggtaatctgttcggccatagtgtgttgactacggttgaaaacggcggctggtacttacctaacgagatgtttaagttgccaccaagcgccttcttcctgattggcctgctgatctggagcattaacgtgatccagcgtaaacgcggttaa

SEQ ID NO: 20213 - protein, 206 aa, Shewanella oneidensis MR-1
MSNSLSMRDMLAGPVFANNPVAMQVLGVCSALAVSNSMQTAVVMTLAVTFVLVFSNLIISAIRNFIPNSVRIIAQMTVIASLVIIVDMVLQDVAYELSKQLSVFVGLIITNCIIMGRAEAFAMKYPPHLAVVDAVGNAAGYGLVLISVAFVRELLGTGNLFGHSVLTTVENGGWYLPNEMFKLPPSAFFLIGLLIWSINVIQRKRG

SEQ ID NO: 20214 - DNA, 609 bp, Shewanella oneidensis MR-1
  CDS (1)..(609): transl_table=11
atggaacactatattaatctgtttatacaggccactttcttagacaacatggcgctgtcgttcttcctcggtatgtgtaccttcttagcggtgtctaaaaaggtgtcgaccgccttcggcttaggcgttgcagttattgtggtaatgaccttagccgtgcccttaaaccaactgatctatgcgaaggtgttagcacctggcgctctggcttgggcgggtatgcctggcatcgatttaagctatctgcaactgatcacctttatcggtgtgattgcagccttagtgcaaattttggaaatgtttttagataaatacattccaagcctgtatgactcacttgggatcttcttgccactgctcaccgtaaactgcgcgatttttgctggggtgatctttatggctaaccgcgattacaactttgccgaatcggcggtatttgccatgggttcgggcacaggttgggcgttggcgattgtgatgctggctggacttcgtgagcgcatgaagttccatgcgattcccgaaggcttacaggggattggtatcacctttattaccacagggttgatggcgctaggctttatgtctttctcggggatctcgctgtaa

SEQ ID NO: 20215 - protein, 202 aa, Shewanella oneidensis MR-1
MEHYINLFIQATFLDNMALSFFLGMCTFLAVSKKVSTAFGLGVAVIVVMTLAVPLNQLIYAKVLAPGALAWAGMPGIDLSYLQLITFIGVIAALVQILEMFLDKYIPSLYDSLGIFLPLLTVNCAIFAGVIFMANRDYNFAESAVFAMGSGTGWALAIVMLAGLRERMKFHAIPEGLQGIGITFITTGLMALGFMSFSGISL

SEQ ID NO: 20216 - DNA, 633 bp, Shewanella oneidensis MR-1
  CDS (1)..(633): transl_table=11
atgtctgacgctaaagaactgaaacaggttctgactggacctatcgtcaacaacaacccgattgcattacaagttcttggtgtatgtagtgcgttagcggtaacgagcaagctcgaaactgcactggtgatggcgttggcattaactgcggtaacagcgttttctaacctgtttatctcaatgatccgtaatcatattcctagcagcgtacgtattatcgtacagatgaccattattgcctctctggtaatcgtggttgaccaattgctgcaggcttatgcttatcagatttctaagcaattatcggtattcgtcggccttattattacgaactgtatcgtaatgggtcgcgctgaagcctatgcgatgaaaacaccgccaatgatgagttttatggatggtattggtaacggtttaggttacggtgcgattctattagctgttggttttgtgcgtgagctgtttggtaacggttctctgttcggtgttcaaatcctgcacaagatctctgatggtggctggtatcaaccaaacggtctgctattactgccgccaagtgcgttcttcctgatcggtatgttgatttggattattcgtacctataagccagagcaagttgaagcaaaagggtaa

SEQ ID NO: 20217 - protein, 210 aa, Shewanella oneidensis MR-1
MSDAKELKQVLTGPIVNNNPIALQVLGVCSALAVTSKLETALVMALALTAVTAFSNLFISMIRNHIPSSVRIIVQMTIIASLVIVVDQLLQAYAYQISKQLSVFVGLIITNCIVMGRAEAYAMKTPPMMSFMDGIGNGLGYGAILLAVGFVRELFGNGSLFGVQILHKISDGGWYQPNGLLLLPPSAFFLIGMLIWIIRTYKPEQVEAKG

SEQ ID NO: 20218 - DNA, 609 bp, Shewanella oneidensis MR-1
  CDS (1)..(609): transl_table=11
atggaacattatattagcctgttaattcgctctgttttcattgaaaacatggcactggccttcttcctcggtatgtgtactttcttagctgtatcgaagaaagtgaccactgcgatgggcctagggattgcggtagttgtagtgttaactatctctgttcctgctaaccaagttatttaccaagggctgttagcacctggcgcattggcttgggccggcgcacctgaagctgacctaagcttcttgaaattcattacctttatcggtgtgatcgcggctttagttcaaattctggaaatggcactggataagtactttcctcctttgtataacgcgttaggtatcttcttacctctgatcactgtgaactgtgcgattttcggtgcggtatcatttatggttgagcgtgactataaactgggtgaaagtctggtgtttggtttcggctctggagtaggttgggcattagctatcgtattgatggccggtatccgtgagaagctgaagtatgccgatgtgcctaatggcctgcgtggtttgggtattacctttattactgctggtttaatggccttaggtttcatgtcgttttctggtgtgtctctataa

SEQ ID NO: 20219 - protein, 202 aa, Shewanella oneidensis MR-1
MEHYISLLIRSVFIENMALAFFLGMCTFLAVSKKVTTAMGLGIAVVVVLTISVPANQVIYQGLLAPGALAWAGAPEADLSFLKFITFIGVIAALVQILEMALDKYFPPLYNALGIFLPLITVNCAIFGAVSFMVERDYKLGESLVFGFGSGVGWALAIVLMAGIREKLKYADVPNGLRGLGITFITAGLMALGFMSFSGVSL

SEQ ID NO: 20220 - DNA, 579 bp, Shewanella oneidensis MR-1
  CDS (1)..(579): transl_table=11
atgagtgaatatctcctgttgttgatcagcactgtattggtcaacaatttcgttttagtgaaattcttaggtttatgtccatttatgggggtctccagcaaattggagtccgctatcggtatgtctatggccaccaccttcgtgttgactttggcatccattctcagttacctcgtgaatcaatatctgctattgccctttgacctcggttatctgcgcaccatgagctttattttagtgattgcggtggtggtgcaatttaccgagatggtcgtgcaaaaaaccagtgcagccctacaccgcgcgttggggatttatctgccgctgatcaccactaactgcgctgtattaggggtagcactattaaacgtgaatgagaaacacgattttattcaatccgctatctacggatttggtgccgcggtagggttttccttagtgttaattctgttttctgcgatgcgtgaacgtttagcggctgccgatgtaccagagccttttaaaggcggtgccatcgccatgatcaccgcgggcctgatgtccttggcctttatgggattcacaggattggttaaataa

SEQ ID NO: 20221 - protein, 192 aa, Shewanella oneidensis MR-1
MSEYLLLLISTVLVNNFVLVKFLGLCPFMGVSSKLESAIGMSMATTFVLTLASILSYLVNQYLLLPFDLGYLRTMSFILVIAVVVQFTEMVVQKTSAALHRALGIYLPLITTNCAVLGVALLNVNEKHDFIQSAIYGFGAAVGFSLVLILFSAMRERLAAADVPEPFKGGAIAMITAGLMSLAFMGFTGLVK

SEQ ID NO: 20222 - DNA, 699 bp, Shewanella oneidensis MR-1
  CDS (1)..(699): transl_table=11
atgactaattatcgcgaaattgcttggcaagggctgtggaaaaataaccctggtctagtacagcgcctcgggctttgcccattgctagcggtcacaacaaccctcaccaatgcccttggccttggtatcgccactatgctggtactgataggctctaacgtcttaatatcgttagtacgcgactatgtgcccaaggaaatccgtatccccgtgtttgtgatgatcattgcagcgctggtgacggcggtgcaacttctggtgaatgcttatgcctatgggctttatatgtcgttggggatcttcctaccgctgattgtgaccaactgcattatcattggccgcgcagaagcatttgcttcccgtaataatgcctttagctccgccttcgatggtttgatgatgggattagggtttaccttggtattggtcttacttggcgccacgcgagaaatccttggtcaaggcacactgtttgatggcgcagatcaactgcttggcccttgggcaaaagccttaacatttcaggtatggcaagttgatacgtccttcctgctagccatgttgccgcccggcgcctttatcgtcatgggtttacttatcgctcttaaaaacgttatcgataaaaagcttagagagcgtcagcctgaaacggcggttcaaccaagcgtcgcacgggcacggatcactaaagtgagttaa

SEQ ID NO: 20223 - protein, 232 aa, Shewanella oneidensis MR-1
MTNYREIAWQGLWKNNPGLVQRLGLCPLLAVTTTLTNALGLGIATMLVLIGSNVLISLVRDYVPKEIRIPVFVMIIAALVTAVQLLVNAYAYGLYMSLGIFLPLIVTNCIIIGRAEAFASRNNAFSSAFDGLMMGLGFTLVLVLLGATREILGQGTLFDGADQLLGPWAKALTFQVWQVDTSFLLAMLPPGAFIVMGLLIALKNVIDKKLRERQPETAVQPSVARARITKVS

SEQ ID NO: 20224 - DNA, 549 bp, Pseudomonas putida KT2440
  CDS (1)..(549): transl_table=11
atgaatgactacatcctggtcctgatcagcgccgcactgatcaatcacctgtgcctgctccgacagccactctccgggctgcaacttcaggtgcacggcctggcctgcgccctgtgcatcgccctgggcgtaatcggcgcgcagctgctggtgcacgcggtacttgccccgttgcacatccacgatcttgccctgtttctgctattgccctggctggccttgctcgcctggggactgccctggcttttggccaagtggcgcccggcctggcctgtagtggggttgccagcgctgctgttgagcaatgcagcagcgcttgggcttgccctgcagcagacaagcgacggcaccacctggccaaccatgctgctcaaaggcttgctgacgggtggcggcttctggctggcgctgatggtgttcgccgacctgcgccagcgcagcgcccacgccgatatccccaacgtgctgcgcggcctgcccatcgaattgatcggtgccggggtgatggctatggcgttttccggtttcaacggaatgtttggccaatga

SEQ ID NO: 20225 - protein, 182 aa, Pseudomonas putida KT2440
MNDYILVLISAALINHLCLLRQPLSGLQLQVHGLACALCIALGVIGAQLLVHAVLAPLHIHDLALFLLLPWLALLAWGLPWLLAKWRPAWPVVGLPALLLSNAAALGLALQQTSDGTTWPTMLLKGLLTGGGFWLALMVFADLRQRSAHADIPNVLRGLPIELIGAGVMAMAFSGFNGMFGQ

SEQ ID NO: 20226 - DNA, 603 bp, Clostridium tetani E88
  CDS (1)..(603): transl_table=11
atgtcaatgggtgatagattatacaatggtattattagagaaaatccaacttttgttcaggtattaggaatgtgtccaaccctagcggtaacttcaagtgctatgaatggggcaggaatgggattatcaacaactgttgtattaataggatcaaacgtagctatatcattacttagaaaagttattccagatgaaattcgtataccggcatatataactataatagctacttttgttacagtgttgcaatttttacttaaagcatatcttccagatttaaataagtctttaggtatatttataccacttatagttgttaactgtattatacttggaagagcggaagcttatgcatcaaaaaatggtatagtaagctcgttatttgatggtttgggaatgggattaggatttactttatccttaactgtactaggaataataagagaattattaggaaatggaacagtatttggttggagattaatgccacaagcatataatccagcactaataatgatacttgcacctggagctttctttacattaggaatattattggcaatattaaatgctagaaaattaaagaaagctaaaaacaattaa

SEQ ID NO: 20227 - protein, 200 aa, Clostridium tetani E88
MSMGDRLYNGIIRENPTFVQVLGMCPTLAVTSSAMNGAGMGLSTTVVLIGSNVAISLLRKVIPDEIRIPAYITIIATFVTVLQFLLKAYLPDLNKSLGIFIPLIVVNCIILGRAEAYASKNGIVSSLFDGLGMGLGFTLSLTVLGIIRELLGNGTVFGWRLMPQAYNPALIMILAPGAFFTLGILLAILNARKLKKAKNN

SEQ ID NO: 20228 - DNA, 576 bp, Clostridium tetani E88
  CDS (1)..(576): transl_table=11
atgaagatatttaccatatttttaagtgcgctattagttaataacttcgttttatctagattcttaggaatatgtcctttccttggtgtttccaaaaaagtagaaactgctacaggaatgggggcagcagttacgtttgttatggcgttagcgtctattatgacttatttagttgaaaaatttatactagtaaaatttgagataacatatttatcaacattggcatttatacttgttatagcatctctagttcaatttgttgagatggtaattaaaaaggtaagtcctgatttgtataaagcattaggtatattcttacctttaataacaacaaactgtgctgttctaggagttgcagttattaacagtgatgaaggatatactttaattgaatcattagtaaactctgtaggagcggcactaggatttacattagcccttgttttacttgcaggaattagagaaaagttagatactaacgaatatataccagaagcactaaaaggtctaccaataacacttgttacagcaggattaatggctatagcgtttctaggattccaaggactaatataa

SEQ ID NO: 20229 - protein, 191 aa, Clostridium tetani E88
MKIFTIFLSALLVNNFVLSRFLGICPFLGVSKKVETATGMGAAVTFVMALASIMTYLVEKFILVKFEITYLSTLAFILVIASLVQFVEMVIKKVSPDLYKALGIFLPLITTNCAVLGVAVINSDEGYTLIESLVNSVGAALGFTLALVLLAGIREKLDTNEYIPEALKGLPITLVTAGLMAIAFLGFQGLI

SEQ ID NO: 20230 - DNA, 639 bp, Vibrio parahaemolyticus RIMD 2210633
  CDS (1)..(639): transl_table=11
ttgttattggtgtcacaaaacacgataatattgagatcggattttaagaacgtaataactatgaccgaatatgttttgttgttggtcggcactgtgctggtgaacaactttgtactggtgaagtttttgggcttgtgtccatttatgggcgtgtctaaaaaactggaaacagcaataggcatggggttagcaaccacttttgtgctaacccttgcatctgtgtgtgcgtacttagtggaaagctatatcttgcgaccgctcggtatcgagtacttaagaaccatgagctttattttggtgatcgctgtcgtggtacagttcaccgagatggttgtacacaaaactagcccgaccctttatcgcttgcttggtatcttcttaccactaatcacgaccaactgtgccgtattgggtgttgcacttctcaacatcaatgagaatcataacttcatcgaatctatcatttatggttttggtgcagccgtcggtttttcacttgtattgatcctttttgcttctatgcgtgagcgtatcgctgcggctgacgtgcctgttccatttaaaggtgcatcgattgcaatgatcacagcgggtttaatgtcgcttgctttcatgggctttacaggtttggtgaagtaa

SEQ ID NO: 20231 - protein, 212 aa, Vibrio parahaemolyticus RIMD 2210633
MLLVSQNTIILRSDFKNVITMTEYVLLLVGTVLVNNFVLVKFLGLCPFMGVSKKLETAIGMGLATTFVLTLASVCAYLVESYILRPLGIEYLRTMSFILVIAVVVQFTEMVVHKTSPTLYRLLGIFLPLITTNCAVLGVALLNINENHNFIESIIYGFGAAVGFSLVLILFASMRERIAAADVPVPFKGASIAMITAGLMSLAFMGFTGLVK

SEQ ID NO: 20232 - DNA, 585 bp, Bacteroides thetaiotaomicron VPI-5482
  CDS (1)..(585): transl_table=11
atgaataattttaaagtaatgatgaacgggattatcaaagagaatcctatttttgtgctcctgctcggtatgtgtcctacactgggtacgacatcatcggcaatcaacggtatgggtatgggactggccactatgttcgtcctgatttgctcgaacgtggtaatttcatctatcaagaatctgattccggatatggtacgcatcccttcatttatcgtggtgatcgcgtcattcgtgacactgttgcagatgataatgcaagcatacgtgcccgatctgtatgctaccctcggtcttttcattccgctgatcgtagtaaactgtatcgtattgggacgtgcggaagctttcgcagcgaagaacaatccgctggcctctatgtttgatggtatcggtatgggatttggctttaccattgccctgactctgttgggtgccgtacgtgaattcctcggaacaggtaagatatttaatctgaccattctgccggaagaatacggaatgctgatctttgttctggctccgggtgcctttatcgctttaggttatctgattgccattattaatagtctgaagaaagcctaa

SEQ ID NO: 20233 - protein, 194 aa, Bacteroides thetaiotaomicron VPI-5482
MNNFKVMMNGIIKENPIFVLLLGMCPTLGTTSSAINGMGMGLATMFVLICSNVVISSIKNLIPDMVRIPSFIVVIASFVTLLQMIMQAYVPDLYATLGLFIPLIVVNCIVLGRAEAFAAKNNPLASMFDGIGMGFGFTIALTLLGAVREFLGTGKIFNLTILPEEYGMLIFVLAPGAFIALGYLIAIINSLKKA

SEQ ID NO: 20234 - DNA, 573 bp, Bacteroides thetaiotaomicron VPI-5482
  CDS (1)..(573): transl_table=11
atggaatatatattgatatttatctcggcaatctttgtaaacaacattgtgttgtcgcagttcctgggaatctgtccgttcctgggtgtttccaagaaggtggaaacagcgatgggtatgagtgcggcagttgctttcgtgctgactatcgctaccatcgtcacattcctgattcagaagtttgtgttggacgctttcggattggggtacttacagacaatcacttttattctggttattgccggactggtgcagatggtagaaattattctgaagaaagtttctccttctttgtatcaggcactgggtgtgttcctgccgttgattacaacgaactgctgtattctcggtgtggcaatcctggtcatccagaaagactttgatctgctgacaggtgttgtatacgcattctctactgctcttggctttggtctggcactggtattgtttgccggattgcgtgagcagatgaccctggtgaagattccgaaaggaatgcaggggactccgattgctttgattaccgcaggtttgctggcaatggcattcatgggcttctctggcgtcgtgtaa

SEQ ID NO: 20235 - protein, 190 aa, Bacteroides thetaiotaomicron VPI-5482
MEYILIFISAIFVNNIVLSQFLGICPFLGVSKKVETAMGMSAAVAFVLTIATIVTFLIQKFVLDAFGLGYLQTITFILVIAGLVQMVEIILKKVSPSLYQALGVFLPLITTNCCILGVAILVIQKDFDLLTGVVYAFSTALGFGLALVLFAGLREQMTLVKIPKGMQGTPIALITAGLLAMAFMGFSGVV

SEQ ID NO: 20236 - DNA, 627 bp, Bacteroides thetaiotaomicron VPI-5482
  CDS (1)..(627): transl_table=11
atggaacatttattaagtttattcgtccgctccatctttgtggacaacatgatattcgcgttcttcttgggtatgtgctcatatctggctgtatcgaagaatgtgaagactgccgtaggactgggtatagccgtaacattcgtgttgctggttacgcttccggtgaactatttattgcaaaccaaggtgctggctgccaacgctatcattgaaggtgttgacctcagcttcctgagttttattcttttcattgccgttattgccggtatcgtgcaattggtggagatggtggtagaacgtttcagcccgtcgctgtatgcttcactgggtatctttctgccgttgatcgccgttaactgtgctatcatgggtgcttctttgtttatgcaacaacgcatcaatctgggtgcaagcgatccgaaatacatcggtgatgtatgggatgcgctgtcttacgcactcggttcgggtatcggctggctgctggctatcgtcggtctggctgctatccgtgagaaaatggcttactctgatgtacctgctccgctaaaaggtctgggtatcacatttatcactgtaggtctgatggcaatcgcatttatgtgtttctctggtttgaacatctaa

SEQ ID NO: 20237 - protein, 208 aa, Bacteroides thetaiotaomicron VPI-5482
MEHLLSLFVRSIFVDNMIFAFFLGMCSYLAVSKNVKTAVGLGIAVTFVLLVTLPVNYLLQTKVLAANAIIEGVDLSFLSFILFIAVIAGIVQLVEMVVERFSPSLYASLGIFLPLIAVNCAIMGASLFMQQRINLGASDPKYIGDVWDALSYALGSGIGWLLAIVGLAAIREKMAYSDVPAPLKGLGITFITVGLMAIAFMCFSGLNI

SEQ ID NO: 20238 - DNA, 642 bp, Bacteroides thetaiotaomicron VPI-5482
  CDS (1)..(642): transl_table=11
atgggacaactgttttcaaagaagaataaagaagtattctctgctccgttgggaatcgataatccggtaaccgtacaggtgcttggtatctgttctgcacttgctgttactgccaagctggaacccgccattgtgatgggactttcagttactgtgattacagcgtttgccaatgtcgttatttcactgttgcgtaagacgattccaaatcgtatccgtatcatcgttcagttggtagtggttgctgctttggttaccatcgttagtgaaattctgaaagcgtttgcatacgatgtaagtgtacagctctctgtttatgtaggtttgatcattaccaactgtatcctgatgggacgtctggaagcatttgccatgcagaacggtccttgggaatcattccttgacggagttggtaacggtttgggttatgccaagattctggtaatcgtagctttcttccgcgaactgctcggttcgggaactttgcttggtttcaatatcctgaattatgagcctatccagaatatcggttatgtaaacaacggtctgatgttgatgccgccgatggcattgattatcgtagcttgcatcatctggtatcagcgtgcacgtcacaaagaactgcaagaagaaagtaattaa

SEQ ID NO: 20239 - protein, 213 aa, Bacteroides thetaiotaomicron VPI-5482
MGQLFSKKNKEVFSAPLGIDNPVTVQVLGICSALAVTAKLEPAIVMGLSVTVITAFANVVISLLRKTIPNRIRIIVQLVVVAALVTIVSEILKAFAYDVSVQLSVYVGLIITNCILMGRLEAFAMQNGPWESFLDGVGNGLGYAKILVIVAFFRELLGSGTLLGFNILNYEPIQNIGYVNNGLMLMPPMALIIVACIIWYQRARHKELQEESN

SEQ ID NO: 20240 - DNA, 696 bp, Shigella flexneri 2a str. 2457T
  CDS (1)..(696): transl_table=11
gtgagcgaaattaaagacgttattgttcaggggttgtggaaaaacaactctgcactggtccaactgctcggcctttgtccgctattggcggtcacatccactgccactaacgctctgggtttaggacttgcgactacgctggtactgacgctgaccaacctgaccatttcgacgctgcgtcactggacgccagccgagatccgcattcccatttacgtgatgatcatcgcctcggtggtcagcgctgtacagatgctgatcaacgcctacgcctttggcctgtatcaatcattagggatttttattccgctgattgtcactaactgtatcgttgtgggccgcgctgaagccttcaccgccaaaaaaggtccggcgctttcggcactggacggcttttcaattggtacgggcgcaacctgcgccatgttcgtgctgggttcactacgcgaaattatcggcaatggcacgttgtttgacggtgcagatgcgctgttaggtagctgggcaaaagtattacgcgtggagattttccacaccgactcccctttcctgctggcgatgctgccaccaggtgcatttattggcttgggactgatgctggcaggaaaatacctgattgatgaaagaatgaaaaagcgccgtgctgaagcagctgccgaacgtgcattgccaaacggtgaaacagggaatgtctga

SEQ ID NO: 20241 - protein, 231 aa, Shigella flexneri 2a str. 2457T
MSEIKDVIVQGLWKNNSALVQLLGLCPLLAVTSTATNALGLGLATTLVLTLTNLTISTLRHWTPAEIRIPIYVMIIASVVSAVQMLINAYAFGLYQSLGIFIPLIVTNCIVVGRAEAFTAKKGPALSALDGFSIGTGATCAMFVLGSLREIIGNGTLFDGADALLGSWAKVLRVEIFHTDSPFLLAMLPPGAFIGLGLMLAGKYLIDERMKKRRAEAAAERALPNGETGNV

SEQ ID NO: 20242 - DNA, 609 bp, Nitrosomonas europaea ATCC 19718
  CDS (1)..(609): transl_table=11
atgaacagtctggccggtttatttattaccgcagttttcgtcgagaatcttgcgcttactttttttcttggcatgtgcacttttctggccatttccaaaaaaatagaggtggcgttcggcatgggaattgccgtgatcgtcgtccagacattgacggttcccatcaataatctggtttatcagtacctgcttcgtgacggtgctctggtctgggcaggtctggcggagattgatttaactttcctcgggctcgtcagttatcttggggttatcgccgcgatagtacagattctggaaatgtttctggatcgtttcatgccggctctgcacagtgcattgggcatctatctgccactgattgccgtgaattgtgccattctgggtggttcattgttcatggtggaacgtgactataattttactgagagccttgtatatggtctcggctccggtttcggttgggcgttggcaattgttgcgctggctggtgtacgtgaaagactcaaatattcggatgtgccagacggtttacagggactgggcattacttttatcagtgcgggattgatggctatgggattcatggccttctccggcattcggctttaa

SEQ ID NO: 20243 - protein, 202 aa, Nitrosomonas europaea ATCC 19718
MNSLAGLFITAVFVENLALTFFLGMCTFLAISKKIEVAFGMGIAVIVVQTLTVPINNLVYQYLLRDGALVWAGLAEIDLTFLGLVSYLGVIAAIVQILEMFLDRFMPALHSALGIYLPLIAVNCAILGGSLFMVERDYNFTESLVYGLGSGFGWALAIVALAGVRERLKYSDVPDGLQGLGITFISAGLMAMGFMAFSGIRL

SEQ ID NO: 20244 - DNA, 672 bp, Nitrosomonas europaea ATCC 19718
  CDS (1)..(672): transl_table=11
atgatggcacaatccgtccgcaaaattttatttacacccgttgttaacgaaaatccgattacactgcaagtactggggatctgttcagcgctggcggttaccagcaaagtatctacagctttgactatgtgtattgctttgacgctggtcgtagcctgttccagcatgctgatcagtctgattcgtcattacatccctacgaatattcgtattatcatacaaatgacgattgccgcctcgctggtgatcgtggttgaccagttcctgcgggcatttgcctatgaggtcagtcgggagctctcggtattcgtcagtctgatcgttaccaattgtatcgtcatggggcgggcagaggcatttgccatgaaaaatccgccctggccgagtttccttgatggattgggtaatggtctcgggtacagcgcgattttgctgatagtcgggataatacgtgaactgttcggttcgggctccctgctgggagttacgatcctgccactcattcgggatggtggttggtatgaacccaatggattgttattattgccgcccagcgctttctttctgatcggattgatcatctggggggtgcgctcctggaaaacgaatcaagtcgagcaacccgagttccgcatccagcagacccataatcctactgagatcataagatga

SEQ ID NO: 20245 - protein, 223 aa, Nitrosomonas europaea ATCC 19718
MMAQSVRKILFTPVVNENPITLQVLGICSALAVTSKVSTALTMCIALTLVVACSSMLISLIRHYIPTNIRIIIQMTIAASLVIVVDQFLRAFAYEVSRELSVFVSLIVTNCIVMGRAEAFAMKNPPWPSFLDGLGNGLGYSAILLIVGIIRELFGSGSLLGVTILPLIRDGGWYEPNGLLLLPPSAFFLIGLIIWGVRSWKTNQVEQPEFRIQQTHNPTEIIR

SEQ ID NO: 20246 - DNA, 627 bp, Rhodopirellula baltica SH 1
  CDS (1)..(627): transl_table=11
atggctgcccccaaagtcggcaaggtcctgtttggacctgtcatcgacaacaacccaatcgcgttgcagatcctgggcatttgtagtgctctggctgtgacgaccagcatccaagtctcgatcgtcatggctctggccgtgatcgcggtgaccgggtgttccaatgcggcggtctcgtccattcgtcactacattcccggcagcatccggatcatcgttcagatgaccgtgatcgcgtcgttggtgatcgtcgttgaccaagtgttgaaggcgtacatgtacgaaatcagcaagcagctttcggtcttcgtgggtttgatcatcaccaactgtatcgtcatgggacgtgcggaaggtttcgctatgaagaatggcgtgtggatcagcttcctcgacggaatcggaaacggactgggatacggattggtcctgatcgtcgtcgcgttcttccgcgaattgttcggcagcggttcgctgttgggcttcgagctctttcaactggaccgcaacggcggctggtacaacccgaacaacttgatgctgttgccgcccagtgcgttcttcatcatcgggttcatgatttgggtcattcgtttgaacaaacccgaacaaatcgaagaggcctaa

SEQ ID NO: 20247 - protein, 208 aa, Rhodopirellula baltica SH 1
MAAPKVGKVLFGPVIDNNPIALQILGICSALAVTTSIQVSIVMALAVIAVTGCSNAAVSSIRHYIPGSIRIIVQMTVIASLVIVVDQVLKAYMYEISKQLSVFVGLIITNCIVMGRAEGFAMKNGVWISFLDGIGNGLGYGLVLIVVAFFRELFGSGSLLGFELFQLDRNGGWYNPNNLMLLPPSAFFIIGFMIWVIRLNKPEQIEEA

SEQ ID NO: 20248 - DNA, 642 bp, Rhodopirellula baltica SH 1
  CDS (1)..(642): transl_table=11
atggtcgaacaatacctcagcgtctttttgaaggcggtcttcgtcgagaaccttgcactcgcattctttcttggaatgtgcaccttcttggctgtcagtaaaaacgtcaaaacggcaatcggcttgggcatcgcggtcatcgcgattgaaaccatcaccgtgcctgccaaccaattgatttacagcctgttgctgaagaaaggtgcgttgacctgggtcaatgattacctgatcagcactgacacgtacaacttcgcggaggtcgacctgaccttcctcgggttcatcagttacatcggtgtgattgccgccatggttcagatcttggaaatgttcctcgatcgattcatgcccagcctttacaacgccctggggatcttccttcccctgatcacggtgaactgtgccatcctgggtgcgtcgctgttcatggagcaacgcgagtatccgttcggcgaatcggtcgtcttcggattcggatgtggtgtcggttgggctttggcgatcatggctttggccggtattcgcgaaaaattgaagtacagcgacgttcctccgccacttcgcggtttgggaatcacgtttatcacggttggattgatgtccctggcattcatgtcgtttagcggcatccagctgtaa

SEQ ID NO: 20249 - protein, 213 aa, Rhodopirellula baltica SH 1
MVEQYLSVFLKAVFVENLALAFFLGMCTFLAVSKNVKTAIGLGIAVIAIETITVPANQLIYSLLLKKGALTWVNDYLISTDTYNFAEVDLTFLGFISYIGVIAAMVQILEMFLDRFMPSLYNALGIFLPLITVNCAILGASLFMEQREYPFGESVVFGFGCGVGWALAIMALAGIREKLKYSDVPPPLRGLGITFITVGLMSLAFMSFSGIQL

SEQ ID NO: 20250 - DNA, 591 bp, Porphyromonas gingivalis W83
  CDS (1)..(591): transl_table=11
atgagtaagaatttgagtgttattataaacggcattatcaaggagaacccgacattcgtcctcctcctcggtatgtgtcctacgttggccacgacaacgtcggccatcaacggtatgagtatgggactggccaccatgtttgtattgatctgctccaacatggtagtatccttggtcaagaatctcatccccgatatggttcgtatcccggcttttattgtcatcattgcaggtttcgtgacgatattgcagatgcttatcaaggcttatatgccggatttggacaagagtctcggtatcttcatcccactgatcgtggtgaactgtatcgtactcggtcgtgctgaagccgttgcatcgaaaaaaggtctgctacactccatgttcgacggtatcggtatcggattgggctttaccctcagtttgactgttctcggtattgtccgtgagcttttgggtagcggtaagcttttcgactttgcagttttcaatgaatcctatggagcattgatcttcgtattggcacccggagctttcatcgctttgggctacctgattgccttggtgaacaaaatgaagaaaaaagcataa

SEQ ID NO: 20251 - protein, 196 aa, Porphyromonas gingivalis W83
MSKNLSVIINGIIKENPTFVLLLGMCPTLATTTSAINGMSMGLATMFVLICSNMVVSLVKNLIPDMVRIPAFIVIIAGFVTILQMLIKAYMPDLDKSLGIFIPLIVVNCIVLGRAEAVASKKGLLHSMFDGIGIGLGFTLSLTVLGIVRELLGSGKLFDFAVFNESYGALIFVLAPGAFIALGYLIALVNKMKKKA

SEQ ID NO: 20252 - DNA, 573 bp, Porphyromonas gingivalis W83
  CDS (1)..(573): transl_table=11
atggaatttttcatgttattcatagcggcggttttcgttaataacgtcgtgctgtcgcagttcctcggtatatgcccattcttaggcgtatcgaagaaggtagacacctcaatcggtatgggtgcagccgtgacattcgtattggcactggctaccttggttaccttcctgattcagaagttcgttttggatcgtttcggattgggctttatgcagaccattgcatttattttggtcattgccgccttggtgcagatggtggagatcatactcaagaaagtatctcctcccctctatcaggcactgggtgtattcttgcccttgattacgacgaactgctgtgtgctcggtgtggctattttggttatccagaaggattataccctgctccagagcttcgtctatgcaatatccacggctatcggtttcaccttggcaatggttactttcgcaggtattcgagagcaactcgatatgaccaatctccccaaagctatgaagggaataccttcggcactcttggctgccggtatattggctatggctttcatgggcttcagcggtatcgcctaa

SEQ ID NO: 20253 - protein, 190 aa, Porphyromonas gingivalis W83
MEFFMLFIAAVFVNNVVLSQFLGICPFLGVSKKVDTSIGMGAAVTFVLALATLVTFLIQKFVLDRFGLGFMQTIAFILVIAALVQMVEIILKKVSPPLYQALGVFLPLITTNCCVLGVAILVIQKDYTLLQSFVYAISTAIGFTLAMVTFAGIREQLDMTNLPKAMKGIPSALLAAGILAMAFMGFSGIA

SEQ ID NO: 20254 - DNA, 615 bp, Porphyromonas gingivalis W83
  CDS (1)..(615): transl_table=11
atggattacataagtatgtttgtccgctcgatattcgtggacaatatggtttttgcctactacttgggaatgtgttctttcttggccgtttccaagaatgtgaagacctctatcggactcggagctgccgtgactttcatcttggtctgcaccttgcccatcaactatctgttacagaactatattttcaaggccggtgctctttcttggctcggatcccaatatgccgaagtggatctgagcttcctctcactgatcatctttatcgcggtgattgcatcctttacgcagctcgtggaaatggtggtggagagattcagcccctccctctatgcttcgctgggtatcttccttcccttgatcgcggtgaactgcgcgatcctcggaggatcgcttttcatgcagcagcgtgagtttatcaatgtcgggatggctaccgtctatggattcggctccggtatcggctggatgctggctatcgtagggatggctgccatacgcgagaagctggcatattccaacgtccccaaaccgttgagagggttgggtatcacttttattatcaccggtctcatgggtattgctttcctgagcttctccggcgtgaaactctaa

SEQ ID NO: 20255 - protein, 204 aa, Porphyromonas gingivalis W83
MDYISMFVRSIFVDNMVFAYYLGMCSFLAVSKNVKTSIGLGAAVTFILVCTLPINYLLQNYIFKAGALSWLGSQYAEVDLSFLSLIIFIAVIASFTQLVEMVVERFSPSLYASLGIFLPLIAVNCAILGGSLFMQQREFINVGMATVYGFGSGIGWMLAIVGMAAIREKLAYSNVPKPLRGLGITFIITGLMGIAFLSFSGVKL

SEQ ID NO: 20256 - DNA, 630 bp, Porphyromonas gingivalis W83
  CDS (1)..(630): transl_table=11
atgtcactttggaataaaaagaataaggaaattcttctcgggccgctaagcagcaacaatcccgttatcgtgcagatgcttggtatctgctctgctctggccgtaacagccaagctgcaaccggctattgtcatggccctgtcggttactgcggtagtagcttttgccaacgttattatctctctcctgcgcaatacgatccccggacgcatccgaattatcgttcagctcgtcgtggtcgcagctctggtgactatcgtgagtcaggtactgaaagccttcgcttacgatgtgaacaagcagttgtccgttttcgtcggcctgatcattaccaactgtattttgatgggacgtttggaggcttttgccttggccaatcgtccttgggagtcattcctcgatggtatcggaaacggtctgggatatggatgggttttggttattatcgctttcttccgcgaattgctcggctccggtacattgctggatataaaagtcattcccaagagcttctacgaatcgggttatgtcaataacggtctgatgatcttgccgccgatggctctgatcaccgtggcagttgtcatctgggtacatcgtgcccgtaacaaggatttgcaagagaactaa

SEQ ID NO: 20257 - protein, 209 aa, Porphyromonas gingivalis W83
MSLWNKKNKEILLGPLSSNNPVIVQMLGICSALAVTAKLQPAIVMALSVTAVVAFANVIISLLRNTIPGRIRIIVQLVVVAALVTIVSQVLKAFAYDVNKQLSVFVGLIITNCILMGRLEAFALANRPWESFLDGIGNGLGYGWVLVIIAFFRELLGSGTLLDIKVIPKSFYESGYVNNGLMILPPMALITVAVVIWVHRARNKDLQEN

SEQ ID NO: 20258 - DNA, 630 bp, Photorhabdus luminescens subsp. laumondii TTO1
  CDS (1)..(630): transl_table=11
atggctgatagtaaagaaataaaacgagtccttcttgggccactcttggataataacccgattgcattgcaggttttggggatttgctcagcgctggcggtaacaaccaagctggaaacggcgttggtcatgacaatagcggtaacattggtgactgccttttccagcttttttatctcgttgattcgtcattacatccccggcagtgtgcggatcattgtccagatggctattattgcatcactggttatcgtggtagatcagattttacaggcttatgcttatgagatttccaagcagttgtcggtatttgttggtcttatcattactaactgtatcgtgatgggacgtgcggaagcctatgcgatgaagtctccacccattgagagctttatggatggtatcggtaatggtttaggttacggggttattctggtattggttggtttcctgcgtgagttgtttggttccggcaaactgtttgggattaccgtgatggaatcggtacagaatggtggctggtatcaacctaatggtttgttcctgttagccccaagcgcgtttttcattattggtatgctgatttggggtctgaggacgttgaaaccggcgcaggttgagaaggagtaa

SEQ ID NO: 20259 - protein, 209 aa, Photorhabdus luminescens subsp. laumondii TTO1
MADSKEIKRVLLGPLLDNNPIALQVLGICSALAVTTKLETALVMTIAVTLVTAFSSFFISLIRHYIPGSVRIIVQMAIIASLVIVVDQILQAYAYEISKQLSVFVGLIITNCIVMGRAEAYAMKSPPIESFMDGIGNGLGYGVILVLVGFLRELFGSGKLFGITVMESVQNGGWYQPNGLFLLAPSAFFIIGMLIWGLRTLKPAQVEKE

SEQ ID NO: 20260 - DNA, 597 bp, Photorhabdus luminescens subsp. laumondii TTO1
  CDS (1)..(597): transl_table=11
atggaacattttataagcctgtttgtccgcgctgtctttattgagaacatggcgttggctttcttcctcggtatgtgcacctttttggccgtatcgaaaaatgtcacaacagcgtttggtctgggtattgccgtcacggtggttttagggatctcggttcctgctaataacctggtgtataacttggtattgcgtgacggtgcattggttgaaggggttgatctcagctttctgaactttattacatttattggcgtgattgctgcattagtgcagattcttgaaatgatccttgatcgttatttcccttcactctataacgcgcttggcatttttttaccactgattacggttaactgtgcgatttttggtggtgtctctttcatggcgcagcgtgactataacttttctgaatccatcgtgtatggttttggctcaggtataggttggatgttggcaattgttctgctggcttctatccgtgaaaaaatgaaatatgctgatgttccagcgggtctgaaaggattggggatcacctttgtcactacgggtttgatggcattgggttttatgtccttctctggtgtccagttataa

SEQ ID NO: 20261 - protein, 198 aa, Photorhabdus luminescens subsp. laumondii TTO1
MEHFISLFVRAVFIENMALAFFLGMCTFLAVSKNVTTAFGLGIAVTVVLGISVPANNLVYNLVLRDGALVEGVDLSFLNFITFIGVIAALVQILEMILDRYFPSLYNALGIFLPLITVNCAIFGGVSFMAQRDYNFSESIVYGFGSGIGWMLAIVLLASIREKMKYADVPAGLKGLGITFVTTGLMALGFMSFSGVQL

SEQ ID NO: 20262 - DNA, 582 bp, Photorhabdus luminescens subsp. laumondii TTO1
  CDS (1)..(582): transl_table=11
atgactgactattttcttttatttgtcggaaccgtattggttaacaatttcgtcttggtgaaattcctcggcttatgccctttcatgggcgtatctaaaaagctggaaactgccatcgggatgggatttgcgacaacatttgttatgacactagcctctgtatgttcatggctggtgaatacttttattctattaccactggacttaatctatttgcgtactctgagctttattcttgtcattgcggtcgtagtgcaattcacagagcttgttgtacgcaaaaccagcccgacgttataccggttattaggtattttcttgccgttgattacgacgaactgtgctgtactgggtgtggcgctgctgaatatcaatcaatcacacgattttttacaatccgctatctatggtttcggtgctgccgccggtttctctctcgttatggtactgtttgccgctattcgcgaacgtctggctgttgctgatgtacccgcccctttcaaggggtcatctattggtcttattactgcgggtttaatgtccttggcttttatgggctttagtggtttggtgaaattctga

SEQ ID NO: 20263 - protein, 193 aa, Photorhabdus luminescens subsp. laumondii TTO1
MTDYFLLFVGTVLVNNFVLVKFLGLCPFMGVSKKLETAIGMGFATTFVMTLASVCSWLVNTFILLPLDLIYLRTLSFILVIAVVVQFTELVVRKTSPTLYRLLGIFLPLITTNCAVLGVALLNINQSHDFLQSAIYGFGAAAGFSLVMVLFAAIRERLAVADVPAPFKGSSIGLITAGLMSLAFMGFSGLVKF

SEQ ID NO: 20264 - DNA, 699 bp, Photorhabdus luminescens subsp. laumondii TTO1
  CDS (1)..(699): transl_table=11
atgagtgaaaccaaaaatttatttatccaagggctatggaaaaacaattccgctttagtacaactgctaggattgtgccccctgttagccgtctcttccactgcaaccaatgcgctcggcttagggctggcaacgacactggttctagtctgtaccaacattgcggtttccagcttgcgtcgttgggtacccaatgagatccgtattcccatttatgttatgataatcgcttcggttgtcagtactgtccagatgttgattaacgcctacgcttttggtctgtatgaatcattggggattttcattccactgattgtgactaactgtattgttatcggccgtgctgaagcctatgccgcgaaaaatccgatcatgccctctgcgattgatggcttagcaatgggattaggagccacttttgctctgtttgttcttggtgctattagagaaattctcggcaatggaaccctatttgatggcgctgatttactgctgggcaattgggctaaggtattacgaatagaaatcgttcatatggattcccctttcctattagccatcttaccacccggcgcttttatcggtttgggattaatgctggcagtgaaatatcttattgatgaaaaaatgaaaacgagagcaataaaagaaaaaagccgtgcaataacaatgtcaccagaatcggagagttctatttga

SEQ ID NO: 20265 - protein, 232 aa, Photorhabdus luminescens subsp. laumondii TTO1
MSETKNLFIQGLWKNNSALVQLLGLCPLLAVSSTATNALGLGLATTLVLVCTNIAVSSLRRWVPNEIRIPIYVMIIASVVSTVQMLINAYAFGLYESLGIFIPLIVTNCIVIGRAEAYAAKNPIMPSAIDGLAMGLGATFALFVLGAIREILGNGTLFDGADLLLGNWAKVLRIEIVHMDSPFLLAILPPGAFIGLGLMLAVKYLIDEKMKTRAIKEKSRAITMSPESESSI

SEQ ID NO: 20266 - DNA, 705 bp, Vibrio vulnificus YJ016
  CDS (1)..(705): transl_table=11
gtggaggccactatgagtgagcataaaaaattacttaaaaatggcatgtgggacaacaaccctgcactggtccagctacttggtctgtgtccgctactggcggtatcgtcaaccgtcaccaacgcacttggtctcggcatcgcaacattattggttctcgttggctccaacgtcactgtttctctgattcgtaactacgtaccaaaagaaattcgtattccggtattcgttatgatcattgcctcactggtcacgtgcgttcaattactgatgaacgcctacgcctatggcttatacctatcattgggcattttcattcctttgattgtgaccaactgcatcatcatcggccgtgctgaagcgtacgcatcaaaaaatgatcctttgcctgcggcattagatggcttttggatgggcatgggtatgaccaccgtgctcgtcgttctcggcgcaatgcgcgaaatcatcggcaacggtacccttttcgatggcgcggatcttctgctgggtgaatgggcgagcgcactgcggattcaggtattccaatttgacagtagcttcctactggcgctgttaccgcctggggcatttattggtgtcggcctgctcatcgcgttgaaaaatgtcatcgatacacagttgaaagctcgccaacctaaacaagaaaaacccgcgattgaacgcgctcgcgtgactaacgcgtaa

SEQ ID NO: 20267 - protein, 234 aa, Vibrio vulnificus YJ016
MEATMSEHKKLLKNGMWDNNPALVQLLGLCPLLAVSSTVTNALGLGIATLLVLVGSNVTVSLIRNYVPKEIRIPVFVMIIASLVTCVQLLMNAYAYGLYLSLGIFIPLIVTNCIIIGRAEAYASKNDPLPAALDGFWMGMGMTTVLVVLGAMREIIGNGTLFDGADLLLGEWASALRIQVFQFDSSFLLALLPPGAFIGVGLLIALKNVIDTQLKARQPKQEKPAIERARVTNA

SEQ ID NO: 20268 - DNA, 639 bp, Vibrio vulnificus YJ016
  CDS (1)..(639): transl_table=11
ttgttattacccggacaaagcacgataatatcgggatcggatttgcagaacgtaataattatgaccgaatatattttgttgttgattggcaccgtcctcgtaaacaactttgtactggtgaagtttctcggattgtgtcccttcatgggcgtgtcaaaaaaattggaaaccgcaattggtatgggcttggcaacgacctttgtccttactatggcttccgtgtgcgcttatcttgttgaaagctacattcttgagccattgcacatcgaatacctacgaaccatgagctttattttggtgattgcggtggtggtccagtttacggaaatggtggttcacaagaccagcccaaccctctatcgcctgctgggtatttttctacctttgattaccaccaactgtgccgtgttgggggttgctctactgaatatcaatgaaaaccactcgtttgttgaatccatcatctatggttttggtgcagcggttggtttttctttagtactgattctgtttgcttcgatgcgtgagcgcatttctgcagcggatgtgcccgcgccttttaaaggggcttccattgcgatgattactgcaggattaatgtcgctagcgtttatgggctttacggggttggtgaaataa

SEQ ID NO: 20269 - protein, 212 aa, Vibrio vulnificus YJ016
MLLPGQSTIISGSDLQNVIIMTEYILLLIGTVLVNNFVLVKFLGLCPFMGVSKKLETAIGMGLATTFVLTMASVCAYLVESYILEPLHIEYLRTMSFILVIAVVVQFTEMVVHKTSPTLYRLLGIFLPLITTNCAVLGVALLNINENHSFVESIIYGFGAAVGFSLVLILFASMRERISAADVPAPFKGASIAMITAGLMSLAFMGFTGLVK

SEQ ID NO: 20270 - DNA, 573 bp, Treponema denticola ATCC 35405
  CDS (1)..(573): transl_table=11
atgcccgaaacacttagtatttttctttctgcaatccttgtaaaaaacgtagttttaatgcgctttttagccctttgcccctttataggaatgtcctccgacgtaaaaaaatcggtaggcatgggctgggccgtactcttcgttactcttttggccacagccgtaacctatcccatatacaattacgtattgataggaaacctcgaattccttcagacccttatctttatcttggtaattgcaagcttggttcagctggtagaattctatctaaaaaaagcggctcctgccctttacagctcgatgggggtttatttggccctgattacgacaaactgtgcaatccttgcagttacaatcgatgccattgatgaaggctatacctttgtacaagcccttgttcatgctgcaggttcagctttcggctttatgatttcgctcttgcttttggcaggcttaagacaaagaatagataatgcccctgttccgaaattcttaaaaggaacgcccattctctttattgctgcagcccttctatccatggcatttgaaggtttcaaaggactgatttaa

SEQ ID NO: 20271 - protein, 190 aa, Treponema denticola ATCC 35405
MPETLSIFLSAILVKNVVLMRFLALCPFIGMSSDVKKSVGMGWAVLFVTLLATAVTYPIYNYVLIGNLEFLQTLIFILVIASLVQLVEFYLKKAAPALYSSMGVYLALITTNCAILAVTIDAIDEGYTFVQALVHAAGSAFGFMISLLLLAGLRQRIDNAPVPKFLKGTPILFIAAALLSMAFEGFKGLI

SEQ ID NO: 20272 - DNA, 660 bp, Treponema denticola ATCC 35405
  CDS (1)..(660): transl_table=11
atgaaaaatttaagcattttcacaaacggaattatccgaaacaatccccttttggttttaatgataggcctctgttcttctctggctgttacaacaaatatcctaaacggccttggaatgggacttgcaatgacctttgttatcgttatgagcgagttaatcataagtatttttagaaaactaattcctcaggacataagaattccggtttttatcatagtaatagcctcttttacgaccattgtagacctattgatgcaggcctatacccctgccctagcggatgcaatgggactttttattaagctgatcgttgtaaactgtattattatgggaagagtcgaatcctttgcttcaaaagaaagccccggaaaatccgttttagacgctctgggaatgggagtcggctatacgatagttcttgtgcttatttcggctataagagaaatcttaggctcgggatccttggctggaaacgtctttatacccgaagcctatcatatacgcttttttgcaaatgcacccggcggcttttttgtattcggtattatgatttcgataaacctctttgcaaaaaagcttttagaaagacctaagaaaaaaattcaaagttcgcctgctccgcaaaccgagccggaagctaaaaaagaggaggagtaa

SEQ ID NO: 20273 - protein, 219 aa, Treponema denticola ATCC 35405
MKNLSIFTNGIIRNNPLLVLMIGLCSSLAVTTNILNGLGMGLAMTFVIVMSELIISIFRKLIPQDIRIPVFIIVIASFTTIVDLLMQAYTPALADAMGLFIKLIVVNCIIMGRVESFASKESPGKSVLDALGMGVGYTIVLVLISAIREILGSGSLAGNVFIPEAYHIRFFANAPGGFFVFGIMISINLFAKKLLERPKKKIQSSPAPQTEPEAKKEEE

SEQ ID NO: 20274 - DNA, 744 bp, Parachlamydia sp. UWE25
  CDS (1)..(744): transl_table=11
atgtggatgggaccctacagcgtgctaaacctttttggtttgttattacaagctgtatttattgagaactttttacttgtcaatttcttaggaatgtgtacctatttagcctgttctaataagctaaaaacagctaatggattgggtatcgctgttgtttttgtattgacagtttctggagttttaaattggtttgtgcatcgttttgtgacaggcccgggagctttaacctggctaagtgcattcggaatagatagttctcaagtcaatctcggttttttggagtttctactatttatctctgtgattgcaggttttacacaaatcctcgaaatcatcattgaaaaagtctctcccgccctttatatgtcgcttggactctatcttcctctcattgcagtcaattgtgcgattttaggagcttgcttatttgcagtgactcgagattatccttttttccctaaccttatttacgtctttggttcagctgtaggctggtggcttgccattgctttgattgcagctattcgagaaaaaatagcgatatctaatgtggttcccgaattaaaaggaatggggattacttttatcatgtcaggattaatgtctatggcatttatggggtttactggtatcaagcttgctgatccttcgccaccagaagctacttctgaacaacctttaaaagaattggcgttatcggatgattcttcctctcaggaaacattgacgttaagcaaataa

SEQ ID NO: 20275 - protein, 247 aa, Parachlamydia sp. UWE25
MWMGPYSVLNLFGLLLQAVFIENFLLVNFLGMCTYLACSNKLKTANGLGIAVVFVLTVSGVLNWFVHRFVTGPGALTWLSAFGIDSSQVNLGFLEFLLFISVIAGFTQILEIIIEKVSPALYMSLGLYLPLIAVNCAILGACLFAVTRDYPFFPNLIYVFGSAVGWWLAIALIAAIREKIAISNVVPELKGMGITFIMSGLMSMAFMGFTGIKLADPSPPEATSEQPLKELALSDDSSSQETLTLSK

SEQ ID NO: 20276 - DNA, 636 bp, Parachlamydia sp. UWE25
  CDS (1)..(636): transl_table=11
atgagccagcccgaacctccagtttcgagttattttacctcgcaaatttggtctagtaaccaagttttagtagctgttttgggaatttgttctgccttagcgattaccaatcgattaagtgttgccattacgatggggctttcagtatcatttgtcacagctttttcctctctttttgtttccttactgagaaaaattactccagacagtgttcgcatgatcgttcaattagcaattatttccgtttttgtcattattattgatcagtttttacaagcttatttttttggtatttctaaagttttaagtgtatttgttggattaattattacaaattgcattgtgatgggaagaacagaaggaatggcgaaaaatgtagggcctttagcagcttttttagacgggttaggtgctggaacgggctatgccattgtcttattcattattgcttttattagagaattatttggatttggccaactatttggttatcaagttatccctcaatcatggtatgccacagcagcaaatcctgacggctatgaaaactttgttctaatggttagtcctccggcagctttttttctgatcggtggtctcatttacgtatctaaaaaaatgcaaggtaatgcttaa

SEQ ID NO: 20277 - protein, 211 aa, Parachlamydia sp. UWE25
MSQPEPPVSSYFTSQIWSSNQVLVAVLGICSALAITNRLSVAITMGLSVSFVTAFSSLFVSLLRKITPDSVRMIVQLAIISVFVIIIDQFLQAYFFGISKVLSVFVGLIITNCIVMGRTEGMAKNVGPLAAFLDGLGAGTGYAIVLFIIAFIRELFGFGQLFGYQVIPQSWYATAANPDGYENFVLMVSPPAAFFLIGGLIYVSKKMQGNA

SEQ ID NO: 20278 - DNA, 576 bp, Desulfovibrio vulgaris subsp. vulgaris str. Hildenborough
  CDS (1)..(576): transl_table=11
atggacgtattcgagattttcatctcagccatcttcgtcaacaacatcgtcctcgcccagtatctcggcaactgcccgtatctcggctgttcccgcgagaagggcgtggccctcggcatgggggcggcggttgtcttcgtcatcatcatggcgacgctgtgcacatggctcatccagtaccatgtgctggttcccttcgacctcgcctatctccagaccatcgtgttcattctggtcatcgcggggcttgtgcagttcgtcgagatgttcctcaagaagatggtgccccccctgtatgcggcactgggcatcttccttccgctcatcaccaccaactgcgccgtcatgggcgtgaccatcctcgtacagcgcgaagaatacgacctcatgacctcgctcacgtacggtctggcttccagcctcggcttcgtgctggcgctgctgctcatggcgggcatccgcgagcgactcgacacggcgcgggtacccaaggccatgataggcacgcccatcgcgctcatcatggcggggctcatgtcgctggcgttcatggccttcaagggcatgacctcgtag

SEQ ID NO: 20279 - protein, 191 aa, Desulfovibrio vulgaris subsp. vulgaris str. Hildenborough
MDVFEIFISAIFVNNIVLAQYLGNCPYLGCSREKGVALGMGAAVVFVIIMATLCTWLIQYHVLVPFDLAYLQTIVFILVIAGLVQFVEMFLKKMVPPLYAALGIFLPLITTNCAVMGVTILVQREEYDLMTSLTYGLASSLGFVLALLLMAGIRERLDTARVPKAMIGTPIALIMAGLMSLAFMAFKGMTS

SEQ ID NO: 20280 - DNA, 582 bp, Erwinia carotovora subsp. atroseptica SCRI1043
  CDS (1)..(582): transl_table=11
atgaccgaatacgcattgctctttgttagcatccttctggtaaataatttcgtcttagtgaagtttcttgggctgtgcccctttatgggcgtgtccaaaaaactagagacggcgattggcatgggaatggcgaccacgtttgtgatgacgctgggctcgatgttttcctggctgatcaacgaatttattcttgtcccgctcgacattctctatttacgcaccatggcttttattctggtgctcgccgttgtggtgcagttctccgagatgttcgtgcgcaaagttagccctgagctgtatcgcctgctggggattttcctaccgctgatcaccaccaactgtgccgtgcttggcgtcgtcttgctcaacatcaacctgtcgcacggttttctgcaatcgacaatttatggtttcggcggtgccgcaggattctcactggtgatggtccttttcgccgccatccgcgagcgcctcgccgtgtcggacattcccgcgccgttccgaggttcgtctatcgcactgatcaccgctggcctgatgtcgctggcatttatgggctttaccggactggtgaaattctga

SEQ ID NO: 20281 - protein, 193 aa, Erwinia carotovora subsp. atroseptica SCRI1043
MTEYALLFVSILLVNNFVLVKFLGLCPFMGVSKKLETAIGMGMATTFVMTLGSMFSWLINEFILVPLDILYLRTMAFILVLAVVVQFSEMFVRKVSPELYRLLGIFLPLITTNCAVLGVVLLNINLSHGFLQSTIYGFGGAAGFSLVMVLFAAIRERLAVSDIPAPFRGSSIALITAGLMSLAFMGFTGLVKF

SEQ ID NO: 20282 - DNA, 624 bp, Desulfotalea psychrophila LSv54
  CDS (1)..(624): transl_table=11
atggctgatactaatagagaactgctactacgctccatttttaagcgtaatcctatcgcccttctggttctgggggtctgttcggcccttgccgtcaccgggcagatgacgacggctcttgtcatggctgtttgtgttactctggtggtggctttttccagtcttatcataagtctggtccgttttcaaattcccaatagcgtccgtattggcatccagataaccgttatcgccaccctggttattctggtggatcagtttcttaaggcattttactatgatctctccaaacagctctccatctatgtgggtctgattattaccaactgtattgttatgggccgggccgagggctatgccatgcataatccccctatagcaagttttgtcgatggtattggtaatgggcttggttatggatttattctcatgtccgtggcattttttcgtgagctccttggctcgggtagcctcttcgggatcactgtcttaccactcaccaccgacggtggctggtatcagagaaatggtttattggtgctaccggccagtgccttttttcttattgccctgctgatctggttgtttagaaccattgatcccagccaacaggagaaagagtaa

SEQ ID NO: 20283 - protein, 207 aa, Desulfotalea psychrophila LSv54
MADTNRELLLRSIFKRNPIALLVLGVCSALAVTGQMTTALVMAVCVTLVVAFSSLIISLVRFQIPNSVRIGIQITVIATLVILVDQFLKAFYYDLSKQLSIYVGLIITNCIVMGRAEGYAMHNPPIASFVDGIGNGLGYGFILMSVAFFRELLGSGSLFGITVLPLTTDGGWYQRNGLLVLPASAFFLIALLIWLFRTIDPSQQEKE

SEQ ID NO: 20284 - DNA, 609 bp, Desulfotalea psychrophila LSv54
  CDS (1)..(609): transl_table=11
atggcccactatcttgatattatcgtccgcgctatattcatagagaacctgcctcttagtttttttctgggtatgtgtacctttcttgccatctctaagcaggtgaagacagccatggggctgggctttgccgtcttggttctgcagattataaccgtgcccattaacaatctcctgcttacccatgttctcaagccgggggccctggcatggcttggtcagcccgatcttgacctgcgctttcttggtttgctcacctatatctctattattgccgccgtggtgcaggtactggaaatggtcctggaccgttttatccccgccctttacaacagtcttggtatttttctgcccttgctcaccgtcaactgtgcaattttgggagcaagcctctttatggtggagagaaactatacttttgccgagagtgcggcctatggtgtcggggccgggggaggtttttttctggccgtggtctgtcttgccggcattcgggaacgtcttgaatatgccaatcctcctgctggtctgaaggggctgggcttgacctttattactacagggctcattgccatcgcctttatgggctttgccggtatggaaatataa

SEQ ID NO: 20285 - protein, 202 aa, Desulfotalea psychrophila LSv54
MAHYLDIIVRAIFIENLPLSFFLGMCTFLAISKQVKTAMGLGFAVLVLQIITVPINNLLLTHVLKPGALAWLGQPDLDLRFLGLLTYISIIAAVVQVLEMVLDRFIPALYNSLGIFLPLLTVNCAILGASLFMVERNYTFAESAAYGVGAGGGFFLAVVCLAGIRERLEYANPPAGLKGLGLTFITTGLIAIAFMGFAGMEI

SEQ ID NO: 20286 - DNA, 597 bp, Yersinia pseudotuberculosis IP 32953
  CDS (1)..(597): transl_table=11
atggaacattatatcagtctgttggtccgcgcagtgtttgtggagaatatggcgttagcgttctttctgggaatgtgtactttcctggccgtctctaaaaaagtgtcaacggcctttggcttaggcattgcggtaacggttgttctgggcatctccgtgccagccaataatttggtttataacctggttctgcgagatggcgcattggttgaaggggttgaccttagcttcctgaatttcattaccttcattggggtcattgccgccattgttcaggtgttggagatgatcctcgatcgttacttccctgcgttatataacgcgctgggtatttttctgccgctaatcaccgtgaactgcgccatctttggtggcgtgtcgtttatggcacagcgtgattacaacttccctgaatccatcgtttatggctttggttctggtatggggtggatgctggcgattgttgcattagcggggatccgcgaaaaaatgaaatatgccaatgtgcctgcgggcttacaggggctagggatcacctttatctcaaccggattgatggcattaggttttatgtctttcgccggtgtgaacctataa

SEQ ID NO: 20287 - protein, 198 aa, Yersinia pseudotuberculosis IP 32953
MEHYISLLVRAVFVENMALAFFLGMCTFLAVSKKVSTAFGLGIAVTVVLGISVPANNLVYNLVLRDGALVEGVDLSFLNFITFIGVIAAIVQVLEMILDRYFPALYNALGIFLPLITVNCAIFGGVSFMAQRDYNFPESIVYGFGSGMGWMLAIVALAGIREKMKYANVPAGLQGLGITFISTGLMALGFMSFAGVNL

SEQ ID NO: 20288 - DNA, 702 bp, Yersinia pseudotuberculosis IP 32953
  CDS (1)..(702): transl_table=11
atgagtgaagcgaaaaaactgttagcacaagggttgtggaaaaataactctgcgctggtgcaactgttggggctctgtccattgttggcagtctcttccacggcaaccaacgcattggggctggggttagcgaccacgctagtccttgtgtgtaccaataccgcagtttctgcattgcgccgttgggtaccgtctgaaatccgtattcctatttatgtcatgattattgcgtcggtcgtcagtaccgtgcaaatgctgatcaacgcttatgcctttggtttatatcaatcattggggatatttatcccattgattgtgaccaactgtatcgtgattggccgggcagaggcctatgcagcgaagaatccggtgggactatccgcattggatggttttgccatggggatgggagcaacctgtgccttatttgttttaggggcactgcgcgaaattttgggtaacggtaccttatttgacggcgcagacatgttgctaggcagttgggctacagtactgcgcattgacatcttgcatttagataccccttttctgctggcgatgttgccaccaggtgcgtttatcggtctgggtttactgctggccggtaaatatgtcattgacgagaaaatgaaagcgcgcaaagccaatacacgggttaacgtaccgcaacttcaggatggagatgccgagaaagccttatga

SEQ ID NO: 20289 - protein, 233 aa, Yersinia pseudotuberculosis IP 32953
MSEAKKLLAQGLWKNNSALVQLLGLCPLLAVSSTATNALGLGLATTLVLVCTNTAVSALRRWVPSEIRIPIYVMIIASVVSTVQMLINAYAFGLYQSLGIFIPLIVTNCIVIGRAEAYAAKNPVGLSALDGFAMGMGATCALFVLGALREILGNGTLFDGADMLLGSWATVLRIDILHLDTPFLLAMLPPGAFIGLGLLLAGKYVIDEKMKARKANTRVNVPQLQDGDAEKAL

SEQ ID NO: 20290 - DNA, 708 bp, Symbiobacterium thermophilum IAM 14863
  CDS (1)..(708): transl_table=11
gtgaagccatccgctcagtccccaacgttcgggtccgtcctggccgacggactccggcaggccccgccgttccggctgctgctgggtctctgcccctcgctggccgtgaccacggccatggagaacggcttctggatgggcctggccgtgatcttcgtcctgtcctgctcggagctgatcatcagcctgctgcgcagggtgatccccgaccgggtacgcattccggtctacatcgtgatcgtggccaccttcgtcaccgtggtcgacatggtgatgaaggcctatctgccggagatgcacgccattctgggcatcttcatccccttgatcgtcgtgaactgcatcatcctcggccgggcggaggccttcgcctccaagaacggcccgctgctctcggtggccgacgcggtgggcgtgggcctgggcttcaccgcatcgctcatggccatcggcggcgtgcgggagctcctgggcaccggcaacctgaagctgttcggcgtcgccctgctgggcccgggcctgccgctggaggtcgtggtgatgctgctacccgccggcgccttcttcgtcatcggcttcctgatggccggcctggcatggctgcagcagcggcaggaggcgcgggggcggcgggaccggccggcatccggatccggttccaccgccggcgccggcacagtgtccggaggagaggaggcggcggtctag

SEQ ID NO: 20291 - protein, 235 aa, Symbiobacterium thermophilum IAM 14863
MKPSAQSPTFGSVLADGLRQAPPFRLLLGLCPSLAVTTAMENGFWMGLAVIFVLSCSELIISLLRRVIPDRVRIPVYIVIVATFVTVVDMVMKAYLPEMHAILGIFIPLIVVNCIILGRAEAFASKNGPLLSVADAVGVGLGFTASLMAIGGVRELLGTGNLKLFGVALLGPGLPLEVVVMLLPAGAFFVIGFLMAGLAWLQQRQEARGRRDRPASGSGSTAGAGTVSGGEEAAV

SEQ ID NO: 20292 - DNA, 588 bp, Symbiobacterium thermophilum IAM 14863
  CDS (1)..(588): transl_table=11
atggagatcctggcgatcctgatcggcggcatcctggtcaacaactatatcttctcccgcttcctgggcctctgcccgttcttcggcgtctccaacaagctggagacggtctacggaatgggcgccgcggtcgtcttcgtcatgacgctggcctcggccatcacctggccgctgcagcatctccttctggagccgctggggctgggctacctgcagacggtggccttcatcctggtgatcgccgccctggtgcagacggtggagatggtcatccagcgggtcagccccaccctgtacgccgccctgggcatcttcctcccgctgctcaccaccaactgcgccgttctgggcgccgcgctgctgaatatcacccagggttacggcttcatgacgtccgtgctgaacggcttcgcctgcggcgttggctggaccctggcgacgctgctcttcgccggcgtgcgggagcggatcgagggggcgcacatcccgccggcgatgcggggtatgcccatcgcgttcgtcgcggccggcctgatggcgctggccttcatgggcttccagggcctctttcgcgggatcctcttctaa

SEQ ID NO: 20293 - protein, 195 aa, Symbiobacterium thermophilum IAM 14863
MEILAILIGGILVNNYIFSRFLGLCPFFGVSNKLETVYGMGAAVVFVMTLASAITWPLQHLLLEPLGLGYLQTVAFILVIAALVQTVEMVIQRVSPTLYAALGIFLPLLTTNCAVLGAALLNITQGYGFMTSVLNGFACGVGWTLATLLFAGVRERIEGAHIPPAMRGMPIAFVAAGLMALAFMGFQGLFRGILF

SEQ ID NO: 20294 - DNA, 597 bp, Mannheimia succiniciproducens MBEL55E
  CDS (1)..(597): transl_table=11
atggaacattacattagtctatttgtaaagtctgtgttcattgagaacatggcgctttctttcttccttggtatgtgtacattcctcgcggtgtcgaagaaagtttcaacagcattcggcttaggtattgccgttatcgtcgtattaggtatttcagtaccggtaaaccaactagtttatacccatatattaaaagacggtgcactaattgaaggtgtggatttaagtttcttaaacttcatcactttcatcggcgttattgcggcattagtacaaatcctagaaatgttcctggataaattcgtaccgtcactttatgaagcgttaggtattttcttaccgttaatcacagtaaactgtgcaattttcggtggcgtatcatttatggttcaacgtgaatataatttcccggaatccgtagtatatggtatcggcgcaggtacgggctggatgttagcgattgtggcattagccggtttgacggaaaaaatgaaatatgcggatgttccggcaggcctacgcggtttagggatcacctttatcaccgtcggtctaatggcattaggtttcatgtcattctccggcattcaattataa

SEQ ID NO: 20295 - protein, 198 aa, Mannheimia succiniciproducens MBEL55E
MEHYISLFVKSVFIENMALSFFLGMCTFLAVSKKVSTAFGLGIAVIVVLGISVPVNQLVYTHILKDGALIEGVDLSFLNFITFIGVIAALVQILEMFLDKFVPSLYEALGIFLPLITVNCAIFGGVSFMVQREYNFPESVVYGIGAGTGWMLAIVALAGLTEKMKYADVPAGLRGLGITFITVGLMALGFMSFSGIQL

SEQ ID NO: 20296 - DNA, 624 bp, Mannheimia succiniciproducens MBEL55E
  CDS (1)..(624): transl_table=11
atggcaggcagcaatcttaaaaaattattgttatcgccaattgccgataacaacccaattgcgttacaaattcttggtatttgttccgcattggcggtaactactcagttacaaactgcggtggtaatggctattgcggtaagttttgttacaggtttttcaagtttctttatttcttgtatccgtaactatgtaccaaacagcattcgtatcatcgtacaaatggcaatcattgcgtcattggtaatcttggttgaccaaattctgcgcgcttatgcttacgacttatctaaacaactttcggtattcgtaggtcttatcattacaaactgtatcgtaatgggtcgtgcggaagcgttcgctatgaaatcaggccctgttgaaagttttgttgacggtatcggtaacggtttaggctacggtgcaatcctattaatcgtcgcatttttacgtgaacttatcggttcgggtaaattattcggcgtaaccgtattggaaaccgtacaaaacggcggttggtatcaggcaaacggtctattcctattggcgccaagcgcgttctttatcatcggatttgtaatctggggacttagaacctggaaaccggaacaagtggagaaataa

SEQ ID NO: 20297 - protein, 207 aa, Mannheimia succiniciproducens MBEL55E
MAGSNLKKLLLSPIADNNPIALQILGICSALAVTTQLQTAVVMAIAVSFVTGFSSFFISCIRNYVPNSIRIIVQMAIIASLVILVDQILRAYAYDLSKQLSVFVGLIITNCIVMGRAEAFAMKSGPVESFVDGIGNGLGYGAILLIVAFLRELIGSGKLFGVTVLETVQNGGWYQANGLFLLAPSAFFIIGFVIWGLRTWKPEQVEK

SEQ ID NO: 20298 - DNA, 648 bp, Mannheimia succiniciproducens MBEL55E
  CDS (1)..(648): transl_table=11
atggaaaaagaacaatcaatttggcacgacctgctttctcaagggctatggcgaaataaccccgccatcgtacagttgcttgggctctgccctttgcttgcggtctcaaactcggcgaccaacgctcttggtttgggctttgcgacccttttggtgcttacctgcactaatactatggtgtctttatttcgtaaacaaatcccccacgagatccgtatccctatttacgtgatgattattgccactaccgtaacggcggtgcaattattgatgaacgcctacacttacagcctttatcaatcgctggggatttttattccattaatcgtcaccaactgtattgtgatcggcagagcggaagcctttgcctctaaaaattcagtactgcattccgctttcgacggattcgccatgggattaggcatgacattaagccttttcctgttgggcgcattacgtgaagtacttggtaatggcacgctgtttgacggtattcatttgctgttaggcgattgggcaaaacctctgcgtattgagtttttccataacgacagtaatttgttactggccattctgccgccgggcgcattcttaggcttagccgttattcttgcattaaaaaatgttattgagagccgtacaaaatga

SEQ ID NO: 20299 - protein, 215 aa, Mannheimia succiniciproducens MBEL55E
MEKEQSIWHDLLSQGLWRNNPAIVQLLGLCPLLAVSNSATNALGLGFATLLVLTCTNTMVSLFRKQIPHEIRIPIYVMIIATTVTAVQLLMNAYTYSLYQSLGIFIPLIVTNCIVIGRAEAFASKNSVLHSAFDGFAMGLGMTLSLFLLGALREVLGNGTLFDGIHLLLGDWAKPLRIEFFHNDSNLLLAILPPGAFLGLAVILALKNVIESRTK

SEQ ID NO: 20300 - DNA, 630 bp, Mannheimia succiniciproducens MBEL55E
  CDS (1)..(630): transl_table=11
ttgcaaaaacaggataataacgcgcttactcaaacgaattacaccaatatgacagactatatattattaattattagtactgcgctcattaataactttgtcctggttaaatttttagggctttgtccgttcatgggcgtttccaaaaaagtcgaaactgcaatcggcatggggcttgctacaacctttgtattaacggttgcctcactttgtacctatcttgcggacagttatattcttgcaccgttaaacgcatctttcttgcgcacgttagtctttattttggttattgcggtcgtagtacaatttactgaaatggtaatcaacaaaaccagtccgacgctctatcgtttgttaggtatttttcttccgcttattaccacaaactgtgccgtattaggggttgcgctgcttaatattaatttagctcataatttaaccgagtctgtcatttatggatttggcgcctcattaggttttgctctggtccttgttcttttcgcctctttacgcgaacgcctggcggcggcagatgtaccggcgccttttaaaggcgcgtctatcgcattagttaccgccggcttgatgtccttggttttcatgggctttaccgggcttattcgggtttaa

SEQ ID NO: 20301 - protein, 209 aa, Mannheimia succiniciproducens MBEL55E
MQKQDNNALTQTNYTNMTDYILLIISTALINNFVLVKFLGLCPFMGVSKKVETAIGMGLATTFVLTVASLCTYLADSYILAPLNASFLRTLVFILVIAVVVQFTEMVINKTSPTLYRLLGIFLPLITTNCAVLGVALLNINLAHNLTESVIYGFGASLGFALVLVLFASLRERLAAADVPAPFKGASIALVTAGLMSLVFMGFTGLIRV

SEQ ID NO: 20302 - DNA, 609 bp, Methylococcus capsulatus str. Bath
  CDS (1)..(609): transl_table=11
atggaagcctacatcaatctgttcatcaagtcggtcttcatcgagaacatggccctgtcgttcttcctgggcatgtgcaccttcatcgcggtgtcgaagaagatcgaaacggccgtgggcttgggcatcgccgtggtgatcgtgcagaccctgacggtgccggccaacaacctgatctacacctatctgctcaaggaaggtgccttgtcctgggctggcctgcacgacgtcgacctcagcttcatcgcgctgatggcctgtatcggcgtgatcgccgccatggtccagattctggagatggtgctcgacaagttcttcccggccctttacaacgccttgggtattttcctgccgctgattacggtgaactgtgccatcctggccggttcgctgttcatgatcgaacgtgattacaacttctcggagagcgtggtgtatggcgtgggcagcggtttcggctgggcgctcgccatcactgcgatggccggcgtgcgcgagaagctcaagtacagcgacgttccggcgggcctgcgcggcctgggcatcaccttcatctccgcgggtctgatggcactgggtttcatggccttctccggcatacagttataa

SEQ ID NO: 20303 - protein, 202 aa, Methylococcus capsulatus str. Bath
MEAYINLFIKSVFIENMALSFFLGMCTFIAVSKKIETAVGLGIAVVIVQTLTVPANNLIYTYLLKEGALSWAGLHDVDLSFIALMACIGVIAAMVQILEMVLDKFFPALYNALGIFLPLITVNCAILAGSLFMIERDYNFSESVVYGVGSGFGWALAITAMAGVREKLKYSDVPAGLRGLGITFISAGLMALGFMAFSGIQL

SEQ ID NO: 20304 - DNA, 660 bp, Methylococcus capsulatus str. Bath
  CDS (1)..(660): transl_table=11
atgaacgaagaatcgaagaaagttctcatcgaaccgctggtcgacaacaaccccatcaccctccaagtgctgggcatctgttccgccctagccgtcacttcacaattgtcgacggccttgatcatgagtctggcgctgacctcggtcaccgcctgttccagcgcgggcatcgctttgatccgcaaccacattccaagcagcgtgcgtatcatcgcgcagatggtgatcatcgcctcactggtgatcgtggtcgaccagctgctcaaggctttcgcctatgaaatcagcaagcagttgtcggtgttcgtcggactcatcatcaccaactgcatcgtgatggggcgcgccgaggcctatgccatgaagaatccgccctgggagagcttcctggacggcatcggcaatggcctgggttacagtctgatcctcgtcaccgtcgccaccatccgtgagctgctgggttccggcaaactgctggggatcgatgtgttgcccctggtcaaggatggcggctggtacgtgccgaatggcctgctgttgctgccccccagtgcattcttcctgatcggtctcctgatctgggcgatccgctcctggaaaacccagcaggtggaaaaggccgatttcgtgatcgccaccgcacacggggaggcacactga

SEQ ID NO: 20305 - protein, 219 aa, Methylococcus capsulatus str. Bath
MNEESKKVLIEPLVDNNPITLQVLGICSALAVTSQLSTALIMSLALTSVTACSSAGIALIRNHIPSSVRIIAQMVIIASLVIVVDQLLKAFAYEISKQLSVFVGLIITNCIVMGRAEAYAMKNPPWESFLDGIGNGLGYSLILVTVATIRELLGSGKLLGIDVLPLVKDGGWYVPNGLLLLPPSAFFLIGLLIWAIRSWKTQQVEKADFVIATAHGEAH

SEQ ID NO: 20306 - DNA, 687 bp, Methylococcus capsulatus str. Bath
  CDS (1)..(687): transl_table=11
atgaatccggactttcgcaaaatcacccgcgacggcttgtgggacaacaacatcgtcttcagtcagagcatcggcctgtgtccgctgctggccgtcaccggcaccgccaccaatgggctcggcatggggctggccaccctggcggtcatggtcgtatgcaacgttctggtttcctgggtacgggtattgatcccctccgagatccgcatcccggtgttcgtggtgctcatcgccatggtggtgacgctggtggacatgatgatgaatgcctggttgcacgagatgcacaaggtgctgggcctgttcatccccctgatcgtgaccaactgcgccatcctggggcgggtcgaggcctatgcttcgcgccatcccgtggcgcatgcggcgatggacgggctgatgatggggctgggtttcaccctggctctggtggtgctgggggcggcccgggaagcgctcggcgccggcacattgttcgccagtgcgcgccttttgatgggcgactcgttcgcgtggctggaaacgacgctcattcacggctaccgcgggttcctgctgatggcgctgccgccgggcgggttcctcatgctcggtttcctgctggcggggaaaaaactgatcgacaagcggttggccgcccgccagcgccggtcgatcgcggtgggcgaaacgctggtggagacttga

SEQ ID NO: 20307 - protein, 228 aa, Methylococcus capsulatus str. Bath
MNPDFRKITRDGLWDNNIVFSQSIGLCPLLAVTGTATNGLGMGLATLAVMVVCNVLVSWVRVLIPSEIRIPVFVVLIAMVVTLVDMMMNAWLHEMHKVLGLFIPLIVTNCAILGRVEAYASRHPVAHAAMDGLMMGLGFTLALVVLGAAREALGAGTLFASARLLMGDSFAWLETTLIHGYRGFLLMALPPGGFLMLGFLLAGKKLIDKRLAARQRRSIAVGETLVET

SEQ ID NO: 20308 - DNA, 582 bp, Methylococcus capsulatus str. Bath
  CDS (1)..(582): transl_table=11
gtgaacgactacctgatgctgctgctcggcacggccctggtcaacaacgtggtgctggtcaagttcctcggactgtgccctttcatgggggtgtccaggaagctcgattccgccgtcggcatgggattcgcgacgaccttcgtgctgaccctgaccgcggtggcgagctggctcatcgagcatttcgtcctgatgccgctgggcatcggcttcctgcgcatcctctcgttcatcctggtgatcgcagcggtggtccagttcaccgagatggtggtgaagaagaccagcccggtgctgtatcaggtgctgggcatcttcctgccgctgatcaccaccaactgcgcggtgctgggagtggcgctgctgaacatccagcaggaatacgatttcattcacagcgcgctgttcggtttcggttcggcgctggggttcaccctggtcatggtgatcttcgccggcatccgagagcggctggccctgatgagcgtgcccgaggcattcaccggcccgcccattgccttcatcaccgcgggcatcctctccctggcgttcatggggttcgcaggattggccacgcattga

SEQ ID NO: 20309 - protein, 193 aa, Methylococcus capsulatus str. Bath
MNDYLMLLLGTALVNNVVLVKFLGLCPFMGVSRKLDSAVGMGFATTFVLTLTAVASWLIEHFVLMPLGIGFLRILSFILVIAAVVQFTEMVVKKTSPVLYQVLGIFLPLITTNCAVLGVALLNIQQEYDFIHSALFGFGSALGFTLVMVIFAGIRERLALMSVPEAFTGPPIAFITAGILSLAFMGFAGLATH

SEQ ID NO: 20310 - DNA, 582 bp, Methylococcus capsulatus str. Bath
  CDS (1)..(582): transl_table=11
atgaaagactatctgttgatcctcgtcagcacgaccctggtgaacaacttcgtcctggtgaagttcctgggactttgccccttcatgggcgtgtcccgcaaatcggagacggcgatcggtatgggactggcgacgaccttcgtgctgaccctgtcttcggtcagcagttacctggtcgaccgtttcctactggagccgatggggctgcaatacctgcgcaccctggccttcatcgtggtgatcgcggtggtggtccagttcaccgaaatggtcgtaaaaaagaccagcccgctgctataccaggtgctggggatttttctgccgctgatcaccaccaactgtgcagtgctcggcgtggccttgctcaatgtccaggcgggccatgatttcatcgaatccttcctctacggcttcggcgccgccgccggcttcaccctggtgctggtgctgttcgccggcctgcgcgagcggatcgatgccgcggacgtgccggcgccgttccgcggcagtgccatcgcactggtcaccgcgggcctgatttccgtcgccttcatgggcttctccggcctggtcagaggctga

SEQ ID NO: 20311 - protein, 193 aa, Methylococcus capsulatus str. Bath
MKDYLLILVSTTLVNNFVLVKFLGLCPFMGVSRKSETAIGMGLATTFVLTLSSVSSYLVDRFLLEPMGLQYLRTLAFIVVIAVVVQFTEMVVKKTSPLLYQVLGIFLPLITTNCAVLGVALLNVQAGHDFIESFLYGFGAAAGFTLVLVLFAGLRERIDAADVPAPFRGSAIALVTAGLISVAFMGFSGLVRG

SEQ ID NO: 20312 - DNA, 702 bp, Methylococcus capsulatus str. Bath
  CDS (1)..(702): transl_table=11
atgaaactcggcccctaccgcaagatcgccctggatggcctctggcacaacaatcaggcgctggtcgccctgctcggcctgtgcccgctgctcgccgtcagcagcaccgtggtcaacagtctcgggctggggctggccaccaccgtcgcgctggtgttctccaacggggtggtttcactgatccgcaaccgcataaccccggacgtgcgcctgccggtcttcgtgctggtcatcgccgccaacgtcaccgtcatcgagttgctgatgaacgcgttcttccacgacctgtacaagatcctcggcatattcatcccgctgatcgtcaccaactgcgccatcatcggccgcgccgaagccttcgcctccaagaacgcggtcgaccgcgccgtcctggacggcttgttcatgggattgggattcaccgcggcactggtcgcgctcggcgccttccgcgaaatcgtcggcaccggggccctgctgaaccgggccgaactgatgttcggcgaaaccgcccggaattggagcgtgcggatcatcgagaactacgacggcttcctgctggccattctgccgcccggcgccttcatcggacttggactcatcatcgccttgaagaacgtgatcgacgcccgcgcaaaagttcgggcccaggccgcggcaggccaacccgtggcgttcacgcccgccgtccggaaagcatga

SEQ ID NO: 20313 - protein, 233 aa, Methylococcus capsulatus str. Bath
MKLGPYRKIALDGLWHNNQALVALLGLCPLLAVSSTVVNSLGLGLATTVALVFSNGVVSLIRNRITPDVRLPVFVLVIAANVTVIELLMNAFFHDLYKILGIFIPLIVTNCAIIGRAEAFASKNAVDRAVLDGLFMGLGFTAALVALGAFREIVGTGALLNRAELMFGETARNWSVRIIENYDGFLLAILPPGAFIGLGLIIALKNVIDARAKVRAQAAAGQPVAFTPAVRKA

SEQ ID NO: 20314 - DNA, 633 bp, Photobacterium profundum SS9
  CDS (1)..(633): transl_table=11
atggctgatactaaagaaatgaaaaagattctgtttgcgccgtttctggataataacccgattgcgcttcaggttcttggtgtatgttctgcattggcagtaacaactaaattggaaacagcgtttgttatgacgctagcggtaatgtttgttactgcattttctaacttatttgtatcgctaatacgtaaccatattcctaacagtgtacgtatcattgttcagatggcgattatcgcgtcattggtaatcgtggttgaccaagtacttaaagcgtttgtttacgatatttctaagcagctttctgtatttgttggcctgatcattacgaactgtatcgtaatgggtcgtgctgaagcatacgcaatgaaatcggcaccactaccgtcttttatcgatggtgttggtaatggcttaggctacggttttgtacttatcactgttgctttcttccgtgaattattaggttcaggcaagttgtttggtgttgaggttctacctctagtttctgatggcggttggtatcaaccaaacggtctgatgttacttgcaccgtctgctttcttcctaattggtttcatgatctgggcaattcgtattattcgtccagcacaagtagaagcgaaggagtaa

SEQ ID NO: 20315 - protein, 210 aa, Photobacterium profundum SS9
MADTKEMKKILFAPFLDNNPIALQVLGVCSALAVTTKLETAFVMTLAVMFVTAFSNLFVSLIRNHIPNSVRIIVQMAIIASLVIVVDQVLKAFVYDISKQLSVFVGLIITNCIVMGRAEAYAMKSAPLPSFIDGVGNGLGYGFVLITVAFFRELLGSGKLFGVEVLPLVSDGGWYQPNGLMLLAPSAFFLIGFMIWAIRIIRPAQVEAKE

SEQ ID NO: 20316 - DNA, 597 bp, Photobacterium profundum SS9
  CDS (1)..(597): transl_table=11
atggaacattatctaagccttttagttcgttcgatttttatcgagaacatggcactttcgttcttcttgggtatgtgtacattcctggctgtatcgaagaaagttaagacttcttttggtttgggtgttgcggtaatcgtcgtattgacgattgctatacctgtgaacaacttagtttacaacctattactgaaagatggtgcgattgttgatggagtggatttaacgttccttaacttcatcacgtttatcggtgtaattgcagcgttagtacagattctggaaatgattctggaccgcttcttcccgccgctatacaacgcactgggtatcttccttccgctgatcacagttaactgtgcaatcttcggtggtgtatctttcatggtacagcgtgactacaactttgttgaatcgattgtttacggtttcggctctggtgtgggttggatgctcgctatcgttgctcttgcgggtatccgtgagaagatgaagtattcagatgtacctcctggcctacgtggcctaggtattacattcatcactgttggtctaatggcgttaggctttatgtctttctccggcgtacagctgtaa

SEQ ID NO: 20317 - protein, 198 aa, Photobacterium profundum SS9
MEHYLSLLVRSIFIENMALSFFLGMCTFLAVSKKVKTSFGLGVAVIVVLTIAIPVNNLVYNLLLKDGAIVDGVDLTFLNFITFIGVIAALVQILEMILDRFFPPLYNALGIFLPLITVNCAIFGGVSFMVQRDYNFVESIVYGFGSGVGWMLAIVALAGIREKMKYSDVPPGLRGLGITFITVGLMALGFMSFSGVQL

SEQ ID NO: 20318 - DNA, 582 bp, Photobacterium profundum SS9
  CDS (1)..(582): transl_table=11
atgactgaataccttttattacttgtcggtacagtgttggtaaacaactttgtactcgttaaattcttaggtttatgcccatttatgggcgtatctaagaagctggaaactgcgattggtatgggcttggcgacgacatttgtcttaaccttggcttccgtgtctgcgtatctcgtggaaaattacattcttgcgcctcttggcattgaataccttcgtactcttagctttattcttgttattgccgttgtcgtgcaatttaccgaaatggtggtacataaaacgagcccaacgctataccgtttgctgggtattttcctaccgttaattacgactaactgcgcggtgttaggtgttgctctattgaatatcaatgagcaccacaactttatcgaatccgttatttatgggtttggtgccgcagttggtttttcgttggtcttgattttattcgcttctatgcgagaacgtattgccgcggcagatgttcctggcccttttaaaggcgcctctattgcgatgatcacagcaggtcttatgtctcttgccttcatgggctttactggattggtgaaactgtag

SEQ ID NO: 20319 - protein, 193 aa, Photobacterium profundum SS9
MTEYLLLLVGTVLVNNFVLVKFLGLCPFMGVSKKLETAIGMGLATTFVLTLASVSAYLVENYILAPLGIEYLRTLSFILVIAVVVQFTEMVVHKTSPTLYRLLGIFLPLITTNCAVLGVALLNINEHHNFIESVIYGFGAAVGFSLVLILFASMRERIAAADVPGPFKGASIAMITAGLMSLAFMGFTGLVKL

SEQ ID NO: 20320 - DNA, 702 bp, Photobacterium profundum SS9
  CDS (1)..(702): transl_table=11
atgagcacaaataaagaattaatgaaaaatggcatgtgggtcaataaccctgccattgtacaactattaggcttgtgtccgttattggccgtatcgtccacagtgaccaatgccttgggtttaggtttagcgacaacagctgtattagtcggttctaatctgatcgtatctttggttcgccaatggattccatcagaagttcgtattccagtatttgtgatgatcattgcggcactcgtcacatgcgttcaattactaatgaatgcatacacctatggtttataccaatcattaggtatcttcattccattgattgtaactaactgtattattattggtcgtgccgaagcatttgcctctaaaaatgatccaatccccgccaccttagatggactgtggatggggttaggcatgacagctgcgctcgtggtactcggtgccatgcgtgagattttaggcaacggtacactcttcgatggtgctgatcgcctattgggtgactgggctttgtcgttgcgtattgaagtgttcaactttgatagcagcttcttgcttgccatgctaccaccgggcgcattcctcggtgtcggctttatgattgcgttaaaaaatgtaatagataaaaaacgtgaagagaaaaaagcattaaccgccgataaaaagccagaaatagaacgcgtacgcattacatctgccgattag

SEQ ID NO: 20321 - protein, 233 aa, Photobacterium profundum SS9
MSTNKELMKNGMWVNNPAIVQLLGLCPLLAVSSTVTNALGLGLATTAVLVGSNLIVSLVRQWIPSEVRIPVFVMIIAALVTCVQLLMNAYTYGLYQSLGIFIPLIVTNCIIIGRAEAFASKNDPIPATLDGLWMGLGMTAALVVLGAMREILGNGTLFDGADRLLGDWALSLRIEVFNFDSSFLLAMLPPGAFLGVGFMIALKNVIDKKREEKKALTADKKPEIERVRITSAD

SEQ ID NO: 20322 - DNA, 609 bp, Idiomarina loihiensis L2TR
  CDS (1)..(609): transl_table=11
atggaaaactatatcaacctgttcatccgcgcggttttcattgaaaacctggcattgtccttcttcttaggtatgtgtacgtttttggctgtatctaagaaagtaaaaacagcatttggtctgggtgtcgcggttattgttgtattgggtatttcggtaccggttaacaacttaatttaccacaacattctggccccaggtgctctagaatgggctggcttcccggatgcggatctaagtttcctgaagtttctgacctttataggtgttattgccgctattgtgcagatattggaaatggcattggataaatatgtacctgcactttacaacgcactgggtattttcctgccactcattaccgttaactgcgctatttttggtggcgtagctttcatggtcgagcgtgattacaattttggcgaatccgttgttttcggaattggtagtggtgttggctgggctttagctattgttgctttggctgcagtgcgcgaaaaactgaaatatgcagatgtacctgatggcctgcgtggcttaggtatcacatttatttcagtgggtctgattggtttgggctttatgtcgttctccggcgtatccttataa

SEQ ID NO: 20323 - protein, 202 aa, Idiomarina loihiensis L2TR
MENYINLFIRAVFIENLALSFFLGMCTFLAVSKKVKTAFGLGVAVIVVLGISVPVNNLIYHNILAPGALEWAGFPDADLSFLKFLTFIGVIAAIVQILEMALDKYVPALYNALGIFLPLITVNCAIFGGVAFMVERDYNFGESVVFGIGSGVGWALAIVALAAVREKLKYADVPDGLRGLGITFISVGLIGLGFMSFSGVSL

SEQ ID NO: 20324 - DNA, 633 bp, Idiomarina loihiensis L2TR
  CDS (1)..(633): transl_table=11
atggctaatgtaaaagaaatgaagtccgtattattcggaccgatattcgccaacaaccccatcgcactacagattcttggtatctgttctgcattggctgtaacgtcgaaaatgagcaacaccttggttatgtgtattgcactaactgcggttgttgcgtgctctaacttatttatttcgattatccggaatcatattccgtcaagcgtacgtattattgtccaaatgacaattattgcgagcttggttattgtcgttgaccagatactaaaagcttacgcttactcaatttctaaagagttgtcagtgttcgttggcttaatcattactaactgtatcgttatggggcgcgcagaagcttacgctatgaagagcactccgtttatgtccttcctggacggactgggtaacggtttaggttactcagtggtgctgttggttgttggcttcattcgtgaactctttggttcaggcagcttgtttgatgtacagattttacctctggcatcacaaggtggttggttcgagcctgttggcttgttactgatgccacctagtgccttcttcatcattggcgggtttatctgggtactgcgtaccttccgcactgaacaagttgaacctaaggagtaa

SEQ ID NO: 20325 - protein, 210 aa, Idiomarina loihiensis L2TR
MANVKEMKSVLFGPIFANNPIALQILGICSALAVTSKMSNTLVMCIALTAVVACSNLFISIIRNHIPSSVRIIVQMTIIASLVIVVDQILKAYAYSISKELSVFVGLIITNCIVMGRAEAYAMKSTPFMSFLDGLGNGLGYSVVLLVVGFIRELFGSGSLFDVQILPLASQGGWFEPVGLLLMPPSAFFIIGGFIWVLRTFRTEQVEPKE

SEQ ID NO: 20326 - DNA, 582 bp, Idiomarina loihiensis L2TR
  CDS (1)..(582): transl_table=11
atgaccgattacttactgctactgataggcaccgtgctggttaataactttgtactggtgaagtttctgggtttatgcccctttatgggcgtttccggcaagctggacacggcaataggcatgtcagcagcgaccacctttgtgctgaccctggcctcggtctgtagctacctggttaaccaatacctacttgagccgctcgacttaatgtcgctgcaaacgctcagttttattctggttattgctgtggtcgtacaatttacagaaatggtggtacacaaaaccagtcctacgctgtatcggttactgggtattttcctgccacttattaccaccaactgtgctgtattaggtgtggctttgcttaacgtcaacgagcaacacaactttgtgcagtccattgtttatggcttgggagccgctattggtttctcgctggtacttattttgttctcagctctgcgtgagcgcttagctgccgccgacgtgccggtagcgtttaaaggttcagctattgcgatgataaccgcagggcttatgtctcttgcctttatgggctttagcggattggtgagcgcttaa

SEQ ID NO: 20327 - protein, 193 aa, Idiomarina loihiensis L2TR
MTDYLLLLIGTVLVNNFVLVKFLGLCPFMGVSGKLDTAIGMSAATTFVLTLASVCSYLVNQYLLEPLDLMSLQTLSFILVIAVVVQFTEMVVHKTSPTLYRLLGIFLPLITTNCAVLGVALLNVNEQHNFVQSIVYGLGAAIGFSLVLILFSALRERLAAADVPVAFKGSAIAMITAGLMSLAFMGFSGLVSA

SEQ ID NO: 20328 - DNA, 681 bp, Idiomarina loihiensis L2TR
  CDS (1)..(681): transl_table=11
atgaatgaatacaaacacttaaccaagcaaggcttatgggacaataacccagcattagttcagctattaggcttatgccctttattagcagttaccgcttcggtgaccaatgcgctgggtcttgggctggccaccttgtttgttctggttggctctaacattaccgtgtctctggtacgcgaatttgtgccatcggaaattcgtattccggtctttgttatggttatcgccacttttgtcaccattattcagttgttgatgaatgcgtatgtctttcagctttaccagtcactgggtattttcattccgctcattgtgaccaactgtgccattattggccgcgccgaagcttacgcttcgaaaaacccatggcaacgggccgccttcgatgggttggcaatgggcgcaggctttgccttagtactggttgtgctgggcgcaatgcgcgaaattatcggtaacggcacgctgtttaatggcgcagaactcttgttaggtgactgggctgcacaattgcgaattgagctattcacggtgaattacccattattgctggcgatactgccacccggagcctttattggtatgggttttattattgcgttgaaaaataaaattgatgcagtacgcagcgcccgcgctgaaaagaaaaccgttacccgtgcacgggttactgcctga

SEQ ID NO: 20329 - protein, 226 aa, Idiomarina loihiensis L2TR
MNEYKHLTKQGLWDNNPALVQLLGLCPLLAVTASVTNALGLGLATLFVLVGSNITVSLVREFVPSEIRIPVFVMVIATFVTIIQLLMNAYVFQLYQSLGIFIPLIVTNCAIIGRAEAYASKNPWQRAAFDGLAMGAGFALVLVVLGAMREIIGNGTLFNGAELLLGDWAAQLRIELFTVNYPLLLAILPPGAFIGMGFIIALKNKIDAVRSARAEKKTVTRARVTA

SEQ ID NO: 20330 - DNA, 582 bp, Azoarcus sp. EbN1
  CDS (1)..(582): transl_table=11
atgcacgaatatgcgctcctgctgctgtcgaccgcgctcgtcaacaacgtcgtgctggtcaaattcctcggcctgtgcccggcgatgggcgtatcgaaaagcatggatgccgcgctcggcatggggttggcgacgactttcgtcatcacgctcgcggcagcggcgagctggatgctcgagcactggctgctggcgccgttcgacctcggcttcctgcgcatcctgagcttcatcctggtcatcgcggcggcggtgcaattcaccgaaatggcgatccgcaagatgagcccggcgctgtaccagagcctcggcatctacttgccgctgatcacgacgaactgcgcagtgctgggcgttgcgctgctcaacgtccagcagggctacggcttcttcaagagcgtgctgttcggctttggttcggcgctcggcttcacgctcgtactgctgatcttcgccggcctgcgcgaacgcctcgccctcgcgtccgtcccggccgctttcgccggcgccccggccgcattcatcacgatcagcctgctgagcctcgccttcatggggctgtccgggctggtcgccacctga

SEQ ID NO: 20331 - protein, 193 aa, Azoarcus sp. EbN1
MHEYALLLLSTALVNNVVLVKFLGLCPAMGVSKSMDAALGMGLATTFVITLAAAASWMLEHWLLAPFDLGFLRILSFILVIAAAVQFTEMAIRKMSPALYQSLGIYLPLITTNCAVLGVALLNVQQGYGFFKSVLFGFGSALGFTLVLLIFAGLRERLALASVPAAFAGAPAAFITISLLSLAFMGLSGLVAT

SEQ ID NO: 20332 - DNA, 585 bp, Azoarcus sp. EbN1
  CDS (1)..(585): transl_table=11
atgagtagttacatctttgtcgtcatcggcgcggtcctggtcaataacgtcgtttttgtccgcatcctcgggctgtgtccgttcatgggggtgtcgaaaaaactcgagacggcgatcggcatgggtgcggcgacgacgttcgtgctgaccctgggctcgggcacgagctacctgatcgaccactacctgctgcagccgtacgacctcgcctacctgcgcacgctgtcgttcatcgtcgtgatcgcggcgatcgtgcagctcaccgagctggtgatccagaagacgagcccgctgctgcaccaggtgctgggaatctacctgccgttgatcacgacgaactgcgcagtgctcggcgtcccgctgctgagcgtcgcgctcgactacaacctgctcgagtcgctgctgttcggcttcggctcgtcgatcggattcacgctcgcgctgatcctgttcgccggcatccgcgagcgcctggacggcgccgacgtccccgcgcccttcaagggaaccgcgatcgcgatgatcaccgcgggattcatgagtctcgcgttcatgggtttcgcgggcctggaccggttccagtaa

SEQ ID NO: 20333 - protein, 194 aa, Azoarcus sp. EbN1
MSSYIFVVIGAVLVNNVVFVRILGLCPFMGVSKKLETAIGMGAATTFVLTLGSGTSYLIDHYLLQPYDLAYLRTLSFIVVIAAIVQLTELVIQKTSPLLHQVLGIYLPLITTNCAVLGVPLLSVALDYNLLESLLFGFGSSIGFTLALILFAGIRERLDGADVPAPFKGTAIAMITAGFMSLAFMGFAGLDRFQ

SEQ ID NO: 20334 - DNA, 582 bp, Zymomonas mobilis subsp. mobilis ZM4
  CDS (1)..(582): transl_table=11
gtgacggatatactacttctggtggtaagtgcctgtctggtcaacaatgttattctaacgcgctttttaggtttatgttcctttatgggtgtaactacgcgcgttgatactgctgtcgggatgggggcggcctgcacctttgttattaccacctcttctatggcaagttgggctttggagcattggttactcgccccctttggtctgggatatcttcggacggtcacttttattctgattatcgcttcggcggttcagctgacggaatcgttttttcgtaaattctcgccgactttgtttcggcttttgggcatttatctgccgcttatcacaaccaattgtgccgttttgggcattaccttgctgttggtagaacagcattatggatttgtggacagcacggttttcgcttttgcttcctcggttggatacagcctcgttatggtgctgtttgcgggattacgtgaaagattggcgttatcggtaacgcctcgtttatttgaaggccctcctatcggttttgtgacggcaagtttgctggcgctggcttttatgggtttttctggaatgtctgtccactag

SEQ ID NO: 20335 - protein, 193 aa, Zymomonas mobilis subsp. mobilis ZM4
MTDILLLVVSACLVNNVILTRFLGLCSFMGVTTRVDTAVGMGAACTFVITTSSMASWALEHWLLAPFGLGYLRTVTFILIIASAVQLTESFFRKFSPTLFRLLGIYLPLITTNCAVLGITLLLVEQHYGFVDSTVFAFASSVGYSLVMVLFAGLRERLALSVTPRLFEGPPIGFVTASLLALAFMGFSGMSVH

SEQ ID NO: 20336 - DNA, 654 bp, Silicibacter pomeroyi DSS-3
  CDS (1)..(654): transl_table=11
atgtcccagaccaagaaagaactgctgatcgatccgctggtcgacaacaacccgatcacgcttcaggtgctgggcatctgctcggcgctggcggtcacctcgtcgctgcaggttgcctttgtcatggcgctggcggtgaccttcgtgacggcgttctcgtccttcttcatctcgatcctgcgcaaccagatccccagctcgatccggatcatcgtgcaaatggtgatcattgccagcctcgtgatcctggtcgaccagatcctcaaggcctatgcctttgaaatctcgaagaccctgtcggtctttgttggcctgatcatcaccaactgcatcgtgatgggccgggccgaggcatttgcgatgaagaacccgccggttgcctcgttcatcgacggcttcggcaacggtctgggttacgggctgatcctgatgctggtgggcgtgatccgcgagctgttcggctcgggcagcctgtttggcgtgaccatcctgcaaaccgttaacaacggcggctggtacgtgcccaacggtctgttgctgctgccgccttcggcgtttttcgtgatcggcctgttgatctgggccttccgcacctggaagcccaagcagatcgaggaacgtgaattcaagatccagtcggtggaggcgcattga

SEQ ID NO: 20337 - protein, 217 aa, Silicibacter pomeroyi DSS-3
MSQTKKELLIDPLVDNNPITLQVLGICSALAVTSSLQVAFVMALAVTFVTAFSSFFISILRNQIPSSIRIIVQMVIIASLVILVDQILKAYAFEISKTLSVFVGLIITNCIVMGRAEAFAMKNPPVASFIDGFGNGLGYGLILMLVGVIRELFGSGSLFGVTILQTVNNGGWYVPNGLLLLPPSAFFVIGLLIWAFRTWKPKQIEEREFKIQSVEAH

SEQ ID NO: 20338 - DNA, 609 bp, Silicibacter pomeroyi DSS-3
  CDS (1)..(609): transl_table=11
atggaagggctgatttccctcgcggtcaaggccgtattcgtcgagaacctggcgctcagcttctttctcggcatgtgtaccttcatcgcggtgtccaagaagatctcgaccgcattgggcctgggtatctcggtcatggtggtgcaggcgatcaccgtgccggccaacaacctgctgctgaatacgctcttgaaaccgggagcgctggcctgggcgggtttcccggatgtggacctgaccttccttggtctgatctcgtatatcggggtgatcgcggcgatggtgcagatcctcgagatgatcctcgataagtatttcccgccgctctataacgcacttggcatcttcctgccgctgatcacggtgaactgcgccattctgggcggttctctgttcatggtggagcgtgactacaactttgccgaggcgacgacctatggcctgtcctcgggctttggctgggcgctggccatcaccgccatggcgggcgtgcgcgagaagctgaaatattccgacgtgccggacgggcttcagggtctgggcatcaccttcattaccgcggggctgatggcgatggccttcatgtccttctcgggcgtcaaactgtaa

SEQ ID NO: 20339 - protein, 202 aa, Silicibacter pomeroyi DSS-3
MEGLISLAVKAVFVENLALSFFLGMCTFIAVSKKISTALGLGISVMVVQAITVPANNLLLNTLLKPGALAWAGFPDVDLTFLGLISYIGVIAAMVQILEMILDKYFPPLYNALGIFLPLITVNCAILGGSLFMVERDYNFAEATTYGLSSGFGWALAITAMAGVREKLKYSDVPDGLQGLGITFITAGLMAMAFMSFSGVKL

SEQ ID NO: 20340 - DNA, 633 bp, Vibrio fischeri ES114
  CDS (1)..(633): transl_table=11
atggctagcgcaaaagatattaaaaagagcattttagcgccggtgttggataacaaccctatcgcgctacaagttcttggtgtttgttcagctctagctgtaacaactaagcttgaaacggctttcgttatgactttagcggtaatgtttgttactgctttatctaacttattcgtttcgctaattcgtaaccacatgccaaacagcgttcgtatcatcgttcagatggcgatcattgcttctttggtaatcgttgttgaccaagtattgaaagcatatctatacgatatctctaaacagctttcagtattcgtaagcttgatcattacaaactgtatcgtaatgggtcgtgcggaagcgttcgcaatgaagtctgctccattcccatcgtttatcgatggtattggtaacggtcttggttatggttttgtactgatgacagtagcatttttccgtgaacttcttggttctggtaagctatttggtgttgaagttcttccacttgtttctaacggtggttggtaccaaccaaatggtctaatgcttctagcaccatcagcattcttcttaattggttttatgatctgggctatccgtatccttaaaccagaacaagtagaagcgaaggagtaa

SEQ ID NO: 20341 - protein, 210 aa, Vibrio fischeri ES114
MASAKDIKKSILAPVLDNNPIALQVLGVCSALAVTTKLETAFVMTLAVMFVTALSNLFVSLIRNHMPNSVRIIVQMAIIASLVIVVDQVLKAYLYDISKQLSVFVSLIITNCIVMGRAEAFAMKSAPFPSFIDGIGNGLGYGFVLMTVAFFRELLGSGKLFGVEVLPLVSNGGWYQPNGLMLLAPSAFFLIGFMIWAIRILKPEQVEAKE

SEQ ID NO: 20342 - DNA, 684 bp, Vibrio fischeri ES114
  CDS (1)..(684): transl_table=11
atggcaagtcataaagaattagttaaaaacggtttatgggataacaaccctgccctagttcaactattaggtctttgtcccttacttgctgtttctgccacagtgactaacgcacttggtttaggcattgctaccatcctagttttggttggctcaaacctaattgtttctttggttcgtcagtggataccacaagaggtgcgtattcctgtattcgtaatgatcatcgcttcactagtaacttgtgtgcaattactgatgaacgcctatgcttatggtctttatttatctcttggaatatttattcctctaattgttaccaactgcattatcattggacgagcagaatcatttgcttcaaaaaatgacccacttcctgccgttttagatggattatggatgggtatgggaatgacagcggtcttggttttactcggcgcaatgcgtgagatccttggtaacggtactttgtttgatggtgccgatctgctgcttggtgattgggcaactatgctaagaattgaacttttccatgttgatagccacttcctactggctatgctacctccaggtgcattccttggcgttggatttcttattgctttaaaaaacgtcattgataagaaaatggccgatcgtcaacctaaagaaaaagcagagatagagcgagctcgtatttcgtaa

SEQ ID NO: 20343 - protein, 227 aa, Vibrio fischeri ES114
MASHKELVKNGLWDNNPALVQLLGLCPLLAVSATVTNALGLGIATILVLVGSNLIVSLVRQWIPQEVRIPVFVMIIASLVTCVQLLMNAYAYGLYLSLGIFIPLIVTNCIIIGRAESFASKNDPLPAVLDGLWMGMGMTAVLVLLGAMREILGNGTLFDGADLLLGDWATMLRIELFHVDSHFLLAMLPPGAFLGVGFLIALKNVIDKKMADRQPKEKAEIERARIS

SEQ ID NO: 20344 - DNA, 582 bp, Vibrio fischeri ES114
  CDS (1)..(582): transl_table=11
atgactgagtatctcttactacttattggtaccgttctagtaaacaactttgtactagttaagttcttaggactttgcccatttatgggcgtgtctaaaaaactagaaagcgctattggaatgggattagcaaccacatttgttcttaccttagcatcagtgtgttcgtatcttgtcgaaacatacatcttgtctccactaggtattgaatacctcagaacaatgagctttattcttgttattgcagttgtggtgcaattcaccgaaatggttgtacacaaaacaagcccaactttgtatcgtgtattgggtattttcttaccattaattacaaccaactgtgccgttcttggtgttgctcttctaaatgtcactgaaaatcataatttcgtagaatctattatttatggctttggtgctgccgttggtttttctttagttcttatcttattttctgcaatgcgtgaacgaattgctgctgccgatgtacctttaccttttaaaggtgcttctattgcgatgatcactgcaggtttaatgtctttagcctttatgggctttactggtttagtgaaattataa

SEQ ID NO: 20345 - protein, 193 aa, Vibrio fischeri ES114
MTEYLLLLIGTVLVNNFVLVKFLGLCPFMGVSKKLESAIGMGLATTFVLTLASVCSYLVETYILSPLGIEYLRTMSFILVIAVVVQFTEMVVHKTSPTLYRVLGIFLPLITTNCAVLGVALLNVTENHNFVESIIYGFGAAVGFSLVLILFSAMRERIAAADVPLPFKGASIAMITAGLMSLAFMGFTGLVKL

SEQ ID NO: 20346 - DNA, 594 bp, Neisseria gonorrhoeae FA 1090
  CDS (1)..(594): transl_table=11
atggaacactatttgagcctcttcatcaaatccgtcttcattgaaaatatggcgctatccttctttttgggtatgtgtacgtttttggcggtatccaaaaaagtatccaccgcattcggtttgggtgtggcggtaattttcgtactcgggctgtccgtccccgccaaccaattggtttactcgctgctcaaagacggcgcgattgtcgaaggcgtggatttgacctttttgaaattcatcacctttatcggcgtgattgccgctttggtgcagattttggaaatgttcttggacaaattcgtccccgccctctataacgcgctgggcatctacctgcctctgattaccgtaaactgcgcaattttcggtgccgtttcgtttatggcgcaacgcgaatacgacttcggcgagtccgtcgtgtacggcttcggcgcgggtttgggctggatgttggcgattgtcgctttagcgggcattaccgaaaaaatgaaatattcggacgctcccaaaggcctcaaaggcttgggcattacctttatcgccgccggcctgatggcaatggcgtttatgtcgttctccggcatccagttataa

SEQ ID NO: 20347 - protein, 197 aa, Neisseria gonorrhoeae FA 1090
MEHYLSLFIKSVFIENMALSFFLGMCTFLAVSKKVSTAFGLGVAVIFVLGLSVPANQLVYSLLKDGAIVEGVDLTFLKFITFIGVIAALVQILEMFLDKFVPALYNALGIYLPLITVNCAIFGAVSFMAQREYDFGESVVYGFGAGLGWMLAIVALAGITEKMKYSDAPKGLKGLGITFIAAGLMAMAFMSFSGIQL

SEQ ID NO: 20348 - DNA, 633 bp, Bacteroides fragilis NCTC 9343
  CDS (1)..(633): transl_table=11
atgagccaattattttctaaaaagaataaagaagtattcgctactccgctgggattgaataacccggtaaccgtgcaggtgctcggtatctgttcggcactggctgtaacggccaaactggaaccggctatcgtgatgggtctttcggtaactgtgattacggctttctcaaacgtcgttatctctttgctgcgtaagacgattcctaaccgtatccgtatcatcgtacagttggtggtagtagccgcattggtaactatagtaagtgaggtgctgaaagcgtttgcatacgatgtaagcgtacagctttcggtatacgtaggtctgatcattacaaactgtatcctgatgggacgcctcgaagcgtttgccatggcaaacggtccgtgggagtcattcctcgacggtgtaggtaatggtctgggatatgccaagatcctgatcatcgtggctttcttccgcgagttgctcggatcgggcacattgctcaacttccgtattatccctgagtcattctataagatgggttacatcaacaatggtttgatgttgatgccgccgatggcactgatcatctgtgcatgtatcatctggtatcagcgcagccgctgcaaagaactccaggaaaagtaa

SEQ ID NO: 20349 - protein, 210 aa, Bacteroides fragilis NCTC 9343
MSQLFSKKNKEVFATPLGLNNPVTVQVLGICSALAVTAKLEPAIVMGLSVTVITAFSNVVISLLRKTIPNRIRIIVQLVVVAALVTIVSEVLKAFAYDVSVQLSVYVGLIITNCILMGRLEAFAMANGPWESFLDGVGNGLGYAKILIIVAFFRELLGSGTLLNFRIIPESFYKMGYINNGLMLMPPMALIICACIIWYQRSRCKELQEK

SEQ ID NO: 20350 - DNA, 627 bp, Bacteroides fragilis NCTC 9343
  CDS (1)..(627): transl_table=11
atggaacaattattaagtttattcgtccgctccatctttgtggacaacatgatattcgccttcttcctgggtatgtgttcatatctggctgtgtcgaagaatgtgaaaactgctgtaggactgggtatcgccgtaactttcgtattggtggttacgttgccggtcaactacttgcttcaaactaaggtgctggctgccaatgcgatcattgaaggtgttgacctcagcttcctgagttttattctctttattgccgttattgccggtatcgtgcagttggtagaaatggtggtggaacgcttcagcccttcgctctacgcttcactgggtatcttccttccgctgatcgccgttaactgtgccatcatgggtgcttcactgttcatgcagcagagaatcacgatggatccgtcgaacccgcaggctattaccggcgtgggcagtgctgtagtatacgcactcggttccggtattggctggttgctggctatcgtcggtctggccgctatccgcgaaaagatggcttactctgatgttcccgctccgctgaaaggtctgggcattacgtttatcacagtaggactgatggctatggcctttatgtgtttctctggattgaaattataa

SEQ ID NO: 20351 - protein, 208 aa, Bacteroides fragilis NCTC 9343
MEQLLSLFVRSIFVDNMIFAFFLGMCSYLAVSKNVKTAVGLGIAVTFVLVVTLPVNYLLQTKVLAANAIIEGVDLSFLSFILFIAVIAGIVQLVEMVVERFSPSLYASLGIFLPLIAVNCAIMGASLFMQQRITMDPSNPQAITGVGSAVVYALGSGIGWLLAIVGLAAIREKMAYSDVPAPLKGLGITFITVGLMAMAFMCFSGLKL

SEQ ID NO: 20352 - DNA, 573 bp, Bacteroides fragilis NCTC 9343
  CDS (1)..(573): transl_table=11
atggaatatatattgatatttatctcggcaatctttgttaataacattgtgttgtcgcaatttctgggaatctgtcctttcttgggtgtttccaagaaggtggatactgcattgggtatgagtgcagcggtagctttcgtgcttaccattgctacgatcgtaacgttcctgatccagaagtttgtactcgatgccttcgggttgcagtacttgcagactatcacgtttatcttggttatcgctgcattggtgcagatggtagaaattattctgaagaaagtttctcccgcactttatcaggcattgggcgtattccttcccttgattacaacgaattgttgtatcttgggtgtggcaattcttgttatccaaaaagattatgacctactgacgggtgttgtatatgcattctctactgctattggtttcggtctggccctggtacttttcgccggactccgtgagcagatgagtcttgtgaaaattcccgaaggaatgaaaggtactccgattgctttaattacagccggattgctggctatggcatttatgggattctccggagttgtataa

SEQ ID NO: 20353 - protein, 190 aa, Bacteroides fragilis NCTC 9343
MEYILIFISAIFVNNIVLSQFLGICPFLGVSKKVDTALGMSAAVAFVLTIATIVTFLIQKFVLDAFGLQYLQTITFILVIAALVQMVEIILKKVSPALYQALGVFLPLITTNCCILGVAILVIQKDYDLLTGVVYAFSTAIGFGLALVLFAGLREQMSLVKIPEGMKGTPIALITAGLLAMAFMGFSGVV

SEQ ID NO: 20354 - DNA, 588 bp, Bacteroides fragilis NCTC 9343
  CDS (1)..(588): transl_table=11
atgaataactttaaagtattaatgaatgggattgttaaagagaatccgacatttgtgctcctgcttggtatgtgtcctacactcggtacgacttcctcggccataaatggtatgggtatggggcttgccactatgtttgtattgatctgttccaatgtagtgatttcattgataaagaacctgattccggacatggtgcgtattccgtcattcattgtagtcattgcatcttttgtgactttgcttcagatggtaatgcaagcatatgtacccggactgtacgctacattgggactttttattccattgattgttgtgaactgcattgtgttgggacgtgcagaagcatttgcagccaagaataatgcactttcttctatgttcgacggaatcggtatgggattgggctttacaattgcccttacattgctgggagctgttcgtgagttcctgggtacaggcaaggtattcaacttgtcaatcattccggaagaatacggtatgcttgtctttgtgcttgctccgggtgcgtttatcgcattgggatatctgattgcgttgattaacagccttaagaaagcgaattaa

SEQ ID NO: 20355 - protein, 195 aa, Bacteroides fragilis NCTC 9343
MNNFKVLMNGIVKENPTFVLLLGMCPTLGTTSSAINGMGMGLATMFVLICSNVVISLIKNLIPDMVRIPSFIVVIASFVTLLQMVMQAYVPGLYATLGLFIPLIVVNCIVLGRAEAFAAKNNALSSMFDGIGMGLGFTIALTLLGAVREFLGTGKVFNLSIIPEEYGMLVFVLAPGAFIALGYLIALINSLKKAN

SEQ ID NO: 20356 - DNA, 642 bp, Chlamydophila abortus S26/3
  CDS (1)..(642): transl_table=11
atggcagcaaataaatcctacaagagttactttcttgatcctctttggaacaataaccaacctcttattgctattttagggatttgctctgcgttggctgtaacaacaacggtaaatacagcattgaccatgggtctcgctgtgagtttcgttacagggtgttcttcgttcttcgtatctttattgcggaaagtcaccccggatagcgtacgtatgatcacccagctaattatcattagcttattcgtgattgtcattgatcaattcctcaaggcttttttctttgatatctcaaaaacactttctgtgttcgtcgggttaattatcaccaactgtatcgtcatgggaagagcagaaagtctagcaagaaatgttccacctattcctgcttttttggatggttttgcctcaggattaggttacggttgggtattagttactgtaagtatcatcagagaattcttcggttttgggacaattcttggattacaactgattcctaaatgtttttatgcctcagaagctcatcccgatgggtatgaaaactttggcttgatggttttagctccctcagcattcttccttttgggtataatgatttggggtgtcaatattctgagatctaagaaagaaagaaggtag

SEQ ID NO: 20357 - protein, 213 aa, Chlamydophila abortus S26/3
MAANKSYKSYFLDPLWNNNQPLIAILGICSALAVTTTVNTALTMGLAVSFVTGCSSFFVSLLRKVTPDSVRMITQLIIISLFVIVIDQFLKAFFFDISKTLSVFVGLIITNCIVMGRAESLARNVPPIPAFLDGFASGLGYGWVLVTVSIIREFFGFGTILGLQLIPKCFYASEAHPDGYENFGLMVLAPSAFFLLGIMIWGVNILRSKKERR

SEQ ID NO: 20358 - DNA, 597 bp, Haemophilus influenzae 86-028NP
  CDS (1)..(597): transl_table=11
atggaacattatattagcctatttgttaaggcagtcttcattgaaaatatggcactttctttcttcttaggaatgtgtactttcttagcggtatctaaaaaggtgtccactgcgtttggtcttgggattgcggtaactttcgttcttggtatcgcagtgccagtaaaccaattaatttatgcaaatgtactaaaagaaaatgctttaattgaaggtgtagatttatcattcttaaacttcatcactttcattggggttattgctggtttagtgcaaattcttgaaatggtgttagataaatttatgccatctctttataacgcattagggattttcttacctttaatcgcagtaaactgtgcgatctttggtggggtatctttcatggttcaacgtgattacaatttccctgaatctatcgtgtatggtttcggctcaggtttaggttggatgttagcgattgtagcgcttgctggcttaacggaaaaaatgaaatacgctgatattcctgctggattaaaaggtttaggtattacctttatctctgttggtttaatggcactaggctttatgtctttctctggtattcaattataa

SEQ ID NO: 20359 - protein, 198 aa, Haemophilus influenzae 86-028NP
MEHYISLFVKAVFIENMALSFFLGMCTFLAVSKKVSTAFGLGIAVTFVLGIAVPVNQLIYANVLKENALIEGVDLSFLNFITFIGVIAGLVQILEMVLDKFMPSLYNALGIFLPLIAVNCAIFGGVSFMVQRDYNFPESIVYGFGSGLGWMLAIVALAGLTEKMKYADIPAGLKGLGITFISVGLMALGFMSFSGIQL

SEQ ID NO: 20360 - DNA, 579 bp, Haemophilus influenzae 86-028NP
  CDS (1)..(579): transl_table=11
atgacgcactatattttattgattatcggcaccgcattaattaacaattttgtattggtaaaattcttaggactttgcccttttatgggtgtatccaaaaaaattgaaaccgctgtgggaatgggattagcaacaatgtttgttttaactgttgcttccctttgtgcatatttggtcgatcactatattctaattcccttaaatgccacttttttacgtacattagtgtttattttagttattgctgtagtggtgcaatttaccgaaatggcaataaacaaaacaagtccaacattatatcgtttactcggcattttcttgcctttgataactacaaactgcgcagtacttggtgtcgcattattaaatgtaaatctcgctcataatttaacagagtctgtcgtttatggttttggtgcatctctcggtttttccttagtattggtactttttgccgcacttcgtgaacgtttagtcgccgctgatatacctgccacttttcgcggttcagccattgctttaattaccgcaggcttaatgtccctcgcttttatgggatttacaggacttgtaaaataa

SEQ ID NO: 20361 - protein, 192 aa, Haemophilus influenzae 86-028NP
MTHYILLIIGTALINNFVLVKFLGLCPFMGVSKKIETAVGMGLATMFVLTVASLCAYLVDHYILIPLNATFLRTLVFILVIAVVVQFTEMAINKTSPTLYRLLGIFLPLITTNCAVLGVALLNVNLAHNLTESVVYGFGASLGFSLVLVLFAALRERLVAADIPATFRGSAIALITAGLMSLAFMGFTGLVK

SEQ ID NO: 20362 - DNA, 708 bp, Haemophilus influenzae 86-028NP
  CDS (1)..(708): transl_table=11
atgacagatttaactgaaaaaaataccgcacttgaagaagaaaaaatagaaagtgcggttgaaaatcaacaaaaatccatctggaaagaaatttttgctcaaggaatttggaaaaataaccctgcggttgtccaacttctcgggctttgtccacttttagcggtgtctagcacagccaccaacgcgcttggtttgggtttagcaacaatgcttgtactcacttgcacaaatacggtcatttcccttttccgtcaatatattcctaaggaaatccgtattccaatctacgtgatgatcattgcaaccacagtaacagcggttcaacttttaatgaatgcttacacttatacgctttatcaatcactggggatttttattccattaattgtgaccaactgtattattatcggtcgcgcagaagcattcgcctcaaaaaacagcttactccattccatctgggatgggttttcaatgggattaggaatggcacttagtctaaccattctcggcgcattacgtgaaattattggacaaggcacgatttttgagggcatagaaaatctattcggcgaacaagcaaaatttttaacgcaccatatttaccatacagacagtagctttttacttttcattctgccaccaggcgcatttataggcttaggcttgctcctcgccataaaaaatcgaattgataatgtaaaaaaataa

SEQ ID NO: 20363 - protein, 235 aa, Haemophilus influenzae 86-028NP
MTDLTEKNTALEEEKIESAVENQQKSIWKEIFAQGIWKNNPAVVQLLGLCPLLAVSSTATNALGLGLATMLVLTCTNTVISLFRQYIPKEIRIPIYVMIIATTVTAVQLLMNAYTYTLYQSLGIFIPLIVTNCIIIGRAEAFASKNSLLHSIWDGFSMGLGMALSLTILGALREIIGQGTIFEGIENLFGEQAKFLTHHIYHTDSSFLLFILPPGAFIGLGLLLAIKNRIDNVKK

SEQ ID NO: 20364 - DNA, 582 bp, Pseudomonas fluorescens Pf-5
  CDS (1)..(582): transl_table=11
atgaccgacttcctcctcgcccttgtcagcactgccctgatcaacaacttcgtgttgcagtggccgctgggcgtcgacccgctgctgcaggccccagccgatggcgctcggcttcggatccatgcgctgggcctggcaacgacggccttgatgctggtcagttgcgcactcggccatgttctctatcgtggtgtgctggtgccctcggggctgcagtcattgcagctgtttgcctggctgtccctgagtgtgctgctgatcgggccggcgctacactggctgccccgggccctgcccagtttgccattcgatggcctctggcccttgttgctggccaatgccgggatgctcggcctgctgttgatcgccagcggggaaaaccttgggctggcgaccctcggcgccatgagcctgggtgccgggctgggcttctggttggtactgagcctgttcaatgacctgcgccagcgtatttccaccaacgatattcccctgccctggcaaggcctgccgatcgacctgatcagcgccggcctgctggcagtggcgtttttcggcttcaacggactgctcaagacatga

SEQ ID NO: 20365 - protein, 193 aa, Pseudomonas fluorescens Pf-5
MTDFLLALVSTALINNFVLQWPLGVDPLLQAPADGARLRIHALGLATTALMLVSCALGHVLYRGVLVPSGLQSLQLFAWLSLSVLLIGPALHWLPRALPSLPFDGLWPLLLANAGMLGLLLIASGENLGLATLGAMSLGAGLGFWLVLSLFNDLRQRISTNDIPLPWQGLPIDLISAGLLAVAFFGFNGLLKT

SEQ ID NO: 20366 - DNA, 672 bp, Psychrobacter arcticum 273-4
  CDS (1)..(672): transl_table=11
atggctgatacaaaaagtattttaacctcgcccatttttgacaataaccctattgctctacagatcttaggtatctgttcggcattggcggtaacgaccagtgtggcaaatgcattggtgatgagcgtggcattgactttggtcacagcgttttcaagcttttttatctctattatccgtaagcaaatcccatcaagcattcgtattatcgtgcagatgacgattattgcttcattggttattttggttgatcagatactaaaagcagtcgcttatgatgtcagtaaaggcttgtcagtattcgttggtttgattattaccaactgtatcgtgatgggacgtgctgaagcgtttgccatgagcaatccgcctatacccagtttcttggatggtatcggtaatggtcttggttattcaaccgtactactatttatcgccagtatccgtgagattttgggtgcaggcagctggtttggtatcaccattttacaaaccgcgaccgatggtggctggtatgtaccaaatggtctattgctactaccgccgtcagcattctttatcattgccctgttcatcgtgattatccgtacatggaaacctgatcaggtcgaagacgctgaatttgtaatgaagccgcaatctaaaggcatggctcaagggggcggtcactaa

SEQ ID NO: 20367 - protein, 223 aa, Psychrobacter arcticum 273-4
MADTKSILTSPIFDNNPIALQILGICSALAVTTSVANALVMSVALTLVTAFSSFFISIIRKQIPSSIRIIVQMTIIASLVILVDQILKAVAYDVSKGLSVFVGLIITNCIVMGRAEAFAMSNPPIPSFLDGIGNGLGYSTVLLFIASIREILGAGSWFGITILQTATDGGWYVPNGLLLLPPSAFFIIALFIVIIRTWKPDQVEDAEFVMKPQSKGMAQGGGH

SEQ ID NO: 20368 - DNA, 609 bp, Psychrobacter arcticum 273-4
  CDS (1)..(609): transl_table=11
atgggacattatgtcagtttatttataacctcggtctttatcgagaatatggcactggcctacttcttaggcatgtgtacttttttagctgtatcaaaaaaagtctcaaccgctatcggtcttggggtggcagtggttgtcgtgatggcaattaccgtaccgctaaataacctactcttccagttcatcctaaaagatggtgcgctggcatgggcaggcttccctgatattgacttaagctttttgggtctgctcagttatattggtttgattgctgccaccgtacagattttagagatgttcttggataagttcgtcccgagtctatataacgcacttggtgtatttttgccgcttatcaccgtcaactgtgccatcttaggtggcgtattgtttatggtagaacgtgattataactttggtgaatcagtggtatacggtgttggtgcaggctttggttgggcactggctattaccgcattggcaggtatccgtgaaaagttaaaatactcagacattccagcgccactgcgcggtcttggtattacttttatcacggttggtctgatgtcacttggctttatgtcgtttggcggtatgtccatttaa

SEQ ID NO: 20369 - protein, 202 aa, Psychrobacter arcticum 273-4
MGHYVSLFITSVFIENMALAYFLGMCTFLAVSKKVSTAIGLGVAVVVVMAITVPLNNLLFQFILKDGALAWAGFPDIDLSFLGLLSYIGLIAATVQILEMFLDKFVPSLYNALGVFLPLITVNCAILGGVLFMVERDYNFGESVVYGVGAGFGWALAITALAGIREKLKYSDIPAPLRGLGITFITVGLMSLGFMSFGGMSI

SEQ ID NO: 20370 - DNA, 624 bp, Colwellia psychrerythraea 34H
  CDS (1)..(624): transl_table=11
atgtcttcagatactaaaaaagtcctcttcggacctgttgttgataataacccgattgcattacaagtattaggtgtttgttcagcgcttgctgtaacaagctcaatggctaatgcgttagttatgacacttgctgtaattgtggtaactgcattttctaacttgtttatttcgattatccgtaatcaaataccatcaagtgtacgtattattgtgcaaatggcgattattgcttcactagtaattgttgttgaccaagtactaaaagctttctcttaccaattatcgaaagaattatcggtttatattggtttgatcattactaactgtatcgttatgggtcgtgctgaagcttttgctatgaaagaaaagcctggcgtgagcttcttagacggtattggtaacggtttaggttatggcgcagtcttaatggttgtcgctttctttcgtgaattacttggctttggtaaagttttcggttttgaagttctaccattagttcaaaacggcggctggtaccaaggtaatggtctattagtgttaccgtttagctcattcttcattattggtttaatcatttgggctgtacgccaatggaaaccagaacaagttgagaaggattaa

SEQ ID NO: 20371 - protein, 207 aa, Colwellia psychrerythraea 34H
MSSDTKKVLFGPVVDNNPIALQVLGVCSALAVTSSMANALVMTLAVIVVTAFSNLFISIIRNQIPSSVRIIVQMAIIASLVIVVDQVLKAFSYQLSKELSVYIGLIITNCIVMGRAEAFAMKEKPGVSFLDGIGNGLGYGAVLMVVAFFRELLGFGKVFGFEVLPLVQNGGWYQGNGLLVLPFSSFFIIGLIIWAVRQWKPEQVEKD

SEQ ID NO: 20372 - DNA, 624 bp, Colwellia psychrerythraea 34H
  CDS (1)..(624): transl_table=11
atggaacattatttaagtatttttattaaaaccattttcattgagaatatggcgttaagcttcttcttaggtatgtgtactttcttagcagtatcaaagaaagttagcacagcgattggcttaggtgttgcagttgttgtagtgctcggtttagcggttcctgctaaccaaatcatctaccaagcaattttagcaccgggtgcacttgacagcttaatggggattactgatccgaaagaatcaattgaccttagctttttgtcatttattacctttatcggggtaattgctgctttagtacaaattttagaaatgcttttagataagtatttcccagctttgtatcaagcgcttggcatcttcctacctttaatcacggttaactgtgccatttttggtgccgtttcctttatggttgcgaaaaaccttacccttggcgaaagtgtcgtttacggcgttggctcaggtataggttggatgttagccattgtattgatggctggtttgcgcgaaaagatgaaatattctgatgtaccaaacggtttgaaaggtttaggtattacatttattactgctggattgatggcttttggctttctttctttcggtggtatttcgttataa

SEQ ID NO: 20373 - protein, 207 aa, Colwellia psychrerythraea 34H
MEHYLSIFIKTIFIENMALSFFLGMCTFLAVSKKVSTAIGLGVAVVVVLGLAVPANQIIYQAILAPGALDSLMGITDPKESIDLSFLSFITFIGVIAALVQILEMLLDKYFPALYQALGIFLPLITVNCAIFGAVSFMVAKNLTLGESVVYGVGSGIGWMLAIVLMAGLREKMKYSDVPNGLKGLGITFITAGLMAFGFLSFGGISL

SEQ ID NO: 20374 - DNA, 792 bp, Colwellia psychrerythraea 34H
  CDS (1)..(792): transl_table=11
atgagcaatgaaatagcaccaccaaatagtaatgacgctgatattactgacaacactgatgagcaagaagctgcggcagtacttaaagctgaacgtaaggcagagtataaagaactagccatacaaggtttatggaagaacaaccctggcttagtgcaactgcttggtttatgtcctctactggccgtaacatcaaccgtgaccaatgcattaggtcttggccttgccaccatgttagtactcatctgttccaatattaccgtgtcagcaatacgtcactgggtacctaaagaaattcgtatacccatttttgttttgattattgctgcctttgtaacttgcgtacaattgctaatgaatgcctttacttacggcatctatcaatcattagggatatttctcccgttaatcgtgactaactgcgccattattggtcgagctgaagcctacgcatcaaaaaacccaatcaaacaatcagcctttgatgggttaatgatgggatcaggctttgccattatcttaattttactcggtgtaataagagaaatccttgggcaaggaacactttttgatggtgcaaatttattacttggcgactgggctagtgtccttcgaattgaagtaatgcaactcgatagtcaatttttattagctattttaccccccggcgcctttatcgccatggggattttaattgcacttaaaaatgctattgatagccatataaaatccaaaaaagtagttgatactgaacaagtaatagagagagttcgagtaaattttgactcttaa

SEQ ID NO: 20375 - protein, 263 aa, Colwellia psychrerythraea 34H
MSNEIAPPNSNDADITDNTDEQEAAAVLKAERKAEYKELAIQGLWKNNPGLVQLLGLCPLLAVTSTVTNALGLGLATMLVLICSNITVSAIRHWVPKEIRIPIFVLIIAAFVTCVQLLMNAFTYGIYQSLGIFLPLIVTNCAIIGRAEAYASKNPIKQSAFDGLMMGSGFAIILILLGVIREILGQGTLFDGANLLLGDWASVLRIEVMQLDSQFLLAILPPGAFIAMGILIALKNAIDSHIKSKKVVDTEQVIERVRVNFDS

SEQ ID NO: 20376 - DNA, 582 bp, Colwellia psychrerythraea 34H
  CDS (1)..(582): transl_table=11
atgactgattatctgttacttctcgttggcactgtactcgtaaacaactttgttttagtacaatttcttggcctatgcccttttatgggtgtttcgtcacgtactgaaacagctataggcatgtcattcgccactgttttcgtcatgactttagcctctctactgagttatttagttaccacatatctgcttgtaccactaaaccttgaatacctaaccaccatgagttttatattggtgatagccgtcgtcgtacaatttactgaaatggttgttcataaaaccagtgctagcctttatcgcttattaggtattttcttacccttgatcaccacaaactgtgcggtcttgggtgttgccttgctgaatttaaggttacaacacggcttttttgaatcaattatttatggctttggtgctgcgctaggtttttcattggtattaattatgttttctgccatgcgtgaaaagttagccaatgccgatgtacctgcaccttttaaaggtactgctattgcaatgataaccgcaggtttaatgtcattagcattccttggttttaccggtttggtgaaaatttaa

SEQ ID NO: 20377 - protein, 193 aa, Colwellia psychrerythraea 34H
MTDYLLLLVGTVLVNNFVLVQFLGLCPFMGVSSRTETAIGMSFATVFVMTLASLLSYLVTTYLLVPLNLEYLTTMSFILVIAVVVQFTEMVVHKTSASLYRLLGIFLPLITTNCAVLGVALLNLRLQHGFFESIIYGFGAALGFSLVLIMFSAMREKLANADVPAPFKGTAIAMITAGLMSLAFLGFTGLVKI

SEQ ID NO: 20378 - DNA, 693 bp, Dechloromonas aromatica RCB
  CDS (1)..(693): transl_table=11
atgttgatcacgctcagcgaaatcaagcagatttccctcaacggagtctggaagcagaacagcagcctggtccagattctcggcatgtgtccgctgctggccattacgaccacgctggtcaatggcgtcatgctgtccttcgccacgctgctggtcatggccttctccaatttcttcgtcgcctgcctgcgcaatttcattccctacgaaattcgcatcccggtgttcatccttgtcgctgcagccgtcgtcaccgtcatcgacctcggcatgaacgcctacatgcacgacctgtacttgatcctcggcatcttcattccgctgatcatcaccaattgcctggtgctgggtcgcatcgaagcctttgccgccaaaaacagcccgctcggctcggcccttgacggcgcgatgatgggcgttggcatgatctggaccctgggcctgctcggcggtatccgcgagttcatcggagctggcaccgtgctcggtggtatcgagctggtcattcccggcacctcggcactgcagatcctgccggccgactacccgggtttcctggtcgccattcttccccccggcgcctttatctgcctgggttgcctggttgcctggaagaattgggttgaagcccgcgccgcccagcgagcccagttgcctccccccgcccccgttgctgccggcggctgccactaa

SEQ ID NO: 20379 - protein, 230 aa, Dechloromonas aromatica RCB
MLITLSEIKQISLNGVWKQNSSLVQILGMCPLLAITTTLVNGVMLSFATLLVMAFSNFFVACLRNFIPYEIRIPVFILVAAAVVTVIDLGMNAYMHDLYLILGIFIPLIITNCLVLGRIEAFAAKNSPLGSALDGAMMGVGMIWTLGLLGGIREFIGAGTVLGGIELVIPGTSALQILPADYPGFLVAILPPGAFICLGCLVAWKNWVEARAAQRAQLPPPAPVAAGGCH

SEQ ID NO: 20380 - DNA, 585 bp, Dechloromonas aromatica RCB
  CDS (1)..(585): transl_table=11
atgagccactatatattcatcctcatcggcacggtgctggtcaacaatgtggtgttggtcagaattctcggcctttgccccttcatgggcgtgtccaaaaagctggaaacagcctacggcatgggtgccgccacgacgttcgtgctcaccgtgggcacgggggccagctggatcatcgaccactacctgctgatgccgtttgacctgatgtatctgcgcatcatcgccttcatcgtcaccatcgccgcctttgtccagctgaccgaactggtcatccagaagaccagtccgatgctgcatcagacgctcggcatctacctgccactgatcaccaccaactgcgccgtactcggtgtgcccttgctggcgctcggcgccaagtacgatttcgtcgaatcactgctcttcggtgccggcagctccgtcggcttctcgctcgccctgatcctttttgccggcctgcgcgaacgtatcgagggcgccgacgtcccgacctatttcaagggcaccgccatcgccctcgtcaccggcggcttgatgtcgctggccttcatgggcttcgccggactggataaataccaatga

SEQ ID NO: 20381 - protein, 194 aa, Dechloromonas aromatica RCB
MSHYIFILIGTVLVNNVVLVRILGLCPFMGVSKKLETAYGMGAATTFVLTVGTGASWIIDHYLLMPFDLMYLRIIAFIVTIAAFVQLTELVIQKTSPMLHQTLGIYLPLITTNCAVLGVPLLALGAKYDFVESLLFGAGSSVGFSLALILFAGLRERIEGADVPTYFKGTAIALVTGGLMSLAFMGFAGLDKYQ

SEQ ID NO: 20382 - DNA, 675 bp, Dechloromonas aromatica RCB
  CDS (1)..(675): transl_table=11
atggccaacagcgactacaagacgatcgtcaaggacggtctgtgggacaacaacggcgtgttcagcatgctgcttggcatgtgtccctgcatggcgatgaccaccagcgccaccaacggcttcggcatggggctggcgacggcggtggtgatggccgcctcgagctacctggtggccgtgttccgcaaccggatcacgacggaagtgcggatcccggtgtatatcctgatcgttgccgccatggtgacggtggtcgatctgggcatgaacgcctggatgcatgagttgtacaaggtgctcggcctgttcatcccgctgatcgtctcaaactgcctgccgctggcccggcttgaagccttcgccgccaagcagtcgccgacgcctgccttcctggatggcttgttcatgggcctgggtttcacgattgccctgacggcgatcggcgccgttcgcgaaatcattggctccggcaccttgtttgccgatgcctcgctgctgctcgggccaagcttcaaggcgatcgagatgcgcctgctgccggcggacatgggcgtcctgatgatgatcctgccgccgggtggcttcatcgtcaccggtctgctcgtcgtcggcaagcgcctgatggatctggctgccggcaaggaaatccagatggccggtgcgcacgccctgtga

SEQ ID NO: 20383 - protein, 224 aa, Dechloromonas aromatica RCB
MANSDYKTIVKDGLWDNNGVFSMLLGMCPCMAMTTSATNGFGMGLATAVVMAASSYLVAVFRNRITTEVRIPVYILIVAAMVTVVDLGMNAWMHELYKVLGLFIPLIVSNCLPLARLEAFAAKQSPTPAFLDGLFMGLGFTIALTAIGAVREIIGSGTLFADASLLLGPSFKAIEMRLLPADMGVLMMILPPGGFIVTGLLVVGKRLMDLAAGKEIQMAGAHAL

SEQ ID NO: 20384 - DNA, 582 bp, Dechloromonas aromatica RCB
  CDS (1)..(582): transl_table=11
atgaaagaatttgccctgatgatgataggcgcggcactggtgaacaacgtgatcctggcgcgcttcctcggcctctgttcgttcatgggagtgacgacgcgggtcgataccgcggccggtatggggctggcgaccaccttcgtgatcactgtctcgtcgatggctgattgggcggtgcagacctacctgctcgatgcctacggcttgggcttcctgcgcacggtgaccttcatcctggtcattgccagcgcggtgcaatttaccgaaatgacgatcaagaaggtgtcgcccagcctgttccagatgctcggtatctacctgccgctgatcacgaccaattgcgcggtgctcggtgttgcgctgctgctggtcgaaggcaagatgggcttcctgagctcgacgatgttcgctttcgcctcgtcggtcggctacagcctggtcatgatcattttcgccggactgcgtgagcgccttgtcctggcccatgtcccccgcttgttcgccggtccccccatcgccttcatcgtcgccggcatgctggccatggcgttcatggggttttccggcatcgccacgagctga

SEQ ID NO: 20385 - protein, 193 aa, Dechloromonas aromatica RCB
MKEFALMMIGAALVNNVILARFLGLCSFMGVTTRVDTAAGMGLATTFVITVSSMADWAVQTYLLDAYGLGFLRTVTFILVIASAVQFTEMTIKKVSPSLFQMLGIYLPLITTNCAVLGVALLLVEGKMGFLSSTMFAFASSVGYSLVMIIFAGLRERLVLAHVPRLFAGPPIAFIVAGMLAMAFMGFSGIATS

SEQ ID NO: 20386 - DNA, 576 bp, Thiobacillus denitrificans ATCC 25259
  CDS (1)..(576): transl_table=11
gtggaaacctatatcctcattctcatctccacggtgttcgtgaacaacatcgtgatggccaagattctcggcttgtgtcccttcatgggggtgtcgaagaaactcgaaacggcgatcggcatggggctcgcgaccaccttcgtgctgacgctggcctcggggtcgagctacctgatcaacgaatacctgctcggcaccgacctgttctatctgcgcacgctgtccttcatcgtcgtgattgcgggcatcgtgcagttcaccgagatgttcatccacaagacgagcccggtgctgtatcaggtactcgggatctatctcccgctcatcacgacgaactgcgccgtgctcggaattccgctcctcaacgtccaggcgcagaacggcttcgtcgaatcgctgttcttcggcgccggcggcgcgatcggattcacgctcgtgctgatccttttcgccggcatccgcgagcgtctcgacacctgtgacgtgcctgccccgttcaagggcacgagcatcgcgatggtcaccgcgggactgatgtcgctcgccttcatgggcttctcgggcctggtcaagtaa

SEQ ID NO: 20387 - protein, 191 aa, Thiobacillus denitrificans ATCC 25259
METYILILISTVFVNNIVMAKILGLCPFMGVSKKLETAIGMGLATTFVLTLASGSSYLINEYLLGTDLFYLRTLSFIVVIAGIVQFTEMFIHKTSPVLYQVLGIYLPLITTNCAVLGIPLLNVQAQNGFVESLFFGAGGAIGFTLVLILFAGIRERLDTCDVPAPFKGTSIAMVTAGLMSLAFMGFSGLVK

SEQ ID NO: 20388 - DNA, 678 bp, Thiobacillus denitrificans ATCC 25259
  CDS (1)..(678): transl_table=11
atgatgaccctgagcgaattccgcagcctcttccacaacggcctcgtcaagcagaacacgggactcgtgcaactgctcggcctgtgcccgctgctcgcgatcagcaacaccgtcgtcaacgccctgtcgctcggcctggcgacgatgctcgtgatggcggcgtcgagcggcgcggtttcggccgcccgcaatttcgttccgaacgaaatccgcatcccggtcttcgtcctcatcatcgcggcgctggtgaccgtgatcgacctcgcgatgaacgccttcgtccatccgctctacctcgtgctcggcattttcattccgctcatcacgaccaactgcatcgtgctcgcccgcgccgacgccttcgccgccaagaaccggccgctgcacagcgtcgtcgacgcggtcgcgatgggcctcgggctgaccctggtgctgatcgtgctcggcgcgatgcgcgagctcgtcggacagggcacgctgttctcgggcatcgacctggtcttcggtgaagacgcgaagcagttcgtgctgcatgtgctgcccgattaccgcggcttcctgctcgcggtgctgccgcccggcgccttcattgcgctcggcctgctgatcgccgcgcacaactggaacaaggcgcgcgccgagcagcgcgcgcagctgaccgttcccgccacggcttga

SEQ ID NO: 20389 - protein, 225 aa, Thiobacillus denitrificans ATCC 25259
MMTLSEFRSLFHNGLVKQNTGLVQLLGLCPLLAISNTVVNALSLGLATMLVMAASSGAVSAARNFVPNEIRIPVFVLIIAALVTVIDLAMNAFVHPLYLVLGIFIPLITTNCIVLARADAFAAKNRPLHSVVDAVAMGLGLTLVLIVLGAMRELVGQGTLFSGIDLVFGEDAKQFVLHVLPDYRGFLLAVLPPGAFIALGLLIAAHNWNKARAEQRAQLTVPATA

SEQ ID NO: 20390 - DNA, 570 bp, Pseudomonas fluorescens PfO-1
  CDS (1)..(570)
atgaccgaactcgtgcttacgctcttcagtgctgcgctgatcaacaacttcgtgttgcactggccgctgggcgtcgttccgctgctgggcagtgagcgtcgacaagtgcatgcgctggggctggcaacgttgtgtctgatgctgcttgtcggtgtggcgggttacgtgctctggcattggctactggtgccgttgcaactggaattcctgcgcctgtttgtgtttatgccgttgagcatcttgctgatcacgccgttgctgaagctgttggcgcattggctcccggcgttgccattcgatggtttgtggccgctgctgctgggcaatgccggtgtgctggggctgatactgatcaacgcgcaagcggacaaaggcctgtttcatgcaattgcgctgagccttggcgccggcctgggtttctggctggtgttgagcctgttcagcgatttgcgtgagcgcacggccgacaacgatattcccctgccctttcgtggcctgccgatcctgttgatcggcgccggactgatggccgtggcttttctcggattcagtggactgatcaaaacatga

SEQ ID NO: 20391 - protein, 189 aa, Pseudomonas fluorescens PfO-1
MTELVLTLFSAALINNFVLHWPLGVVPLLGSERRQVHALGLATLCLMLLVGVAGYVLWHWLLVPLQLEFLRLFVFMPLSILLITPLLKLLAHWLPALPFDGLWPLLLGNAGVLGLILINAQADKGLFHAIALSLGAGLGFWLVLSLFSDLRERTADNDIPLPFRGLPILLIGAGLMAVAFLGFSGLIKT

SEQ ID NO: 20392 - DNA, 711 bp, Microbulbifer degradans 2-40
  CDS (1)..(711)
atggcaacttacagcgaaatcacctctaacggcttgtggaaaaacaaccccgcgctggtacaacttttgggtttatgcccacttctagcggtaactggctcggtagtaaatgctcttggtttaggcttggcaaccctgcttgtactcattgggtctaacgttgcggtttcgttaattcgcaatgcagttagcgatgctgtgcgcttaccggcctttgtgatgattattgctgcctttaccacctgcaccgaattagtgatgcaggcatttactttcgagctttatcaaatactaggtatttttattccgcttattgttaccaactgctctattctcggccgcgccgatgcctttgccagtaaaaacaaagtactgccttcagcagtagacggttttatgatgggtatgggctttttactagtgttactggtaattggcgcagtacgcgaaattattggcaacggcacacttttcgaaaacatgcatttgttgtttggtgaagcggcgcgcaactggcgactggatttatttggtgaaggctataaaggctttttggtggcggtattaccacccggcgcattcttagttacaggcctattaattgccgttaaaaatatggtggatgcagaattaaaacgccgcgaagatgcgcgtaaagccaaaccggtaaaaggctctaaacgcgtgcgtactacaggccaaatcgcttaa

SEQ ID NO: 20393 - protein, 236 aa, Microbulbifer degradans 2-40
MATYSEITSNGLWKNNPALVQLLGLCPLLAVTGSVVNALGLGLATLLVLIGSNVAVSLIRNAVSDAVRLPAFVMIIAAFTTCTELVMQAFTFELYQILGIFIPLIVTNCSILGRADAFASKNKVLPSAVDGFMMGMGFLLVLLVIGAVREIIGNGTLFENMHLLFGEAARNWRLDLFGEGYKGFLVAVLPPGAFLVTGLLIAVKNMVDAELKRREDARKAKPVKGSKRVRTTGQIA

SEQ ID NO: 20394 - DNA, 714 bp, Azotobacter vinelandii AvOP
  CDS (1)..(714): transl_table=11
atgagcaatcccagctatcgcgagctgagcgccaatgggctctggaagaacaatccggcactggtgcagcttctcggactctgtcctctgctcggcgtgagcaactccactgtcaatgccttgggactcgggctggccacgatcctggtattgggcagctccagcatggccgtatcgctggtacgcggggtggtgaatactgccgtgcgcctgccggttttcgtgatgatcatcgccgcactgaccacctgtatcgagctcctgatgcaggccttcacctatgagctttaccagatcctcggcatcttcatcccgttgattaccaccaactgcgtgatactcggtcgtgccgacggttttgccgctaggcattctctcctgctggcgggcttcgatggattgatgatggggttgggctttgccgtggtactcgtcatgctgggcggagtccgcgagatgttcggtaccggcggattgttcgccaacatgcatctgctgttcgggcccgcagcgaccgattggcatatcgcgctgatcgacgactacaaagggtttctgctagccatattgccgcccggggcctttatcgttctgggtctcctgatcgcggcaaagaaccggatcgacgagcaccgagccgaacgaagcaggacctttcagccacaaacctccagccccagccgccgcgtgcgagtgactggggtaatcgagtaa

SEQ ID NO: 20395 - protein, 237 aa, Azotobacter vinelandii AvOP
MSNPSYRELSANGLWKNNPALVQLLGLCPLLGVSNSTVNALGLGLATILVLGSSSMAVSLVRGVVNTAVRLPVFVMIIAALTTCIELLMQAFTYELYQILGIFIPLITTNCVILGRADGFAARHSLLLAGFDGLMMGLGFAVVLVMLGGVREMFGTGGLFANMHLLFGPAATDWHIALIDDYKGFLLAILPPGAFIVLGLLIAAKNRIDEHRAERSRTFQPQTSSPSRRVRVTGVIE

SEQ ID NO: 20396 - DNA, 579 bp, Shewanella baltica OS155
  CDS (1)..(579): transl_table=11
atgactgaatatctcctcttgttgatcagtacagtgctggtcaacaatttcgttttagtgaaattcttaggcctgtgcccttttatgggggtctccagcaaattggagtccgctattggcatgtctatggcgaccacttttgtgctgacgttagcctctattctcagttatctcgtcaaccagtatctgttattaccctttgacctgagttatctacgaaccatgagctttattttagtgattgccgttgttgtgcaatttactgaaatggtcgtgcaaaagaccagtgccgctctgcaccgtgccttagggatttacctgccgcttatcacgactaactgcgcggtattgggcgtagccttattaaacgtgaatgagaagcacgattttatccaatcggctatctatggctttggtgctgcgttaggcttctcattagtgttaattctcttctcggcgatgcgcgagcgtttagcggccgccgatgtccccttacctttcaaaggcggcgcgattgcgatgatcaccgcaggtcttatgtccctcgcctttatgggattcacaggattggttaagtaa

SEQ ID NO: 20397 - protein, 192 aa, Shewanella baltica OS155
MTEYLLLLISTVLVNNFVLVKFLGLCPFMGVSSKLESAIGMSMATTFVLTLASILSYLVNQYLLLPFDLSYLRTMSFILVIAVVVQFTEMVVQKTSAALHRALGIYLPLITTNCAVLGVALLNVNEKHDFIQSAIYGFGAALGFSLVLILFSAMRERLAAADVPLPFKGGAIAMITAGLMSLAFMGFTGLVK

SEQ ID NO: 20398 - DNA, 627 bp, Shewanella amazonensis SB2B
  CDS (1)..(627): transl_table=11
atggccaacgaactgaaaaaggttctgaccggacctattatcaataacaacccgattgcgctgcagatcctcggtgtttgtagtgcgctggcagtaaccagcaagctggaaactgcactggtgatgaccctggcgctgaccgcagtgactgcgttctcgaacctgttcatctccatgatccgtaaccacattccaagcagtgtgcgtattatcgtgcaaatggcgattatcgcctcgctggtaatcgtggttgatcaaatcctgcaagcttacgcctatgacgtggccaagcagctgtcagtattcgtgggccttatcatcactaactgtatcgtgatgggccgcgccgaagcctacgctatgaagactcctccaatgatgagctttatggatggtatcggtaacggtctgggctatggcgccatcctgctgtctgttggcttcgttcgtgaactgtttggtaacggttcgctgttcggcgtagagatcctgtccaagatctctgacggtggctggtatcagcccaacggtctgctcctgctgccgccaagtgcgttcttcctgatcggtgttctgatttggatcatccgcacctacaagcctgagcaagttgaagcaaaaggataa

SEQ ID NO: 20399 - protein, 208 aa, Shewanella amazonensis SB2B
MANELKKVLTGPIINNNPIALQILGVCSALAVTSKLETALVMTLALTAVTAFSNLFISMIRNHIPSSVRIIVQMAIIASLVIVVDQILQAYAYDVAKQLSVFVGLIITNCIVMGRAEAYAMKTPPMMSFMDGIGNGLGYGAILLSVGFVRELFGNGSLFGVEILSKISDGGWYQPNGLLLLPPSAFFLIGVLIWIIRTYKPEQVEAKG

SEQ ID NO: 20400 - DNA, 654 bp, Silicibacter sp. TM1040
  CDS (1)..(654): transl_table=11
atggcacaaacctatcgttcgcaactggtcgatccgctgatcgacaacaacccgatcacgttgcaggttctgggcatctgctcggcgcttgctgtgacctcctcgatgcaggtggcctttgtgatggcactggcggtgaccttcgtgaccggcttttcgtcgatgttcatctcgatgctgcgcaaccagatcccttcttcgatccggatcatcgtgcagatggtgatcatcgcctcgctggtgatcctggtggatcagctcctgaaggcctacgcctatgaaatctccaagacgctttcggtctttgtgggtctcatcatcaccaactgtatcgtgatgggccgcgccgaagcctttgcgatgaagaacccgcccgtggcgagctttatcgacggggttggcaatggtcttggttacgggcttttgctgctgatcgttgcattctttcgcgagcttttcggcgccggatcgctctttggtgtgaccattctggagaccgtgaacaacggcggctggtatgtgcccaacggcatgatgctgctgccgccgtcggccttctttgtgatcggccttctgatctgggggatccgcacatggaaaccggcacaggtcgaagagcgtgagtataaaattcagacggtggaggcccactga

SEQ ID NO: 20401 - protein, 217 aa, Silicibacter sp. TM1040
MAQTYRSQLVDPLIDNNPITLQVLGICSALAVTSSMQVAFVMALAVTFVTGFSSMFISMLRNQIPSSIRIIVQMVIIASLVILVDQLLKAYAYEISKTLSVFVGLIITNCIVMGRAEAFAMKNPPVASFIDGVGNGLGYGLLLLIVAFFRELFGAGSLFGVTILETVNNGGWYVPNGMMLLPPSAFFVIGLLIWGIRTWKPAQVEEREYKIQTVEAH

SEQ ID NO: 20402 - DNA, 579 bp, Shewanella denitrificans OS-217
  CDS (1)..(579): transl_table=11
atgacagagtatctcctgttgttgattggcactgtgctagtgaacaacttcgtattagttaaattcttaggtttatgtccctttatgggggtgtcgagcaagttggcttccgccatcggcatgtctatggcaaccaccttcgtattgaccttagcctcagtgctcagcttcctcactaatgagtttctactgcagcctttttcgctggaatacctgcgcaccatgagctttattctggtgattgctgtggtggtgcaatttactgaaatgctagtacaaaaaaccagtgccagtttgcatcgcgccttagggatttacttaccgcttattaccaccaattgcgccgtgttaggtgtggctttactcaatatcaatgaagatcataattttattgagtctgccatttatggttttggtgcggcggtgggcttttctatggtgctcattttattttccgccatgcgtgaacgcttagcggcggccgatgtaccactgccttttcgcggtggcgccattgctatgataacagcgggacttatgtcattagcctttatgggatttgcggggctgattaaataa

SEQ ID NO: 20403 - protein, 192 aa, Shewanella denitrificans OS-217
MTEYLLLLIGTVLVNNFVLVKFLGLCPFMGVSSKLASAIGMSMATTFVLTLASVLSFLTNEFLLQPFSLEYLRTMSFILVIAVVVQFTEMLVQKTSASLHRALGIYLPLITTNCAVLGVALLNINEDHNFIESAIYGFGAAVGFSMVLILFSAMRERLAAADVPLPFRGGAIAMITAGLMSLAFMGFAGLIK

SEQ ID NO: 20404 - DNA, 585 bp, Ectothiorhodospira halophila
  CDS (1)..(585): transl_table=11
atgacggaatacctgctactgctgctcggcgtcgccctggtgaacaatgtggtcctgacccagttcctggggctgtgcccgttcatgggtgtgtcgaaccgactggataccgccctgggcatgggcctggccaccaccttcgtactcacgttggcggcggcggccgggtgggtgatcgagcacgccctgctcatccccctggacctggagttcctgcgcatcctcagcttcatcctcgtcatcgccgggaccgtgcagttcaccgagatggccgtcgcccgggtcagccccgccctgcaccaggttctgggcgtcttcctgccgctgatcaccaccaactgcgccgtgctcggcgtggccctgctcaacatccaggaagcgcacacgttcgccgagagcctggtcttcggcgtcggagcggcgctcggtttcacgctggttctggtcctgttcgccggcctgcgcgagcggctggccacggcggcggtaccggccgcctttgccggtgcccccatcggcttcgtggtcgccgggctgctgtcgctggcgttcatgggactgaccggactgcccgaaggagggtga

SEQ ID NO: 20405 - protein, 194 aa, Ectothiorhodospira halophila
MTEYLLLLLGVALVNNVVLTQFLGLCPFMGVSNRLDTALGMGLATTFVLTLAAAAGWVIEHALLIPLDLEFLRILSFILVIAGTVQFTEMAVARVSPALHQVLGVFLPLITTNCAVLGVALLNIQEAHTFAESLVFGVGAALGFTLVLVLFAGLRERLATAAVPAAFAGAPIGFVVAGLLSLAFMGLTGLPEGG

SEQ ID NO: 20406 - DNA, 573 bp, Pseudomonas stutzeri
  CDS (1)..(573): transl_table=11
atggaatatgcgctgtttctgatcggcaccgtgctggtcaacaacgtggtgctggtctacttcctcggcctgtgtccgttcatgggggtctccggcaagctcgacccctcgctgggcatgggcttggcgacgaccctggtgatgaccctgggcggcgtcagcagctggctgctagaacgctacgtgctgcagccgctgggcatcggctttttgcgcatcctctcctacatcctggtgatcgccggcctggtgcagctgatcgagatgatcatccgcagggttagcccgccgctgtatcgctcgctgggcatctacctgccgctgatcaccaccaactgcgccgtgctgggcgtgccgctgatcagcgtgcgcgaaggccacaggctggccgaggcggggctgttcggcctgggctcggcgctgggcttcaccctggtcatggtgatcttcgccggcttgcgcgagcgcctggcgctggccagcgtgccggcggccttcgccggcgcaccgatcgctttcgtcaccgccgggttgctggcgatggctttcatgggcttcgccggcctgatctga

SEQ ID NO: 20407 - protein, 190 aa, Pseudomonas stutzeri
MEYALFLIGTVLVNNVVLVYFLGLCPFMGVSGKLDPSLGMGLATTLVMTLGGVSSWLLERYVLQPLGIGFLRILSYILVIAGLVQLIEMIIRRVSPPLYRSLGIYLPLITTNCAVLGVPLISVREGHRLAEAGLFGLGSALGFTLVMVIFAGLRERLALASVPAAFAGAPIAFVTAGLLAMAFMGFAGLI

SEQ ID NO: 20408 - DNA, 642 bp, Chlamydophila caviae
  CDS (1)..(642): transl_table=11
atggcagcaaataaatcatataagagttatttccttgatcctctttggggtaacaaccaaccgcttattgctattttagggatttgttctgcacttgctgtaacaacaacagtaaacacggcgattactatgggtcttgctgtaagctttgttacaggatgctcctcattctttgtatctttattacgcaaagcgactcctgatagcgtccgtatgatcacacagctcattattattagcttatttgtgattgttattgatcagtttttaaaagcctttttctttactatctcaaaaacgctttccgtttttgttggattgattatcaccaactgtatcgttatgggaagagctgaaagcctagcaagaaatgttccccctattccagcatttttagatggtcttgcatcgggattaggttacggttgggtattagttactgtgagtatagtcagagagttcttcggctttggtactattcttggattacaacttatcccaaaatgtttctacgcgtccgaaacccatcctgatggatatgaaaactttggtttgatggttttagcgccctcagcatttttccttttaggcattatgatttggggagtgaatattcttagatctaagaaagcaaaaaggtaa

SEQ ID NO: 20409 - protein, 213 aa, Chlamydophila caviae
MAANKSYKSYFLDPLWGNNQPLIAILGICSALAVTTTVNTAITMGLAVSFVTGCSSFFVSLLRKATPDSVRMITQLIIISLFVIVIDQFLKAFFFTISKTLSVFVGLIITNCIVMGRAESLARNVPPIPAFLDGLASGLGYGWVLVTVSIVREFFGFGTILGLQLIPKCFYASETHPDGYENFGLMVLAPSAFFLLGIMIWGVNILRSKKAKR

SEQ ID NO: 20410 - DNA, 642 bp, Chlamydia muridarum
  CDS (1)..(642): transl_table=11
atgacaaccaataaatcctctttaagctactttactgatgctttgtggatcaataaccagcctctcgtcgctattctagggatctgttcagctcttgctgttaccaccacagtaacaacggctttaacaatgggattagccgttagctttgttaccggattcgcttcttttgttgtatctttactaagaaaaattactccagaaagcgttcgaatgatcgctcagcttatcatcattagcctttttgtgatccttatcgaccaatttttaaaagccttttttttcaatatttccaaaacgctttctgtttttgttggtctaatcattactaactgtattgtcatgggacgagcagaaagtatggctagacatatttctcctattcctgcgtttttagatggtctgggatcgggacttggatatgggtgggttcttgtttgcatcagtatcattagagagttattcgggtttggaaccattttaggcttccacatcattcctaagattttttatgcttcagcagctcaccccgatggatatgaaaacttagggttgatggttttagctccatcagcatttttcctattaggaatcatggtttggctggtgaatattgttagagcttcaaagacaaagaggtaa

SEQ ID NO: 20411 - protein, 213 aa, Chlamydia muridarum
MTTNKSSLSYFTDALWINNQPLVAILGICSALAVTTTVTTALTMGLAVSFVTGFASFVVSLLRKITPESVRMIAQLIIISLFVILIDQFLKAFFFNISKTLSVFVGLIITNCIVMGRAESMARHISPIPAFLDGLGSGLGYGWVLVCISIIRELFGFGTILGFHIIPKIFYASAAHPDGYENLGLMVLAPSAFFLLGIMVWLVNIVRASKTKR

SEQ ID NO: 20412 - DNA, 642 bp, Chlamydia pneumoniae
  CDS (1)..(642): transl_table=11
atgacaagtaaaaagtcctataaaagctatttctttgatcctctatggagcaacaaccaaattctcattgcgattttggggatttgctcggctctggcagtgacaacaacagtacaaacggcaattactatgggaattgctgtcagcattgttacaggatgctcgtctttctttgtttccttattacgtaagttcactcctgacagtgtgagaatgattactcagctaattatcattagcttgtttgtgattgttatcgaccagtttttaaaagcttttttctttgatatttccaaaacactttctgtttttgtgggtcttatcatcaccaattgcatcgtgatgggaaggtctgaaagtctagctaggcatgtgactcctattccagcgttcttagatgggtttgcctctggcttaggatacggctgggtcttacttgtcattggagtcatcagagaactctttggttttggaactcttatggggtttcgcatcatccctcaatttgtttatgcttccgaaacccaccccgatggataccaaaatttaagtcttatggtgctagcaccgtcggcttttttcctacttggtattatgatttggcttgttaacattcgagactctaaaaagagaaaaaggtag

SEQ ID NO: 20413 - protein, 213 aa, Chlamydia pneumoniae
MTSKKSYKSYFFDPLWSNNQILIAILGICSALAVTTTVQTAITMGIAVSIVTGCSSFFVSLLRKFTPDSVRMITQLIIISLFVIVIDQFLKAFFFDISKTLSVFVGLIITNCIVMGRSESLARHVTPIPAFLDGFASGLGYGWVLLVIGVIRELFGFGTLMGFRIIPQFVYASETHPDGYQNLSLMVLAPSAFFLLGIMIWLVNIRDSKKRKR

SEQ ID NO: 20414 - DNA, 642 bp, Chlamydia trachomatis
  CDS (1)..(642): transl_table=11
atgaccactaataaatcctacttaacctattttacagatgcgttgtggatcaacaatcaacctttgatcgctatcttaggtatctgctcagctcttgcggttacgactacggtgactacagctctaactatgggattcgcggttagctttgtcactggctgttcctcttttgttgtttctttgcttaggaaaattactcccgaaagtgttcggatgatcgctcagctaattatcattagcctatttgtgatcttaattgaccagtttttgaaagcttttttctttactatttcgaaaaccctctccgtttttgttggattaatcattactaactgcattgtcatggggcgagcagaaagtatggctagacacgtttcacctattccagcgtttttagatggattaggatctggcctcggctatgggtgggtacttgtttgcattagtatcattagagagctatttggcttcggaactattctaggatttcgtgtcattcctgaaattctatacacttcagcagcacaccctgatggatacgaaaacctaggtctgatggttttagctccatccgcatttttccttttagggatcatgatttggatcgtaaacattattagagctccaaagacaaagaggtag

SEQ ID NO: 20415 - protein, 213 aa, Chlamydia trachomatis
MTTNKSYLTYFTDALWINNQPLIAILGICSALAVTTTVTTALTMGFAVSFVTGCSSFVVSLLRKITPESVRMIAQLIIISLFVILIDQFLKAFFFTISKTLSVFVGLIITNCIVMGRAESMARHVSPIPAFLDGLGSGLGYGWVLVCISIIRELFGFGTILGFRVIPEILYTSAAHPDGYENLGLMVLAPSAFFLLGIMIWIVNIIRAPKTKR

SEQ ID NO: 20416 - DNA, 624 bp, Haemophilus ducreyi
  CDS (1)..(624): transl_table=11
atggcaaataacaatcttaaaaagttattgttatctccaatctcagataacaatccaattgcattacagatcttaggtatttgttctgcgcttgctgtaactacacagttacaaacagcattcgtaatggccattgcggtgagtttagtaaccgcattctctagtatgtttatttcaatgatccgtaactatattccaaatagtattcgtattattgtacaaatggcaattattgcttctttggttattcttgtagaccaaatattgcgtgcctatgtttatgacttatcgaaacagctttctgtttttgttggtcttattattactaactgtatcgttatgggacgtgcagaagcatttgcaatgaaatcagctccgcttgaaagttttgtagatggtattggtaatggcttaggttatggtgcgatgttagttattgtcgcttttttacgcgaattaattggttcaggtaaaatctttggtgttactgttttacaaactatccaagatggtggttggtatcaagcgaatggtttattcttattagcaccaagtgcgttctttatcatcggttttgtgatttgggcgatcagaacttggaaaccagagcaagtggagaaataa

SEQ ID NO: 20417 - protein, 207 aa, Haemophilus ducreyi
MANNNLKKLLLSPISDNNPIALQILGICSALAVTTQLQTAFVMAIAVSLVTAFSSMFISMIRNYIPNSIRIIVQMAIIASLVILVDQILRAYVYDLSKQLSVFVGLIITNCIVMGRAEAFAMKSAPLESFVDGIGNGLGYGAMLVIVAFLRELIGSGKIFGVTVLQTIQDGGWYQANGLFLLAPSAFFIIGFVIWAIRTWKPEQVEK

SEQ ID NO: 20418 - DNA, 627 bp, Haemophilus influenzae
  CDS (1)..(627): transl_table=11
atgtctggaaaaacaagttataaagatctgttgttagcgccaattgctaaaaacaaccctattgcattgcaaatcttagggatttgttctgcattagctgtaacaacaaaattagaaactgcttttgttatggcgattgcagttaccttagtaactggattatcaaacttatttgtttccctaatccgcaattatatccctaacagcattcgtattattgtacagctcgcaatcatcgcttcgcttgttatcgtagtggatcaaattctaaaagcctatgcttatggtttatctaaacaactttcagtattcgttggtttgattattactaactgtatcgtaatggggcgtgctgaagcatttgcgatgaaatcccctccagttgaaagttttgtagatggtatcggaaatggcttaggttatggttcaatgttaattatcgtagcatttttccgtgaacttatcggttcaggtaaattatttggtatgacgattttcgaaactattcaaaatggtggctggtatcaagcaaatggtttattcctacttgcaccaagtgcattctttatcatcggatttgtgatctggggattaagaacttggaaaccagaacaacaggagaagtaa

SEQ ID NO: 20419 - protein, 208 aa, Haemophilus influenzae
MSGKTSYKDLLLAPIAKNNPIALQILGICSALAVTTKLETAFVMAIAVTLVTGLSNLFVSLIRNYIPNSIRIIVQLAIIASLVIVVDQILKAYAYGLSKQLSVFVGLIITNCIVMGRAEAFAMKSPPVESFVDGIGNGLGYGSMLIIVAFFRELIGSGKLFGMTIFETIQNGGWYQANGLFLLAPSAFFIIGFVIWGLRTWKPEQQEK

SEQ ID NO: 20420 - DNA, 627 bp, Neisseria meningitidis serogroup A
  CDS (1)..(627): transl_table=11
atggctgatatgaaacgcttgaaacatttgatgttttcaccctttatcgacaacaacccgattgccttgcaggttttgggtatttgttcggctttggcggttaccaccaaacttcagacggccatcgtgatgggtatttccgtagctttggtaaccggtttttccagcttcttcatttcgctggtacgcaactacatccccaacagcatccgcatcatcgtgcaaatggcgattatcgcgtcgctggttacgctggtcgaccaactcttgcaggcatttgcctacgaattgtccaaacagctttccgtattcgtcggtctgattattaccaactgtatcgtgatgggccgcgccgaagcatttgcgatgaaagagccgccgctggaaagcctgatcgacggcatcggcaacggcgcgggctacgggatgatgctgcttgtcgtcgccaccgtccgcgaactgattggctcgggcaaactcttgggctacaccgttttccaaaccgtgcaggacggcggctggtatcagaccaacggcttgttcctgctcgcccccagcgcgttcttcatcatcggctttttgatttggggactgcgtacctggaaacccgaacaggcggaggaataa

SEQ ID NO: 20421 - protein, 208 aa, Neisseria meningitidis serogroup A
MADMKRLKHLMFSPFIDNNPIALQVLGICSALAVTTKLQTAIVMGISVALVTGFSSFFISLVRNYIPNSIRIIVQMAIIASLVTLVDQLLQAFAYELSKQLSVFVGLIITNCIVMGRAEAFAMKEPPLESLIDGIGNGAGYGMMLLVVATVRELIGSGKLLGYTVFQTVQDGGWYQTNGLFLLAPSAFFIIGFLIWGLRTWKPEQAEE

SEQ ID NO: 20422 - DNA, 627 bp, Neisseria meningitidis serogroup B
  CDS (1)..(627): transl_table=11
atggctgatatgaaacgcttgaaacatttgatgttttcaccctttatcgacaacaacccgattgccttgcaggttttgggtatttgttcggctttggcggttaccaccaaacttcagacggccatcgtgatgggtatttccgtagctttggtaaccggtttttccagcttcttcatttcgctggtacgcaactacatccccaacagcatccgtattatcgtgcaaatggcgattatcgcgtcgctggttacgctggtcgaccaactcttgcaggcatttgcctacgaattgtccaaacagctttccgtattcgtcggtctgattattaccaactgtatcgtgatgggccgcgccgaagcatttgcgatgaaagagccgccgctggaaagcctgatcgacggcatcggcaacggcgcgggctacgggataatgctgcttgtcgtcgccaccgtccgcgaactgattggctcgggcaaactcttgggctacaccgttttccaaaccgtgcaggacggcggctggtatcagaccaacggcttgttcctgctcgcccccagcgcgttcttcatcatcggctttttgatttggggactgcgtacctggaaacccgaacaggcggaggaataa

SEQ ID NO: 20423 - protein, 208 aa, Neisseria meningitidis serogroup B
MADMKRLKHLMFSPFIDNNPIALQVLGICSALAVTTKLQTAIVMGISVALVTGFSSFFISLVRNYIPNSIRIIVQMAIIASLVTLVDQLLQAFAYELSKQLSVFVGLIITNCIVMGRAEAFAMKEPPLESLIDGIGNGAGYGIMLLVVATVRELIGSGKLLGYTVFQTVQDGGWYQTNGLFLLAPSAFFIIGFLIWGLRTWKPEQAEE

SEQ ID NO: 20424 - DNA, 627 bp, Pasteurella multocida
  CDS (1)..(627): transl_table=11
atggctgatactaaaaagttaaaaggcttgttgctatcgccagtgatggacaacaacccgattgcgttacaaattttagggatttgttctgcgttagcggtaacaaccaaattagaaacggcaattgtaatgacgtttgcggtaattttcgttacggcattctcaaacttatttatttctttgatccgtaactatattccaaacagtgtacgtattatcgtgcaaatggcgattatcgcctcgttggttatcttagttgaccaaatcttacgtgcttatgcctatggtttatcaaaacaactttcggttttcgtgggcttgattattactaactgtatcgttatgggacgagcagaagcctttgcgatgaaatcacaaccactagaaagtttcgttgatgggattggtaacggcttaggttatggcgcaattttagtgtcagttgcctttatccgtgaattaattggttcaggcaaattatttggtatgacggtattccaaactatccaagatggtggttggtatcaaaccaatggtttattcctacttgcaccaagtgcgttctttattattggttttattatttggggtattcgtaccttaaaaccaaatcaggtggagaagtag

SEQ ID NO: 20425 - protein, 208 aa, Pasteurella multocida
MADTKKLKGLLLSPVMDNNPIALQILGICSALAVTTKLETAIVMTFAVIFVTAFSNLFISLIRNYIPNSVRIIVQMAIIASLVILVDQILRAYAYGLSKQLSVFVGLIITNCIVMGRAEAFAMKSQPLESFVDGIGNGLGYGAILVSVAFIRELIGSGKLFGMTVFQTIQDGGWYQTNGLFLLAPSAFFIIGFIIWGIRTLKPNQVEK

SEQ ID NO: 20426 - DNA, 675 bp, Pseudomonas aeruginosa
  CDS (1)..(675): transl_table=11
gtgatggctgctcaacccacgatccgcgaagtcctgttcaatccggtcttccagaacaatccgatcggcctgcagatcctcgggatctgctcggcgctggcggtaacctcgaacctgaagaccgctaccgtcatggccatcgccctgaccctggtgaccggcttctccaacctgttcatctcgatgatccgccggcagattcccagctcgatccggatgatcgtgcagatggtgatcatcgcctcgctggtgatcgtcgtcgaccaggtgctcaaggcctatgcctatagcctgagcaagcagctctcggtgttcgtcgggctgatcatcaccaactgcatcgtgatgggccgcgccgaagccttcgccatggccaacccgccgctcgtgtcgttcttcgacggcatcggcaacggtctcggctacagcgccatgctgctggtgctgggcttcgtccgcgagctgttcggcgccggcaagctctacggcatcagcgtgttgccgacggtcaacgatggcggctggtaccagccgaacggcctgctcctgttgccgccttcggcgttcttcctgatcggcctgatcatctgggccctgcggacctggaagaaagaccaggtcgaggccccgacctacaagatggccccgcaggtatccagcaaggaggcttactga

SEQ ID NO: 20427 - protein, 224 aa, Pseudomonas aeruginosa
MMAAQPTIREVLFNPVFQNNPIGLQILGICSALAVTSNLKTATVMAIALTLVTGFSNLFISMIRRQIPSSIRMIVQMVIIASLVIVVDQVLKAYAYSLSKQLSVFVGLIITNCIVMGRAEAFAMANPPLVSFFDGIGNGLGYSAMLLVLGFVRELFGAGKLYGISVLPTVNDGGWYQPNGLLLLPPSAFFLIGLIIWALRTWKKDQVEAPTYKMAPQVSSKEAY

SEQ ID NO: 20428 - DNA, 633 bp, Vibrio alginolyticus
  CDS (1)..(633)
atgtctagtgcacaaaacgttaaaaagagcattctagcgccagtattggataacaacccaatcgcgctacaagttcttggtgtatgttctgctcttgcagtaacaactaaactagaaacagcttttgtaatgacgctagcggtaacatttgtaactgcgctgtctaacttctctgtttcattgatccgtaaccacattcctaacagtgtgcgtatcatcgttcagatggcaattatcgcatcgctagtaatcgtggtagaccaggtgctaaaagcttacctatacgatatctctaaacagctatctgtattcgttggtctgattatcactaactgtatcgtaatgggtcgtgctgaagcattcgcaatgaagtctgcgccagtaccatctcttattgacggtattggtaacggtctaggttacggtttcgttcttatcactgtaggtttcttccgtgagctatttggctcaggcaagctatttggcctagaagttctacctctagtgagcaacggtggttggtaccagcctaacggcctaatgctactagcaccatcagcattcttcctaatcggcttccttatctgggtaatccgtattctgaaaccagaacaagtagaagcgaaggagtaa

SEQ ID NO: 20429 - protein, 210 aa, Vibrio alginolyticus
MSSAQNVKKSILAPVLDNNPIALQVLGVCSALAVTTKLETAFVMTLAVTFVTALSNFSVSLIRNHIPNSVRIIVQMAIIASLVIVVDQVLKAYLYDISKQLSVFVGLIITNCIVMGRAEAFAMKSAPVPSLIDGIGNGLGYGFVLITVGFFRELFGSGKLFGLEVLPLVSNGGWYQPNGLMLLAPSAFFLIGFLIWVIRILKPEQVEAKE

SEQ ID NO: 20430 - DNA, 633 bp, Vibrio anguillarum
  CDS (1)..(633): transl_table=11
atgtctagcgcaaaagagattaaaaagagcattctagcgccagtgttggataacaacccaattgcacttcaagtgcttggtgtctgttctgcccttgcggtaaccactaaattggaaacggcgtttgttatgacgctagccgttatgtttgtaacggctttctctaacttattcgtttcgttaattcgtcaccacatacctaacagtgtgcgtatcatcgttcagatggcgatcattgcttcattggttattgttgttgaccagatcctacgtgcttatttatacgatatctcgaaacagctatcggtgttcgtagggttgatcattactaactgtatcgtaatgggccgtgctgaagcatttgcaatgaagtcggcaccgattccttcctttatcgatggtatcggtaatggtctgggttatggttttgtattgatcactgttggtttcttccgcgaacttcttggttcaggcaagctatttggaatggaagttctacctcttgtgaaagatggtggctggtatcaacctaacggtttgatgctgctagcaccttcggcattcttcctaattggcttcatgatttgggcgattcgcacgttcaaacctgaacaactagaagcgaaggagtaa

SEQ ID NO: 20431 - protein, 210 aa, Vibrio anguillarum
MSSAKEIKKSILAPVLDNNPIALQVLGVCSALAVTTKLETAFVMTLAVMFVTAFSNLFVSLIRHHIPNSVRIIVQMAIIASLVIVVDQILRAYLYDISKQLSVFVGLIITNCIVMGRAEAFAMKSAPIPSFIDGIGNGLGYGFVLITVGFFRELLGSGKLFGMEVLPLVKDGGWYQPNGLMLLAPSAFFLIGFMIWAIRTFKPEQLEAKE

SEQ ID NO: 20432 - DNA, 633 bp, Vibrio cholerae
  CDS (1)..(633): transl_table=11
atgtctagcgcaaaagagctgaaaaagagtgtgttagccccagttttggacaacaacccgattgcactgcaagttctgggtgtgtgttctgcactggcggtaaccactaagctggaaacggcatttgttatgacgctagcggtaatgtttgttactgcattgtctaacttcttcgtttctctgatccgtaaccacattcctaacagtgtgcgtattatcgtacaaatggcgattatcgcttcgttagttatcgtggtagaccagattctgaaagcgtatctgtacgatatttctaagcaactgtcggtattcgttggtctgattatcaccaactgtatcgtaatgggtcgtgcagaagcgtttgcaatgaagtctgaaccaattccttctttcattgatggtattggtaacggtttaggatacggtttcgtgctgatgacggttggtttcttccgtgagcttttaggctcaggtaagctatttggcttggaagttctgcctctgatcagcaacggtggttggtatcagccaaacggcctgatgctactcgcaccttcagcattcttcctgatcggcttcatgatttgggcgattcgcacgttcaaaccagaacaagtagaagcgaaggagtaa

SEQ ID NO: 20433 - protein, 210 aa, Vibrio cholerae
MSSAKELKKSVLAPVLDNNPIALQVLGVCSALAVTTKLETAFVMTLAVMFVTALSNFFVSLIRNHIPNSVRIIVQMAIIASLVIVVDQILKAYLYDISKQLSVFVGLIITNCIVMGRAEAFAMKSEPIPSFIDGIGNGLGYGFVLMTVGFFRELLGSGKLFGLEVLPLISNGGWYQPNGLMLLAPSAFFLIGFMIWAIRTFKPEQVEAKE

SEQ ID NO: 20434 - DNA, 633 bp, Vibrio harveyi
  CDS (1)..(633): transl_table=11
atgtctagcgcacaaaacattaaaaagagcattatggcgccggtgttggacaacaacccgatcgcgctgcaggttcttggtgtatgttctgctcttgcagtaacaactaaactagaaacagcatttgtaatgacactagcggtaactttcgtaactgcactgtctaacttctctgtttctttaatccgtaaccacattcctaacagtgtgcgtatcatcgtacagatggcaatcatcgcatcgctagtaatcgtggtagaccaagtgcttaaagcttacctatacgatatctctaaacagctatctgtattcgtaggtcttatcatcacgaactgtatcgtaatgggtcgtgctgaagcattcgcaatgaaatctgcaccagtaccatcgctaatcgacggtatcggtaacggtctaggttacggcttcgttcttatcactgtaggcttcttccgtgaactatttggttcaggcaagctattcggtatggaagttctaccactagtgagcaacggtggttggtaccagccaaacggtctaatgctactagcaccatctgcattcttcctaatcggcttcctgatctgggtaatccgtattctgaagccagaacaagtagaagcgaaggagtaa

SEQ ID NO: 20435 - protein, 210 aa, Vibrio harveyi
MSSAQNIKKSIMAPVLDNNPIALQVLGVCSALAVTTKLETAFVMTLAVTFVTALSNFSVSLIRNHIPNSVRIIVQMAIIASLVIVVDQVLKAYLYDISKQLSVFVGLIITNCIVMGRAEAFAMKSAPVPSLIDGIGNGLGYGFVLITVGFFRELFGSGKLFGMEVLPLVSNGGWYQPNGLMLLAPSAFFLIGFLIWVIRILKPEQVEAKE

SEQ ID NO: 20436 - DNA, 633 bp, Vibrio parahaemolyticus
  CDS (1)..(633): transl_table=11
atgtctagcgcacaaaacattaaaaagagcattatggcgccggtgttggataacaacccgatcgcgctacaagttcttggtgtatgttctgctcttgcagtaacaactaaactagaaacggcgtttgtaatgacactagcggtaacattcgtaactgctctgtctaacttctctgtttctctgatccgtaaccacattcctaacagtgtgcgtatcatcgttcaaatggcgatcatcgcatctctagtaatcgtggtagaccaggtgctaaaagcttacctatacgatatctctaaacagctatcagtattcgttggcctgatcatcacaaactgtatcgtaatgggtcgtgctgaagcattcgcaatgaagtctgcgccagtaccttctctaatcgacggtattggtaacggtctaggttacggtttcgttcttatcactgttggtttcttccgtgagctattcggctcaggcaaactatttggtatggaagtactacctctagtgagcaacggtggttggtaccagcctaacggtctaatgctactagcaccatctgcattcttcctaatcggcttcctgatctgggtaatccgtgtgtttaaaccagaacaagtagaagcgaaggagtaa

SEQ ID NO: 20437 - protein, 210 aa, Vibrio parahaemolyticus
MSSAQNIKKSIMAPVLDNNPIALQVLGVCSALAVTTKLETAFVMTLAVTFVTALSNFSVSLIRNHIPNSVRIIVQMAIIASLVIVVDQVLKAYLYDISKQLSVFVGLIITNCIVMGRAEAFAMKSAPVPSLIDGIGNGLGYGFVLITVGFFRELFGSGKLFGMEVLPLVSNGGWYQPNGLMLLAPSAFFLIGFLIWVIRVFKPEQVEAKE

SEQ ID NO: 20438 - DNA, 633 bp, Vibrio vulnificus
  CDS (1)..(633): transl_table=11
atgtctagtgcacaaaacattaaaaagagcattcttgcgccagtattggataacaacccaatcgcgctacaagttcttggtgtatgttctgcgcttgcagtaactaccaaactagaaacagcgtttgttatgacactagcggtaacgtttgtaactgcattgtctaacttctttgtttctttaatccgtaaccacattcctaacagtgtgcgtatcatcgttcaaatggcgatcatcgcatctctagtaatcgtggtagaccagatcttgaaagcttacttgtacgatatctctaaacagctatcggtattcgtaggtcttatcattactaactgtatcgtaatgggtcgtgcagaagcgttcgcgatgaaatctgcaccagttccatcattgatcgacggtattggtaacggtcttggttatggttttgttcttattactgtgggcttcttccgtgaactattcggtagcggtaagttgtttggtatggaagtactaccactagtgaacaatggtggttggtatcagccaaatggtctgatgcttctagcgccatctgcattcttcctaatcggcttcatgatttgggcgatccgtacgttcaaaccagagcaagtagaagcgaaggagtaa

SEQ ID NO: 20439 - protein, 210 aa, Vibrio vulnificus
MSSAQNIKKSILAPVLDNNPIALQVLGVCSALAVTTKLETAFVMTLAVTFVTALSNFFVSLIRNHIPNSVRIIVQMAIIASLVIVVDQILKAYLYDISKQLSVFVGLIITNCIVMGRAEAFAMKSAPVPSLIDGIGNGLGYGFVLITVGFFRELFGSGKLFGMEVLPLVNNGGWYQPNGLMLLAPSAFFLIGFMIWAIRTFKPEQVEAKE

SEQ ID NO: 20440 - DNA, 633 bp, Vibrio vulnificus
  CDS (1)..(633): transl_table=11
atgtctagtgcacaaaacattaaaaagagcattcttgcgccagtattggataacaacccaatcgcgctacaagttcttggtgtatgttctgcgcttgcagtaactaccaaactagaaacagcgtttgttatgacattagcggtaacgtttgtaactgcattgtctaacttctttgtttctgtaatccgtaaccacattcctaacagtgtgcgtatcatcgttcaaatggcgatcatcgcatctctagtaatcgtggtagaccagatcttgaaagcttacttgtacgatatctctaaacagctatcggtattcgtaggtcttatcattactaactgtatcgtaatgggtcgtgcagaagcgttcgcgatgaaatctgcaccagttccatcactgatcgacggtattggtaacggtcttggttatggttttgttcttattactgtgggcttcttccgtgaactattcggtagcggtaagttgtttggtatggaagtactaccactagtgaacaatggtggttggtatcagccaaatggtctgatgcttctagcgccatctgcattcttcctaatcggcttcatgatttgggcgatccgtacgttcaaaccagagcaagtagaagcgaaggagtaa

SEQ ID NO: 20441 - protein, 210 aa, Vibrio vulnificus
MSSAQNIKKSILAPVLDNNPIALQVLGVCSALAVTTKLETAFVMTLAVTFVTALSNFFVSVIRNHIPNSVRIIVQMAIIASLVIVVDQILKAYLYDISKQLSVFVGLIITNCIVMGRAEAFAMKSAPVPSLIDGIGNGLGYGFVLITVGFFRELFGSGKLFGMEVLPLVNNGGWYQPNGLMLLAPSAFFLIGFMIWAIRTFKPEQVEAKE

SEQ ID NO: 20442 - DNA, 630 bp, Yersinia pestis
  CDS (1)..(630): transl_table=11
atggctgatagcaaagagattaaacgggtcttattaagcccattgtttgataacaacccgattgccttgcaaatccttggggtttgctcagcactggcggtgaccactaagctggagacagcattagtgatgactctggcagtcacgctggtgactgcgttttcgagtttcttcatctcattgattcgaaatcacatcccaaacagcgtaaggattatcgttcagatggtcatcattgcttcgctggtgattgtggtagaccaagtattacgtgcttatgcctatgaaatttccaagcagttgtcggtgttcgttggcttgattattacgaactgtatcgtcatgggccgtgctgaagcttatgcgatgaaatcaccgccaattgaaagttttatggatggtatcggtaatggcctggggtacggcgtaatactggttctggtcggttttgtccgcgaattggttggttcaggcaagctatttggcgtgacggtattggaaacggtgcaaaacggtgggtggtatctacctaacggattattcctgctggcacctagtgcattctttattattggtctgctgatttggggcctacggaccttgaaacctgcgcagattgagaaggagtaa

SEQ ID NO: 20443 - protein, 209 aa, Yersinia pestis
MADSKEIKRVLLSPLFDNNPIALQILGVCSALAVTTKLETALVMTLAVTLVTAFSSFFISLIRNHIPNSVRIIVQMVIIASLVIVVDQVLRAYAYEISKQLSVFVGLIITNCIVMGRAEAYAMKSPPIESFMDGIGNGLGYGVILVLVGFVRELVGSGKLFGVTVLETVQNGGWYLPNGLFLLAPSAFFIIGLLIWGLRTLKPAQIEKE

SEQ ID NO: 20444 - DNA, 795 bp, Chlamydophila caviae
  CDS (1)..(795): transl_table=11
atgtggttaggcgaatatacatggctaaatgtctttggtatctttttacaagcaaccttcatccaaaacatccttctatcgaatttccttgggatgtgtagctatcttgcctgttccgcgcgagtttctactgctaatggcttaggaatgtctgtagccttagtactgacagttactggaagcattaactgggtcgtgcatacatttattaccgggcctaaagctttaacttggatatccccctcattagccaatgtaaatctaaatttccttgagctgattatcttcattgtagttattgctgccttcacacagatcttggaactacttttagaaaaggtatccagaaatctctatctttccttagggatcttcctaccgttaattgctgtaaattgtgcaattttaggaggcgtgctctttgggattacacggaattatccatttatccctatgatgatattctctttaggagcaggatgcggttggtggttagctattgtcttatttgcaactattaaagaaaaacttgcctattctgatattcctaaaaaccttcaaggcatggggatctccttcattaccacaggacttatagctatggcctttatgagtcttacaggtattgatatctctaagccatcagcagcagcaccaacatcggatattctagaaacaccaaatgcttcttcgataacaacaacaaatctaaaacctgtgaaaaaagtacgaatagcacaacaacgtgctgctaaggaaaaagcaataaatataaaaagaggaaaaactcagtaa

SEQ ID NO: 20445 - protein, 264 aa, Chlamydophila caviae
MWLGEYTWLNVFGIFLQATFIQNILLSNFLGMCSYLACSARVSTANGLGMSVALVLTVTGSINWVVHTFITGPKALTWISPSLANVNLNFLELIIFIVVIAAFTQILELLLEKVSRNLYLSLGIFLPLIAVNCAILGGVLFGITRNYPFIPMMIFSLGAGCGWWLAIVLFATIKEKLAYSDIPKNLQGMGISFITTGLIAMAFMSLTGIDISKPSAAAPTSDILETPNASSITTTNLKPVKKVRIAQQRAAKEKAINIKRGKTQ

SEQ ID NO: 20446 - DNA, 735 bp, Chlamydia muridarum
  CDS (1)..(735): transl_table=11
atgtggttaggagactattctttaataaatctcttaggcatctttttgcaagccacctttatccaaaatattttgctttccacatttttagggatgtgcagctatttagcctgttcttctcgcttgtcaacagccaacggcttagggatgtctgtagctctcgtacttaccattacaggaagtattaactggttgatccaccattttgtcacagggcctcatgccttatcctggctatctcctgcattagcaaatatagatctcagctttttagaattgattacatttattgttgttatcgcagcattcacacaaattttagagctccttctggagcgattttcaagaaacctctatttagctttaggaatctttctaccccttattgcagtaaactgtgctattttaggcggagtattatttggaattacccgaaactatccttttcttcctatggttgtattttctttaggatcaggatgtggttggtggttagctattgttctctttgcaaccattagagaaaagttagcctattccgatatccctcaacatttacaaggaatggggatctccttcattacaacaggccttatagctatggcattcatgggattaacaggaattgacatctcaaaacctacagctaaatctgtagtgatttcagacacttccaccaataaatcaaaaacaacctccgcgcaagaacgcctcagctcaaaccacaaagcttaa

SEQ ID NO: 20447 - protein, 244 aa, Chlamydia muridarum
MWLGDYSLINLLGIFLQATFIQNILLSTFLGMCSYLACSSRLSTANGLGMSVALVLTITGSINWLIHHFVTGPHALSWLSPALANIDLSFLELITFIVVIAAFTQILELLLERFSRNLYLALGIFLPLIAVNCAILGGVLFGITRNYPFLPMVVFSLGSGCGWWLAIVLFATIREKLAYSDIPQHLQGMGISFITTGLIAMAFMGLTGIDISKPTAKSVVISDTSTNKSKTTSAQERLSSNHKA

SEQ ID NO: 20448 - DNA, 771 bp, Chlamydia pneumoniae
  CDS (1)..(771): transl_table=11
atgtggttaggtgcgtatacttggcttaatgtctttggtattcttctacaagcagcctttattcagaatatccttcttgcgaatttcttggggatgtgtagttaccttgcttgctctactagggtttctacagccaatggcttggggatgtccgtagcccttgttctcactgtaacagggagcatcaactggtttgtccatgctttcatcacgggccctaaagctctaacttggatctctccatctttagcttctgtaaacctaggttttctggagctgattattttcatcgtggtgattgcggcattcacgcaaatcttagagcttcttttagaaaaggtctccaggaatctatatctctccttagggatcttccttcccttgattgctgtgaactgcgcgatcctagggggtgtgctcttcggaatcacacgtagttatccttttattcctatgatgatcttctctttaggagcgggatgtgggtggtggctcgctattgttattttagccactatcaaagaaaaactcgcctactctgatattcccaaaaacctccagggaatggggatctccttcattacaacaggcctcattgctatggcttttatgagcttaacaggtattgatatttctaaaccttcagcaaagattcaaagagctcctctagagactgaagttgttgaaaacacgaccaatccactaaaagaatcttcgtccaaacaccagccaagtatttctaaagcacgaacgcagcgtcgctctctctag

SEQ ID NO: 20449 - protein, 256 aa, Chlamydia pneumoniae
MWLGAYTWLNVFGILLQAAFIQNILLANFLGMCSYLACSTRVSTANGLGMSVALVLTVTGSINWFVHAFITGPKALTWISPSLASVNLGFLELIIFIVVIAAFTQILELLLEKVSRNLYLSLGIFLPLIAVNCAILGGVLFGITRSYPFIPMMIFSLGAGCGWWLAIVILATIKEKLAYSDIPKNLQGMGISFITTGLIAMAFMSLTGIDISKPSAKIQRAPLETEVVENTTNPLKESSSKHQPSISKARTQRRSL

SEQ ID NO: 20450 - DNA, 735 bp, Chlamydia trachomatis
  CDS (1)..(735): transl_table=11
atgtggttgggagactattctttattaaatctcttagggatctttttacaagccacgtttattcagaatattttgctgtccacatttttaggaatgtgtagctatttggcctgttcatctcgcttgtcaacagccaacggcttggggatgtctgtggctctcgtgcttacaattacaggaagcattaactggttggtacattattttatcacaaaaccgggcgccttggcttggttatcacctgcattagcaaatattgatctcagcttcctagaattaatcatgtttattgttgttatcgcagcattcacacaaattttagaagtactcctcgaaagattttccagaaacctttacctagctttgggaatatttcttccccttattgcagtaaactgcgctatcctaggtggagtattatttggaattactcgaaactatccttttctacctatggtggtattctccttgggctcaggatgtggctggtggcttgcgatcgttctttttgcaactattagagaaaaattagcttactccgatgttcctcaacacttacgagggacagggatttccttcattacgacaggactgatggctatggcttttatgggattaacaggaattgatatttccaaacccacaacatctaaacctgcatttgtcacgaatatagccactgatagcccacaaccaaatacacattctagctcagaagaacccaaggcttcataa

SEQ ID NO: 20451 - protein, 244 aa, Chlamydia trachomatis
MWLGDYSLLNLLGIFLQATFIQNILLSTFLGMCSYLACSSRLSTANGLGMSVALVLTITGSINWLVHYFITKPGALAWLSPALANIDLSFLELIMFIVVIAAFTQILEVLLERFSRNLYLALGIFLPLIAVNCAILGGVLFGITRNYPFLPMVVFSLGSGCGWWLAIVLFATIREKLAYSDVPQHLRGTGISFITTGLMAMAFMGLTGIDISKPTTSKPAFVTNIATDSPQPNTHSSSEEPKAS

SEQ ID NO: 20452 - DNA, 597 bp, Haemophilus ducreyi
  CDS (1)..(597): transl_table=11
atggaacatcttttaagtatcttcgttaagtccgtatttattgaaaatatggcgctttctttcttccttggcatgtgtacattccttgcggtgtctaagaaagtttcgaccgcttttggcttagggattgcggttattgtagtattaggcatagctgtacctgtaaatcaacttgtttatactcatatattaaaagacggtgtgttagttgatggcgtagatttaagtttcttaaacttcattacttttatcggggtcattgccgcacttgttcaaatccttgaaatgattttagacaagttcttccctgcgctttacagtgcactagggattttcttaccgcttattacagtaaactgtgcgatttttggtggggtatcatttatggttcaacgtgaatatgatctagttgaatcagtagtttatggtattggtgccggtacggggtggatgttagcaattgttgcccttgcaggtttaaccgagaaaatgaaatattcagatgtaccagcaggcttacgtggtttaggcattacatttattactgttggcctaatggcattaggttttatgtctttctcaggcattcaattataa

SEQ ID NO: 20453 - protein, 198 aa, Haemophilus ducreyi
MEHLLSIFVKSVFIENMALSFFLGMCTFLAVSKKVSTAFGLGIAVIVVLGIAVPVNQLVYTHILKDGVLVDGVDLSFLNFITFIGVIAALVQILEMILDKFFPALYSALGIFLPLITVNCAIFGGVSFMVQREYDLVESVVYGIGAGTGWMLAIVALAGLTEKMKYSDVPAGLRGLGITFITVGLMALGFMSFSGIQL

SEQ ID NO: 20454 - DNA, 597 bp, Haemophilus influenzae
  CDS (1)..(597): transl_table=11
atggaacattatattagcctatttgttaaggcagtcttcattgaaaatatggcactttctttcttcttaggaatgtgtactttcttagcggtatctaaaaaggtgtcccctgcgtttggtcttgggattgcggtaactttcgttcttgggatcgcagtgccagtaaaccaattaatttatgcaaatgtactaaaagagaatgctttaattgaaggtgtagatttatcattcttaaacttcatcactttcattggggttattgctggtttagtgcaaattcttgaaatggtattagataaatttatgccatctctttataacgcattagggattttcttacctttaatcgcagtaaactgtgcgatctttggtggggtatctttcatggttcaacgtgattacaatttccctgaatctatcgtgtatggtttcggctcaggtttaggttggatgttagcgattgtagcgcttgctggcttaacggaaaaaatgaaatacgctgatattcctgctggattaaaaggtttaggtattacctttatctctgttggtttaatggcactaggctttatgtctttctctggtattcaattataa

SEQ ID NO: 20455 - protein, 198 aa, Haemophilus influenzae
MEHYISLFVKAVFIENMALSFFLGMCTFLAVSKKVSPAFGLGIAVTFVLGIAVPVNQLIYANVLKENALIEGVDLSFLNFITFIGVIAGLVQILEMVLDKFMPSLYNALGIFLPLIAVNCAIFGGVSFMVQRDYNFPESIVYGFGSGLGWMLAIVALAGLTEKMKYADIPAGLKGLGITFISVGLMALGFMSFSGIQL

SEQ ID NO: 20456 - DNA, 594 bp, Neisseria meningitidis serogroup A
  CDS (1)..(594): transl_table=11
atggaacactatttgagcctctttatcaaatccgtcttcatcgaaaatatggcgctatccttctttttgggtatgtgtacgtttttggcggtatccaaaaaagtatccaccgcattcggtttgggtgtggcggtgattttcgtactcggactgtccgtccccgccaaccaattggtttactcgctgctcaaagacggcgcgattgtcgaaggcgtggatttgacctttttgaaattcatcaccttcatcggcgtgattgccgctttggtgcagattttggaaatgttcttggataaattcgtccccgccctctataacgcgctgggcatctacctgccgctgattaccgtaaactgcgcgattttcggtgccgtatcgtttatggcgcagcgcgaatacggcttcggcgaatccgtcgtgtacggcttcggtgcgggcttgggctggatgttggcgattgtcgctttggcgggcattaccgaaaaaatgaaatattcggacgctcccaaaggcctcaaaggcttgggcattacctttatcgccgccggcctgatggcgatggcgtttatgtcgttctctggcatccagttataa

SEQ ID NO: 20457 - protein, 197 aa, Neisseria meningitidis serogroup A
MEHYLSLFIKSVFIENMALSFFLGMCTFLAVSKKVSTAFGLGVAVIFVLGLSVPANQLVYSLLKDGAIVEGVDLTFLKFITFIGVIAALVQILEMFLDKFVPALYNALGIYLPLITVNCAIFGAVSFMAQREYGFGESVVYGFGAGLGWMLAIVALAGITEKMKYSDAPKGLKGLGITFIAAGLMAMAFMSFSGIQL

SEQ ID NO: 20458 - DNA, 594 bp, Neisseria meningitidis serogroup B
  CDS (1)..(594): transl_table=11
atggaacactatttgagcctcttcatcaaatccgtcttcattgaaaatatggcactatccttctttttgggtatgtgcacgtttttggcggtatccaaaaaagtatccaccgcattcggtttgggtgtggcggtaattttcgtactcgggctgtccgtccctgtcaaccaactcgtttactcgctgctcaaagacggcgcgattgccgaaggcgtggatttgacctttttgaaattcatcaccttcatcggcgtgattgccgctttggtgcagattttggaaatgttcttggataaattcgtccccgccctctataacgcattgggcatctacctgccgctgattaccgtgaactgcgcgattttcggcgccgtatcgtttatggcgcaacgcgaatacaacttcggcgagtccgttgtatacggcttcggcgcgggcttgggctggatgttggcgattgtcgctttggcgggcattaccgaaaaaatgaaatattcggacgctcccaaaggcctcaaaggcttgggcattacctttatcgccgccggcctgatggcgatggcgtttatgtcgttctctggcatccagttataa

SEQ ID NO: 20459 - protein, 197 aa, Neisseria meningitidis serogroup B
MEHYLSLFIKSVFIENMALSFFLGMCTFLAVSKKVSTAFGLGVAVIFVLGLSVPVNQLVYSLLKDGAIAEGVDLTFLKFITFIGVIAALVQILEMFLDKFVPALYNALGIYLPLITVNCAIFGAVSFMAQREYNFGESVVYGFGAGLGWMLAIVALAGITEKMKYSDAPKGLKGLGITFIAAGLMAMAFMSFSGIQL

SEQ ID NO: 20460 - DNA, 597 bp, Pasteurella multocida
  CDS (1)..(597): transl_table=11
atggaacattatattagccttttcgttaaatccgtttttatcgaaaacatggcactttctttcttcttaggaatgtgtactttccttgctgtatcgaaaaaagtgtctactgcatttggtttggggattgcggttatcgtggtattaggtattgcggtacctgtaaaccaattagtgtatagctttatcttaaaagacagtgcattagttcaaggtattgatctcagtttcttaaacttcattacctttatcggtgtgattgccgcattagttcaaattcttgagatggtattggataagtatttccctgcactttataacgcgttagggatcttcttaccattaattaccgtaaactgtgcgatttttggtggggtatccttcatggttcaacgtgattatacctttgttgaatccgttgtatacggtattggcgcagggacgggttggatgttagccattgttgcgcttgcaggcatcacggaaaaaatgaaatatgctgatgtaccagcagggttacgtggtttaggcattacctttatcactgtaggtctgatggcacttggttttatgtcattttcaggtattcagttgtaa

SEQ ID NO: 20461 - protein, 198 aa, Pasteurella multocida
MEHYISLFVKSVFIENMALSFFLGMCTFLAVSKKVSTAFGLGIAVIVVLGIAVPVNQLVYSFILKDSALVQGIDLSFLNFITFIGVIAALVQILEMVLDKYFPALYNALGIFLPLITVNCAIFGGVSFMVQRDYTFVESVVYGIGAGTGWMLAIVALAGITEKMKYADVPAGLRGLGITFITVGLMALGFMSFSGIQL

SEQ ID NO: 20462 - DNA, 609 bp, Pseudomonas aeruginosa
  CDS (1)..(609): transl_table=11
atggagcactacatcagcctgttcgtgaaagccgtgttcgtcgagaacatggcgctggcgttcttcctcggcatgtgtaccttcatcgccatctcgaagaaggtggagaccgccatcggcctgggtatcgcggtgatcgtggtgcagaccatcaccgtgccggccaacaacctgatctacacctacctgctcaaggacggcgcgctggcctgggccgggctgcccgaggtggacctgagcttcctcggcctgctcagctacatcggggtgatcgccgccatcgtgcagatcctcgagatgctcctcgacaagtacgtacccagcctctacaacgcgctgggcgtgttcctgccgctgatcacggtgaactgcgcgatcatggccggctcgctgttcatggtcgagcgcgactacaaccttgccgagagcacggtgtacggcgtcggctcgggcttttcctgggcgctggcgatcgccgcgctggcgggtatccgcgagaagctcaagtacagcgacgtccccgagggcctgcagggcctggggatcaccttcatcaccatcggcctgatgtcgttgggcttcatgtcgttctccggcgtgcagttgtaa

SEQ ID NO: 20463 - protein, 202 aa, Pseudomonas aeruginosa
MEHYISLFVKAVFVENMALAFFLGMCTFIAISKKVETAIGLGIAVIVVQTITVPANNLIYTYLLKDGALAWAGLPEVDLSFLGLLSYIGVIAAIVQILEMLLDKYVPSLYNALGVFLPLITVNCAIMAGSLFMVERDYNLAESTVYGVGSGFSWALAIAALAGIREKLKYSDVPEGLQGLGITFITIGLMSLGFMSFSGVQL

SEQ ID NO: 20464 - DNA, 597 bp, Vibrio alginolyticus
  CDS (1)..(597): transl_table=11
atggaacattacattagtctgttagttaaatcgattttcatcgaaaacatggctctgtctttcttcctaggtatgtgtactttccttgccgtatctaagaaggttaagacctctttcggcctaggtgttgcagttgtggtagtactgactatcgctgttcctgtgaacaacctagtatacaacctagttctgagagagaacgcgttagttgagggcgtggaccttagcttcctaaacttcatcacctttatcggtgtaattgcagcacttgtacagattctagagatggttctagaccgtttcttcccacctttgtacaacgcgctaggcatcttcctaccgctgatcacagtaaactgtgcaatcttcggtggtgtatctttcatggtacaacgtgactacaactttgctgaatctatcgtttacggtttcggctctggtgtgggctggatgctagcaatcgttgctcttgcaggtatccgtgagaagatgaagtactctgacgtacctccaggtctacgtggtcttggtatcacatttatcactgtaggtcttatggcgttaggctttatgtctttctctggtgttcaactgtaa

SEQ ID NO: 20465 - protein, 198 aa, Vibrio alginolyticus
MEHYISLLVKSIFIENMALSFFLGMCTFLAVSKKVKTSFGLGVAVVVVLTIAVPVNNLVYNLVLRENALVEGVDLSFLNFITFIGVIAALVQILEMVLDRFFPPLYNALGIFLPLITVNCAIFGGVSFMVQRDYNFAESIVYGFGSGVGWMLAIVALAGIREKMKYSDVPPGLRGLGITFITVGLMALGFMSFSGVQL

SEQ ID NO: 20466 - DNA, 597 bp, Vibrio anguillarum
  CDS (1)..(597): transl_table=11
atggaacattatatcagtttgcttgttcgatcgatttttatcgaaaacatggcactctctttcttcttgggtatgtgtacatttcttgctgtatctaagaaagtaaagacatcgtttggtttagggattgcggttactgttgttctgaccatttcagtaccagtgaataacttggtttataacttgttacttaaaccgggtgcattgggtgaaaatattgatcttacatttctaaatttcattacctttatcggtgttattgccgcattggtacagatcttagagatgatattggatcgttttttcccacctttgtataacgcgctgggcattttcttacctttaatcacagtgaactgcgccatttttggtggtgtatctttcatggttcagcgtgattataactttgctgaatccgtcgtttacggtttcggttcgggtgtgggttggatgttagcgattgtcgctcttgccggtatccgtgagaaaatgaaatattcagatgtacctccgggtttacgtggtttagggattaccttcatcacggcgggtctaatggcgttaggctttatgtctttctctggtgttcaactgtaa

SEQ ID NO: 20467 - protein, 198 aa, Vibrio anguillarum
MEHYISLLVRSIFIENMALSFFLGMCTFLAVSKKVKTSFGLGIAVTVVLTISVPVNNLVYNLLLKPGALGENIDLTFLNFITFIGVIAALVQILEMILDRFFPPLYNALGIFLPLITVNCAIFGGVSFMVQRDYNFAESVVYGFGSGVGWMLAIVALAGIREKMKYSDVPPGLRGLGITFITAGLMALGFMSFSGVQL

SEQ ID NO: 20468 - DNA, 597 bp, Vibrio cholerae
  CDS (1)..(597): transl_table=11
atggaacattatattagtctgctggtgaaatcgattttcatcgagaacatggcactctctttcttcctagggatgtgtacattcttggcggtgtcgaagaaagttaagacatcattcggcttaggtattgcggtaatcgtagtactgactatctctgtaccagttaacaatctggtgtacaaccttgtgcttaagccagatgcactggttgaaggggtagatcttagcttcctcaactttattacctttatcggtgttattgcggcattagtacagattctggaaatgatcctcgatcgcttcttcccgcctctgtataacgcactgggcatcttccttccgctgatcacagtaaactgtgcgatcttcggtggtgtgtctttcatggtgcagcgcgactacagctttgctgaatcagtggtatacggtttcggttctggtgtgggttggatgctggctatcgtcgctcttgcaggtatccgtgagaagatgaagtattcagacgttcctccaggtctgcgtggtttaggtattacctttatcacggctggcttgatggcgttgggcttcatgtctttctctggtgttcaactgtaa

SEQ ID NO: 20469 - protein, 198 aa, Vibrio cholerae [sequence omitted]

SEQ ID NO: 20470 - DNA, 597 bp, Vibrio harveyi
  CDS (1)..(597): transl_table=11
atggaacattacatcagtctgctagttaaatcgattttcatcgaaaacatggcactgtctttcttcctaggtatgtgtactttccttgccgtatctaagaaagttaagacctctttcggtctgggtgttgcagttgtggtagtactaactatcgcggttcctgtgaacaacctagtttacaacctagttctgaaagagaacgcgttagttgagggcgtagaccttagcttcctaaacttcatcacctttatcggtgtaatcgctgcacttgtacagattctagagatggttcttgaccgtttcttcccacctttgtacaacgcgcttggcatcttcctaccgctgatcacagtaaactgtgcgatcttcggtggtgtatctttcatggtacaacgtgactacaactttgctgaatctatcgtttacggtttcggttctggtgtgggctggatgctagcgatcgtcgctcttgcaggtatccgtgagaagatgaagtactcagatgtacctcctggtctacgtggtctaggtatcacgttcatcactgtaggtctaatggcgttaggctttatgtctttctctggtgttcaactgtaa

SEQ ID NO: 20471 - protein, 198 aa, Vibrio harveyi
MEHYISLLVKSIFIENMALSFFLGMCTFLAVSKKVKTSFGLGVAVVVVLTIAVPVNNLVYNLVLKENALVEGVDLSFLNFITFIGVIAALVQILEMVLDRFFPPLYNALGIFLPLITVNCAIFGGVSFMVQRDYNFAESIVYGFGSGVGWMLAIVALAGIREKMKYSDVPPGLRGLGITFITVGLMALGFMSFSGVQL

SEQ ID NO: 20472 - DNA, 597 bp, Vibrio parahaemolyticus
  CDS (1)..(597): transl_table=11
atggaacattacatcagtctgttagttaaatcgattttcatcgagaacatggcactgtctttcttcctaggtatgtgtactttccttgccgtatctaagaaagttaagacctctttcggtctaggtgttgcagttgtggtagttttgactatcgctgttcctgtgaacaacctagtttacaacctagttctgaaagaaaatgcgttagttgagggcgtggaccttagcttcctaaacttcatcacctttatcggtgtaattgcagcacttgtacagatcctagagatggttcttgaccgtttcttcccacctttgtacaacgcgctaggcatcttcctaccgttgatcacagtaaactgtgcgatcttcggtggtgtatctttcatggtacaacgtgactacaactttgctgaatctgttgtttacggtttcggttctggtgtgggttggatgctagcaatcgttgctcttgcaggtatccgtgagaagatgaagtactctgacgtacctccaggtctacgtggtcttggtatcacattcatcactgtaggtcttatggcgttaggctttatgtctttctctggtgttcaactgtaa

SEQ ID NO: 20473 - protein, 198 aa, Vibrio parahaemolyticus
MEHYISLLVKSIFIENMALSFFLGMCTFLAVSKKVKTSFGLGVAVVVVLTIAVPVNNLVYNLVLKENALVEGVDLSFLNFITFIGVIAALVQILEMVLDRFFPPLYNALGIFLPLITVNCAIFGGVSFMVQRDYNFAESVVYGFGSGVGWMLAIVALAGIREKMKYSDVPPGLRGLGITFITVGLMALGFMSFSGVQL

SEQ ID NO: 20474 - DNA, 597 bp, Vibrio vulnificus
  CDS (1)..(597): transl_table=11
atggaacattacatcagtctgttaattaaatcgattttcatcgagaacatggctctgtctttcttcttgggtatgtgtaccttcttggcggtatctaagaaagtaaagacctctttcggtctaggtgttgcagtagtggttgttttgactatcgctgtaccagtaaacaacctggtttacaacctagtacttaaggaaaacgcgctggtcgaaggcgtggatctgagcttcctaaacttcatcacctttatcggtgtaattgcggcacttgtacagattctagagatgattcttgaccgtttcttcccgcctttgtacaacgcgctaggcatcttcctaccgctgatcacagtaaactgtgcgatcttcggtggtgtatctttcatggtacaacgtgactacaacttcgctgaatctgttgtttatggtttcggtgcaggtgtgggttggatgctcgcgatcgtggcccttgcaggtatccgtgagaagatgaagtactcagatgtacctcctggtctacgtggtttaggtattacctttatcactgtaggtttgatggcgttaggctttatgtctttctctggtgttcaactgtaa

SEQ ID NO: 20475 - protein, 198 aa, Vibrio vulnificus
MEHYISLLIKSIFIENMALSFFLGMCTFLAVSKKVKTSFGLGVAVVVVLTIAVPVNNLVYNLVLKENALVEGVDLSFLNFITFIGVIAALVQILEMILDRFFPPLYNALGIFLPLITVNCAIFGGVSFMVQRDYNFAESVVYGFGAGVGWMLAIVALAGIREKMKYSDVPPGLRGLGITFITVGLMALGFMSFSGVQL

SEQ ID NO: 20476 - DNA, 600 bp, Yersinia pestis
  CDS (1)..(600): transl_table=11
atgaccgagagttatttgaccatttttattagagctgtttttgttgaaaatatggcattaaatttctttcttggaatgtgcacatttctggcaatatctaaaaaagtagaaacagcctttggccttgggttgacagttacagccctgctggcgatagcaacacctctcaataatcttatttacacctatatactcagagagaatgctctgattgatggagtggatcttagttttcttgatttcattaccttcatcggggtgcttgcggcattagtccaaatacttgaaatggtacttgagcgatttttgccaagcttacatcacaccctgggggcctttttaccactactgacgatccactgtgcaatatttggtgcaaccatttttatggttcagcgagaatatacgttcaccgaatcttttgtttacgggactggctgtggtttaggttggatgctggccattatatccatggcaggtttacgagaaaaaatgaagtactctaacattccaaaagggttgcaagggctcggcatcgtctttatgacggcagggctgatgtccttaggatttatgtcattttcaggtattcggctctaa

SEQ ID NO: 20477 - protein, 199 aa, Yersinia pestis
MTESYLTIFIRAVFVENMALNFFLGMCTFLAISKKVETAFGLGLTVTALLAIATPLNNLIYTYILRENALIDGVDLSFLDFITFIGVLAALVQILEMVLERFLPSLHHTLGAFLPLLTIHCAIFGATIFMVQREYTFTESFVYGTGCGLGWMLAIISMAGLREKMKYSNIPKGLQGLGIVFMTAGLMSLGFMSFSGIRL

SEQ ID NO: 20478 - DNA, 582 bp, Buchnera aphidicola subsp
  CDS (1)..(582): transl_table=11
atgaaacattatattttattttttatttctaatatattaattgaaaattttattctagtaaaatttctcggtttgtgtccttttttaggagcgtcgagtaatattgaaactgcttttggaatgagttgcgcaactactttcgttatactcacatcatcagtattattatggtgtgttaattttttcattttgttacctctggatttaatttatttgagaattattgcttatatgttaattgtttcagttagtgttcaatttttagaaatagtgttacgaaagacgagtcctattttatatcgtttacttgggatttttctcccattaattacaactaattgtacagtgttagctattccattattcagtttatatgaacatcatacatttttagaatctatattttatgggttaagtgcatcgttaggatttgctttagtgatgattattttttcttgtattcgtgaacgtatagtattatctgatattcctttgccatttcaaggtgctcctattattttaattactgtaagtttaatatctattacatttatgggttttaagggtttgataaaaatttga

SEQ ID NO: 20479 - protein, 193 aa, Buchnera aphidicola subsp
MKHYILFFISNILIENFILVKFLGLCPFLGASSNIETAFGMSCATTFVILTSSVLLWCVNFFILLPLDLIYLRIIAYMLIVSVSVQFLEIVLRKTSPILYRLLGIFLPLITTNCTVLAIPLFSLYEHHTFLESIFYGLSASLGFALVMIIFSCIRERIVLSDIPLPFQGAPIILITVSLISITFMGFKGLIKI

SEQ ID NO: 20480 - DNA, 582 bp, Buchnera aphidicola subsp
  CDS (1)..(582): transl_table=11
atgaaaagttactttttttttattttatcaaatatattaattgataattttattttagtaaaatttcttggtttatgtcccttcataggtgcgtcaaatcaaataaaacaagcttttggaataagtttcgccacttcttttgttgtagttgtatcgacagttttattatggtttgttaacttttttattttgttaccttttgatttagtttatttaagaattatagtgtatatgttaattatttcttttggtgttcaattaatagaaattattttacgagggactagtcctatcttatatcgtatacttggtatttttctccctttaattacaactaattgtgccgttttagctattccattgtttagtctctatttaaatcatacattcttagaatctattctttatgcagtcagtgcctcttttggttttactttagtgatggttatattttctagtattcgtgaacgtatattattatctgacgttcctttagcatttcaagggtcgcctattgttcttattactgtaagtttaatatctattgtatttatggggtttaaaggtttagtgagaatttaa

SEQ ID NO: 20481 - protein, 193 aa, Buchnera aphidicola subsp
MKSYFFFILSNILIDNFILVKFLGLCPFIGASNQIKQAFGISFATSFVVVVSTVLLWFVNFFILLPFDLVYLRIIVYMLIISFGVQLIEIILRGTSPILYRILGIFLPLITTNCAVLAIPLFSLYLNHTFLESILYAVSASFGFTLVMVIFSSIRERILLSDVPLAFQGSPIVLITVSLISIVFMGFKGLVRI

SEQ ID NO: 20482 - DNA, 585 bp, Buchnera aphidicola subsp
  CDS (1)..(585): transl_table=11
atggtgatgcatttttttttgctttttgtaagtaatatacttattaataattttatattagttagatttcttggattgtgtcctttcatgggaatttctagaacaatagattcagctataggaatgggattagcaactacatgtgtgattgtttttgtttcaataatttcatggttaatcaatttttatattttaatcccttttcatttgattcatctttgcacgatgacgtatatgttgataatagcagtaagtgtacagatttttgaaattatagtgaaaaaagtaagttctactttatatcgattattaggtatatatttgccattaataacaactaattgttctgtattagcaatacccttaatgaacactaaattaaattctaattttatagaatcggttttatatgggtttagttcttctttgggtttttttttggtattagtaatattttctagtatacgagaacgtatttctgaatctgatgtacccatgtattttcgaggttatccaattgcattaattacagctagcttattagctattgcttttatgggatttgatggattaattaaattttaa

SEQ ID NO: 20483 - protein, 194 aa, Buchnera aphidicola subsp
MVMHFFLLFVSNILINNFILVRFLGLCPFMGISRTIDSAIGMGLATTCVIVFVSIISWLINFYILIPFHLIHLCTMTYMLIIAVSVQIFEIIVKKVSSTLYRLLGIYLPLITTNCSVLAIPLMNTKLNSNFIESVLYGFSSSLGFFLVLVIFSSIRERISESDVPMYFRGYPIALITASLLAIAFMGFDGLIKF

SEQ ID NO: 20484 - DNA, 582 bp, Haemophilus ducreyi
  CDS (1)..(582): transl_table=11
atggtcgattatattctgttagtgatcagtacagccttaattaataactttgtacttgtgaagtttttagggctttgtccatttatgggcgtatcaaaaaaagtggaaaccgcaattggtatgggaatggcgactacatttgtgttaacacttgcttcgttatctgcttatttagttgaaaggtttatcttgatcccattagatgcacaattcttgcggactttagtgtttattttggttattgcagttattgtgcaattgactgaaatgatcgtacataaaacgagcccaacgctatatcgtttactcgggatctatttaccgctgattactacaaattgtgccgtgcttggtgttgccttattgaatgtgaatttatcgaataatttaattgagtctgtcttatatggttttggtgcagcggttggtttttcattagtgttagtcttattcgcagcattacgtgagcgtttagctgccgcggatgtgcctcgtcctttccaaggagcgtcgattgccttgatcacggcaggtttgatgtctttggcgtttatgggctttacgggcttggtgaaactctaa

SEQ ID NO: 20485 - protein, 193 aa, Haemophilus ducreyi
MVDYILLVISTALINNFVLVKFLGLCPFMGVSKKVETAIGMGMATTFVLTLASLSAYLVERFILIPLDAQFLRTLVFILVIAVIVQLTEMIVHKTSPTLYRLLGIYLPLITTNCAVLGVALLNVNLSNNLIESVLYGFGAAVGFSLVLVLFAALRERLAAADVPRPFQGASIALITAGLMSLAFMGFTGLVKL

SEQ ID NO: 20486 - DNA, 579 bp, Haemophilus influenzae
  CDS (1)..(579): transl_table=11
atgacgcactatattttattgattatcggcaccgcattaattaacaattttgtattggtaaaattcttaggtctttgcccttttatgggtgtatccaaaaaaattgaaacggctgtgggaatgggattagcaacaatgtttgttttaactgttgcttccctttgtgcatatttggtcgatcactatattctaattcccttaaatgccacttttttacgtacattagtgtttattttagttattgctgtagtggtgcaatttaccgaaatggcaataaacaaaacaagtccaacattatatcgtttactcggcattttcttgcctttgataactacaaactgcgcagtacttggtgtcgcattattaaatgtaaatctcgctcataatttaacagagtctgtcgtttatggttttggtgcatctctcggcttttccttagtattggtactttttgccgcgcttcgtgaacgtttagtcgccgctgatatacctgccacttttcgcggttcatccattgctttaattaccgcaggcttaatgtccctcgcttttatgggatttacaggacttgtaaaataa

SEQ ID NO: 20487 - protein, 192 aa, Haemophilus influenzae
MTHYILLIIGTALINNFVLVKFLGLCPFMGVSKKIETAVGMGLATMFVLTVASLCAYLVDHYILIPLNATFLRTLVFILVIAVVVQFTEMAINKTSPTLYRLLGIFLPLITTNCAVLGVALLNVNLAHNLTESVVYGFGASLGFSLVLVLFAALRERLVAADIPATFRGSSIALITAGLMSLAFMGFTGLVK

SEQ ID NO: 20488 - DNA, 579 bp, Pasteurella multocida
  CDS (1)..(579): transl_table=11
atgacagaatacattctccttattattagtacagccttaattaataactttgtcctggtgaaatttctagggctttgtccttttatgggcgtttctaaaaaaattgaaaccgcaattggcatgagtttagcgaccatgtttgtccttactgttgcctcaatctctgcttatttaattgatacctatattcttactcccttaagcgcgacttttttacgtactctcgtctttattttagtaattgctgtggtggtacaatttactgaaatggtaatcaataaaaccagtcctacactgtatcgtttattagggatttttctcccactcattacgacaaattgtgctgtacttggcgtcgcactgttaaatattaatcaagcacacaccctgacccaatcagtgatttatggttttggtgcgtcattaggttttggcttagtgcttgttctctttgctgccttacgtgaacgcttagccgcggcagacgtgcctcatgtttttaaaggtgcctcgattgccttaatcacagcagggttaatgtcacttgcctttatgggctttacaggattggtgagatga

SEQ ID NO: 20489 - protein, 192 aa, Pasteurella multocida
MTEYILLIISTALINNFVLVKFLGLCPFMGVSKKIETAIGMSLATMFVLTVASISAYLIDTYILTPLSATFLRTLVFILVIAVVVQFTEMVINKTSPTLYRLLGIFLPLITTNCAVLGVALLNINQAHTLTQSVIYGFGASLGFGLVLVLFAALRERLAAADVPHVFKGASIALITAGLMSLAFMGFTGLVR

SEQ ID NO: 20490 - DNA, 585 bp, Pseudomonas aeruginosa
  CDS (1)..(585): transl_table=11
atgactgaactcgccctgatcctggtcagcgccatcctggtcaacaactttgtcctggtgcagttcctcggcctgtgcccgttcatgggcgtgtcgcggaagatcgagacggccatcggcctgtccctcgccaccaccttcgtcctgaccctggcggcgatgtgcagccatatcctgcaacgctacgtgctgcgcccgctggacctggagtacctgcgcaccatcggctttatcctggtgatcgcggtggtggtgcagttcaccgagatgctggtgaagaagaccagcccgctgctgtaccgggtgctcggcatcttcctgccgctgatcaccaccaattgcatcgtcctcggcgtcgccctgctcaacgccaacaaggctgaatacggcttcctccaggccactacccagggcttcggcgccgggctgggcttttccctggtactggtgctgttcgccgccctgcgcgagcgcatcgccatcgccgacgtgccggcgccgttccgcggcgcggccatcggcatgatcaccgccggcctgatgtcgctggcgttcatgggcttcagcgggttggtccggccatga

SEQ ID NO: 20491 - protein, 194 aa, Pseudomonas aeruginosa
MTELALILVSAILVNNFVLVQFLGLCPFMGVSRKIETAIGLSLATTFVLTLAAMCSHILQRYVLRPLDLEYLRTIGFILVIAVVVQFTEMLVKKTSPLLYRVLGIFLPLITTNCIVLGVALLNANKAEYGFLQATTQGFGAGLGFSLVLVLFAALRERIAIADVPAPFRGAAIGMITAGLMSLAFMGFSGLVRP

SEQ ID NO: 20492 - DNA, 582 bp, Rhodobacter capsulatus
  CDS (1)..(582): transl_table=11
atgcaagacttccttctcgtcctcttgagcaccgcgctcgtgaacaacgtcgtgctggtgaaattcctcgggctctgcccgttcatgggcgtctcgcgcaagaccgatgccgcgatcggcatggggctggccacgaccttcgtgatcaccgtcgcctcggccgcctgctggctggtcgaggcgctgatcctggaaccgctcgacctgaaattcctgcgcatcctgagcatgatcctggtcatcgccgcgatcgtgcagttcatcgagacggtgatgcgcaaggtcacccccgacctgcacaaggcgctcggcatctatctgccgctgatcaccacgaactgcgccgtcctcggcctgccgctgatgtacattcagggccatctgagccttgcgatgagcacgctgagcggctttggcgcctcggtcggtttcacgctcgttctggtgatctttgcgggcatgcgcgaacggctggcgcagctttcggtgcccgcggcctttgccggaacccccatcgccttcgtgtccgcagggcttctgggcctcgccttcatgggctttgccgggctcgtgcacgtctga

SEQ ID NO: 20493 - protein, 193 aa, Rhodobacter capsulatus
MQDFLLVLLSTALVNNVVLVKFLGLCPFMGVSRKTDAAIGMGLATTFVITVASAACWLVEALILEPLDLKFLRILSMILVIAAIVQFIETVMRKVTPDLHKALGIYLPLITTNCAVLGLPLMYIQGHLSLAMSTLSGFGASVGFTLVLVIFAGMRERLAQLSVPAAFAGTPIAFVSAGLLGLAFMGFAGLVHV

SEQ ID NO: 20494 - DNA, 717 bp, Azotobacter vinelandii
  CDS (1)..(717): transl_table=11
atgagtcattgcggagcacccagcgttcccgagcccgaaaagaaggtgccgtggcagtacttcacctcggccctgtggcaatacaacgtcgccctggtgcagatgctcgcgctctgcccgaccctggcggtgaccaccaccgccaccaacggcctgggcatgggcctggccaccaccctggtgctggtcatgaccaacgcgctcatctcgtcgatgcgccataccatttctcccgaggtgcgcaacccggtgatgatcggcgtgatcgccggcgtggtgaccctgaccgacatggcgatgaacgcctggatgcacgagctgtacaaggtgctcggcctgttcatcgcgctgatcgtgaccaactgcgcggtgctcggccgtgccgagtccttctgcctgaggaacccggtgatcccctcgatcctagacggcgccggcatgggcgccggcttcaccgccgtactggtggtgatcggcggcatccgcgagatcctcggcagcggcaccctgttctcccaggcgtcctcgctgctcggctcgcacttcaagtggatggagatcaccgtgatccccgacttccagggcatcctgctggccatcctgccgccgggcgccttcatcgtcctgggcttcctgctggccgccaagcgggcgatcgatcgcaagcgtgccgagcgtcgccagcagacccatggcgagctggtggttctgcagtga

SEQ ID NO: 20495 - protein, 238 aa, Azotobacter vinelandii
MSHCGAPSVPEPEKKVPWQYFTSALWQYNVALVQMLALCPTLAVTTTATNGLGMGLATTLVLVMTNALISSMRHTISPEVRNPVMIGVIAGVVTLTDMAMNAWMHELYKVLGLFIALIVTNCAVLGRAESFCLRNPVIPSILDGAGMGAGFTAVLVVIGGIREILGSGTLFSQASSLLGSHFKWMEITVIPDFQGILLAILPPGAFIVLGFLLAAKRAIDRKRAERRQQTHGELVVLQ

SEQ ID NO: 20496 - DNA, 672 bp, Buchnera aphidicola subsp
  CDS (1)..(672): transl_table=11
atggaattcaaaaaattttttaaaaagagattgtggaataataattcttctttagtacagcttttaggtttatgtccaattttagccatgactacaaatactattaatgctataggattaggaataacaactacctttgtattaactataacaaatagtattatttcaattttaaaaaactttatacctaaagatattagaattcctatttatatgataatagtttcttcgacagttacttgtatagaaatgctattgcatgcttatcaatttaatttatatcagtcattaggcgtcttcattccgttaatagtaactaattgtattgttgttggaagagctgattgtattgcttataaaagttcttttgtaatttcttttttagacggtatgtcaataggcttagggtcaacctttgcaatgtttgtaattggttccatacgtgaaatactgggaaatggaacttttttatttggtgcaaataaaatttttaatgttttagatcattcatttttttttacgttcatagataaaaactctacaataattttagctatgttaccttcaggtggatttttagtattaggttttgtaattgctttcaaaaattatttagatttaggtaaaaaaaattgtttaaaatgttttcattcgtgtaaactaaaaaaataa

SEQ ID NO: 20497 - protein, 223 aa, Buchnera aphidicola subsp
MEFKKFFKKRLWNNNSSLVQLLGLCPILAMTTNTINAIGLGITTTFVLTITNSIISILKNFIPKDIRIPIYMIIVSSTVTCIEMLLHAYQFNLYQSLGVFIPLIVTNCIVVGRADCIAYKSSFVISFLDGMSIGLGSTFAMFVIGSIREILGNGTFLFGANKIFNVLDHSFFFTFIDKNSTIILAMLPSGGFLVLGFVIAFKNYLDLGKKNCLKCFHSCKLKK

SEQ ID NO: 20498 - DNA, 726 bp, Buchnera aphidicola subsp
  CDS (1)..(726): transl_table=11
atgagtaatattttaaaaatttttgttgatggattatggaaaaaaaattcatcgttagtacaattgttaggattgtgtcctgtattagcaattacagtaaatgctattaatgctattggtttaggtttagcaactactttagtattaatttgctctaatgcaacaatttctttaattaagaacaatattcaaaaagattttcgtattcctatttatataattattattagctctgtagttagttctattgatttagttattaaagcttatgcatttaatttatatcagtcattaggaatttttatcccgttaattattactaattgcattgtttgtaatcgtgctgatttaattgctgttcataattctgttttagtttctattttagatggattgagtataggtttaggttctacgttaacaatgtttttattgggatcaattcgtgaaattataggtcacggaacgctgttttttgggattgaacatgtattaggtgagtcttttaggtttctttatattgaagtactagataaaaattcagtatttttattgtttgcatttccatctggagcttttatgattttaggtattgtattagcaggaaaaaattttttagatgaagttttgggtattatagaacataaaaatgtttgtgtatgttcaaataaagttttagtttataaagatggaaataaaaaaattgaatcacaaaaatcgttataa

SEQ ID NO: 20499 - protein, 241 aa, Buchnera aphidicola subsp
MSNILKIFVDGLWKKNSSLVQLLGLCPVLAITVNAINAIGLGLATTLVLICSNATISLIKNNIQKDFRIPIYIIIISSVVSSIDLVIKAYAFNLYQSLGIFIPLIITNCIVCNRADLIAVHNSVLVSILDGLSIGLGSTLTMFLLGSIREIIGHGTLFFGIEHVLGESFRFLYIEVLDKNSVFLLFAFPSGAFMILGIVLAGKNFLDEVLGIIEHKNVCVCSNKVLVYKDGNKKIESQKSL

SEQ ID NO: 20500 - DNA, 696 bp, Escherichia coli O157
  CDS (1)..(696): transl_table=11
gtgagcgaaattaaagacgttattgttcaggggttgtggaaaaacaactctgcgctggtccagttgctcggcctttgtcctctgttggctgtcacgtctactgccactaacgctctgggtttaggacttgcgactacgctggtactgacgctgaccaacctgaccatttcgacgctgcgtcactggacgccagccgagatccgcattcccatttacgtgatgatcatcgcctcggtggtcagcgctgtacagatgctgatcaacgcctacgcctttggcctgtatcaatcattagggatttttattccgctgattgtcactaactgtatcgttgtgggccgcgctgaagccttcgctgccaaaaaaggtccggcgctttcggcactggacggcttttcaattggtatgggcgcaacctgcgccatgttcgtgctgggttcactacgcgaaattatcggcaatggcacattgtttgacggtgcagatgcgctgttaggtagctgggcaaaagtattacgcgtggagattttccacaccgactcccctttcctgctggcgatgctgccaccaggtgcatttattggcctgggactgatgctggcaggaaaatacctgattgatgaaagaatgaaaaagcgccgtactgaagcagctgccgaacgtgcattgccaaacggtgaaacagggaatgtctga

SEQ ID NO: 20501 - protein, 231 aa, Escherichia coli O157
MSEIKDVIVQGLWKNNSALVQLLGLCPLLAVTSTATNALGLGLATTLVLTLTNLTISTLRHWTPAEIRIPIYVMIIASVVSAVQMLINAYAFGLYQSLGIFIPLIVTNCIVVGRAEAFAAKKGPALSALDGFSIGMGATCAMFVLGSLREIIGNGTLFDGADALLGSWAKVLRVEIFHTDSPFLLAMLPPGAFIGLGLMLAGKYLIDERMKKRRTEAAAERALPNGETGNV

SEQ ID NO: 20502 - DNA, 696 bp, Escherichia coli O6
  CDS (1)..(696): transl_table=11
gtgagcgaaattaaagacgttattgttcaggggttgtggaaaaacaactctgcgctggtccagttgctcggcctttgtccgctgttggcggtcacgtccactgccactaacgctctgggtttaggacttgcgactacgctggtactgacgctaaccaacctgaccatttcgacgctgcgtcactggacgcccgccgagatccgcattcccatttacgtgatgatcatcgcctcggtggtcagcgctgtacagatgctgatcaacgcctacgcctttggcctgtatcaatcattagggatttttattccgctgattgtcactaactgtatcgttgtgggccgcgctgaagccttcgccgccaaaaaaggtccggcgctttcggcactggacggcttttcaattggtatgggcgcaacctgcgccatgttcgtgctgggttcactacgcgaaattatcggcaatggcacgttgtttgacggtgcagatgcgctgttaggtagctgggcgaaagtattacgcgtggagattttccacaccgactcccctttcctgctggcgatgctgccaccaggtgcatttattggcctgggactgatgctggcaggaaaatacctgattgatgaaaaaatgaaaaagcgccgtactgaagcagttgccgaacgtgcattgccaaacggtgaaacagggaatgtctga

SEQ ID NO: 20503 - protein, 231 aa, Escherichia coli O6
MSEIKDVIVQGLWKNNSALVQLLGLCPLLAVTSTATNALGLGLATTLVLTLTNLTISTLRHWTPAEIRIPIYVMIIASVVSAVQMLINAYAFGLYQSLGIFIPLIVTNCIVVGRAEAFAAKKGPALSALDGFSIGMGATCAMFVLGSLREIIGNGTLFDGADALLGSWAKVLRVEIFHTDSPFLLAMLPPGAFIGLGLMLAGKYLIDEKMKKRRTEAVAERALPNGETGNV

SEQ ID NO: 20504 - DNA, 696 bp, Escherichia coli
  CDS (1)..(696): transl_table=11
gtgagcgaaattaaagacgttattgttcaggggttgtggaaaaacaactctgcgctggtccagttgctcggcctttgtcctctgttggcggtcacgtccactgccactaacgctctgggtttaggacttgcgactacgctggtactgacgctgaccaacctgaccatttcgacgctgcgtcactggacgccagccgagatccgcattcccatttacgtgatgatcatcgcctcggtggtcagcgctgtacagatgctgatcaacgcctacgcctttggcctgtatcaatcattagggatttttattccgctgattgtcactaactgtatcgttgtgggccgcgctgaagccttcgccgccaaaaaaggtccggcgctttcggcactggacggcttttcaattggtatgggcgcaacctgcgccatgttcgtgctgggttcactacgcgaaattatcggcaatggcacattgtttgacggtgcagatgcgctgttaggtagctgggcaaaagtattacgcgtggagattttccacaccgactcccctttcctgctggcgatgctgccaccaggtgcatttattggcctgggactgatgctggcaggaaaatacctgattgatgaaagaatgaaaaagcgccgtgctgaagcagctgcagaacgtgcattgccaaacggtgaaacagggaatgtctga

SEQ ID NO: 20505 - protein, 231 aa, Escherichia coli
MSEIKDVIVQGLWKNNSALVQLLGLCPLLAVTSTATNALGLGLATTLVLTLTNLTISTLRHWTPAEIRIPIYVMIIASVVSAVQMLINAYAFGLYQSLGIFIPLIVTNCIVVGRAEAFAAKKGPALSALDGFSIGMGATCAMFVLGSLREIIGNGTLFDGADALLGSWAKVLRVEIFHTDSPFLLAMLPPGAFIGLGLMLAGKYLIDERMKKRRAEAAAERALPNGETGNV

SEQ ID NO: 20506 - DNA, 684 bp, Haemophilus ducreyi
  CDS (1)..(684): transl_table=11
atggcggataatcaaattccaattactcaaattgaagatggcacagtaaaacagccgtctgtttggcgaaatttattgattgatggattatggaaaaataatggtgccttagtgcaattgttaggcctttgccctttattggctgtatcgaatagtgtgactaatgcactggggcttgggctagcaaccttatttgtattgttgtgtactaatgtaactatttctttatttcgtcaaatgatcccgcatgatattcgtattcctatttatgtgatggtgattgcaacagtggtaacggcggtgcaattgttgatgaatgcttttgcgtatcctgtttatcaatcattaggcatctttattccattaattgtgactaattgtattgtgattggtcgagcagaggcttatgcatctaagcatcaagttcatcattctgcttttgatgggctagcaacaggtttgggaatgacactgagtttagtgttgcttggggcaatccgtgaattaattggtaatggcacattatttgatggattagatttgctgtttggtgattgggcaaaagtgttacggcttgatctcttacagttagattcaggcttattgttagctattttgccaccgggtgcttttattggccttggtttaattttagcggtcaaaaatctttttgatcataaataa

SEQ ID NO: 20507 - protein, 227 aa, Haemophilus ducreyi
MADNQIPITQIEDGTVKQPSVWRNLLIDGLWKNNGALVQLLGLCPLLAVSNSVTNALGLGLATLFVLLCTNVTISLFRQMIPHDIRIPIYVMVIATVVTAVQLLMNAFAYPVYQSLGIFIPLIVTNCIVIGRAEAYASKHQVHHSAFDGLATGLGMTLSLVLLGAIRELIGNGTLFDGLDLLFGDWAKVLRLDLLQLDSGLLLAILPPGAFIGLGLILAVKNLFDHK

SEQ ID NO: 20508 - DNA, 708 bp, Haemophilus influenzae
  CDS (1)..(708): transl_table=11
atgacagatttaactgaaaaaaataccgcacttgaagaagaaaaaatagaaagtgcggttgaaaatcaacaaaaatccatctggaaagaaatttttgctcaaggaatttggaaaaataatcctgcggttgtccaacttctcgggctctgtccgctgttagcggtgtctagcaccgccaccaatgcacttggtttaggtttagcgacaatgcttgtactcacttgcacaaatacggtcatttcccttttccgtcaatatattcctaaggaaatccgtattccaatctacgtaatgatcattgcaaccacagtaacagcggttcaacttttaatgaatgcttacacttatacgctttatcaatcactggggatttttattccattaattgtgaccaactgtattattatcggtcgcgcagaagcattcgcctcaaaaaacagcttactccattccatctgggatgggttttcaatgggattaggaatggcacttagtctaaccatactcggcgcattacgtgaaattattggacaaggcacgatttttgagggcatagaaaatctattcggcgaacaagcaaaatttttaacgcaccatatttaccatacagacagtagctttttacttttcattctgccaccaggcgcatttataggcttaggcttgctcctcgccataaaaaatcgaattgataatataaaaaaataa

SEQ ID NO: 20509 - protein, 235 aa, Haemophilus influenzae
MTDLTEKNTALEEEKIESAVENQQKSIWKEIFAQGIWKNNPAVVQLLGLCPLLAVSSTATNALGLGLATMLVLTCTNTVISLFRQYIPKEIRIPIYVMIIATTVTAVQLLMNAYTYTLYQSLGIFIPLIVTNCIIIGRAEAFASKNSLLHSIWDGFSMGLGMALSLTILGALREIIGQGTIFEGIENLFGEQAKFLTHHIYHTDSSFLLFILPPGAFIGLGLLLAIKNRIDNIKK

SEQ ID NO: 20510 - DNA, 723 bp, Pseudomonas aeruginosa
  CDS (1)..(723): transl_table=11
atgagtgaacaagatttccgcgagatcgcccgcaacggcctgtggcgcaacaacccgggcctggtccagttgctcggcctgtgcccgctgctgggcaccagcaactcgacggtcaacgccctcggcctgggcctggccaccatgctcgtgctggcctgctccaatgccgcggtatcgttggtgcgcggcgcggtgagcgaggcgatccggctaccggcgttcgtcatgatcatcgccgtgctgaccacctgcatcgaactgctgatgcaggcctggacctacgagctgtaccaggtcctcggcatcttcatcccgctgatcaccaccaactgcgtgatcctcggtcgcgccgaggccttcgcggcgaagaacggcgtgctgcgcgccagcttcgacggactgctgatgggcctcggcttcgccctggtcctgctggtcctcggcggcctgcgcgagctgctcggccagggtaccctgctggccgacatgcacttgctgttcggcccggcggcggcggactggaagatccagccgttcccgcagtaccagggcttcctgctggcgatcctgccgccgggcgcgttcatcatgctcggcctgctgatcgccctgaagaaccgtatcgatgaaagcctggcggaacgcgccaaggtgcaggcgggcgacgtacccgccacccagcgccagcgccagcgcgtccgcgtcaccggagtgattgaatga

SEQ ID NO: 20511 - protein, 240 aa, Pseudomonas aeruginosa
MSEQDFREIARNGLWRNNPGLVQLLGLCPLLGTSNSTVNALGLGLATMLVLACSNAAVSLVRGAVSEAIRLPAFVMIIAVLTTCIELLMQAWTYELYQVLGIFIPLITTNCVILGRAEAFAAKNGVLRASFDGLLMGLGFALVLLVLGGLRELLGQGTLLADMHLLFGPAAADWKIQPFPQYQGFLLAILPPGAFIMLGLLIALKNRIDESLAERAKVQAGDVPATQRQRQRVRVTGVIE

SEQ ID NO: 20512 - DNA, 726 bp, Pseudomonas stutzeri
  CDS (1)..(726): transl_table=11
atgagcagccaatgcggatcagcggatgtcacggcgcccaagcccaaggggctgttcaactacttcagctcggcgctgtgggactacaacgtcgccctggtgcaaatgctcgcgttgtgcccggcgctggcggtgaccaccaccgctaccaacggcctgggcatgggcctggccaccaccctggtgctgatgatcaccaatgcgatcatttccgcgctgcgccacagcatttcgccggcggtgcgcaacccgctgatgatcggcatcatcgccggcgtggtgaccctcatcgacatggcgatcaatgcctggatgcacgaactgtacaaggtgctggggctgttcatcgccttgatcgtgaccaactgcgcggtactcggccgtgccgaatcgttctgcagccgcaacccggtgctgccctcgatcctcgacgggcgccgggcatgggcatcgggcttcacctgggtactggtggtgatcggcgggatacgcgagatcctcgggcagcgggcacgttgttcgcccaggcctcgcttgctgctcggtgagcacttccgctggctggagatcaccgtcctgcccggcttccagggcatcctgctggcgatcctgccgcccggggcgttcattgttctgggcttcgtgctggcgttcaagcgagtagttgatcgccggcgcgccgagcgacggatcaggacccatggcgaactggtagtgttgcagtga

SEQ ID NO: 20513 - protein, 241 aa, Pseudomonas stutzeri
MSSQCGSADVTAPKPKGLFNYFSSALWDYNVALVQMLALCPALAVTTTATNGLGMGLATTLVLMITNAIISALRHSISPAVRNPLMIGIIAGVVTLIDMAINAWMHELYKVLGLFIALIVTNCAVLGRAESFCSRNPVLPSILDGRRAWASGFTWVLVVIGGIREILGQRARCSPRPRLLLGEHFRWLEITVLPGFQGILLAILPPGAFIVLGFVLAFKRVVDRRRAERRIRTHGELVVLQ

SEQ ID NO: 20514 - DNA, 732 bp, Rhodobacter capsulatus
  CDS (1)..(732): transl_table=11
atgtcggagagttacgccaagatcgcccgcgacggcttgtgggacaagaacatcgtgacgggccagatgctggcgctgtgcccgacgctggccatcaccggcaccgccacgaacgggctgggcatggggctggcgacgacggtggtgctgatcctgtcgaacgtggtgatttccgcgctgcgcaagaccatcgccccggagatccgcattccggccttcatcctgatcatcgccgccatcgtgaccgtggtcgatctggcgctgaacgcctggctgcacgatctgcacaaggtgctgggcctcttcatcgcgctgatcgtgaccaactgcgccatcctgggccgggccgaggcctttgcctcgcgctttggcgtgctcgcctcggcgcttgacgggctgatgatggggatcggcttcacgcttgcgctggtggtggtgggggcgatccgggaaatcctgggttcggggacgcttttcgcccaggcctcgctgcttctggggccgcatttcgccttcatggagctgcagatctttcccgactaccccggctttctgatcatgatcctgccgccgggcggctttctggtggtgggggggcttttcgcgctcaagcgcatcatcgatgcccgcaagccgacgatcgaacaggaaatcaagcagatgcgcaccgaacgcgtgttcaccgcggcgggcgtgctgaaaccgaaactggaaaccggagaagaggcatga

SEQ ID NO: 20515 - protein, 243 aa, Rhodobacter capsulatus
MSESYAKIARDGLWDKNIVTGQMLALCPTLAITGTATNGLGMGLATTVVLILSNVVISALRKTIAPEIRIPAFILIIAAIVTVVDLALNAWLHDLHKVLGLFIALIVTNCAILGRAEAFASRFGVLASALDGLMMGIGFTLALVVVGAIREILGSGTLFAQASLLLGPHFAFMELQIFPDYPGFLIMILPPGGFLVVGGLFALKRIIDARKPTIEQEIKQMRTERVFTAAGVLKPKLETGEEA

SEQ ID NO: 20516 - DNA, 693 bp, Salmonella choleraesuis
  CDS (1)..(693): transl_table=11
atgagcgaaataaaagacattgttgttcaggggttatggaaaaataactctgctctggtgcagctacttggcctgtgccctctactggcggtgacgtctacggcaaccaacgctctggggctgggtctggccacaacgctggtattaacgctgaccaaccttacggtgtccgcactacgtcgctggacgccggcagaaatccgtatcccgatttacgttatgatcattgcctcggtggtaagcgcagtacagatgctgatcaatgcgtatgcgttcggtttgtatcagtctttagggatttttattccgctgattgtaacgaactgcattgttgttggtcgcgccgaagcgtttgccgcgaaaaaaggaccgtggctttccgcgttggacggtttttctatcggcatgggcgcgacaggcgcgatgttcgtgctgggctcactgcgcgagatcctcgggaatggtacgcttttcgatggcgcggatagcctgctgggaggctgggcaaaagtattacgggtcgagatatttcacaccgactcgcctttcctgctggcgatgctgccgccaggcgcgtttatcggtctgggactcatgctggcggtaaaatatcttattgatgaaaaaatgaagaaacgccgcgccgaaaccgcgccttccgcagttccggcaggtgaaacagggaaagtctga

SEQ ID NO: 20517 - protein, 230 aa, Salmonella choleraesuis
MSEIKDIVVQGLWKNNSALVQLLGLCPLLAVTSTATNALGLGLATTLVLTLTNLTVSALRRWTPAEIRIPIYVMIIASVVSAVQMLINAYAFGLYQSLGIFIPLIVTNCIVVGRAEAFAAKKGPWLSALDGFSIGMGATGAMFVLGSLREILGNGTLFDGADSLLGGWAKVLRVEIFHTDSPFLLAMLPPGAFIGLGLMLAVKYLIDEKMKKRRAETAPSAVPAGETGKV

SEQ ID NO: 20518 - DNA, 693 bp, Salmonella paratyphi
  CDS (1)..(693): transl_table=11
atgagcgaaataaaagacattgttgttcaggggttatggaaaaataactctgctctggtgcagctacttggcctgtgccctttactggcagtgacgtctacggcaaccaacgctctggggctgggtctcgccacaacgctggtattaacgctgaccaaccttacggtgtccacactacgtcgctggacgccggcagaaatccgtatcccgatttacgttatgatcattgcttcggtggtcagcgcagtacagatgctgatcaatgcatatgcgttcggtctgtatcagtctttagggatttttattccgctgattgtaacgaactgcatagttgttggtcgcgccgaagcgtttgccgcgaaaaaaggaccgtggctttccgcgttggacggtttttccatcggcatgggcgcgacaggcgcgatgttcgtgctgggctcactgcgcgagatcctcgggaatggtacgcttttcgatggcgcggatagcctgctgggaggctgggcaaaagtattacgggtcgagatatttcacaccgactcgcctttcctgctggcgatgctgccgccaggcgcgtttatcggtctgggactcatgctggcggtaaaatatcttattgatgaaaaaatgaagaaacgccgcgccgaaaccgcgccttccgctgttccggccggtgaaacagggaaagtctga

SEQ ID NO: 20519 - protein, 230 aa, Salmonella paratyphi
MSEIKDIVVQGLWKNNSALVQLLGLCPLLAVTSTATNALGLGLATTLVLTLTNLTVSTLRRWTPAEIRIPIYVMIIASVVSAVQMLINAYAFGLYQSLGIFIPLIVTNCIVVGRAEAFAAKKGPWLSALDGFSIGMGATGAMFVLGSLREILGNGTLFDGADSLLGGWAKVLRVEIFHTDSPFLLAMLPPGAFIGLGLMLAVKYLIDEKMKKRRAETAPSAVPAGETGKV

SEQ ID NO: 20520 - DNA, 693 bp, Vibrio cholerae
  CDS (1)..(693): transl_table=11
atgaatgaaaaccgaactctgatgttaaatggcatgtggaacaacaacccagccttagtgcaattactgggattgtgtccgctgctcgccgtttcctccaccgtgaccaatgccctcggattaggcattgctacgcttcttgttctcgtcggctcgaatgtcaccgtctctctcgtgcgtgattatgtgccgaaagaagtccgaattccggtgttcgtgatgatcatcgcttcgctggtgacttgcgtacagttactgatgaacgcctacgcttacgggctttatctctcgctcggcatttttattccgctgattgtgacaaactgcatcatcataggccgtgctgaagcgtttgcttcaaaaaatgatgtgctcccagccgcgttagacggattttggatgggattggggatgacctcagtactggttgtgctcggatcactgcgcgaaatcatcggcaatggcacgctgttcgatggcgcggacctgctactcggagaatgggctaaagtcctacgcatcgaagtgtttcactttgacagcgcctttttgctggcactgctgccccccggtgccttcatcggcgttggctttttgatcgccgctaaaagcgtgattgataaacagactgccgctcgccaaccaaaacaacaaaagcaagccatagagcgtgcacgcgtgaccaatgtctaa

SEQ ID NO: 20521 - protein, 230 aa, Vibrio cholerae
MNENRTLMLNGMWNNNPALVQLLGLCPLLAVSSTVTNALGLGIATLLVLVGSNVTVSLVRDYVPKEVRIPVFVMIIASLVTCVQLLMNAYAYGLYLSLGIFIPLIVTNCIIIGRAEAFASKNDVLPAALDGFWMGLGMTSVLVVLGSLREIIGNGTLFDGADLLLGEWAKVLRIEVFHFDSAFLLALLPPGAFIGVGFLIAAKSVIDKQTAARQPKQQKQAIERARVTNV

SEQ ID NO: 20522 - DNA, 693 bp, Vibrio parahaemolyticus
  CDS (1)..(693): transl_table=11
atgagcgaaaacaaacaattgatgaagaacggcatgtggagcaacaacccagcattggttcagctgctcggtttatgtcctctactcgccgtttcatcgacgatcaccaacgcgctgggtcttggtattgccacattactggtactagtggggtctaacgtaacggtttcactgatccgtaactatgttcctaaagagatacgaattccggttttcgttatgatcattgcgtcactcgtaacctgcgtccagctattaatgaatgcttacgcttacggattgtacctatcactgggtatctttatcccgttgatcgtaaccaactgtatcatcatcggtcgcgccgaagcttacgcttcaaaaaatgatgtgcttcctgccgcattggacggcttatggatgggactgggcatgaccagtgtgctagttgtgttgggctcaatgcgcgagcttatcggcaacggcacattgtttgacggcgcagacttgctattgggtgactgggctgcagcgctgcgcattcaagtattccaatttgatagcagcttcttattagcactattaccaccaggtgctttcatcggtgtaggacttttgattgcgttgaaaaatgttatcgacagctcaattcaggctcgtcagccgaaagaagaaaaaccggccattgagcgtgctcgcgtaactaacgcataa

SEQ ID NO: 20523 - protein, 230 aa, Vibrio parahaemolyticus
MSENKQLMKNGMWSNNPALVQLLGLCPLLAVSSTITNALGLGIATLLVLVGSNVTVSLIRNYVPKEIRIPVFVMIIASLVTCVQLLMNAYAYGLYLSLGIFIPLIVTNCIIIGRAEAYASKNDVLPAALDGLWMGLGMTSVLVVLGSMRELIGNGTLFDGADLLLGDWAAALRIQVFQFDSSFLLALLPPGAFIGVGLLIALKNVIDSSIQARQPKEEKPAIERARVTNA

SEQ ID NO: 20524 - DNA, 693 bp, Vibrio vulnificus
  CDS (1)..(693): transl_table=11
atgagtgagcataaaaaattacttaaaaatggcatgtgggacaacaaccctgcactggtccagctacttggtctgtgtccgctactggcggtatcgtcaaccgtcaccaacgcacttggtctcggcatagcaacattattggttctcgttggctccaacgtcactgtttctctgattcgtaactacgtaccaaaagaaattcgtattccggtattcgttatgatcattgcctcactggtcacgtgcgttcaattactgatgaacgcctacgcctatggcttatacctatcattgggcattttcattcctttgattgtgaccaactgcatcatcatcggccgtgctgaagcgtacgcatcaaaaaatgatcctttgcctgcggcattagatggcttttggatgggcatgggtatgaccaccgtgcttgtcgttctgggcgcaatgcgcgaaatcatcggcaacggtacccttttcgatggcgcggatcttctgctgggtgaatgggcgagcgcactgcggattcaagtattccaatttgacagtagcttcctactggcgctgttaccgcccggggcatttattggtgtcggcctgctcatcgcgttgaaaaatgtcatcgatacacagttaaaagctcgccaacctaaacaagaaaaacccgcgattgaacgcgctcgcgtgactaacgcataa

SEQ ID NO: 20525 - protein, 230 aa, Vibrio vulnificus
MSEHKKLLKNGMWDNNPALVQLLGLCPLLAVSSTVTNALGLGIATLLVLVGSNVTVSLIRNYVPKEIRIPVFVMIIASLVTCVQLLMNAYAYGLYLSLGIFIPLIVTNCIIIGRAEAYASKNDPLPAALDGFWMGMGMTTVLVVLGAMREIIGNGTLFDGADLLLGEWASALRIQVFQFDSSFLLALLPPGAFIGVGLLIALKNVIDTQLKARQPKQEKPAIERARVTNA

SEQ ID NO: 20526 - DNA, 702 bp, Yersinia pestis
  CDS (1)..(702): transl_table=11
atgagtgaagcgaaaaacctgttagcacaagggttgtggaaaaataactctgcgctggtgcaactgttggggctctgtccattattggcagtctcttccacggcaaccaacgcattggggctggggttagcgaccacgctagtccttgtgtgtaccaataccgcagtttccgcattgcgccgttgggtaccgtctgaaatccgtattcctatttatgtcatgattattgcgtcggtcgtcagtaccgtgcaaatgctgatcaacgcttatgcctttggtttatatcaatcattggggatatttatcccattgattgtgaccaactgtatcgtgattggccgggcagaggcctatgcagcgaagaatccggtggggctatccgcattggatggttttgccatggggatgggagcaacctgtgccttatttgttttaggggcactgcgcgaaattttgggtaacggtaccttatttgacggcgcagacatgttgctaggcagttgggctacagtactgcgcattgacatcttgcatttagatacccctttcctgctggcgatgttgccaccaggtgcgtttatcggcctgggtttactgctggccggtaaatatgtcattgacgagaaaatgaaagcgcgcaaagccaatacacgggttagcgtaccgcaacttcaggatggagatgccgagaaagccttatga

SEQ ID NO: 20527 - protein, 233 aa, Yersinia pestis
MSEAKNLLAQGLWKNNSALVQLLGLCPLLAVSSTATNALGLGLATTLVLVCTNTAVSALRRWVPSEIRIPIYVMIIASVVSTVQMLINAYAFGLYQSLGIFIPLIVTNCIVIGRAEAYAAKNPVGLSALDGFAMGMGATCALFVLGALREILGNGTLFDGADMLLGSWATVLRIDILHLDTPFLLAMLPPGAFIGLGLLLAGKYVIDEKMKARKANTRVSVPQLQDGDAEKAL

SEQ ID NO: 20528 - DNA, 25 bp, Artificial sequence
  (1)..(25): primer
atgactgactacctgttactgtttg

SEQ ID NO: 20529 - DNA, 25 bp, Artificial sequence
  (1)..(25): primer
ttacaacttcaccaaaccactaaag

SEQ ID NO: 20530 - protein, 232 aa, Artificial sequence
  Variant (2)..(5): xaa in position 2 to 5 is any amino acid
  Variant (7)..(9): xaa in position 7 to 9 is any amino acid
  Variant (11)..(15): xaa in position 11 to 15 is any amino acid
  Variant (16)..(16): xaa in position 16 is any or no amino acid
  Variant (21)..(22): xaa in position 21 to 22 is any amino acid
  Variant (27)..(29): xaa in position 27 to 29 is any amino acid
  Variant (30)..(33): xaa in position 30 to 33 is any or no amino acid
  Variant (35)..(36): xaa in position 35 to 36 is any or no amino acid
  Variant (41)..(43): xaa in position 41 to 43 is any amino acid
  Variant (45)..(53): xaa in position 45 to 53 is any amino acid
  Variant (56)..(58): xaa in position 56 to 58 is any amino acid
  Variant (60)..(62): xaa in position 60 to 62 is any amino acid
  Variant (63)..(87): xaa in position 63 to 87 is any or no amino acid
  Variant (89)..(93): xaa in position 89 to 93 is any amino acid
  Variant (95)..(95): xaa in position 95 is any amino acid
  Variant (99)..(100): xaa in position 99 to 100 is any amino acid
  Variant (102)..(103): xaa in position 102 to 103 is any amino acid
  Variant (106)..(107): xaa in position 106 to 107 is any amino acid
  Variant (109)..(114): xaa in position 109 to 114 is any amino acid
  Variant (116)..(116): xaa in position 116 is any amino acid
  Variant (117)..(118): xaa in position 117 to 118 is any or no amino acid
  Variant (120)..(120): xaa in position 120 is any amino acid
  Variant (124)..(124): xaa in position 124 is any amino acid
  Variant (127)..(128): xaa in position 127 to 128 is any amino acid
  Variant (131)..(131): xaa in position 131 is any amino acid
  Variant (135)..(147): xaa in position 135 to 147 is any amino acid
  Variant (148)..(158): xaa in position 148 to 158 is any or no amino acid
  Variant (160)..(160): xaa in position 160 is any amino acid
  Variant (162)..(162): xaa in position 162 is any amino acid
  Variant (164)..(166): xaa in position 164 to 166 is any amino acid
  Variant (171)..(173): xaa in position 171 to 173 is any amino acid
  Variant (176)..(177): xaa in position 176 to 177 is any amino acid
  Variant (179)..(179): xaa in position 179 is any amino acid
  Variant (183)..(183): xaa in position 183 is any amino acid
  Variant (185)..(188): xaa in position 185 to 188 is any amino acid
  Variant (189)..(203): xaa in position 189 to 203 is any or no amino acid
  Variant (205)..(219): xaa in position 205 to 219 is any amino acid
  Variant (220)..(220): xaa in position 220 is any or no amino acid
  Variant (222)..(224): xaa in position 222 to 224 is any amino acid
  Variant (227)..(231): xaa in position 227 to 231 is any amino acid
LXXXXVXXXNXXXXXXLGLCXXLAVSXXXXXXXAXXMGLAXXXVXXXXXXXXXLIXXXIXXXXXXXXXXXXXXXXXXXXXXXXXXXXLXXXXXIXVIAXXVXXVEXXLXXXXXXLXXXLXIFLXLIXXNCXVLGXXXXXXXXXXXXXXXXXXXXXXXXSXVXGXXXGLGFXXXLVXXAXIREXLXXXXXXXXXXXXXXXXXXXVXXXXXXXXXXXXXXXXLXXXAFXXXXXL

SEQ ID NO: 20531 - protein, 30 aa, Artificial sequence
  Variant (2)..(4): xaa in position 2 to 4 is any or no amino acid
  Variant (7)..(7): xaa in position 7 is Ile, Leu, Met or Val
  Variant (9)..(9): xaa in position 9 is Pro, Ser or Thr
  Variant (10)..(10): xaa in position 10 is any amino acid
  Variant (11)..(11): xaa in position 11 is Leu or Met
  Variant (12)..(12): xaa in position 12 is Ala or Gly
  Variant (13)..(13): xaa in position 13 is any amino acid
  Variant (14)..(14): xaa in position 14 is Ser or Thr
  Variant (15)..(18): xaa in position 15 to 18 is any amino acid
  Variant (19)..(19): xaa in position 19 is Asn, Ser, Thr or Val
  Variant (20)..(20): xaa in position 20 is Ala, Gly, Ser or Thr
  Variant (21)..(22): xaa in position 21 to 22 is any amino acid
  Variant (23)..(23): xaa in position 23 is Leu or Met
  Variant (24)..(24): xaa in position 24 is Ala, Cys, Gly, Ser or Thr
  Variant (25)..(25): xaa in position 25 is any amino acid
  Variant (26)..(26): xaa in position 26 is Ala, Cys, Gly, Ser or Thr
  Variant (27)..(29): xaa in position 27 to 29 is any amino acid
  Variant (30)..(30): xaa in position 30 is Ala, Ile, Leu or Val
LXXXLGXCXXXXXXXXXXXXXXXXXXXXXX

SEQ ID NO: 20532 - protein, 38 aa, Artificial sequence
  Variant (3)..(4): xaa in position 3 to 4 is any amino acid
  Variant (6)..(8): xaa in position 6 to 8 is any amino acid
  Variant (9)..(9): xaa in position 9 is Asp, Glu or Gln
  Variant (10)..(11): xaa in position 10 to 11 is any amino acid
  Variant (12)..(12): xaa in position 12 is Phe, Ile, Leu, Met or Val
  Variant (13)..(18): xaa in position 13 to 18 is any amino acid
  Variant (19)..(19): xaa in position 19 is Ile, Leu, Met or Val
  Variant (20)..(22): xaa in position 20 to 22 is any amino acid
  Variant (24)..(24): xaa in position 24 is Gly or Ser
  Variant (25)..(25): xaa in position 25 is Ile, Leu or Val
  Variant (26)..(26): xaa in position 26 is Phe or Tyr
  Variant (27)..(27): xaa in position 27 is Ile, Leu or Val
  Variant (28)..(28): xaa in position 28 is Ala, Gly, Pro or Ser
  Variant (30)..(30): xaa in position 30 is Ile or Leu
  Variant (31)..(31): xaa in position 31 is any amino acid
  Variant (32)..(32): xaa in position 32 is Thr or Val
  Variant (35)..(35): xaa in position 35 is any amino acid
  Variant (36)..(36): xaa in position 36 is Ile or Val
  Variant (37)..(37): xaa in position 37 is Phe, Ile, Leu, Met or Val
  Variant (38)..(38): xaa in position 38 is Ala or Gly
IAXXVXXXXXXXXXXXXXXXXXLXXXXXLXXXNCXXXX

SEQ ID NO: 20533 - protein, 14 aa, Artificial sequence
  Variant (2)..(4): xaa in position 2 to 4 is any amino acid
  Variant (5)..(5): xaa in position 5 is Ala, Ile or Val
  Variant (6)..(6): xaa in position 6 is Ile, Leu or Met
  Variant (7)..(8): xaa in position 7 to 8 is any amino acid
  Variant (9)..(9): xaa in position 9 is Phe, Ile, Leu, Met or Val
  Variant (10)..(10): xaa in position 10 is Ala, Gly or Ser
  Variant (11)..(12): xaa in position 11 to 12 is any amino acid
GXXXXXXXXXXXRE

SEQ ID NO: 20534 - DNA, 627 bp, Escherichia coli K12
  CDS (1)..(627): transl_table=11
gtgcctgtgctagaccgccatcttcatccccggattaaaccgttgttgcatcagtgcgtgcgggttcttgataaaccgggcattacgccagatggtttaacattagtgggatttgccatcggcgtgctggctctgccgtttctggcgctgggctggtatctggcggcgctagtcgtcattttgttgaacaggctgcttgatggtctggacggtgcgctggcgcggcgcagagagcttaccgacgcgggcggctttcttgatatttctctcgattttctcttttacgcgctggtgccgtttggctttattcttgctgcaccggagcaaaatgcgctggcaggcggctggttgttgtttgcgtttatcggcacgggcagcagttttctcgcctttgctgcactggcagcaaaacatcagattgataaccccggttatgcacataagtcgttttactatctggggggattaaccgaaggcacagaaacgatcttactgtttgtgctgggatgtttattccctgcatggtttgcgtggtttgcgtggatcttcggtgcgttgtgctggatgacgacctttacgcgggtgtggagtgggtatctgacgctgaagtcgctccagcgtcagtaa

SEQ ID NO: 20535 - protein, 208 aa, Escherichia coli K12
MPVLDRHLHPRIKPLLHQCVRVLDKPGITPDGLTLVGFAIGVLALPFLALGWYLAALVVILLNRLLDGLDGALARRRELTDAGGFLDISLDFLFYALVPFGFILAAPEQNALAGGWLLFAFIGTGSSFLAFAALAAKHQIDNPGYAHKSFYYLGGLTEGTETILLFVLGCLFPAWFAWFAWIFGALCWMTTFTRVWSGYLTLKSLQRQ

SEQ ID NO: 20536 - DNA, 519 bp, Archaeoglobus fulgidus DSM 4304
  CDS (1)..(519): transl_table=11
gtggcattaagactgtccaaactcggagtaaagcccaaccacctcacactcgccggtctggtttttgctctcatctcctcttacctgataattgagggcaggatattgcatgcaagcatcttcgtcctgctcagcagcctttgcgatttgcttgacggggcgctggcgagaaaggcagagttaaccacaaagtttgggggctaccttgattcagtgactgacagatacgttgacgtcatcctcttcatctccctcggaatctacggcgttgactgggttgccatcgcaatggcgatgagcggagctttgcttgtgagctacacgagggcgagggccgaaacaattatcgagaagtgcgatgttggtatagcagagaggagcgagaggcttttgattctgcttctggggatgcttacaggatacatttacgaggctgttttgattatagctgttttaagccacatcactgccctgcacagggttgtttatacttactcaagaacaaaggagggggattag

SEQ ID NO: 20537 - protein, 172 aa, Archaeoglobus fulgidus DSM 4304
MALRLSKLGVKPNHLTLAGLVFALISSYLIIEGRILHASIFVLLSSLCDLLDGALARKAELTTKFGGYLDSVTDRYVDVILFISLGIYGVDWVAIAMAMSGALLVSYTRARAETIIEKCDVGIAERSERLLILLLGMLTGYIYEAVLIIAVLSHITALHRVVYTYSRTKEGD

SEQ ID NO: 20538 - DNA, 561 bp, Pyrococcus abyssi GE5
  CDS (1)..(561): transl_table=11
atgctaagcaagctgaggccagcggtgaaggagcctctagaaagaacggccagttacctagctaaaataggcctaacgccgaatcaagtcacccttctcggctttctcttgacgcttatagcatcttacgagttttatcttggtaatcaaatcgttgcaggtacaataatggccatcggctccctattggatgccttagatggagcgttagctagggccaccggaaaggtgtcaaggttcggtggattcctagattctacattggataggctgagcgatggagcgcttttagttggaatagccctaggtaacttaatcgactggagggtagcatttttagcattgattggctcgtacatggtgagctatgctaggtgtagagcggagctcgcgggttcgggaacgctagctgttggaattgccgaaaggggagagaggctcataataataatgatcttctcgctcattaatagggtttggatcggggtttatttagttgcggtgctctcctgggttaccttcattcaaagggtttatgaggcgaggaaaagactccaatga

SEQ ID NO: 20539 - protein, 186 aa, Pyrococcus abyssi GE5
MLSKLRPAVKEPLERTASYLAKIGLTPNQVTLLGFLLTLIASYEFYLGNQIVAGTIMAIGSLLDALDGALARATGKVSRFGGFLDSTLDRLSDGALLVGIALGNLIDWRVAFLALIGSYMVSYARCRAELAGSGTLAVGIAERGERLIIIMIFSLINRVWIGVYLVAVLSWVTFIQRVYEARKRLQ

SEQ ID NO: 20540 - DNA, 621 bp, Vibrio cholerae O1 biovar eltor str. N16961
  CDS (1)..(621): transl_table=11
atgcttgatcgctacgcgataaaaatcattcgctggccacttcatcaagccgcaggattgctggatgaagcgggcgtcaccgccaatcaaaccacggtattcggctttgtgattggggcattagcattacctgcgcttgcaatgcagcaatactggctcgccttgttattgattgtggttaatcggatctgtgatggactggatggtgccctcgcgcgccgccaagggctgacagatgcgggaggatttctcgatattagcctcgactttctgttctactctttagtgccgtttggctttgtccttgcaaacccagaacataacgcggtcgcgggcgctttcttgatttttgcttttatcgggacgggtagtagctttcttgcttttgcagtcatggccagtaaacgtaacatcaccaatccggtgtatcagcacaaatccttgtattacatgagcggtctgacagagggcacggaaaccatcgcctgcttcatgttgatgtgtttattgcctcactctttttcaaccctagcttggctgtttggtgctgcctgttggtttactacggcaacccgcatctattacggttttcaaaccttgcaacacgtcgaacaaaggtaa

SEQ ID NO: 20541 - protein, 206 aa, Vibrio cholerae O1 biovar eltor str. N16961
MLDRYAIKIIRWPLHQAAGLLDEAGVTANQTTVFGFVIGALALPALAMQQYWLALLLIVVNRICDGLDGALARRQGLTDAGGFLDISLDFLFYSLVPFGFVLANPEHNAVAGAFLIFAFIGTGSSFLAFAVMASKRNITNPVYQHKSLYYMSGLTEGTETIACFMLMCLLPHSFSTLAWLFGAACWFTTATRIYYGFQTLQHVEQR

SEQ ID NO: 20542 - DNA, 588 bp, Methanothermobacter thermautotrophicus str. Delta H
  CDS (1)..(588): transl_table=11
gtgccagatataaatgagtccatgttaaaccagttcagaccggtgatccggagattcattgaccccattgcagatagaattgccctgccagcagattacataacactgacgggtttccttgttgcatgtgctgccagcgcaggatatgcatctggaagcctgatcactggagcggccctgcttgcagcaagtggattcatagatgtgcttgacggggccgtggcacggagaagattcaggcccacagccttcggtggtttccttgactctacccttgacagactctccgatggtataatcatcatcgggataaccgcggggggattcacaggactgctaaccgggctcctcgcactccattccggactcatggtgagctatgtgagggcccgtgcagaatctctgggcattgaatgcgctgttggaatcgctgaaagggctgagagaatcattataatccttgcagggtcccttgcagggtaccttatccatccgtggttcatggacgctgcgattattgtgctcgcagctctcggttactttaccatgatccagaggatgatctacgtgtggcaaaggctgaaataa

SEQ ID NO: 20543 - protein, 195 aa, Methanothermobacter thermautotrophicus str. Delta H
MPDINESMLNQFRPVIRRFIDPIADRIALPADYITLTGFLVACAASAGYASGSLITGAALLAASGFIDVLDGAVARRRFRPTAFGGFLDSTLDRLSDGIIIIGITAGGFTGLLTGLLALHSGLMVSYVRARAESLGIECAVGIAERAERIIIILAGSLAGYLIHPWFMDAAIIVLAALGYFTMIQRMIYVWQRLK

SEQ ID NO: 20544 - DNA, 678 bp, Halobacterium sp. NRC-1
  CDS (1)..(678): transl_table=11
atgcaaccgcgcttcgtcggtcggttaggggtggccgacgccgtgaccacggcgaacgcggcgctggggtttctcgcggtcgtcacggcacccagcaacccccggctcgccgcccggatcgtgctggtggcggcgatcgccgacggcctcgatggggtggtggcgcgccgcctcggctcgacgccggcgggcaaacacctcgattcgcttgccgacgtggcgtcgttcggcgttgcgccggcgtgcatcgtggtcgccgccacggggaacacctggcaggcgggggcaccggtggggatcggggcgctcgtcgtcggggcggggttcgtcgccagcgcggtcgtccggctgggcctgtacacggcctacgacaccggccacgagcacacggagggcgtgcagacaacgcttgccgccacgctgttggcggcgggcgtgctcgcgggcgtcgagcagccgacggtcatcgttggggctgcgggggtgctggctgtgttgatggtgtcgacgatcgagtacccagatctgttggttcgggacgcgctcgcgatgggcgtcgtgcaggcgggcgcggtggttgcaccggcggcgctggcgggcgcgttcccgaaggcgttgttcgggtgggcgggcgcgtacctggtgttcgcaccgcggttctactggcgagcggcgtag

SEQ ID NO: 20545 - protein, 225 aa, Halobacterium sp. NRC-1
MQPRFVGRLGVADAVTTANAALGFLAVVTAPSNPRLAARIVLVAAIADGLDGVVARRLGSTPAGKHLDSLADVASFGVAPACIVVAATGNTWQAGAPVGIGALVVGAGFVASAVVRLGLYTAYDTGHEHTEGVQTTLAATLLAAGVLAGVEQPTVIVGAAGVLAVLMVSTIEYPDLLVRDALAMGVVQAGAVVAPAALAGAFPKALFGWAGAYLVFAPRFYWRAA

SEQ ID NO: 20546 - DNA, 612 bp, Sinorhizobium meliloti 1021
  CDS (1)..(612): transl_table=11
atgcttgacggcgcgcttcgcaggcggctcgatccggttctggacaggctcggcgccgcactggccggccgcggggtcagtgccgatgccgtcacgatcctcggcctttgccttggccttgcggcagccctgctcatcggtctcggcgcttatctgcctgccgccgccctgatccttgtgagccggctctgcgacggccttgacggagccgtcgcccgcgcgagccggaaaacggatttcggcggctttctcgacatcgttctcgatttcaccttttacggcgccgttccacttggtttcatcatcgcagatccggccgcaaacggtcttgccggcgggtttttgctcttcgccttctatgtcaacggcgcgagcttcctcgcctatgccgtgatggccgagaagcgcgccctgacgaccgcggtgcgcggtgcgaagtcgctctacttcacgacggggctcgcagaggcgacggagacgatcgtcttttttctgctctcgtgccttttccctgggtggttcccgttattcgcaacggtcttcgcgctcgtctgcctctataccgcgctgtcgcggatcgttctcgcaagactgacttttcggcaagactga

SEQ ID NO: 20547 - protein, 203 aa, Sinorhizobium meliloti 1021
MLDGALRRRLDPVLDRLGAALAGRGVSADAVTILGLCLGLAAALLIGLGAYLPAAALILVSRLCDGLDGAVARASRKTDFGGFLDIVLDFTFYGAVPLGFIIADPAANGLAGGFLLFAFYVNGASFLAYAVMAEKRALTTAVRGAKSLYFTTGLAEATETIVFFLLSCLFPGWFPLFATVFALVCLYTALSRIVLARLTFRQD

SEQ ID NO: 20548 - DNA, 588 bp, Clostridium perfringens str. 13
  CDS (1)..(588): transl_table=11
atgttagatacttatggaagaaagtatgtaaatccaataatagatttaggtgctaatacattattaaagttaagattaacaccaaatggagttagtataatagctctaattataggagttttaagttctgtatttctttatttcgataaattgattttatcagtagtttttctttggatatcaggatacttagattctgttgatggtgctatggcaagaaaaaagaatttaactagcccctttggaacacttttagatataacctttgatagaattgttgaacttagcataatatttgtcttagctttaaaatttcaaaatagtagattatatcttttaatattaacaatgatgattttaatatctatgaccatatttttaacagtaggagccttagctcaaaataatggtatgaagtcttttagataccaagcaggacttgcagaaagatcagaaggatttatttgtttttcacttatgattttactatcatctataaaattaaatttagttacaaatatattttccttaataatatttataaccataatacaaagagctttagaggctaaaaggcttttaaaataa

SEQ ID NO: 20549 - protein, 195 aa, Clostridium perfringens str. 13
MLDTYGRKYVNPIIDLGANTLLKLRLTPNGVSIIALIIGVLSSVFLYFDKLILSVVFLWISGYLDSVDGAMARKKNLTSPFGTLLDITFDRIVELSIIFVLALKFQNSRLYLLILTMMILISMTIFLTVGALAQNNGMKSFRYQAGLAERSEGFICFSLMILLSSIKLNLVTNIFSLIIFITIIQRALEAKRLLK

SEQ ID NO: 20550 - DNA, 564 bp, Pyrococcus furiosus DSM 3638
  CDS (1)..(564): transl_table=11
gtgctgagcaatttgagaccattggcgaaaaagccactggaaaagatagctgagccattctcaaagcttggcataactcctaatcaactcactatggttggatttttcctgtctttacttgcatcttatgaatattacctcaataatcaggtttttggctcattaatactattacttggggcgttcttagatgctttagatgggagcctagcaaggttaaccggaagagttacaaaatttggtggttttctcgattctacgatggataggcttagcgatgcagcaataatctttggaattgcattgggagagttagttaattggaaagtagcgtttttagcgttaataggctcttacatggtaagctatacaagatgtagggctgaattagctggttctggaactttagcagttggaattgctgagaggggagagagattattgattcttgttattgcaggattattcggaattattgatattggtgtgtatctggttgcaatactctcttggataaccttcttgcaaagagtttatgaagcaaagaaaaggcttgaaaaatag

SEQ ID NO: 20551 - protein, 187 aa, Pyrococcus furiosus DSM 3638
MLSNLRPLAKKPLEKIAEPFSKLGITPNQLTMVGFFLSLLASYEYYLNNQVFGSLILLLGAFLDALDGSLARLTGRVTKFGGFLDSTMDRLSDAAIIFGIALGELVNWKVAFLALIGSYMVSYTRCRAELAGSGTLAVGIAERGERLLILVIAGLFGIIDIGVYLVAILSWITFLQRVYEAKKRLEK

SEQ ID NO: 20552 - DNA, 585 bp, Methanosarcina acetivorans C2A
  CDS (1)..(585): transl_table=11
atggtaattccgtttgcccgctcagtgcccctctctccaaacactctaaccctgctgggttttgcggtaagcgtggctgccggagttgcattcgcgctgggaaaaccttttgaaggagggttcctgatcctcttcagcggagtttttgatatccttgacggaggggtcgcaagagcaaaaggaaggatcactcccttcggaggtgtcctcgactcggtttgcgaccgctattccgacggcctgatgttccttggaatcatggccggagcaatttatggccggctcagctttgcccccttcctcggggtggaaggctggctctgggcaggcttcgcactgatcggctctttcctggtaagctacacccgcgcccgtgccgagtccgcaggttgcaggaaactatcagtaggaattgctgaaagaaccgaaagaatggtcatcctggcccttggtgccctctcaggtttccttggctgggctcttgtgctgatagccgtattttcccacatcaccatgatccagagagtgctgagggcaaaaagcatactgagcagtccatcggaacccgaaagccagaaaccgtaa

SEQ ID NO: 20553 - protein, 194 aa, Methanosarcina acetivorans C2A
MVIPFARSVPLSPNTLTLLGFAVSVAAGVAFALGKPFEGGFLILFSGVFDILDGGVARAKGRITPFGGVLDSVCDRYSDGLMFLGIMAGAIYGRLSFAPFLGVEGWLWAGFALIGSFLVSYTRARAESAGCRKLSVGIAERTERMVILALGALSGFLGWALVLIAVFSHITMIQRVLRAKSILSSPSEPESQKP

SEQ ID NO: 20554 - DNA, 618 bp, Streptomyces coelicolor A3(2)
  CDS (1)..(618): transl_table=11
atgctggacgtgcgggcgagggcggcactgagcggtccgctggaccgtgctgccgcgatgctggaccgccccgctgtcacgcccaatcgtctgaccgcgctcggcctgctgacgggtcttgcctcggccggttccgcagcagccggctggtggccggccgctgcggcgctgtggctgctgtcccggctcgccgacggcctggacgggccgctggcccgtcgccgcggcacggcgaacagcagtggagcaggcggcttcctcgacatcagtgccgacttcctcgtctacggagcgttcgtcgtcggcgtcgccgtcggcgtgggcggtccggcactgccgttcctgctcgtcctgctcacctactacgtcaacggcactgccttcctggccttctcctccattgccgagcgcactgggcgccgcggtgacggccgcctgtcaggaggccggtcgctgaacttcctgggcggcctggccgaaggtggcgagaccatcgccgtgcacacactgtggtgcctgctgcccggcttcgcccacaccatcgcctgggtctgggccgcggtggtcgctgtcaccgcggcccaccgcgtcgtcaccggctatcggcagctgcgctga

SEQ ID NO: 20555 - protein, 205 aa, Streptomyces coelicolor A3(2)
MLDVRARAALSGPLDRAAAMLDRPAVTPNRLTALGLLTGLASAGSAAAGWWPAAAALWLLSRLADGLDGPLARRRGTANSSGAGGFLDISADFLVYGAFVVGVAVGVGGPALPFLLVLLTYYVNGTAFLAFSSIAERTGRRGDGRLSGGRSLNFLGGLAEGGETIAVHTLWCLLPGFAHTIAWVWAAVVAVTAAHRVVTGYRQLR

SEQ ID NO: 20556 - DNA, 612 bp, Vibrio parahaemolyticus RIMD 2210633
  CDS (1)..(612): transl_table=11
atgcttgatagcctgagtataaagctcatccgcaaaccgctgacactcagtgcgacatacctcgacaaatgtggcatcaccgcaaaccaaacgacagtatttggttttgtgcttggctgctttgccctaccggctttgatcaccgaacaatacttgttggcattgctgtttattttgctgaacagaatctgtgatggattagacggcgcactggcgaggattcaaggcattaccgatgcgggcggttttctcgatattagcttggattttctgttctattccctaattccttttggttttgtgttagcaaatccagaacaaaatgccattgcaggggcatttttgattttttcctttgtcggaacgggaagcagctttttggcttttgccatcatggcagggaaacaaggcatcgataatccggtgtataaacacaaatctctctactacatgagcggcttaaccgaaggcacggaaaccatcggctgttttgtgctgttttgcctgatgccacaacacttttcggtcattgcatacatcttcggtgcggcatgttggtttaccacattcacgcgaatttactctgggtttcatacgctcaaaggccgttaa

SEQ ID NO: 20557 - protein, 203 aa, Vibrio parahaemolyticus RIMD 2210633
MLDSLSIKLIRKPLTLSATYLDKCGITANQTTVFGFVLGCFALPALITEQYLLALLFILLNRICDGLDGALARIQGITDAGGFLDISLDFLFYSLIPFGFVLANPEQNAIAGAFLIFSFVGTGSSFLAFAIMAGKQGIDNPVYKHKSLYYMSGLTEGTETIGCFVLFCLMPQHFSVIAYIFGAACWFTTFTRIYSGFHTLKGR

SEQ ID NO: 20558 - DNA, 678 bp, Vibrio vulnificus YJ016
  CDS (1)..(678): transl_table=11
ttgatgacgtgccgccaggaagccgagtgctgcattggccttgggagcagtgccatgttagatagatttagcattaaagtgatacgttggccgctgacgcaaagtgcccaagtgctcaaccattatggtgtcaccgccaatcagatcaccgtgctcggttttgtcttaggctgttttgcccttcccgccctagtggcagagcaatacctgctggcattggcttttattgttttaaatcgagtctgcgatggacttgatggggcgttagcacgcctccaagggatcaccgacgccggtggttttctcgacatcagcttggacttcctcttctactcgctcgtcccttttggctttgtcttggctaacccagaacaaaacgccattgctggcgcgtttttgattttctctttcattggaacaggcagcagttttctcgctttcgcggtaatggcaggtaaacggggcattgataacccggtttatcaaaacaaatcactttattacatgagtggtttgaccgaaggcacagaaaccattgcctgctttgtgttgttctgcctcttcccacactctttcgcaacacttgcttacctctttggtgcggcatgttggttcacgacagggacacgtatctactctggctttcataccctcaatcaggttgatgaagaggaataa

SEQ ID NO: 20559 - protein, 225 aa, Vibrio vulnificus YJ016
MMTCRQEAECCIGLGSSAMLDRFSIKVIRWPLTQSAQVLNHYGVTANQITVLGFVLGCFALPALVAEQYLLALAFIVLNRVCDGLDGALARLQGITDAGGFLDISLDFLFYSLVPFGFVLANPEQNAIAGAFLIFSFIGTGSSFLAFAVMAGKRGIDNPVYQNKSLYYMSGLTEGTETIACFVLFCLFPHSFATLAYLFGAACWFTTGTRIYSGFHTLNQVDEEE

SEQ ID NO: 20560 - DNA, 774 bp, Thermus thermophilus HB27
  CDS (1)..(774): transl_table=11
gtggtcccgggggccaaggagaggccggtccaggagttcctcaacgccctccttttccgccccctggcgcacctcgtcgtcctcctcctcctgcgtacgcccgtgaggccccaccacctggtcctcttccacacgggcctggtccttgggaccgcctggctgctccttaggggggaggacctcggggctgccctcctcctccagctcaaaaccgtcttggacaacgccgacgggcagctcgcccgcctccggggggaggtgacggagcttgggcgctatttggacaccggcctggacttcctggggaaccttttcctcttcctggccctgggcttgcgcaccgcctccttggagaaggccctcctcgcctttttggtcttcaccttcgtccagtcctacgacttcaacctggaaaggctccaccgcttggccaaaggcctttccctgcccgaggggcccaaggacagggagacccttgggcttcgcctcttccgggggctttacgccctcctcttcgcccctcaggaccgggccatcgtcgccttggagcgctttctccaggggcggttgcggcttgacccctcccgtttctgggacgagggggccttggcgggggtggtgaacctgggcctcaccacgcagcttttcttcctgggggttttcctcctcttccacgagcctggcgcctacctcacctttgtcctccttcaggctgtgtatcttggcctttggtacctatggaggatcgcccgcagtatcccatccccacggtag

SEQ ID NO: 20561 - protein, 257 aa, Thermus thermophilus HB27
MVPGAKERPVQEFLNALLFRPLAHLVVLLLLRTPVRPHHLVLFHTGLVLGTAWLLLRGEDLGAALLLQLKTVLDNADGQLARLRGEVTELGRYLDTGLDFLGNLFLFLALGLRTASLEKALLAFLVFTFVQSYDFNLERLHRLAKGLSLPEGPKDRETLGLRLFRGLYALLFAPQDRAIVALERFLQGRLRLDPSRFWDEGALAGVVNLGLTTQLFFLGVFLLFHEPGAYLTFVLLQAVYLGLWYLWRIARSIPSPR

SEQ ID NO: 20562 - DNA, 618 bp, Desulfotalea psychrophila LSv54
  CDS (1)..(618): transl_table=11
atgctcgatcgttatatactacccagaaccagctcttttttatccttctgcgctcgtctcctccatgcccgggacatcactgccaatcgggtaaccctctttggcctttgctgtggccttgttaccctgcctcttttagcggtcgaacagtatattcctgccctgttctgtatctgtcttaatcggtttttggatggggtggatggggccttggcccgtattcagggggcaagcgatgatggagcctatcttgatatagtttgtgattttattttttatgccgtggtagttctgggctttgccctggccgcgcctggggagaatgccctggctgctgacctgcttctggctgcctttatgggtacctcctcctcttttttggcctttgccgtcttcgccgagaggaggtctcttccccttattgtctatccctctaaggggttttactatcttggcggtcttgccgaggggacggagaccatctgtttttttattctcttctgtctcttgccccagtggttccccgctctggcgctttttttcgccctgctctgtctggtgaccaccgtcgttcgagtattttttgcctatcgtcttctgcaggagccccacccttaa

SEQ ID NO: 20563 - protein, 205 aa, Desulfotalea psychrophila LSv54
MLDRYILPRTSSFLSFCARLLHARDITANRVTLFGLCCGLVTLPLLAVEQYIPALFCICLNRFLDGVDGALARIQGASDDGAYLDIVCDFIFYAVVVLGFALAAPGENALAADLLLAAFMGTSSSFLAFAVFAERRSLPLIVYPSKGFYYLGGLAEGTETICFFILFCLLPQWFPALALFFALLCLVTTVVRVFFAYRLLQEPHP

SEQ ID NO: 20564 - DNA, 597 bp, Legionella pneumophila subsp. pneumophila str. Philadelphia 1
  CDS (1)..(597): transl_table=11
atgcttgaacaatcattacgacattattatcagcttgtcttggtagatcccatactacctgctttacgtgacaggataacgccattgtccattacctggttgtcgggaatatttggcttgttgtttattccttttgtcttattagacaaaccttatattgcaattagctttctcttgctttctggatacctggatactcttgatggttcgttggcccgctttcaaaacagagcctctgattttggctcagcaatggatatcgtcatagatagaattgtagaattttctgctgttcttgctttgtatctttttgatccacaacaccgtgccactttagccattttaatgttaggcagtattttgctctgtattacaagttttctggttgtgggaattttttccaacaatactactcaaaaaagtttttattacagcccggggataatggagcgtgccgaagcatttctattctttatttttatgacattattttccagctgctttaattttcttgccgctctcttttgttttttagtctgtttaaccgcgttgataaggctttttgaatttaaaaaaagtgtacaggctccaagttag

SEQ ID NO: 20565 - protein, 198 aa, Legionella pneumophila subsp. pneumophila str. Philadelphia 1
MLEQSLRHYYQLVLVDPILPALRDRITPLSITWLSGIFGLLFIPFVLLDKPYIAISFLLLSGYLDTLDGSLARFQNRASDFGSAMDIVIDRIVEFSAVLALYLFDPQHRATLAILMLGSILLCITSFLVVGIFSNNTTQKSFYYSPGIMERAEAFLFFIFMTLFSSCFNFLAALFCFLVCLTALIRLFEFKKSVQAPS

SEQ ID NO: 20566 - DNA, 588 bp, Legionella pneumophila subsp. pneumophila str. Philadelphia 1
  CDS (1)..(588): transl_table=11
atgatagaacaacaccttaggccactgtatcaacgcctttgtgtcaatccaattactcctgtgttgatagagcgagtgaccccaaatcaagtcaccttcttttctggcgtattgggtcttttagtgatacccgcactgtggctaaatctaccctatctggccattagtttactattactgtctggatattgtgataccctcgatggtactattgctcgtctaactaaccatagctctgactggggtagtgtattggatattatgactgatcgcgtggttgaggtgggtgttgtgtttgccttatgggctattaatccaaatgagcggggtcttgggtctttgttaatgatggcgagtatactactttgtatcacgagttttcttgttgtgggtatttttaagactaatgattcagaaaaaagttttcattacagcccaggattaatagaaagagctgaagcctttgttttttttatagccatgatgctttggccaaaccacttcctaagtttagcaatgatcttttctttgttagtgatagggacagcgatgcacaggctttatgaatttcataagcaatctatttaa

SEQ ID NO: 20567 - protein, 195 aa, Legionella pneumophila subsp. pneumophila str. Philadelphia 1
MIEQHLRPLYQRLCVNPITPVLIERVTPNQVTFFSGVLGLLVIPALWLNLPYLAISLLLLSGYCDTLDGTIARLTNHSSDWGSVLDIMTDRVVEVGVVFALWAINPNERGLGSLLMMASILLCITSFLVVGIFKTNDSEKSFHYSPGLIERAEAFVFFIAMMLWPNHFLSLAMIFSLLVIGTAMHRLYEFHKQSI

SEQ ID NO: 20568 - DNA, 657 bp, Nocardia farcinica IFM 10152
  CDS (1)..(657): transl_table=11
gtgctcagcttcttcggccgcgagaccttcgccaaggccaccgcgccgctgggcagggcgctcgtcggcaccgggctcacccccgacgccgtcaccctgatcggcacggcggcctcgatcgcggctgcggtgaccttgttcccgaccgggcatctgttctggggcacgatggtcatctggctgttcgtgatgttcgacatgctcgacggggcgatggccagggcacgcgggggcggcacccgttacggcgcggtgctcgacgccacctgcgaccgggtggccgacggcgccatcttcggcggtctggcctggtgggccgtctaccacgagaacaacaagtggttgctggccgcgacgctggtggtgctggtgacctcgcaggtcatctcctatgccaaggctcgcgcggaggcgagcggcctgtccgccgacggcggcctgatcgagcggcccgaccggctgatcatcgtgctcgtcggcgcgggcttcaccgggatcggcggctactggggaatcgagtggctgacctgggccgtgcacgtggccatgtggatcctggcggtgctgagcatcatcacggtgttccagcgggtgctcgccgtgcgcaattcgcccggcgcgcgtgaggtgatcccggccgccggggaggcccgatga

SEQ ID NO: 20569 - protein, 218 aa, Nocardia farcinica IFM 10152
MLSFFGRETFAKATAPLGRALVGTGLTPDAVTLIGTAASIAAAVTLFPTGHLFWGTMVIWLFVMFDMLDGAMARARGGGTRYGAVLDATCDRVADGAIFGGLAWWAVYHENNKWLLAATLVVLVTSQVISYAKARAEASGLSADGGLIERPDRLIIVLVGAGFTGIGGYWGIEWLTWAVHVAMWILAVLSIITVFQRVLAVRNSPGAREVIPAAGEAR

SEQ ID NO: 20570 - DNA, 597 bp, Legionella pneumophila str. Paris
  CDS (1)..(597): transl_table=11
atgcttgaacaatcattacgacattattatcagcttgtcttggtagatcccatactacctgctttacgtgacaggataacgccattgtccattacctggttgtcgggaatatttggcttgttgtttattccttttgtcttattagacaaaccgtatattgcaattagttttctcttgctttctggatacctggatactcttgatggttcgctggcccgctttcaaaacagagcctctgattttggctcagcaatggatatcgtcatggatagaattgtagaattttctgctgttcttgctttgtatctttttgatccacaacaccgtgccactttagccattttaatgttaggcagtattttactctgtattacaagctttctggttgtgggaattttttccaacaatactactcaaaaaagtttttattacagcccgggaataatggagcgtgccgaagcatttctattctttatttttatgacattattttccagctgctttaattttcttgccgctctcttttgttttttagtctgtttaactgcgttgataaggctttttgaatttaaaaaaagcgtacaggctccaggttag

SEQ ID NO: 20571 - protein, 198 aa, Legionella pneumophila str. Paris
MLEQSLRHYYQLVLVDPILPALRDRITPLSITWLSGIFGLLFIPFVLLDKPYIAISFLLLSGYLDTLDGSLARFQNRASDFGSAMDIVMDRIVEFSAVLALYLFDPQHRATLAILMLGSILLCITSFLVVGIFSNNTTQKSFYYSPGIMERAEAFLFFIFMTLFSSCFNFLAALFCFLVCLTALIRLFEFKKSVQAPG

SEQ ID NO: 20572 - DNA, 597 bp, Legionella pneumophila str. Lens
  CDS (1)..(597): transl_table=11
atgcttgaacaatcattacgacattattatcagcttgtcttgatagatcccatactacctgctttacgtgacaggataacgccattgtccattacctggttgtcgggaatatttggcttgttgtttattccttttgtcttattagacaaaccttatattgcaattagctttctcttgctttcgggatacctggatactcttgatggttcgctggcccgctttcaaaacagagcctctgactttggctcagcaatggatatcgtcatggatagaattgtagaattttctgctgtccttgctttgtatctttttgatccacaacaccgtgccactttagccattttaatgttaggcagtattttactctgtattacaagctttctggttgtgggaattttttccaacaatactactcaaaaaagtttttattacagcccggggataatggagcgtgccgaagcatttctattctttatttttatgacattattttccagctgctttaattttcttgccgctctcttttgttttttagtctgtctaaccgcgttgataaggctttttgaatttaaaaaaagtgtacgggctcctggttag

SEQ ID NO: 20573 - protein, 198 aa, Legionella pneumophila str. Lens
MLEQSLRHYYQLVLIDPILPALRDRITPLSITWLSGIFGLLFIPFVLLDKPYIAISFLLLSGYLDTLDGSLARFQNRASDFGSAMDIVMDRIVEFSAVLALYLFDPQHRATLAILMLGSILLCITSFLVVGIFSNNTTQKSFYYSPGIMERAEAFLFFIFMTLFSSCFNFLAALFCFLVCLTALIRLFEFKKSVRAPG

SEQ ID NO: 20574 - DNA, 630 bp, Photobacterium profundum SS9
  CDS (1)..(630): transl_table=11
atgcttgatcgctatgcagttaaagttattcgttggccgctaaaaacactggcagccctacccgataaactcggcattacggctaaccaagtaacgttagctggctttttaattggcttacttgccttaccatcccttatgctgcaagagtatgattgggcacttacattcatcgttattaatcgaatatttgatggcttagacggcgctattgcacgtcgacaaggcattacagattgcggtggttttctcgatatcacactggattttctattttattcgatggtgccatttggctttgtattggcagacccaagtgcaaacgccgttgccggtgcgttcttgatattttcgtttattggtactggctcaagttttctatcttttgccataatggcaggaaaacgaaatatcgaaagccctgtttataagcaaaaatctttgtactacatcggaggattaacggaaggcacagaaaccattgcctgctttgtactgttctgcttatttccacaatactttgcaatcatcgcatgggtgtacggcaccttatgctggattacaacggctacacgtatctgggcgggttatcacaccttgaaagatacacctgaaatagaggttaattga

SEQ ID NO: 20575 - protein, 209 aa, Photobacterium profundum SS9
MLDRYAVKVIRWPLKTLAALPDKLGITANQVTLAGFLIGLLALPSLMLQEYDWALTFIVINRIFDGLDGAIARRQGITDCGGFLDITLDFLFYSMVPFGFVLADPSANAVAGAFLIFSFIGTGSSFLSFAIMAGKRNIESPVYKQKSLYYIGGLTEGTETIACFVLFCLFPQYFAIIAWVYGTLCWITTATRIWAGYHTLKDTPEIEVN

SEQ ID NO: 20576 - DNA, 774 bp, Thermus thermophilus HB8
  CDS (1)..(774): transl_table=11
gtggtcccgggggccaaggagaggccggtccaggagttcctcaacgccctccttttccgccccctggcgcacctcgtcgtcctcctcctcctgcgtacgcccgtgaggccccaccacctggtcctcttccacacgggcctggtccttggggccgcctggctgctccttaggggggaggacctcggggccgccctcctcctccagctcaaaaccgtcttggacaacgccgacgggcagctcgcccgccttaggggagaggtgacggagtttgggcgctacctggacacggggatggacttcctcgggaacctggccctcttcctggccctgggcctgcgcaccggtttcctggagaaggccctcctcgcttttttggttttcaccctggtccagtcctacgacttcaacctggaaaggctttaccgcctttcccgggggcttcccttgcccgaggggcctcgggacccggaaaccccctggcttcgcctcttccgggggctttacgccctcctcttcgccccccaggaccgggccatcgtcgccttggagcgctttctccaggggcggttgcggcttgacccctcgcgtttctgggacgagggggccttggcgggggtggtgaacctgggcctcaccacgcagcttttcttcctgggggttttcctcctcttccacgagcctggcgcctacctcacctttgtcctccttcaggccgtgtatcttggcctttggtacctatggaggatcgcccgcagtatcccatccccacggtag

SEQ ID NO: 20577 - protein, 257 aa, Thermus thermophilus HB8
MVPGAKERPVQEFLNALLFRPLAHLVVLLLLRTPVRPHHLVLFHTGLVLGAAWLLLRGEDLGAALLLQLKTVLDNADGQLARLRGEVTEFGRYLDTGMDFLGNLALFLALGLRTGFLEKALLAFLVFTLVQSYDFNLERLYRLSRGLPLPEGPRDPETPWLRLFRGLYALLFAPQDRAIVALERFLQGRLRLDPSRFWDEGALAGVVNLGLTTQLFFLGVFLLFHEPGAYLTFVLLQAVYLGLWYLWRIARSIPSPR

SEQ ID NO: 20578 - DNA, 639 bp, Idiomarina loihiensis L2TR
  CDS (1)..(639): transl_table=11
atgtttgaccctaagctacttccggcaacccgaaaaattctcgacctcccggcgcgattattagttcgtgtcggcgttagcgctgatcaggtcaccataacgggttttatcatcggtttgctggcagtgccatttttagcttttgagctttatgaattcgcgctggccgctattttactaaaccgcctgtgcgacggtctggacggcgccgtagcaaggcgcactcagttaaccgatgccggtggttttctcgatattgtgctggatttcattttttacagtgctgtggtatttggttttttattggcgtcgcccgaacagaacgccattgcctcaggcttgttgttagtcacttttatggggactggctctacctttctggcctttgcctgcattgccggaaagcgcggtattgaaaacccggaatatccgaataagtcgctgcattatatgggcggtttaaccgaaggttttgaaaccattttagcttttgtggcgttttgtttatggccacagcacttttccgtactggcctatatattcgctgccgcctgctggcttaccgcaataacccgcattgttgccggttaccgcacactgaaacagccaggggcaaagccggagagcaccaatgtctga

SEQ ID NO: 20579 - protein, 212 aa, Idiomarina loihiensis L2TR
MFDPKLLPATRKILDLPARLLVRVGVSADQVTITGFIIGLLAVPFLAFELYEFALAAILLNRLCDGLDGAVARRTQLTDAGGFLDIVLDFIFYSAVVFGFLLASPEQNAIASGLLLVTFMGTGSTFLAFACIAGKRGIENPEYPNKSLHYMGGLTEGFETILAFVAFCLWPQHFSVLAYIFAAACWLTAITRIVAGYRTLKQPGAKPESTNV

SEQ ID NO: 20580 - DNA, 600 bp, Francisella tularensis subsp. tularensis SCHU S4
  CDS (1)..(600): transl_table=11
atgatagagcagaaaattagaccagtttttcagagaatatttgttgatggtattgctaagtttattgcgcctgtgatagcacctaatttaatcacactaatatcgttgatagttggtttggttgctgcaatagctttttttataaatcagtatttatgtatatttttgttattactgtctggatattttgatattttagatggttcggttgcacgcttacaaggtagttcttcatcatttgggactatcttagatattttgagtgatcgtttcgttgaaagttttattattattgcaattttcattaatcagcttgatatagcatgggttggtttattaatgatgatgtctataattgtttgtattagtagttttttgttagtagggattttcagtcaaaaagaatcatcaaagagtttttactatactcctggcttgattgagagagccgaaacatttatattctttattgtaatgattttatttcctaatatagtagttgtattaggattgatttatacattattagttttatggacaacgctatatcgttgctatgagttttatgtttatgataagcaaaggagtaaatttcaatga

SEQ ID NO: 20581 - protein, 199 aa, Francisella tularensis subsp. tularensis SCHU S4
MIEQKIRPVFQRIFVDGIAKFIAPVIAPNLITLISLIVGLVAAIAFFINQYLCIFLLLLSGYFDILDGSVARLQGSSSSFGTILDILSDRFVESFIIIAIFINQLDIAWVGLLMMMSIIVCISSFLLVGIFSQKESSKSFYYTPGLIERAETFIFFIVMILFPNIVVVLGLIYTLLVLWTTLYRCYEFYVYDKQRSKFQ

SEQ ID NO: 20582 - DNA, 783 bp, Ehrlichia ruminantium str. Welgevonden
  CDS (1)..(783): transl_table=11
atgaaagaagaacaaagtggtaagtttttccctattgcaagattgtttccaaatttaattaccttgttggggttatgtgctggcctaacttctataaaatttacgtttatcggtaaatgggaatctgcaattgtatttatcataatagcagcagttatagatggtatggatggaagaattgccaggttacttaattctactagtggatttggtgctcaacttgattcttttgcagattttttaaattttggtgctgctccagcgtttttattatacttttggtctctcagacaaataaaagtaataggatggatgcttgttatgacatttgtgatatgtatgtctataagacttgctagatttaacatgtcattatacgaagaagaaaaagaattagactggcataagtttttctttgtaggagtacccgctccattaggagcaatattatcattaattccaataatgcttactttttattttcatgataatcactggttagtggaaaatttactagagcataataagatagcagtatattttgctattattgcatttttatcagtaagtaatattcctactttttctgcaaaacatttatatataccaaaaaatttaatttatatttttattgtactattaggcatattcattgtatttgcaataacaaaaccatggttaacttttccagtagttggaataatgtacatactatcaatccctgtaagtagtattgtatacatatatcttatgtacaaaaataaaaataagaaaaacatatga

SEQ ID NO: 20583 - protein, 260 aa, Ehrlichia ruminantium str. Welgevonden
MKEEQSGKFFPIARLFPNLITLLGLCAGLTSIKFTFIGKWESAIVFIIIAAVIDGMDGRIARLLNSTSGFGAQLDSFADFLNFGAAPAFLLYFWSLRQIKVIGWMLVMTFVICMSIRLARFNMSLYEEEKELDWHKFFFVGVPAPLGAILSLIPIMLTFYFHDNHWLVENLLEHNKIAVYFAIIAFLSVSNIPTFSAKHLYIPKNLIYIFIVLLGIFIVFAITKPWLTFPVVGIMYILSIPVSSIVYIYLMYKNKNKKNI

SEQ ID NO: 20584 - DNA, 570 bp, Thermococcus kodakarensis KOD1
  CDS (1)..(570): transl_table=11
atgctcaacaggtacagggagaacgtcaaaggttaccttgaggccatcgtaaaacctctagcaaaagccggtgtcacaccgaacacgataacgttcataggcctcctgataagcctgcttggagcgtatctcttctacctccagcgcccaaggctcgccgcagtgatcctcctcataggctctgccatagatgccctcgacggaacgctggcaagaatgactggaaaaacgagccgctttggagcgttcctggattctacctttgacaggataagcgatggtgcagtcctctttggaatagccctcggcaacctcgcggactggcgcttgactttcctgacctttatgggtgcatacctcgtcagctacgagcgctgtagggcagagcttgcaggctcaggaacgctcgcagttggaatagccgagagggctgagaggttattgatcctgatggcgttctcccttgctggggcagagtacgtgaagtggggtgtttacatcgtcggcgtgctcgcgtggataacggtcttccagagaatgtgggcggcctatcagaggctcaaggagtga

SEQ ID NO: 20585 - protein, 189 aa, Thermococcus kodakarensis KOD1
MLNRYRENVKGYLEAIVKPLAKAGVTPNTITFIGLLISLLGAYLFYLQRPRLAAVILLIGSAIDALDGTLARMTGKTSRFGAFLDSTFDRISDGAVLFGIALGNLADWRLTFLTFMGAYLVSYERCRAELAGSGTLAVGIAERAERLLILMAFSLAGAEYVKWGVYIVGVLAWITVFQRMWAAYQRLKE

SEQ ID NO: 20586 - DNA, 783 bp, Ehrlichia ruminantium str. Gardel
  CDS (1)..(783): transl_table=11
atgaaagaagaacaaagtggtaagtttttccctattgcaagattgtttccaaatttaattaccttgttggggttatgtgctggcttaacttctataaaatttacgtttatcggtaaatgggaatctgcaattgtatttatcataatagcagcagttatagatggtatggatggaagaattgctaggttacttaattctactagtgggtttggtgctcaacttgattcttttgcagattttttaaattttggtgctgctccagcgtttttattatacttttggtctctcagacaaataaaagttataggatggatgcttgttatgacatttgtgatatgtatgtctataagacttgctagatttaacatgtcattatacgaagaagaaaaagaattagactggcataagtttttctttgtaggagtacctgctccattaggagcaatattatcattaattccaataatgcttactttttattttcatgataatcactggttagtggaaaatttactagagcataataagatagcagtatattttgctattattgcatttttatcagtaagtaatattcctactttttctgcaaaacatttatacataccaaaaaatttaatttatatttttattgtactattaggcatatttattgtatttgcaataacaaaaccatggttaacttttccagtagttggaataatgtacatactatcaatccctataagtagtatggtatacatatatcttatgtacaaaaataaaaataagaaaaacatatga

SEQ ID NO: 20587 - protein, 260 aa, Ehrlichia ruminantium str. Gardel
MKEEQSGKFFPIARLFPNLITLLGLCAGLTSIKFTFIGKWESAIVFIIIAAVIDGMDGRIARLLNSTSGFGAQLDSFADFLNFGAAPAFLLYFWSLRQIKVIGWMLVMTFVICMSIRLARFNMSLYEEEKELDWHKFFFVGVPAPLGAILSLIPIMLTFYFHDNHWLVENLLEHNKIAVYFAIIAFLSVSNIPTFSAKHLYIPKNLIYIFIVLLGIFIVFAITKPWLTFPVVGIMYILSIPISSMVYIYLMYKNKNKKNI

SEQ ID NO: 20588 - DNA, 609 bp, Vibrio fischeri ES114
  CDS (1)..(609): transl_table=11
atgcttgatagtttcagtattaaagtgattcgttggcctttagcgcaaagtgccaagctcattaataaactgggaattacagccaaccaaacgacgctatttggttttgttttaggctgcttagccttccctgctcttattgcagagcaatatttgttggctctagtatttattgtcttgaatcgcatttgtgatggattagatggggcattagctcgaatacaaggcataactgatgcgggcggctttcttgatatcagtttggattttctgttttattcactgatcccttttggatttgttctcgccaaccctgatcaaaatgccattgcgggtgcgtttttaattttctcatttgttgggacaggaagcagctttttggcttttgctattatggcaagtaaacaaggaattgataatccagtttataaacacaaatccctttattacatgagtggcttaaccgaaggaacagaaaccattgcgtgttttatcgcattttgtctgtttccaacccattttaccattatcgcctatgtgtttggtgccgcttgctggtttaccacctttactcgcatttactctgggttccatactttaaaaccgtaa

SEQ ID NO: 20589 - protein, 202 aa, Vibrio fischeri ES114
MLDSFSIKVIRWPLAQSAKLINKLGITANQTTLFGFVLGCLAFPALIAEQYLLALVFIVLNRICDGLDGALARIQGITDAGGFLDISLDFLFYSLIPFGFVLANPDQNAIAGAFLIFSFVGTGSSFLAFAIMASKQGIDNPVYKHKSLYYMSGLTEGTETIACFIAFCLFPTHFTIIAYVFGAACWFTTFTRIYSGFHTLKP

SEQ ID NO: 20590 - DNA, 666 bp, Corynebacterium jeikeium K411
  CDS (1)..(666): transl_table=11
atgcttagcgtgcacggccgtggccccgccgcggtcatcattgaaccgatcgccagagtgctgcacaagatgggaattactcccaacgcagtgaccgttttcggcaccctgatggcgataggtttcgcgctctggctgattccctccggtcaccactttgccgctgccgtactcatcggtcttacggtcgctactgacatggtggacggcaccatggctcgcatgcgcggcggcggcactcggttcggcgccacgctagatgccacctgcgaccgcctcagcgacggcgccatcttcggcgccctggtcctctggtttggcctgcaggaacccgccaacgtcgtgatgatgagcgtctgcttggtgattctcgttgccagccaggtcaccagctacgtcaaagcccgcgcagaggcctcgggaatcaaggtcgtgggagggctcatcgagcgcccggaacgcctcatcatctccttggtggcagttggtatcggcgggcttggcgtgccacacattctggcgtggggactgtggatcctcgctgccggatcgctgtacacggttgttgagcgcctactaattgttgctcgttcggacgccgcgtctcagactatcgccgcccccgaaggagcccgcgagtttcccgttgaggggagtgaaggctga

SEQ ID NO: 20591 - protein, 221 aa, Corynebacterium jeikeium K411
MLSVHGRGPAAVIIEPIARVLHKMGITPNAVTVFGTLMAIGFALWLIPSGHHFAAAVLIGLTVATDMVDGTMARMRGGGTRFGATLDATCDRLSDGAIFGALVLWFGLQEPANVVMMSVCLVILVASQVTSYVKARAEASGIKVVGGLIERPERLIISLVAVGIGGLGVPHILAWGLWILAAGSLYTVVERLLIVARSDAASQTIAAPEGAREFPVEGSEG

SEQ ID NO: 20592 - DNA, 678 bp, Thermobifida fusca YX
  CDS (1)..(678): transl_table=11
atgaccggagccgaattccacgacgatgaagagaccatgctgagaatcctgcgccccgctaccgcccgactgctcgcacccatcggccgcggcctcgttcgtatcggcgtcaccccgaatacggtcaccctcgtgggaaccggcggcgtcgtcatcagctcgctggtgttctatcctctgggcgagctgtacatcggcaccctcgtcgtcgcgttcttcgcgctcttcgacatgcttgacggcgcggtcgcccgcgcctccggagagaccagtgcctggggagcgttcctcgactccacactggaccggctctccgatgccgccattttcgcgggactgctggtgtggctcatcggcggcggacgcgacgaggtcctcgcctggctcgccctgttctgcatgatcagcggcttcggcgtgtcctacatcaaagcgcgcgctgaaggcctgggggccaactgcgatgtgggcatcgcggaacgcaccgaacgcctcatcatcatcctggtcgccaccggactgcacgggctcggcgtcccttacgcgctggctaccgggctgtggctgctcgctttcctcagcgccatcaccatcgtgcaacgcttggtggagacccggatccgccttaccgagccggacgagcagatcctcgacaaagccgagacagaaacctcgtga

SEQ ID NO: 20593 - protein, 225 aa, Thermobifida fusca YX
MTGAEFHDDEETMLRILRPATARLLAPIGRGLVRIGVTPNTVTLVGTGGVVISSLVFYPLGELYIGTLVVAFFALFDMLDGAVARASGETSAWGAFLDSTLDRLSDAAIFAGLLVWLIGGGRDEVLAWLALFCMISGFGVSYIKARAEGLGANCDVGIAERTERLIIILVATGLHGLGVPYALATGLWLLAFLSAITIVQRLVETRIRLTEPDEQILDKAETETS

SEQ ID NO: 20594 - DNA, 780 bp, Ehrlichia canis str. Jake
  CDS (1)..(780): transl_table=11
atgaaagaagaacaaagcagcaaattttttcctattgctaggttatttccaaacatagtaactttattaggcttatgtgctggtttgacttctataaaattcacttttattggcaaatgggaatctgctgttatgtttattatcattgcagcattaatagatggcatggatggtaggattgctaggttactaaattctactagtggttttggtgcacatcttgactcttttgcagatttcttaaattttggtgctgctcccgctttcttgatatatttttggtcacttaaacaaattaaagtcataggttggatgctagtaatgatgtttgtaatgtgcatgtcgattagacttgcaaggttcaatgtgtctttatatgaagaaaaaaaattagactggcacaaatttttctttgtaggagtacctgctccactaggagcagtactatcattaattccaataatgttgacattttattatcacgacaatcattggttagttgaaaacttatcagaccaaaataatgtagcaatatattttgctatcattgcatttttattagtaagtaacattcctacattttcagcaaaacatctctatataccaaaaaatttatcttatatatttattttactatttggtatatttattgtatttgcaataacaaaaccatggctaacatttccagtatttggaataatgtatatattatcaatacctataagtagttcagtatacatatatattatgtacaaaaacaaaactaaaataaatatgtaa

SEQ ID NO: 20595 - protein, 259 aa, Ehrlichia canis str. Jake
MKEEQSSKFFPIARLFPNIVTLLGLCAGLTSIKFTFIGKWESAVMFIIIAALIDGMDGRIARLLNSTSGFGAHLDSFADFLNFGAAPAFLIYFWSLKQIKVIGWMLVMMFVMCMSIRLARFNVSLYEEKKLDWHKFFFVGVPAPLGAVLSLIPIMLTFYYHDNHWLVENLSDQNNVAIYFAIIAFLLVSNIPTFSAKHLYIPKNLSYIFILLFGIFIVFAITKPWLTFPVFGIMYILSIPISSSVYIYIMYKNKTKINM

SEQ ID NO: 20596 - DNA, 534 bp, Methanosarcina barkeri str. fusaro
  CDS (1)..(534): transl_table=11
ttgctgggttttgccgtaagcatcgctgcaggggcagcatttgcgctgggaaaaccttttgcaggtggtcttcttattctttttagcgggatctttgatatccttgatggcggagtcgcgagggcaaaaggcaggattacgccctttggaggcgtgcttgattcggtttgcgaccggtattccgatggtctaatgttcctcggaataatagcaggcgcggttaacggcaggcttgtcctttccccaattgtgcaaatcgaaggctggctctgggcaggctttgcccttataggctccttcctggtaagctacactcgcgcccgtgcggaatctgcaggttgccggaaattgtcagtcggaattgccgaacgtacggaaagaatggttcttctggccctgggcggaatttcaggttttctaggttgggctctggtacttgtagctgtgttttcccacatcaccattatccagcgagtccttcgggcaaaaagcatattgagtaagccttcagaagttgatttccaaaaaccgtaa

SEQ ID NO: 20597 - protein, 177 aa, Methanosarcina barkeri str. fusaro
MLGFAVSIAAGAAFALGKPFAGGLLILFSGIFDILDGGVARAKGRITPFGGVLDSVCDRYSDGLMFLGIIAGAVNGRLVLSPIVQIEGWLWAGFALIGSFLVSYTRARAESAGCRKLSVGIAERTERMVLLALGGISGFLGWALVLVAVFSHITIIQRVLRAKSILSKPSEVDFQKP

SEQ ID NO: 20598 - DNA, 582 bp, Dehalococcoides sp. CBDB1
  CDS (1)..(582): transl_table=11
atgtctggtatggcaagttggcgtaaagagattgcccttaaagttacaaaccccgtaataaatcttttagctaaaaccggtcttaccccaaatatggttacgataatcggttttgttattactctggtggcggctttaatcatagttaatgggaacctgcttttagcgggaatagttatgttgctggcaggtgtatttgatatgctggacggggcacttgcccgccgtaccggcagggttacccgcttcggggcagtgcttgattctactttagacagggtctcggaagctgcaattcttatcggggtatgcgctttttattcccaaaacggacagacacctgaggtgatactggcggtaattaccctcacactttctttgctggtcagttatatacgggctagagccgaagccatggggcttgaaggaaaagaaggattttttaccagacctgaacgggtggttgcactggctataggcatgatgctgaatatactcgttccggtattggtcttggtaagtgttctcagtttgataactgttattcaacggcttgcaaatgtttaccgacagaccaaatga

SEQ ID NO: 20599 - protein, 193 aa, Dehalococcoides sp. CBDB1
MSGMASWRKEIALKVTNPVINLLAKTGLTPNMVTIIGFVITLVAALIIVNGNLLLAGIVMLLAGVFDMLDGALARRTGRVTRFGAVLDSTLDRVSEAAILIGVCAFYSQNGQTPEVILAVITLTLSLLVSYIRARAEAMGLEGKEGFFTRPERVVALAIGMMLNILVPVLVLVSVLSLITVIQRLANVYRQTK

SEQ ID NO: 20600 - DNA, 609 bp, Rhodobacter sphaeroides 2.4.1
  CDS (1)..(609)
atgctcgacggtctgatgcgacgcctgatcgacccgccgctcgaccgtgcggggcccatgctcgcccgccgcggctggagcgcggatgccgtgacgatggtgggccttgcgctcgggctcctcgcggcggggctggtggcggcgggtgcctccaccctctgggcgatcctgccgcttctcgcgggccggatcgccgacgggctcgacggcgcgatcgcgcgtgcgggacgcaggaccgacttcggcggctatctcgacatcacatgcgacttcctgttctacgcggccttaccgctcgccttcgtgctgcgcgcgcctgaaaacggggcggccggcgcctttctgctcgcctctttctatgtgaacggcgcgagctttctgggctttgccgtgctggccgcaaagcgcgggatggagacgacggcccgcggcgagaagtcgctctacttcacggcagggcttctggaaggcagcgagacgatcctgttcttcctcttcctctgcctctttccggggctcttcgcgccggccgcctggattttcggcgccctctgcttcgtgaccgcggcgagccgcgtcctgctcgcccgcaggctctttcgcgactga

SEQ ID NO: 20601 - protein, 202 aa, Rhodobacter sphaeroides 2.4.1
MLDGLMRRLIDPPLDRAGPMLARRGWSADAVTMVGLALGLLAAGLVAAGASTLWAILPLLAGRIADGLDGAIARAGRRTDFGGYLDITCDFLFYAALPLAFVLRAPENGAAGAFLLASFYVNGASFLGFAVLAAKRGMETTARGEKSLYFTAGLLEGSETILFFLFLCLFPGLFAPAAWIFGALCFVTAASRVLLARRLFRD

SEQ ID NO: 20602 - DNA, 795 bp, Magnetospirillum magnetotacticum MS-1
  CDS (1)..(795)
atgttccgccccaagcgtccgccccgtatccgggggttgtcgatcaacaagctgatccccaacatcctgacgctgctggcgctgtgcgctggcctcacctccatccgcttcgccgtacacggcatgtggaaggaggcggtgatctccaccgttctggccgccattctggacgggttggacgggcgggtggcgcggctgcttcaaggcacctccaagttcggcgccgaactggattccctttccgatttcgtcagcttcggcgtggcgcccgccatggtgctgtatttttggaccatgcaaggcgccggaggattcggctgggcgctggtcttgctgttctcggtgtgctgcgcgctgcgtctggcccgcttcaacaccatgatcggcgaacccgacctgccgccctacgcctataacttcttcaccggcgttccggctccggcggcggccgggctggtcttgcttcccatggtcttcaccatccagttcggcggcggcttcttcgatcagcccgcggtggtcgcggtcttcttgttgggcgtttccttcctgatggtcagcaagatccccaccttctcggggaaaaaagtgcgcgtgccccaccgttgggtcctgcccatcctgctgatcattggcctcgcggcggctttcatggtgaccgagccctggctgaccctgtcgctgctgggtgtcttgtatctggggatgatcccactcagcttgcgctcgttccgccgcctcaaggctcaggcggaagtcccggccccggacgaagcgcccataccttccgcgtag

SEQ ID NO: 20603 - protein, 264 aa, Magnetospirillum magnetotacticum MS-1
MFRPKRPPRIRGLSINKLIPNILTLLALCAGLTSIRFAVHGMWKEAVISTVLAAILDGLDGRVARLLQGTSKFGAELDSLSDFVSFGVAPAMVLYFWTMQGAGGFGWALVLLFSVCCALRLARFNTMIGEPDLPPYAYNFFTGVPAPAAAGLVLLPMVFTIQFGGGFFDQPAVVAVFLLGVSFLMVSKIPTFSGKKVRVPHRWVLPILLIIGLAAAFMVTEPWLTLSLLGVLYLGMIPLSLRSFRRLKAQAEVPAPDEAPIPSA

SEQ ID NO: 20604 - DNA, 795 bp, Deinococcus geothermalis DSM 11300
  CDS (1)..(795): transl_table=11
atgacacacggcaaggcccgacccgcccgcgaatgggccgccgagagtctgtttcggcccctggccgagcagcttcttccaccgctggcccgccgccgggtgaacccggtccgggttgtactcacccatactgcgctcggggtactggcgggtgcgctgctgcgccggggtcaccaccgcacacccgccgcgctcttgcaggtcaagacgctgctcgacaacctcgacgggcaactggcgcgcgcgaccggacagaccaccgagacaggccgctacctggactcggaaatggacgtggtggtgaacgctgccgtgctggtgggcctggccggacgctggggcctgccgctcaccctgctgcaaagtctgatcctgagtgtggactacctgtgggagcgcgatcaccgggccgcgcggggcgaggtcttccgtgatccacctgcgcagaccagagatgacccgcgcattctggctgccctgaggctggcctacaccctgtacttcacgccgcaggaacggctgctggaggcgctgttcgagcggcggctgcgggcggtgacgggcggaacacccacctccgccgaccgccgcgcctacaccccgcgcgccatcaatcaggtcgcggtgaatcttggtctcagcacgcagctcctcgcgctgggcggctgcctgcttctgcggcggccccgcatctacttgtggagcctccccgcccaagccctgctgctggccggggtacaggtgtggcgggaaggcagggtggtccgggggaggttggagaagggaagaagataa

SEQ ID NO: 20605 - protein, 264 aa, Deinococcus geothermalis DSM 11300
MTHGKARPAREWAAESLFRPLAEQLLPPLARRRVNPVRVVLTHTALGVLAGALLRRGHHRTPAALLQVKTLLDNLDGQLARATGQTTETGRYLDSEMDVVVNAAVLVGLAGRWGLPLTLLQSLILSVDYLWERDHRAARGEVFRDPPAQTRDDPRILAALRLAYTLYFTPQERLLEALFERRLRAVTGGTPTSADRRAYTPRAINQVAVNLGLSTQLLALGGCLLLRRPRIYLWSLPAQALLLAGVQVWREGRVVRGRLEKGRR

SEQ ID NO: 20606 - DNA, 900 bp, Anaeromyxobacter dehalogenans 2CP-C
  CDS (1)..(900): transl_table=11
gtgcgcccgtccggcgtctgccttgttccgggcgaggtgcgtacattcgtcggcgtgacccctcgcgcgctcgcggcgctgctccccctggtcggcctcgtcgccttcctcctcgggacgctgctcgcgttcgcggcgcgcgcggccctgttcggccgcccgcacacgccggacatcgagaagcgccagcacaccatcctcgcgaagttcttccaggagtggtggatctggctgtggggcccggtggagcggctgtgcgtccggctcgggatctcgccggacgccatcacgctcgcgagcacgctcgtcgccgccggcgcggcggtgctgctcgggttcgggtggctgtcgctgggcggctgggtgttcctgttcggcgcgagcttcgacttcatcgacgggcgggtggcgcgcgcgaccggccgcgtcacccgggccggcgcgttcctcgactccacgctcgaccgggtcggcgagctgctcgtgttcggcgggctggcggtcaccttccgcggctcggtggtgctgttcgccgcgctggccgccgcgggggcgtcgctgctcgtctcctacgcgcgggcgcgcggcgaggcgctcggcgccgacgaggccgcccgggtgggcgggatgcagcggcccgagcgcatcgtggtcaccggggtggcgtgcgcgctctcgccgctcgccgacgcggcctggggcgccggcgtcggccgggcggtcgtcggcagcgcgctcgccgcgctggcagccctggcgacggccacggcggcgcggcggacgttcgtgatctatcgtgccctgcggcgcgcggatccggccgtggcgccccggccgccgttccgcctcgccgacgtgttccgcctcgacgccacgcggcggcgcaaggcggcgcgctga

SEQ ID NO: 20607 - protein, 299 aa, Anaeromyxobacter dehalogenans 2CP-C
MRPSGVCLVPGEVRTFVGVTPRALAALLPLVGLVAFLLGTLLAFAARAALFGRPHTPDIEKRQHTILAKFFQEWWIWLWGPVERLCVRLGISPDAITLASTLVAAGAAVLLGFGWLSLGGWVFLFGASFDFIDGRVARATGRVTRAGAFLDSTLDRVGELLVFGGLAVTFRGSVVLFAALAAAGASLLVSYARARGEALGADEAARVGGMQRPERIVVTGVACALSPLADAAWGAGVGRAVVGSALAALAALATATAARRTFVIYRALRRADPAVAPRPPFRLADVFRLDATRRRKAAR

SEQ ID NO: 20608 - DNA, 645 bp, Chromohalobacter salexigens DSM 3043
  CDS (1)..(645): transl_table=11
atgttggataaatggacggggcgctgggtagccccagcactcaatcgcctggccggcgggttgggggagcgtggtgtcacgcctgctcagttgacgctgggcggtttcgcggcgggaatgctggcgttgccgttactggctggccagatgtacgggctcgccctggtggcgatcatcatcaatcgtctgtgcgatggcctggatggtgccctggcgcgacacctgcaacgacagagcgatgccggcgggtttctggatatcgcgctggatttcgtgttctacgcggccgtggtgctggggtttgccctggccgtccccgaacgcaatgccttgcccgcggcgctgttgctgttcgcgttcgtggggaccggctcgtcgtttctggctttcgcgattgccgcgactcgccacgggctggagcgtccgcgcttcgagcacaaggcgttctattatctggatggcttgaccgaggggaccgagacgattctcgctttcgtggtgttctgtctgtggccggaggagtttgcactcctggcgaccctgtttgccgtggcctgtctggtgacgactgccacgcgcgtcgcgggagggtaccgggccctgctggcggccgagcgctcgtcatccgatcggcaggagggatga

SEQ ID NO: 20609 - protein, 214 aa, Chromohalobacter salexigens DSM 3043
MLDKWTGRWVAPALNRLAGGLGERGVTPAQLTLGGFAAGMLALPLLAGQMYGLALVAIIINRLCDGLDGALARHLQRQSDAGGFLDIALDFVFYAAVVLGFALAVPERNALPAALLLFAFVGTGSSFLAFAIAATRHGLERPRFEHKAFYYLDGLTEGTETILAFVVFCLWPEEFALLATLFAVACLVTTATRVAGGYRALLAAERSSSDRQEG

SEQ ID NO: 20610 - DNA, 663 bp, Solibacter usitatus Ellin6076
  CDS (1)..(663): transl_table=11
atgaccttcacgcgcgggatcggcttattctttggagcgatcatcaatcggatcgtgcgctggctcgcattgtcgaagatccacccgaacgtgctgacgttcctcggactgctgatcaatatctgggcggcctggctcttcgcgcaagggaatttccgttgggccggcgtcgtggttacaggcgcggcgatcttcgatatggtggatggccgggtggcgcgcgccaccagccaggtcacgcggttcggcggcttcttcgattcggtggtggaccggtattcggacctcgcgctgtatatcggattactagtgtattacgccagcataaaccggttcttttacatcgtgctcacggcgattgtgatgaccgggtcggtgatgatcagttacacgcgggcgcgggcggagaatgccatccccaagtgcaaggtcggctttctggagcggccggagcgcgtggtgctgattattcttggcgcgctggcggcctggattccgggcgtcggcgaccgcatggcggcggtgctgtgggtgatcgcggtactctccaatgtgaccgtgatccaccgcatgatgtacacgtaccagcaggcgaaattgctggaagacgcgcaactgcgcgcggtgccggagaacaaggaagagcgcgcgcggcggagctag

SEQ ID NO: 20611 - protein, 220 aa, Solibacter usitatus Ellin6076
MTFTRGIGLFFGAIINRIVRWLALSKIHPNVLTFLGLLINIWAAWLFAQGNFRWAGVVVTGAAIFDMVDGRVARATSQVTRFGGFFDSVVDRYSDLALYIGLLVYYASINRFFYIVLTAIVMTGSVMISYTRARAENAIPKCKVGFLERPERVVLIILGALAAWIPGVGDRMAAVLWVIAVLSNVTVIHRMMYTYQQAKLLEDAQLRAVPENKEERARRS

SEQ ID NO: 20612 - DNA, 582 bp, Exiguobacterium sp. 255-15
  CDS (1)..(582): transl_table=11
atgttagatacacgcgcgagaagagtcgtccagcccctttttgagcagatggcgaccttattaaagaagatggggctttccgccaaccaggtcaccatcatttccggcatcatcggtgcctcgaccggtttctttgtgtataacgatatgacgggaattgcaattttattattatggctgtccggagcactcgatgtcgtcgatggaacgatggcacgccgggaaaaaacgacaccgatcgggacgattctcgatttagtgctcgaccggattgtggaattatccgttttgatcggaattgccttacgttttccggagacgcaagtcgtcattttattactcgtcgcctcattcgtgattggtatgacgatgtttcttgcgattggagcggtcagcgaaaattatggatttaagtcattccagtatcaaccgggcctcgtcgaacggacggaaggattcctttttctgactgcgatgttactgtttccaagcgccatcatctggattgcgatcctctttttgattgctgaattgtatacggtcggcgagcggttttatcaagcttcgaaggtgttgcgatga

SEQ ID NO: 20613 - protein, 193 aa, Exiguobacterium sp. 255-15
MLDTRARRVVQPLFEQMATLLKKMGLSANQVTIISGIIGASTGFFVYNDMTGIAILLLWLSGALDVVDGTMARREKTTPIGTILDLVLDRIVELSVLIGIALRFPETQVVILLLVASFVIGMTMFLAIGAVSENYGFKSFQYQPGLVERTEGFLFLTAMLLFPSAIIWIAILFLIAELYTVGERFYQASKVLR

SEQ ID NO: 20614 - DNA, 777 bp, Ehrlichia chaffeensis str. Sapulpa
  CDS (1)..(777): transl_table=11
atgaaagaggagcagagtagcaaattttttcctattactaggttatttcctaatatagtaaccctattaggtttatgtgctggcctgacttctataaaatttacttttattggtaaatgggaatctgctgtaatgttcatcattatagcagcactcatagatggaatggatggtagaattgctagatttctcaattctacaagcggcttcggtgctcagcttgattcttttgcagattttttaaattttggagttgctccagcatttttattgtatttttggtctcttaagcaaataaaagtcataggatggatgctagtaatgatgttcgtcatttgcatgtcaatcagacttgcaagattcaatgtgtccttatatgaagaaaaaaaattagattggcacaaatttttcttcgtaggagtacctgctccattaggagcagtactgtcattaattccaataatgttgaccttttactaccatgataatcattggttagttacaaatttatctgatcaaaataatgtagcaatatactttgccgttattgcatttttattagttagcaacattcctacattttctgcaaaacatatttatataccaaaaaatctatcttatatatttattctactgtttggcatattcattgtatttgcaataacaaaaccatggattacatttccagttgttggaatgatgtatatattatcaattcctataagtagcatggtatacatatacattatgtgcaaaactaaaggtaaaataatctag

SEQ ID NO: 20615 - protein, 258 aa, Ehrlichia chaffeensis str. Sapulpa
MKEEQSSKFFPITRLFPNIVTLLGLCAGLTSIKFTFIGKWESAVMFIIIAALIDGMDGRIARFLNSTSGFGAQLDSFADFLNFGVAPAFLLYFWSLKQIKVIGWMLVMMFVICMSIRLARFNVSLYEEKKLDWHKFFFVGVPAPLGAVLSLIPIMLTFYYHDNHWLVTNLSDQNNVAIYFAVIAFLLVSNIPTFSAKHIYIPKNLSYIFILLFGIFIVFAITKPWITFPVVGMMYILSIPISSMVYIYIMCKTKGKII

SEQ ID NO: 20616 - DNA, 612 bp, Jannaschia sp. CCS1
  CDS (1)..(612): transl_table=11
atgattgatgcccgccttttgccccttcaacgcgccctgatggagccgcccgcccgatggctggcggcctgtggcgtgcgggcggatcagatcacgctggtcgggtgtgggatcgggcttctggctgctttggcggcagcactggggctgtattggctggctcttgcgggccttgccctgaaccgtctcgccgatgggttggacggtgccgtcgcacggctgacgacccctaccgatcgcggggccttcctcgatatcgcgttggatttcgtcttctacgcagttttccccatcggcttcatcttcgccgatccggcctccaacggattgcccggtgcagtcctgatcgcgagcttcgtgttgacgggcacgtcgtttctcgccttttccatcatcgcggagcggcgcggtttgctggccgagaactacccgaccaagggcatctactacctgggcggcctggcggagggggctgagaccatcgccgtcttcgctgccttgtgcctgtttccggacgccttcccgtggatcgcttgggcgtttgcagcgatctgcatcgtgacaggcgccacgcgctacatggccggatggcaggctttcgggaaaaactaa

SEQ ID NO: 20617 - protein, 203 aa, Jannaschia sp. CCS1
MIDARLLPLQRALMEPPARWLAACGVRADQITLVGCGIGLLAALAAALGLYWLALAGLALNRLADGLDGAVARLTTPTDRGAFLDIALDFVFYAVFPIGFIFADPASNGLPGAVLIASFVLTGTSFLAFSIIAERRGLLAENYPTKGIYYLGGLAEGAETIAVFAALCLFPDAFPWIAWAFAAICIVTGATRYMAGWQAFGKN

SEQ ID NO: 20618 - DNA, 603 bp, Sphingopyxis alaskensis RB2256
  CDS (1)..(603): transl_table=11
atgttcgatgcccgacttcgccctctgatcgacccgccgctcaatgcagcggggcgccggctcgccgcttggggcatcggcgccgatgccgtgacgttcgccggcatgtttgcgggactcgcggccgcggctgccatcgcgaacggcctttatgcagcaggcctcgtgctaattctggtcaatcgcctgctcgacggtctagacggcgcggtcgcacgcgcgacagggatgagcgattttggcggctatctcgatatcgttgccgatttcgtcttctatgtggcggtcccggtcggttttgcggtggcggcgccgggcgacagctttgctgccttgctgctggtcgccgccttcgcgctcaccggtacaagtttccttgcctatgcgaccctcgcggcgaaacgtggcatcgagaccgcggcgcatggccgtaagagcttcttttacagcaccggcctcgccgagggggccgagacgatcgtgtgcttcgcgctgatgtgcctcatgccgcagcactttgccccgatcgccgcaatatacaccgcgctttgccttgtcactgtcgtgcagcgatcggtgatggcttggcgcatgtttcgatag

SEQ ID NO: 20619 - protein, 200 aa, Sphingopyxis alaskensis RB2256
MFDARLRPLIDPPLNAAGRRLAAWGIGADAVTFAGMFAGLAAAAAIANGLYAAGLVLILVNRLLDGLDGAVARATGMSDFGGYLDIVADFVFYVAVPVGFAVAAPGDSFAALLLVAAFALTGTSFLAYATLAAKRGIETAAHGRKSFFYSTGLAEGAETIVCFALMCLMPQHFAPIAAIYTALCLVTVVQRSVMAWRMFR

SEQ ID NO: 20620 - DNA, 561 bp, Mesorhizobium sp. BNC1
  CDS (1)..(561): transl_table=11
atgcttgcggagcggttggtcaaggctggcatctcgtctgatacggtcactatcgctggtttcctcctcggacttatggcaggtgccgccatcattgcaggctggttcctagcggcaattatcttgatcctcttgagccgccttgcggacggcctggacggggccgtggcgcgcctcaccaacagttccgattttggcggctatcttgatatcgtgctcgacttcgccttctacggagtaatcccgctcgctttcgtgcttcacaatccggtcgacaatggccttgccggcgccgtgctgcttttttcgttctacgtgaatggcgcgagttttctggcctatgccgtgatcgcggaaaagcgccgtctggcgacgacgattcgtggagaaaagagcttcttcttcacgacggggctggcggaagcaggcgaaaccttgatcatattcctgctcttctgccttttccctgactggtttgcgacgctcgcctatctgtttgccgcgctcacgctctacaccgctatctcgcggattgttctggcggcaggagtcttccgctga

SEQ ID NO: 20621 - protein, 186 aa, Mesorhizobium sp. BNC1
MLAERLVKAGISSDTVTIAGFLLGLMAGAAIIAGWFLAAIILILLSRLADGLDGAVARLTNSSDFGGYLDIVLDFAFYGVIPLAFVLHNPVDNGLAGAVLLFSFYVNGASFLAYAVIAEKRRLATTIRGEKSFFFTTGLAEAGETLIIFLLFCLFPDWFATLAYLFAALTLYTAISRIVLAAGVFR

SEQ ID NO: 20622 - DNA, 609 bp, Silicibacter sp. TM1040
  CDS (1)..(609): transl_table=11
atgtttgatgccaagatccgccccctcatcgacccgtttctgaatgcgcagggcgcccggcttgccgcgcgcggcgtcacggccaatcaggtcacccttgccgggcttggtcttgggcttgcgtcagccgggctgatcgcaattggcctgacctgttgggcgctggcattcctgttggcgtcgcggatggcggatgggctggatggagccgtggcccgtcagcacgccccaagtgattttggtggctacctcgatattgtctgtgattttgtattctacggcgctgtaccgcttggatttgtggcgcttgcccccgaagcaaacggattggccggggcgttcctgttgtgcagcttttacgccaatggagcgagtttcctgggctatgcggtgctggcagaaaaacgcgaaatgaagacttctgcgcgcggggtgaaaacgctctacttcaccggggggctccttgagggtgcagaaaccatcggcttttttgtggttctgtgtctctggcccgacgggtttgcgccactggcctatgtgtttggaaccctgtgttttgcgacggctgcatcgcgggtcgtattggccgcaaaggtgttctcggcctga

SEQ ID NO: 20623 - protein, 202 aa, Silicibacter sp. TM1040
MFDAKIRPLIDPFLNAQGARLAARGVTANQVTLAGLGLGLASAGLIAIGLTCWALAFLLASRMADGLDGAVARQHAPSDFGGYLDIVCDFVFYGAVPLGFVALAPEANGLAGAFLLCSFYANGASFLGYAVLAEKREMKTSARGVKTLYFTGGLLEGAETIGFFVVLCLWPDGFAPLAYVFGTLCFATAASRVVLAAKVFSA

SEQ ID NO: 20624 - DNA, 666 bp, Shewanella frigidimarina NCIMB 400
  CDS (1)..(666): transl_table=11
atgctagatagatttatcaccccagtaataaagccactgttagcgcccgttgtgctgctactagacaaaaagaatgtccatcccgatcagctcaccttagtcggtttcggtttcggcatgttggcagtaccgttactggcattacaactttggtatggcgcgttgttttttattgcactgaatcggattgttgacggactcgatggcgcccttgctcgccatcaaaaacacaccagtgctgcgggtggctatttagatatttgtgtcgactttctgttttatgcggccattccgctcgggttcgccttagccaaccctactgaaaacgccttagccgcggcagtgttgttaaccgtgtttatcggcactggctcaagctttttggcctttgccataccggccgaaaagctacatttacctcgaccacaatttgccaataagagcttttattttttaaacggcctaaccgaaggcaccgaaaccatcgcctttttcgtcgcattttgtttgtggccggcttatttcccagagcttgcctatagctttgcttttttaggcgcgattactatcttcacccgtatacacggcggctatcacactctgaaaaatcataccttgaaaaaaaacacttcagttaatccatctcaacgaggtaaatcaacatga

SEQ ID NO: 20625 - protein, 221 aa, Shewanella frigidimarina NCIMB 400
MLDRFITPVIKPLLAPVVLLLDKKNVHPDQLTLVGFGFGMLAVPLLALQLWYGALFFIALNRIVDGLDGALARHQKHTSAAGGYLDICVDFLFYAAIPLGFALANPTENALAAAVLLTVFIGTGSSFLAFAIPAEKLHLPRPQFANKSFYFLNGLTEGTETIAFFVAFCLWPAYFPELAYSFAFLGAITIFTRIHGGYHTLKNHTLKKNTSVNPSQRGKST

SEQ ID NO: 20626 - DNA, 660 bp, Psychrobacter cryohalolentis K5
  CDS (1)..(660): transl_table=11
atgctcgataagtttattacccccatcatcaagcctctattagagccattggtcgtactattttataagggtggtattaccgcaaatcagttgactgtcactggttttctcattggtatgttggcgttgccattgattgcttttgagctgtggaatgcagcactaattgctattatattgaaccgtgtttttgatggattagatggtgcactggcacgttatgctggccaaagctcaagtgcgggcggctatttagacattaccctagattttttattctatgcagcggtgccactcggctttgtattggttaatcccgagcaaaacgctattgtaggcgcattgttattagccgcctttattggcactggctctagctttttggcctttgctattgcagctgaaaaattccaattagataagccgcaatttaaatataagagcttttattatctaaatggtctcactgagggtactgaaaccattgttttatttatcgccttttgtatttggccacagcactttgtggtattagcaagtatttttgcagcggcctgtgcggttactattatgactcgtatatatggcggttatcatacgcttaaacggctcgaaaccgatatacataagcccattaaggaggtcagtaatggcgaatga

SEQ ID NO: 20627 - protein, 219 aa, Psychrobacter cryohalolentis K5
MLDKFITPIIKPLLEPLVVLFYKGGITANQLTVTGFLIGMLALPLIAFELWNAALIAIILNRVFDGLDGALARYAGQSSSAGGYLDITLDFLFYAAVPLGFVLVNPEQNAIVGALLLAAFIGTGSSFLAFAIAAEKFQLDKPQFKYKSFYYLNGLTEGTETIVLFIAFCIWPQHFVVLASIFAAACAVTIMTRIYGGYHTLKRLETDIHKPIKEVSNGE

SEQ ID NO: 20628 - DNA, 648 bp, Nocardioides sp. JS614
  CDS (1)..(648): transl_table=11
atgcttgacgctcgggtccgtcgcgtcatcgcgccgagcctcgacacgatcgcggccggtctcgaccgagccggcgtcaagccgatgtggctcaccgtcgggggcctcggcgcagggctgggcgcgtgtgctgcggtggcgacgggccagtggagcgtcggcctggtgttgtggctggtcaacagggtgttggacggcttggacggccccgtcgcccggaggaacggggccaccgagctcggcggcttcctggacatcgtcttcgacttcacggtgtacggcggcttcgtggtggcggtcgctgtcgcggtcccggaagcgcgctttgcggcactgagcctgatgctggcctactacatctcggggaccgccctgctgtcgttgtcctcgctgttggagaagcgtcgcatcgacgcaggccacgacggccgctcgatcaggttcaccggaggcttggccgaaggcaccgagaccgttctcgtctacgtgctcatcgcgctgctacccggtcgcgccgagaccgtgctctggatcttcaccatcgtggtcaccctcaccgccgtgcagcgcatcgcctcgggcatccggctcctcacgctgacggagagcacggcgccggcccctgctggcgtcccatcccaccgctga

SEQ ID NO: 20629 - protein, 215 aa, Nocardioides sp. JS614
MLDARVRRVIAPSLDTIAAGLDRAGVKPMWLTVGGLGAGLGACAAVATGQWSVGLVLWLVNRVLDGLDGPVARRNGATELGGFLDIVFDFTVYGGFVVAVAVAVPEARFAALSLMLAYYISGTALLSLSSLLEKRRIDAGHDGRSIRFTGGLAEGTETVLVYVLIALLPGRAETVLWIFTIVVTLTAVQRIASGIRLLTLTESTAPAPAGVPSHR

SEQ ID NO: 20630 - DNA, 732 bp, uncultured archaeon GZfos19C7
  CDS (1)..(732)
atggattccgataaacttgaggtttttgacatcggcagcaggttttggtgcgatatagatacgccagatagtttagaatatgcgaagagaaagacgcttgattcgctcacaaaaccaactgatggagtagtttcgaaatgcattaacagaaggatttcaaaaaaggtatcggaaagattggtgaatacgaatcttacaccaactcaaataaccattatatctttcctcatggctttggcttccgccgctttcttcttcctcggtgagtataagtatctcgtcattggcgggatattagcacaagcttcttcgattattgatggatgtgatggagaggtagcgagattgaagtttttaattaccgattacggtgcttttgttgactccattctggatagatatgcagacgcaataattattttaggattgatttttggttattggaggttgaaagtaggtatatcagtgtggacaattggtttgtttgcagttcttggctcatttatgataagttatacaaatgcgaggtatgaaggagtgtttgaaaaacccggtggaggtagagggataccagtaagaagagatatgcggttgtttataataatggtaggagcatttctgaaccaggtgttagctctgctgctgttattggcaatacttacgaatgtagaggtggtgaggcgggttctctcgattaaaagtagtattacgaaaaagactgataaaaagtag

SEQ ID NO: 20631 - protein, 243 aa, uncultured archaeon GZfos19C7
MDSDKLEVFDIGSRFWCDIDTPDSLEYAKRKTLDSLTKPTDGVVSKCINRRISKKVSERLVNTNLTPTQITIISFLMALASAAFFFLGEYKYLVIGGILAQASSIIDGCDGEVARLKFLITDYGAFVDSILDRYADAIIILGLIFGYWRLKVGISVWTIGLFAVLGSFMISYTNARYEGVFEKPGGGRGIPVRRDMRLFIIMVGAFLNQVLALLLLLAILTNVEVVRRVLSIKSSITKKTDKK

SEQ ID NO: 20632 - DNA, 591 bp, Aquifex aeolicus
  CDS (1)..(591): transl_table=11
atgagtctgctcacgagaaggttaaaaccctactacgaagaactcttggaaccccttgtaaacttcttcggaaagtacaacgtgagtccaaatctaatcacacttttcggtcttttcctggtaggactcggttccttctttctgtacttagaaaacctaatcctcgcctttctgctacttctcctcggtgctttggcagacagtatagacggggctctggcgaggaggctaaatctcaaaacagagttcggggcgtttctcgactcaaccgttgacaggttctctgacgctctgcccttcaccgctctcggtgttcactacgcatcctacggggatgagacaggagttttgctttcttttttggctcttattagttcgttcggtgtgagctacacaagggcgagggcagaaagcctcggtgtttacggtcttgggggagtttttgagagaacggaaaggtggatagttctcttgggaagtatactcctgggactgttaaaactgggactttttatcattacacttggttctttgataaccgtttttcaaagggtttacgaaacgaagaaagctctggaggttaagagatga

SEQ ID NO: 20633 - protein, 196 aa, Aquifex aeolicus
MSLLTRRLKPYYEELLEPLVNFFGKYNVSPNLITLFGLFLVGLGSFFLYLENLILAFLLLLLGALADSIDGALARRLNLKTEFGAFLDSTVDRFSDALPFTALGVHYASYGDETGVLLSFLALISSFGVSYTRARAESLGVYGLGGVFERTERWIVLLGSILLGLLKLGLFIITLGSLITVFQRVYETKKALEVKR

SEQ ID NO: 20634 - DNA, 567 bp, Pyrococcus horikoshii
  CDS (1)..(567): transl_table=11
atgctgagcaagataaggccgaaggtaaagcaacccctggaaagaattgggaaaactctggcttcactggggataacccctaaccaattaaccattataggtttcttgataaccctcctagcttcctacgaattttaccttcaaaatcaaatcttagctggaataatactagcggttggggcttttctagatgctttagacggagcactagccagggccactgggaaggtttcaaagtttggtggcttcctggattcaacgattgacaggcttagcgatgcctcgatattatttggaatagccctgggtggattggtcaggtgggatgtaactttcttaactttaatcggctcgtacatggttagctactcaaggtgcagagcggaactcgccggttcaggaacgttagccatcggaattgccgaaaggggtgagaggataataataatattcatagcatccctattcaatgccgttaaaattggagtatacctggtagctatactatcctggataacgttcatacagagggtatatgaggcaaagaaaagattggaaatgggatga

SEQ ID NO: 20635 - protein, 188 aa, Pyrococcus horikoshii
MLSKIRPKVKQPLERIGKTLASLGITPNQLTIIGFLITLLASYEFYLQNQILAGIILAVGAFLDALDGALARATGKVSKFGGFLDSTIDRLSDASILFGIALGGLVRWDVTFLTLIGSYMVSYSRCRAELAGSGTLAIGIAERGERIIIIFIASLFNAVKIGVYLVAILSWITFIQRVYEAKKRLEMG

SEQ ID NO: 20636 - DNA, 22 bp, Artificial sequence
  (1)..(22): primer
atgcctgtgctagaccgccatc

SEQ ID NO: 20637 - DNA, 22 bp, Artificial sequence
  (1)..(22): primer
ttactgacgctggagcgacttc

SEQ ID NO: 20638 - protein, 219 aa, Artificial sequence
  Variant (2)..(5): xaa in position 2 to 5 is any amino acid
  Variant (9)..(14): xaa in position 9 to 14 is any amino acid
  Variant (16)..(16): xaa in position 16 is any amino acid
  Variant (18)..(27): xaa in position 18 to 27 is any amino acid
  Variant (28)..(31): xaa in position 28 to 31 is any or no amino acid
  Variant (33)..(35): xaa in position 33 to 35 is any amino acid
  Variant (37)..(37): xaa in position 37 is any amino acid
  Variant (39)..(42): xaa in position 39 to 42 is any amino acid
  Variant (44)..(44): xaa in position 44 is any amino acid
  Variant (48)..(48): xaa in position 48 is any amino acid
  Variant (52)..(55): xaa in position 52 to 55 is any amino acid
  Variant (56)..(58): xaa in position 56 to 58 is any or no amino acid
  Variant (60)..(61): xaa in position 60 to 61 is any amino acid
  Variant (63)..(64): xaa in position 63 to 64 is any amino acid
  Variant (67)..(69): xaa in position 67 to 69 is any amino acid
  Variant (71)..(79): xaa in position 71 to 79 is any amino acid
  Variant (81)..(90): xaa in position 81 to 90 is any amino acid
  Variant (91)..(102): xaa in position 91 to 102 is any or no amino acid
  Variant (104)..(127): xaa in position 104 to 127 is any amino acid
  Variant (128)..(161): xaa in position 128 to 161 is any or no amino acid
  Variant (163)..(163): xaa in position 163 is any amino acid
  Variant (165)..(166): xaa in position 165 to 166 is any amino acid
  Variant (168)..(194): xaa in position 168 to 194 is any amino acid
  Variant (195)..(214): xaa in position 195 to 214 is any or no amino acid
  Variant (216)..(218): xaa in position 216 to 218 is any amino acid
VXXXXVTLXXXXXXLXAXXXXXXXXXXXXXXAXXXIXLXXXXDXLDGXLARXXXXXXXTXXGXXLDXXXDXXXXXXXXXGXXXXXXXXXXXXXXXXXXXXXXLXXXXXXXXXXXXXXXXXXXXXXXXXXXXXXXXXXXXXXXXXXXXXXXXXXXXXXXXXXLXEXXEXXXXXXXXXXXXXXXXXXXXXXXXXXXXXXXXXXXXXXXXXXXXXXXTXXXR

SEQ ID NO: 20639 - protein, 9 aa, Artificial sequence
  Variant (2)..(2): xaa in position 2 is Ala, Gly, Asn, Ser, Thr or Val
  Variant (3)..(3): xaa in position 3 is any amino acid
  Variant (6)..(6): xaa in position 6 is any amino acid
  Variant (7)..(7): xaa in position 7 is Ile, Leu, Met or Val
DXXDGXXAR

SEQ ID NO: 20640 - protein, 9 aa, Artificial sequence
  Variant (2)..(2): xaa in position 2 is Ala, Gly or Thr
  Variant (3)..(3): xaa in position 3 is any amino acid
  Variant (6)..(8): xaa in position 6 to 8 is any amino acid
GXXLDXXXD

SEQ ID NO: 20641 - DNA, 705 bp, Escherichia coli
  CDS (1)..(705)
atgtttttagcatcattgttgagacgtattgcatttagttactacgattataaagcttataatttcaatattgaaaaaacagactttgttgtcatccatattcccgatcagattggcgatgctatggccatctttcctgttattcgggcgcttgaattgcataaaattaagcatcttttaattgtaacgtcgacaattaatttagaagtctttaatgcgcttaaacttgaacagactaaattaacattagtcacaatgactatgcaggatcacgcaacattaaaagaaataaaagatttagcaaagaacataacacagcaatacggtacgccggatctttgcattgaggggatgcgtaaaaagaacctgaaaacgatgttatttatcagtcagttgaaagcaaaaacgaattttcaggttgttggtataaccatgaattgcttctcccctttgtgcaagaacgcgtccagtatggatcagaaactccgggctcccgtacctatgacatgggcatttatgatgcgtgaggcgggttttccagcagtcaggccaatatatgaattgccactaagtgaggatgtactcgatgaggtgcgcgaggaaatgcgatcgttaggatcttacattgcgttcaatttagaaggtagctcgcaggaacgtacattttcattatcgattgcagaaaatctaatagcaaaaatttaa

SEQ ID NO: 20642 - protein, 234 aa, Escherichia coli
MFLASLLRRIAFSYYDYKAYNFNIEKTDFVVIHIPDQIGDAMAIFPVIRALELHKIKHLLIVTSTINLEVFNALKLEQTKLTLVTMTMQDHATLKEIKDLAKNITQQYGTPDLCIEGMRKKNLKTMLFISQLKAKTNFQVVGITMNCFSPLCKNASSMDQKLRAPVPMTWAFMMREAGFPAVRPIYELPLSEDVLDEVREEMRSLGSYIAFNLEGSSQERTFSLSIAENLIAKI

SEQ ID NO: 20643 - DNA, 26 bp, Artificial sequence
  (1)..(26): primer
atgtttttagcatcattgttgagacg

SEQ ID NO: 20644 - DNA, 28 bp, Artificial sequence
  (1)..(28): primer
ttaaatttttgctattagattttctgca

SEQ ID NO: 20645 - DNA, 785 bp, Escherichia coli K12; identical to SEQ ID NO: 3693
  CDS (86)..(781)

SEQ ID NO: 20646 - protein, 231 aa, Escherichia coli K12; identical to SEQ ID NO: 3694

SEQ ID NO: 20647 - DNA, 1005 bp, Nostoc sp. PCC 7120; identical to SEQ ID NO: 3695
  CDS (1)..(1005)

SEQ ID NO: 20648 - protein, 334 aa, Nostoc sp. PCC 7120; identical to SEQ ID NO: 3696

SEQ ID NO: 20649 - DNA, 642 bp, Salmonella enterica subsp. enterica serovar Typhi; identical to SEQ ID NO: 3697
  CDS (1)..(642)

SEQ ID NO: 20650 - protein, 213 aa, Salmonella enterica subsp. enterica serovar Typhi; identical to SEQ ID NO: 3698

SEQ ID NO: 20651 - DNA, 942 bp, Nostoc sp. PCC 7120; identical to SEQ ID NO: 3699
  CDS (1)..(942)

SEQ ID NO: 20652 - protein, 313 aa, Nostoc sp. PCC 7120; identical to SEQ ID NO: 3700

SEQ ID NO: 20653 - DNA, 642 bp, Yersinia pestis; identical to SEQ ID NO: 3701
  CDS (1)..(642)

SEQ ID NO: 20654 - protein, 213 aa, Yersinia pestis; identical to SEQ ID NO: 3702

SEQ ID NO: 20655 - DNA, 1668 bp, Thermotoga maritima; identical to SEQ ID NO: 3703
  CDS (1)..(1668)

SEQ ID NO: 20656 - protein, 555 aa, Thermotoga maritima; identical to SEQ ID NO: 3704

SEQ ID NO: 20657 - DNA, 2056 bp, Arabidopsis thaliana (mouse-ear cress); identical to SEQ ID NO: 3705
  CDS (1)..(2025)

SEQ ID NO: 20658 - protein, 674 aa, Arabidopsis thaliana (mouse-ear cress); identical to SEQ ID NO: 3706

SEQ ID NO: 20659 - DNA, 624 bp, Staphylococcus aureus; identical to SEQ ID NO: 3707
  CDS (1)..(624)

SEQ ID NO: 20660 - protein, 207 aa, Staphylococcus aureus; identical to SEQ ID NO: 3708

SEQ ID NO: 20661 - DNA, 639 bp, Streptococcus pneumoniae; identical to SEQ ID NO: 3709
  CDS (1)..(639)

SEQ ID NO: 20662 - protein, 212 aa, Streptococcus pneumoniae; identical to SEQ ID NO: 3710

SEQ ID NO: 20663 - DNA, 642 bp, Mycoplasma genitalium; identical to SEQ ID NO: 3711
  CDS (1)..(642): transl_table=4

SEQ ID NO: 20664 - protein, 213 aa, Mycoplasma genitalium; identical to SEQ ID NO: 3712

SEQ ID NO: 20665 - DNA, 636 bp, Bacillus halodurans; identical to SEQ ID NO: 3713
  CDS (1)..(636)

SEQ ID NO: 20666 - protein, 211 aa, Bacillus halodurans; identical to SEQ ID NO: 3714

SEQ ID NO: 20667 - DNA, 1668 bp, Treponema pallidum subsp. pallidum (syphilis spirochete); identical to SEQ ID NO: 3715
  CDS (1)..(1668)

SEQ ID NO: 20668 - protein, 555 aa, Treponema pallidum subsp. pallidum (syphilis spirochete); identical to SEQ ID NO: 3716

SEQ ID NO: 20669 - DNA, 669 bp, Chlamydophila pneumoniae, Chlamydia pneumoniae; identical to SEQ ID NO: 3717
  CDS (1)..(669)

SEQ ID NO: 20670 - protein, 222 aa, Chlamydophila pneumoniae, Chlamydia pneumoniae; identical to SEQ ID NO: 3718

SEQ ID NO: 20671 - DNA, 621 bp, Lactococcus lactis subsp. lactis; identical to SEQ ID NO: 3719
  CDS (1)..(621)

SEQ ID NO: 20672 - protein, 206 aa, Lactococcus lactis subsp. lactis; identical to SEQ ID NO: 3720

SEQ ID NO: 20673 - DNA, 633 bp, Deinococcus radiodurans; identical to SEQ ID NO: 3721
  CDS (1)..(633)

SEQ ID NO: 20674 - protein, 210 aa, Deinococcus radiodurans; identical to SEQ ID NO: 3722

SEQ ID NO: 20675 - DNA, 1932 bp, Arabidopsis thaliana (mouse-ear cress); identical to SEQ ID NO: 3723
  CDS (1)..(1932)

SEQ ID NO: 20676 - protein, 643 aa, Arabidopsis thaliana (mouse-ear cress); identical to SEQ ID NO: 3724

SEQ ID NO: 20677 - DNA, 636 bp, Bacillus subtilis; identical to SEQ ID NO: 3725
  CDS (1)..(636)

SEQ ID NO: 20678 - protein, 211 aa, Bacillus subtilis; identical to SEQ ID NO: 3726

SEQ ID NO: 20679 - DNA, 624 bp, Borrelia burgdorferi (Lyme disease spirochete); identical to SEQ ID NO: 3727
  CDS (1)..(624)

SEQ ID NO: 20680 - protein, 207 aa, Borrelia burgdorferi (Lyme disease spirochete); identical to SEQ ID NO: 3728

SEQ ID NO: 20681 - DNA, 624 bp, Ureaplasma urealyticum; identical to SEQ ID NO: 3729
  CDS (1)..(624): transl_table=4

SEQ ID NO: 20682 - protein, 207 aa, Ureaplasma urealyticum; identical to SEQ ID NO: 3730

SEQ ID NO: 20683 - DNA, 642 bp, Haemophilus influenzae; identical to SEQ ID NO: 3731
  CDS (1)..(642)

SEQ ID NO: 20684 - protein, 213 aa, Haemophilus influenzae; identical to SEQ ID NO: 3732

SEQ ID NO: 20685 - DNA, 1470 bp, Spinacia oleracea (spinach); identical to SEQ ID NO: 3733
  CDS (49)..(1257)

SEQ ID NO: 20686 - protein, 402 aa, Spinacia oleracea (spinach); identical to SEQ ID NO: 3734

SEQ ID NO: 20687 - DNA, 1533 bp, Triticum sp. (wheat); identical to SEQ ID NO: 3735
  CDS (65)..(1279)

SEQ ID NO: 20688 - protein, 404 aa, Triticum sp. (wheat); identical to SEQ ID NO: 3736

SEQ ID NO: 20689 - DNA, 1240 bp, Arabidopsis thaliana (mouse-ear cress); identical to SEQ ID NO: 3737
  CDS (1)..(1188)

SEQ ID NO: 20690 - protein, 395 aa, Arabidopsis thaliana (mouse-ear cress); identical to SEQ ID NO: 3738

SEQ ID NO: 20691 - DNA, 2077 bp, Saccharomyces cerevisiae; identical to SEQ ID NO: 3739
  CDS (482)..(1987)

SEQ ID NO: 20692 - protein, 501 aa, Saccharomyces cerevisiae; identical to SEQ ID NO: 3740

SEQ ID NO: 20693 - DNA, 642 bp, Mycoplasma pneumoniae; identical to SEQ ID NO: 3741
  CDS (1)..(642): transl_table=4

SEQ ID NO: 20694 - protein, 213 aa, Mycoplasma pneumoniae; identical to SEQ ID NO: 3742

SEQ ID NO: 20695 - DNA, 1245 bp, Chlamydomonas reinhardtii; identical to SEQ ID NO: 3743
  CDS (28)..(1155)

SEQ ID NO: 20696 - protein, 375 aa, Chlamydomonas reinhardtii; identical to SEQ ID NO: 3744

SEQ ID NO: 20697 - DNA, 1520 bp, Mesembryanthemum crystallinum (common ice plant); identical to SEQ ID NO: 3745
  CDS (127)..(1320)

SEQ ID NO: 20698 - protein, 397 aa, Mesembryanthemum crystallinum (common ice plant); identical to SEQ ID NO: 3746

SEQ ID NO: 20699 - DNA, 690 bp, Caenorhabditis elegans; identical to SEQ ID NO: 3747
  CDS (1)..(690)

SEQ ID NO: 20700 - protein, 229 aa, Caenorhabditis elegans; identical to SEQ ID NO: 3748

SEQ ID NO: 20701 - DNA, 1668 bp, Caenorhabditis elegans; identical to SEQ ID NO: 3749
  CDS (1)..(1668)

SEQ ID NO: 20702 - protein, 555 aa, Caenorhabditis elegans; identical to SEQ ID NO: 3750

SEQ ID NO: 20703 - DNA, 1365 bp, Schizosaccharomyces pombe; identical to SEQ ID NO: 3751
  CDS (1)..(1365)

SEQ ID NO: 20704 - protein, 454 aa, Schizosaccharomyces pombe; identical to SEQ ID NO: 3752

SEQ ID NO: 20705 - DNA, 1647 bp, Homo sapiens; identical to SEQ ID NO: 3753
  CDS (1)..(1647)

SEQ ID NO: 20706 - protein, 548 aa, Homo sapiens; identical to SEQ ID NO: 3754

SEQ ID NO: 20707 - DNA, 738 bp, Debaryomyces hansenii; identical to SEQ ID NO: 3755
  CDS (1)..(738)

SEQ ID NO: 20708 - protein, 245 aa, Debaryomyces hansenii; identical to SEQ ID NO: 3756

SEQ ID NO: 20709 - DNA, 1521 bp, Debaryomyces hansenii; identical to SEQ ID NO: 3757
  CDS (1)..(1521)

SEQ ID NO: 20710 - protein, 506 aa, Debaryomyces hansenii; identical to SEQ ID NO: 3758

SEQ ID NO: 20711 - DNA, 1353 bp, Yarrowia lipolytica; identical to SEQ ID NO: 3759
  CDS (1)..(1353)

SEQ ID NO: 20712 - protein, 450 aa, Yarrowia lipolytica; identical to SEQ ID NO: 3760

SEQ ID NO: 20713 - DNA, 1380 bp, Kluyveromyces lactis; identical to SEQ ID NO: 3761
  CDS (1)..(1380)

SEQ ID NO: 20714 - protein, 459 aa, Kluyveromyces lactis; identical to SEQ ID NO: 3762

SEQ ID NO: 20715 - DNA, 642 bp, Erwinia carotovora subsp; identical to SEQ ID NO: 3763
  CDS (1)..(642)

SEQ ID NO: 20716 - protein, 213 aa, Erwinia carotovora subsp; identical to SEQ ID NO: 3764

SEQ ID NO: 20717 - DNA, 627 bp, Mesoplasma florum L1; identical to SEQ ID NO: 3765
  CDS (1)..(627)

SEQ ID NO: 20718 - protein, 208 aa, Mesoplasma florum L1; identical to SEQ ID NO: 3766

SEQ ID NO: 20719 - DNA, 1431 bp, Candida glabrata; identical to SEQ ID NO: 3767
  CDS (1)..(1431)

SEQ ID NO: 20720 - protein, 476 aa, Candida glabrata; identical to SEQ ID NO: 3768

SEQ ID NO: 20721 - DNA, 639 bp, Bacillus thuringiensis serovar konkukian str; identical to SEQ ID NO: 3769
  CDS (1)..(639)

SEQ ID NO: 20722 - protein, 212 aa, Bacillus thuringiensis serovar konkukian str; identical to SEQ ID NO: 3770

SEQ ID NO: 20723 - DNA, 834 bp, Homo sapiens; identical to SEQ ID NO: 3771
  CDS (1)..(834)

SEQ ID NO: 20724 - protein, 277 aa, Homo sapiens [sequence omitted]

SEQ ID NO: 20725 - DNA, 1965 bp, Oryza sativa; identical to SEQ ID NO: 3773
  CDS (257)..(1726)

SEQ ID NO: 20726 - protein, 489 aa, Oryza sativa; identical to SEQ ID NO: 3774

SEQ ID NO: 20727 - DNA, 747 bp, Photobacterium profundum; identical to SEQ ID NO: 3775
  CDS (1)..(747)

SEQ ID NO: 20728 - protein, 248 aa, Photobacterium profundum; identical to SEQ ID NO: 3776

SEQ ID NO: 20729 - DNA, 621 bp, Bdellovibrio bacteriovorus; identical to SEQ ID NO: 3777
  CDS (1)..(621)

SEQ ID NO: 20730 - protein, 206 aa, Bdellovibrio bacteriovorus; identical to SEQ ID NO: 3778

SEQ ID NO: 20731 - DNA, 624 bp, Bdellovibrio bacteriovorus; identical to SEQ ID NO: 3779
  CDS (1)..(624)

SEQ ID NO: 20732 - protein, 207 aa, Bdellovibrio bacteriovorus; identical to SEQ ID NO: 3780

SEQ ID NO: 20733 - DNA, 618 bp, Mycoplasma mycoides; identical to SEQ ID NO: 3781
  CDS (1)..(618)

SEQ ID NO: 20734 - protein, 205 aa, Mycoplasma mycoides; identical to SEQ ID NO: 3782

SEQ ID NO: 20735 - DNA, 2638 bp, Oryza sativa; identical to SEQ ID NO: 3783
  CDS (248)..(2206)

SEQ ID NO: 20736 - protein, 652 aa, Oryza sativa; identical to SEQ ID NO: 3784

SEQ ID NO: 20737 - DNA, 1494 bp, Oryza sativa; identical to SEQ ID NO: 3785
  CDS (20)..(1231)

SEQ ID NO: 20738 - protein, 403 aa, Oryza sativa; identical to SEQ ID NO: 3786

SEQ ID NO: 20739 - DNA, 1824 bp, Homo sapiens; identical to SEQ ID NO: 3787
  CDS (45)..(1232)

SEQ ID NO: 20740 - protein, 395 aa, Homo sapiens [sequence omitted]

SEQ ID NO: 20741 - DNA, 630 bp, Listeria monocytogenes; identical to SEQ ID NO: 3789
  CDS (1)..(630)

SEQ ID NO: 20742 - protein, 209 aa, Listeria monocytogenes; identical to SEQ ID NO: 3790

SEQ ID NO: 20743 - DNA, 636 bp, Thermus thermophilus; identical to SEQ ID NO: 3791
  CDS (1)..(636)

SEQ ID NO: 20744 - protein, 211 aa, Thermus thermophilus; identical to SEQ ID NO: 3792

SEQ ID NO: 20745 - DNA, 1653 bp, Treponema denticola; identical to SEQ ID NO: 3793
  CDS (1)..(1653)

SEQ ID NO: 20746 - protein, 550 aa, Treponema denticola; identical to SEQ ID NO: 3794

SEQ ID NO: 20747 - DNA, 636 bp, Lactobacillus johnsonii; identical to SEQ ID NO: 3795
  CDS (1)..(636)

SEQ ID NO: 20748 - protein, 211 aa, Lactobacillus johnsonii; identical to SEQ ID NO: 3796

SEQ ID NO: 20749 - DNA, 1497 bp, Ashbya gossypii; identical to SEQ ID NO: 3797
  CDS (1)..(1497)

SEQ ID NO: 20750 - protein, 498 aa, Ashbya gossypii; identical to SEQ ID NO: 3798

SEQ ID NO: 20751 - DNA, 651 bp, Vibrio vulnificus; identical to SEQ ID NO: 3799
  CDS (1)..(651)

SEQ ID NO: 20752 - protein, 216 aa, Vibrio vulnificus; identical to SEQ ID NO: 3800

SEQ ID NO: 20753 - DNA, 630 bp, Porphyromonas gingivalis; identical to SEQ ID NO: 3801
  CDS (1)..(630)

SEQ ID NO: 20754 - protein, 209 aa, Porphyromonas gingivalis; identical to SEQ ID NO: 3802

SEQ ID NO: 20755 - DNA, 642 bp, Photorhabdus luminescens; identical to SEQ ID NO: 3803
  CDS (1)..(642)

SEQ ID NO: 20756 - protein, 213 aa, Photorhabdus luminescens; identical to SEQ ID NO: 3804

SEQ ID NO: 20757 - DNA, 645 bp, Mycoplasma gallisepticum; identical to SEQ ID NO: 3805
  CDS (1)..(645): transl_table=4

SEQ ID NO: 20758 - protein, 214 aa, Mycoplasma gallisepticum; identical to SEQ ID NO: 3806

SEQ ID NO: 20759 - DNA, 930 bp, Gloeobacter violaceus; identical to SEQ ID NO: 3807
  CDS (1)..(930)

SEQ ID NO: 20760 - protein, 309 aa, Gloeobacter violaceus; identical to SEQ ID NO: 3808

SEQ ID NO: 20761 - DNA, 996 bp, Gloeobacter violaceus; identical to SEQ ID NO: 3809
  CDS (1)..(996)

SEQ ID NO: 20762 - protein, 331 aa, Gloeobacter violaceus; identical to SEQ ID NO: 3810

SEQ ID NO: 20763 - DNA, 1038 bp, Gloeobacter violaceus; identical to SEQ ID NO: 3811
  CDS (1)..(1038)

SEQ ID NO: 20764 - protein, 345 aa, Gloeobacter violaceus; identical to SEQ ID NO: 3812

SEQ ID NO: 20765 - DNA, 615 bp, Chromobacterium violaceum; identical to SEQ ID NO: 3813
  CDS (1)..(615)

SEQ ID NO: 20766 - protein, 204 aa, Chromobacterium violaceum; identical to SEQ ID NO: 3814

SEQ ID NO: 20767 - DNA, 2049 bp, Giardia lamblia ATCC 50803; identical to SEQ ID NO: 3815
  CDS (1)..(2049)

SEQ ID NO: 20768 - protein, 682 aa, Giardia lamblia ATCC 50803; identical to SEQ ID NO: 3816

SEQ ID NO: 20769 - DNA, 1425 bp, Neurospora crassa; identical to SEQ ID NO: 3817
  CDS (1)..(1425)

SEQ ID NO: 20770 - protein, 474 aa, Neurospora crassa; identical to SEQ ID NO: 3818

SEQ ID NO: 20771 - DNA, 612 bp, Synechococcus sp; identical to SEQ ID NO: 3819
  CDS (1)..(612)

SEQ ID NO: 20772 - protein, 203 aa, Synechococcus sp; identical to SEQ ID NO: 3820

SEQ ID NO: 20773 - DNA, 654 bp, Haemophilus ducreyi; identical to SEQ ID NO: 3821
  CDS (1)..(654)

SEQ ID NO: 20774 - protein, 217 aa, Haemophilus ducreyi; identical to SEQ ID NO: 3822

SEQ ID NO: 20775 - DNA, 1609 bp, Chlorarachnion sp; identical to SEQ ID NO: 3823
  CDS (10)..(1464)

SEQ ID NO: 20776 - protein, 484 aa, Chlorarachnion sp; identical to SEQ ID NO: 3824

SEQ ID NO: 20777 - DNA, 630 bp, Enterococcus faecalis; identical to SEQ ID NO: 3825
  CDS (1)..(630)

SEQ ID NO: 20778 - protein, 209 aa, Enterococcus faecalis; identical to SEQ ID NO: 3826

SEQ ID NO: 20779 - DNA, 648 bp, Coxiella burnetii; identical to SEQ ID NO: 3827
  CDS (1)..(648)

SEQ ID NO: 20780 - protein, 215 aa, Coxiella burnetii; identical to SEQ ID NO: 3828

SEQ ID NO: 20781 - DNA, 1659 bp, Clostridium tetani; identical to SEQ ID NO: 3829
  CDS (1)..(1659)

SEQ ID NO: 20782 - protein, 552 aa, Clostridium tetani; identical to SEQ ID NO: 3830

SEQ ID NO: 20783 - DNA, 1674 bp, Bacteroides thetaiotaomicron; identical to SEQ ID NO: 3831
  CDS (1)..(1674)

SEQ ID NO: 20784 - protein, 557 aa, Bacteroides thetaiotaomicron; identical to SEQ ID NO: 3832

SEQ ID NO: 20785 - DNA, 618 bp, Bacteroides thetaiotaomicron; identical to SEQ ID NO: 3833
  CDS (1)..(618)

SEQ ID NO: 20786 - protein, 205 aa, Bacteroides thetaiotaomicron; identical to SEQ ID NO: 3834

SEQ ID NO: 20787 - DNA, 630 bp, Streptococcus agalactiae; identical to SEQ ID NO: 3835
  CDS (1)..(630)

SEQ ID NO: 20788 - protein, 209 aa, Streptococcus agalactiae; identical to SEQ ID NO: 3836

SEQ ID NO: 20789 - DNA, 1524 bp, Galdieria sulphuraria; identical to SEQ ID NO: 3837
  CDS (77)..(1423)

SEQ ID NO: 20790 - protein, 448 aa, Galdieria sulphuraria; identical to SEQ ID NO: 3838

SEQ ID NO: 20791 - DNA, 1005 bp, Synechococcus vulcanus; identical to SEQ ID NO: 3839
  CDS (1)..(1005)

SEQ ID NO: 20792 - protein, 334 aa, Synechococcus vulcanus; identical to SEQ ID NO: 3840

SEQ ID NO: 20793 - DNA, 1831 bp, Arabidopsis thaliana; identical to SEQ ID NO: 3841
  CDS (116)..(1525)

SEQ ID NO: 20794 - protein, 469 aa, Arabidopsis thaliana; identical to SEQ ID NO: 3842

SEQ ID NO: 20795 - DNA, 1875 bp, Homo sapiens; identical to SEQ ID NO: 3843
  CDS (14)..(1273)

SEQ ID NO: 20796 - protein, 419 aa, Homo sapiens; identical to SEQ ID NO: 3844

SEQ ID NO: 20797 - DNA, 1644 bp, Thermoanaerobacter tengcongensis; identical to SEQ ID NO: 3845
  CDS (1)..(1644)

SEQ ID NO: 20798 - protein, 547 aa, Thermoanaerobacter tengcongensis; identical to SEQ ID NO: 3846

SEQ ID NO: 20799 - DNA, 1665 bp, Clostridium perfringens; identical to SEQ ID NO: 3847
  CDS (1)..(1665)

SEQ ID NO: 20800 - protein, 554 aa, Clostridium perfringens; identical to SEQ ID NO: 3848

SEQ ID NO: 20801 - DNA, 1258 bp, Odontella sinensis; identical to SEQ ID NO: 3849
  CDS (23)..(1213)

SEQ ID NO: 20802 - protein, 396 aa, Odontella sinensis; identical to SEQ ID NO: 3850

SEQ ID NO: 20803 - DNA, 606 bp, Homo sapiens; identical to SEQ ID NO: 3851
  CDS (1)..(606)

SEQ ID NO: 20804 - protein, 201 aa, Homo sapiens [sequence omitted]

SEQ ID NO: 20805 - DNA, 1299 bp, Vaucheria litorea; identical to SEQ ID NO: 3853
  CDS (8)..(1225)

SEQ ID NO: 20806 - protein, 405 aa, Vaucheria litorea; identical to SEQ ID NO: 3854

SEQ ID NO: 20807 - DNA, 1711 bp, Cryptosporidium parvum; identical to SEQ ID NO: 3855
  CDS (290)..(1549)

SEQ ID NO: 20808 - protein, 419 aa, Cryptosporidium parvum; identical to SEQ ID NO: 3856

SEQ ID NO: 20809 - DNA, 1492 bp, Arabidopsis thaliana; identical to SEQ ID NO: 3857
  CDS (1)..(1461)

SEQ ID NO: 20810 - protein, 486 aa, Arabidopsis thaliana; identical to SEQ ID NO: 3858

SEQ ID NO: 20811 - DNA, 1480 bp, Dictyostelium discoideum; identical to SEQ ID NO: 3859
  CDS (1)..(1479)

SEQ ID NO: 20812 - protein, 492 aa, Dictyostelium discoideum; identical to SEQ ID NO: 3860

SEQ ID NO: 20813 - DNA, 1545 bp, Synechococcus sp; identical to SEQ ID NO: 3861
  CDS (267)..(1268)

SEQ ID NO: 20814 - protein, 333 aa, Synechococcus sp; identical to SEQ ID NO: 3862

SEQ ID NO: 20815 - DNA, 1452 bp, Arabidopsis thaliana; identical to SEQ ID NO: 3863
  CDS (1)..(1452)

SEQ ID NO: 20816 - protein, 483 aa, Arabidopsis thaliana; identical to SEQ ID NO: 3864

SEQ ID NO: 20817 - DNA, 1398 bp, Arabidopsis thaliana; identical to SEQ ID NO: 3865
  CDS (1)..(1398)

SEQ ID NO: 20818 - protein, 465 aa, Arabidopsis thaliana; identical to SEQ ID NO: 3866

SEQ ID NO: 20819 - DNA, 1856 bp, Drosophila melanogaster; identical to SEQ ID NO: 3867
  CDS (77)..(1762)

SEQ ID NO: 20820 - protein, 561 aa, Drosophila melanogaster; identical to SEQ ID NO: 3868

SEQ ID NO: 20821 - DNA, 1869 bp, Synechocystis sp; identical to SEQ ID NO: 3869
  CDS (233)..(1231)

SEQ ID NO: 20822 - protein, 332 aa, Synechocystis sp; identical to SEQ ID NO: 3870

SEQ ID NO: 20823 - DNA, 834 bp, Mus musculus; identical to SEQ ID NO: 3871
  CDS (1)..(834)

SEQ ID NO: 20824 - protein, 277 aa, Mus musculus; identical to SEQ ID NO: 3872

SEQ ID NO: 20825 - DNA, 1200 bp, Homo sapiens; identical to SEQ ID NO: 3873
  CDS (180)..(965)

SEQ ID NO: 20826 - protein, 261 aa, Homo sapiens; identical to SEQ ID NO: 3874

SEQ ID NO: 20827 - DNA, 822 bp, Drosophila melanogaster; identical to SEQ ID NO: 3875
  CDS (40)..(822)

SEQ ID NO: 20828 - protein, 260 aa, Drosophila melanogaster; identical to SEQ ID NO: 3876

SEQ ID NO: 20829 - DNA, 1823 bp, Mus musculus; identical to SEQ ID NO: 3877
  CDS (6)..(1652)

SEQ ID NO: 20830 - protein, 548 aa, Mus musculus; identical to SEQ ID NO: 3878

SEQ ID NO: 20831 - DNA, 627 bp, Clostridium perfringens; identical to SEQ ID NO: 3879
  CDS (1)..(627)

SEQ ID NO: 20832 - protein, 208 aa, Clostridium perfringens; identical to SEQ ID NO: 3880

SEQ ID NO: 20833 - DNA, 630 bp, Clostridium tetani; identical to SEQ ID NO: 3881
  CDS (1)..(630)

SEQ ID NO: 20834 - protein, 209 aa, Clostridium tetani; identical to SEQ ID NO: 3882

SEQ ID NO: 20835 - DNA, 678 bp, Halobacterium sp; identical to SEQ ID NO: 3883
  CDS (1)..(678)

SEQ ID NO: 20836 - protein, 225 aa, Halobacterium sp; identical to SEQ ID NO: 3884

SEQ ID NO: 20837 - DNA, 630 bp, Lactobacillus plantarum; identical to SEQ ID NO: 3885
  CDS (1)..(630)

SEQ ID NO: 20838 - protein, 209 aa, Lactobacillus plantarum; identical to SEQ ID NO: 3886

SEQ ID NO: 20839 - DNA, 633 bp, Oceanobacillus iheyensis; identical to SEQ ID NO: 3887
  CDS (1)..(633)

SEQ ID NO: 20840 - protein, 210 aa, Oceanobacillus iheyensis; identical to SEQ ID NO: 3888

SEQ ID NO: 20841 - DNA, 651 bp, Pasteurella multocida; identical to SEQ ID NO: 3889
  CDS (1)..(651)

SEQ ID NO: 20842 - protein, 216 aa, Pasteurella multocida; identical to SEQ ID NO: 3890

SEQ ID NO: 20843 - DNA, 639 bp, Shewanella oneidensis; identical to SEQ ID NO: 3891
  CDS (1)..(639)

SEQ ID NO: 20844 - protein, 212 aa, Shewanella oneidensis; identical to SEQ ID NO: 3892

SEQ ID NO: 20845 - DNA, 624 bp, Staphylococcus epidermidis; identical to SEQ ID NO: 3893
  CDS (1)..(624)

SEQ ID NO: 20846 - protein, 207 aa, Staphylococcus epidermidis; identical to SEQ ID NO: 3894

SEQ ID NO: 20847 - DNA, 627 bp, Streptococcus pyogenes; identical to SEQ ID NO: 3895
  CDS (1)..(627)

SEQ ID NO: 20848 - protein, 208 aa, Streptococcus pyogenes; identical to SEQ ID NO: 3896

SEQ ID NO: 20849 - DNA, 642 bp, Vibrio cholerae; identical to SEQ ID NO: 3897
  CDS (1)..(642)

SEQ ID NO: 20850 - protein, 213 aa, Vibrio cholerae; identical to SEQ ID NO: 3898

SEQ ID NO: 20851 - DNA, 642 bp, Vibrio parahaemolyticus; identical to SEQ ID NO: 3899
  CDS (1)..(642)

SEQ ID NO: 20852 - protein, 213 aa, Vibrio parahaemolyticus; identical to SEQ ID NO: 3900

SEQ ID NO: 20853 - DNA, 816 bp, Xenopus laevis; identical to SEQ ID NO: 3901
  CDS (1)..(816)

SEQ ID NO: 20854 - protein, 271 aa, Xenopus laevis; identical to SEQ ID NO: 3902

SEQ ID NO: 20855 - DNA, 21 bp, Artificial sequence
  (1)..(21): primer
atggcgcttcgtcgccccctt

SEQ ID NO: 20856 - DNA, 27 bp, Artificial sequence
  (1)..(27): primer
ttattcaaagaactgacttattttcgc

SEQ ID NO: 20857 - protein, 242 aa, Artificial sequence
  Variant (5)..(5): xaa in position 5 is any amino acid
  Variant (7)..(7): xaa in position 7 is any amino acid
  Variant (15)..(18): xaa in position 15 to 18 is any amino acid
  Variant (20)..(26): xaa in position 20 to 26 is any amino acid
  Variant (27)..(51): xaa in position 27 to 51 is any or no amino acid
  Variant (54)..(55): xaa in position 54 to 55 is any amino acid
  Variant (57)..(57): xaa in position 57 is any amino acid
  Variant (60)..(68): xaa in position 60 to 68 is any amino acid
  Variant (69)..(76): xaa in position 69 to 76 is any or no amino acid
  Variant (79)..(79): xaa in position 79 is any amino acid
  Variant (81)..(81): xaa in position 81 is any amino acid
  Variant (83)..(83): xaa in position 83 is any amino acid
  Variant (85)..(86): xaa in position 85 to 86 is any amino acid
  Variant (89)..(91): xaa in position 89 to 91 is any amino acid
  Variant (93)..(94): xaa in position 93 to 94 is any amino acid
  Variant (96)..(97): xaa in position 96 to 97 is any amino acid
  Variant (99)..(100): xaa in position 99 to 100 is any amino acid
  Variant (102)..(103): xaa in position 102 to 103 is any amino acid
  Variant (105)..(105): xaa in position 105 is any amino acid
  Variant (107)..(114): xaa in position 107 to 114 is any amino acid
  Variant (115)..(121): xaa in position 115 to 121 is any or no amino acid
  Variant (123)..(123): xaa in position 123 is any amino acid
  Variant (124)..(126): xaa in position 124 to 126 is any or no amino acid
  Variant (134)..(140): xaa in position 134 to 140 is any amino acid
  Variant (141)..(143): xaa in position 141 to 143 is any or no amino acid
  Variant (145)..(151): xaa in position 145 to 151 is any amino acid
  Variant (155)..(167): xaa in position 155 to 167 is any or no amino acid
  Variant (169)..(171): xaa in position 169 to 171 is any amino acid
  Variant (173)..(176): xaa in position 173 to 176 is any amino acid
  Variant (180)..(180): xaa in position 180 is any amino acid
  Variant (183)..(192): xaa in position 183 to 192 is any amino acid
  Variant (193)..(195): xaa in position 193 to 195 is any or no amino acid
  Variant (197)..(202): xaa in position 197 to 202 is any amino acid
  Variant (206)..(209): xaa in position 206 to 209 is any amino acid
  Variant (212)..(212): xaa in position 212 is any amino acid
  Variant (214)..(217): xaa in position 214 to 217 is any amino acid
  Variant (223)..(226): xaa in position 223 to 226 is any amino acid
  Variant (227)..(232): xaa in position 227 to 232 is any or no amino acid
  Variant (234)..(241): xaa in position 234 to 241 is any amino acid
IIGIXGXSGSGKTTXXXXIXXXXXXXXXXXXXXXXXXXXXXXXXXXXXXXXVIXXDXYYXXXXXXXXXXXXXXXXXFDXPXAXDXXLLXXXLXXLXXGXXVXXPXYXXXXXXXXXXXXXXXVXXXXVIILEGIXXXXXXXXXXLXXXXXXXIFVXXXXXXXXXXXXXDXXXDXXXXRRIXRDXXXXXXXXXXXXXIXXXXXXVKPXXXXFIXPXXXXADIIIXXXXXXXXXXVXXXXXXXXI

SEQ ID NO: 20858 - protein, 58 aa, Artificial sequence; identical to SEQ ID NO: 6166
  Variant (1)..(1): xaa in position 1 is Ile, Val, Leu or Ala
  Variant (2)..(2): xaa in position 2 is Ile, Val or Leu
  Variant (3)..(3): xaa in position 3 is any amino acid
  Variant (4)..(4): xaa in position 4 is Ile, Val or Leu
  Variant (5)..(5): xaa in position 5 is any amino acid
  Variant (6)..(6): xaa in position 6 is Gly or Ala
  Variant (7)..(7): xaa in position 7 is any amino acid
  Variant (8)..(8): xaa in position 8 is Ser, Thr or Ala
  Variant (9)..(9): xaa in position 9 is Gly, Ala or Ser
  Variant (10)..(10): xaa in position 10 is Ser, Cys, Ala or Gly
  Variant (13)..(13): xaa in position 13 is Thr or Ser
  Variant (14)..(18): xaa in position 14 to 18 is any amino acid
  Variant (19)..(19): xaa in position 19 is Ile, Leu, Val or Met
  Variant (20)..(27): xaa in position 20 to 27 is any amino acid
  Variant (28)..(52): xaa in position 28 to 52 is any or no amino acid
  Variant (53)..(53): xaa in position 53 is Ile, Leu or Val
  Variant (54)..(55): xaa in position 54 to 55 is any amino acid
  Variant (57)..(57): xaa in position 57 is any amino acid
  Variant (58)..(58): xaa in position 58 is Tyr or Phe

SEQ ID NO: 20859 - protein, 74 aa, Artificial sequence; identical to SEQ ID NO: 6167
  Variant (1)..(1): xaa in position 1 is Ala, Ser, Val, Glu or Cys
  Variant (2)..(10): xaa in position 2 to 10 is any amino acid
  Variant (11)..(11): xaa in position 11 is Leu, Ile, Val or Met
  Variant (12)..(13): xaa in position 12 to 13 is any amino acid
  Variant (14)..(14): xaa in position 14 is Leu or Ile
  Variant (15)..(19): xaa in position 15 to 19 is any amino acid
  Variant (20)..(20): xaa in position 20 is Val, Ile, Leu, Thr or Tyr
  Variant (21)..(22): xaa in position 21 to 22 is any amino acid
  Variant (24)..(24): xaa in position 24 is any amino acid
  Variant (26)..(34): xaa in position 26 to 34 is any amino acid
  Variant (35)..(46): xaa in position 35 to 46 is any or no amino acid
  Variant (47)..(47): xaa in position 47 is Val, Ile or Phe
  Variant (48)..(48): xaa in position 48 is Ile, Val, Leu or Phe
  Variant (49)..(49): xaa in position 49 is Ile, Val or Leu
  Variant (50)..(50): xaa in position 50 is any amino acid
  Variant (51)..(51): xaa in position 51 is Glu or Asp
  Variant (53)..(53): xaa in position 53 is Ile or Leu
  Variant (54)..(54): xaa in position 54 is Leu, His, Tyr, Phe or Met
  Variant (55)..(59): xaa in position 55 to 59 is any amino acid
  Variant (60)..(63): xaa in position 60 to 63 is any or no amino acid
  Variant (64)..(64): xaa in position 64 is Leu, Ile, Val or Met
  Variant (65)..(71): xaa in position 65 to 71 is any amino acid
  Variant (72)..(72): xaa in position 72 is Ile, Val or Leu
  Variant (73)..(73): xaa in position 73 is Phe, Tyr or Ser
  Variant (74)..(74): xaa in position 74 is Val, Met, Leu, Ile or Phe

SEQ ID NO: 20860 - protein, 44 aa, Artificial sequence; identical to SEQ ID NO: 6168
  Variant (1)..(1): xaa in position 1 is Arg or Lys
  Variant (2)..(2): xaa in position 2 is Ile, Val, Leu or Met
  Variant (3)..(3): xaa in position 3 is any amino acid
  Variant (6)..(29): xaa in position 6 to 29 is any amino acid
  Variant (30)..(32): xaa in position 30 to 32 is any or no amino acid
  Variant (33)..(33): xaa in position 33 is Phe, Tyr, Trp or Asn
  Variant (34)..(34): xaa in position 34 is Ile, Val or Cys
  Variant (35)..(35): xaa in position 35 is any amino acid
  Variant (36)..(36): xaa in position 36 is Pro or Lys
  Variant (37)..(40): xaa in position 37 to 40 is any amino acid
  Variant (42)..(43): xaa in position 42 to 43 is any amino acid
  Variant (44)..(44): xaa in position 44 is Ile, Val, Leu, Met or Lys

SEQ ID NO: 20861 - DNA, 1323 bp, Escherichia coli K12
  CDS (1)..(1323): transl_table=11
atgattggtcgcatatcgcgttttatgacgcgttttgtcagccggtggcttcccgatccactgatctttgccatgttgctgacattgctaacattcgtgatcgcgctttggttaacaccacaaacgccgatcagcatggtgaaaatgtggggtgacggtttctggaacttgctggcgtttggtatgcagatggcgcttatcatcgttaccggtcatgcccttgccagctctgctccggtgaaaagtttgctgcgtactgccgcctccgccgcaaagacgcccgtacagggcgtcatgctggtcactttcttcggttcagtcgcttgtgtcatcaactggggatttggtttggttgtcggcgcaatgtttgcccgtgaagtcgcccggcgagtccccggttctgattatccgttgctcattgcctgcgcctacattggttttctcacctggggtggcggcttctctggatcaatgcctctgttggctgcaacaccgggcaacccggttgagcatatcgccgggctgatcccggtgggcgatactctgttcagtggttttaacattttcatcactgtggcgttgattgtggtgatgccatttatcacccgcatgatgatgccaaaaccgtctgacgtggtgagtatcgatccaaaactactcatggaagaggctgattttcaaaagcagctaccgaaagatgccccaccatccgagcgactggaagaaagccgcattctgacgttgatcatcggcgcactcggtatcgcttaccttgcgatgtacttcagcgaacatggcttcaacatcaccatcaataccgtcaacctgatgtttatgattgcgggtctgctgctacataaaacgccaatggcttatatgcgtgctatcagcgcggcagcacgcagtactgccggtattctggtgcaattccccttctacgctgggatccaactgatgatggagcattccggtctgggcggactcattaccgaattcttcatcaatgttgcgaacaaagacaccttcccggtaatgaccttttttagttctgcactgattaacttcgccgttccgtctggcggcggtcactgggttattcagggacctttcgtgatacccgcagcccaggcgctgggcgctgatctcggtaaatcggtaatggcgatcgcctacggcgagcaatggatgaacatggcacaaccattctgggcgctgccagcactggcaatcgccggactcggtgtccgcgacatcatgggctactgcatcactgccctgctcttctccggtgtcattttcgtcattggtttaacgctgttctga

SEQ ID NO: 20862 - protein, 440 aa, Escherichia coli K12
MIGRISRFMTRFVSRWLPDPLIFAMLLTLLTFVIALWLTPQTPISMVKMWGDGFWNLLAFGMQMALIIVTGHALASSAPVKSLLRTAASAAKTPVQGVMLVTFFGSVACVINWGFGLVVGAMFAREVARRVPGSDYPLLIACAYIGFLTWGGGFSGSMPLLAATPGNPVEHIAGLIPVGDTLFSGFNIFITVALIVVMPFITRMMMPKPSDVVSIDPKLLMEEADFQKQLPKDAPPSERLEESRILTLIIGALGIAYLAMYFSEHGFNITINTVNLMFMIAGLLLHKTPMAYMRAISAAARSTAGILVQFPFYAGIQLMMEHSGLGGLITEFFINVANKDTFPVMTFFSSALINFAVPSGGGHWVIQGPFVIPAAQALGADLGKSVMAIAYGEQWMNMAQPFWALPALAIAGLGVRDIMGYCITALLFSGVIFVIGLTLF

SEQ ID NO: 20863 - DNA, 1461 bp, Archaeoglobus fulgidus DSM 4304
  CDS (1)..(1461): transl_table=11
atggaggatgggcggtacagcgccctggagagaatgggagcaagactgtgcgcaagcgtggagaaatggatgccggacccattaatctttgctctgcttctgactttggtgacttatctgttggtaatagtggtgatgaagccgtacacagtgatggatgcgggaacgatggttaagtggctcctcgtggatgtttggtacaaaggcttctggggtctcctgtccttcgccatgcaaatgtgtttgattcttgttaccggttatgcaatagcctatcatccaatcgtttacaggattttgaaaaagatagcgacactcccttcagatactaaatcggctgcagctcttacggcacttattgcaatgattgcagcttggataaactggggacttggacttatagttggggccattttggccagaacaattggaattgaattctacagaacaggaaagccattgcactatccggctgtagtagcagccggttatgccggtttaggacttacttggcattggggtttatcggcttctgcaccattattgattaacacgccaaatcactttctaaaggatgttttcgtggagttgttcggcagggagacagttccgctgaacgagaccatctttcatccatatactcttataaatctggcaataatcatttctttcggggtactggcttattacgcgcttgcgcctaacaggggtgaattgaaaggaatagacaaagttgcaccacacataattgagctggtgaagaaagaaaaggaagaggagctgaaagaaaaaagtaaagagcgcgtaacgattgctgacaagcttgagaacagtaaagttctcgccctactaataagcatattggggattatcacgatgggctactggttctacgagaaaggctttttcggtggactaaacctaaattcgctgaattttacgtttataatggttggccttcttctctacatgaatcccatagcttacatgagggctatcaccagagcggcaggagcagtagcaggaatactggttcagtttccgttctatgcgggtattatgggaatgatgaggtacagtgcagttgttgcagggggaccaaatcttgcaactgttatagccaacagtatagcgagcgttgcaacgccgtttacgtggccggcaatatgtttatacattgcagggctgataaacatattcataccttctggaggtggagaatgggcagcagttggagagattttagcaagaacgtcagctgccctgggtgtgcctattggaaaaaccgtaattgcttatggtgtaggggacgcttggacaaacctcttccagccattctgggcgattcctctcctcggacttacgggaacaagggccagagatgtttttggatacacgatctccgtgatgatattggcaaccattccgctctcgctcggtttagttctcgttccatattga

SEQ ID NO: 20864 - protein, 486 aa, Archaeoglobus fulgidus DSM 4304
MEDGRYSALERMGARLCASVEKWMPDPLIFALLLTLVTYLLVIVVMKPYTVMDAGTMVKWLLVDVWYKGFWGLLSFAMQMCLILVTGYAIAYHPIVYRILKKIATLPSDTKSAAALTALIAMIAAWINWGLGLIVGAILARTIGIEFYRTGKPLHYPAVVAAGYAGLGLTWHWGLSASAPLLINTPNHFLKDVFVELFGRETVPLNETIFHPYTLINLAIIISFGVLAYYALAPNRGELKGIDKVAPHIIELVKKEKEEELKEKSKERVTIADKLENSKVLALLISILGIITMGYWFYEKGFFGGLNLNSLNFTFIMVGLLLYMNPIAYMRAITRAAGAVAGILVQFPFYAGIMGMMRYSAVVAGGPNLATVIANSIASVATPFTWPAICLYIAGLINIFIPSGGGEWAAVGEILARTSAALGVPIGKTVIAYGVGDAWTNLFQPFWAIPLLGLTGTRARDVFGYTISVMILATIPLSLGLVLVPY

SEQ ID NO: 20865 - DNA, 1455 bp, Aeropyrum pernix K1
  CDS (1)..(1455): transl_table=11
gtgggctcattgggggacgagtctaggcgtcccttcctagaggctttcggcgaggcgctggagcgaagggtcaggggcgtcatgccagaccccttcatcttcgccatactccttacattcatagcaatagtgctcgacctcatcctcctgaggcccatacagcatgtggggctggggggtactgtcaagtttctagtctacagtgcatggtacggcggcttctggaagctcctgaccttcagcatgcagatgacccttatactggtgacgggctacgttatagcctaccacccactcgtatacagggttctctccaggatagccggcctacctagggacacgaagcaggcagccgtcctcgccgcagccgtcgccatagcactctcatacctcagctggggcctgagcctgataggcggggccatactggccagggagatagggaggcaggccgccttccgcggaaggaagatccactatccagtagtggtcgtcgctgcatacagcggcctagggctaacatggcactggggtctcacggcaagcgccccgctgctcatgaacactcccggccacttcctggccaacgttgtgaaggagctctacggcgtcgagacaataccgctctcacagacgattttccacccctacactatcataaacttcctgctgataaccctggcagcactggcgatatactggctcataagcccctcccgagggcccgtcagggggatagaggagttcgaccccgacgccctcaaggaagaggctgcgcccgctggtgagaagcccaggatcgagaccctggcggacaggcttgagaactccaggacactggccatactcaccgtcatactgggtttcacggcggttgcaatagagctgtatacacggggcataagcagggcgctcaacctcaacaccatgaacttcatcttcctaatgacaggactcctgctctacgccaaccccatgagctacgcaagggccttctacaggagcgtctcatcggccgcgggcgtcatactacagttccacttctacgccggcatcttcggcctcctaaacacgcccttcgagcctctcggcaagagctcggcccagatcatcgcagaaggcctggccgacgtttcaacacccttcatatggccggtagtggccttcctaaccgcgggcatagtgaacctcttcataccaagcgggggcggcgagtgggctgcgataggagaaatactagtcagggccggccacgagctgggagtgccgataggtaaaaccataatagcctacggcttcggcgactcgtggacaaacttactccagcccttctgggcaatacccctcctagacataactaggacgagggctagggatgtattcggctacaccatagcactcatgatactcatagctccagtggctgcggtaaccctgaccctgataccgtactga

SEQ ID NO: 20866 - protein, 484 aa, Aeropyrum pernix K1
MGSLGDESRRPFLEAFGEALERRVRGVMPDPFIFAILLTFIAIVLDLILLRPIQHVGLGGTVKFLVYSAWYGGFWKLLTFSMQMTLILVTGYVIAYHPLVYRVLSRIAGLPRDTKQAAVLAAAVAIALSYLSWGLSLIGGAILAREIGRQAAFRGRKIHYPVVVVAAYSGLGLTWHWGLTASAPLLMNTPGHFLANVVKELYGVETIPLSQTIFHPYTIINFLLITLAALAIYWLISPSRGPVRGIEEFDPDALKEEAAPAGEKPRIETLADRLENSRTLAILTVILGFTAVAIELYTRGISRALNLNTMNFIFLMTGLLLYANPMSYARAFYRSVSSAAGVILQFHFYAGIFGLLNTPFEPLGKSSAQIIAEGLADVSTPFIWPVVAFLTAGIVNLFIPSGGGEWAAIGEILVRAGHELGVPIGKTIIAYGFGDSWTNLLQPFWAIPLLDITRTRARDVFGYTIALMILIAPVAAVTLTLIPY

SEQ ID NO: 20867 - DNA, 1365 bp, Helicobacter pylori J99
  CDS (1)..(1365): transl_table=11
atgtttttattaaggcatttgacttcagcgtgcgtgtttttagcgtctaaatgtttgccggactcctttgtcttggtcgctcttttatcgtttgtcgtgttcgttcttgtttattgtttgacagggcaagacgcttcgtctgtcatttctagttgggggaatggtgcttggacgcttttaggtttttctatgcaaatggctcttattttggtattgggtcaggctctagctagcgctaaattagtccaaaaacttttaaaatacttggcgtctttgcctaaggggtattacaccgctttatggttggttacttttttatcgttaatcgctaattggatcaactggggttttggcttggtgattagcgcgatttttgcaaaagagatcgccaaaaatgttaagggggtggattataggttgctcattgctagcgcttattcgggttttgtgatctggcatgggggtttatcaggctctatccctttaagcgttgccacccaaaatgaaaatctatccaaaataagcgctggggtgattgaaaaagctatccctatcagtcagacgattttttcttcttataatttgatcattatagggatcattcttatagggttaccctttttaatggcaatgatccaccctaaaaaagaagaaatcgttgaaattgattcaaagcttttaaaagacgaatacaaagaaacagaactcattagccaccaacaagataaaacgatcgcgcattttttggaaaacagcgctttgctttcttatcttttggtttttttgggttttgggtatcttggtatttatttttttaaagggggagggattagtttaaacattgtcaatacgattttcctttttttagggattttgctccataaaacccctttagcttatgtgaaagcgatcaatcattccgctaggagcgtggctgggattttactccaattccctttttacgctgggattatggggatgatggcaagccatagcgtgggggggcattctttagcgcaaatgctctctttagccttcacgcacatcgctaatgaaaaaactttcgcgctcatgacttttttgagcgcggggattgtcaatatttttattccatcaggcggagggcaatgggcgattcaagctcctatcatgctccctgctgggcaaagcttgggggtggatccgggcgtgatttctatggctatcgcttggggagacgcttggacgaacatgatacagcctttttgggctttgcccgcattagccattgcgggtttgggcgctaaggatattatgggctattgcgttttgactttaatttttgtaggcttagtggtgtgcggggtgttttattttttggtgtga

SEQ ID NO: 20868 - protein, 454 aa, Helicobacter pylori J99
MFLLRHLTSACVFLASKCLPDSFVLVALLSFVVFVLVYCLTGQDASSVISSWGNGAWTLLGFSMQMALILVLGQALASAKLVQKLLKYLASLPKGYYTALWLVTFLSLIANWINWGFGLVISAIFAKEIAKNVKGVDYRLLIASAYSGFVIWHGGLSGSIPLSVATQNENLSKISAGVIEKAIPISQTIFSSYNLIIIGIILIGLPFLMAMIHPKKEEIVEIDSKLLKDEYKETELISHQQDKTIAHFLENSALLSYLLVFLGFGYLGIYFFKGGGISLNIVNTIFLFLGILLHKTPLAYVKAINHSARSVAGILLQFPFYAGIMGMMASHSVGGHSLAQMLSLAFTHIANEKTFALMTFLSAGIVNIFIPSGGGQWAIQAPIMLPAGQSLGVDPGVISMAIAWGDAWTNMIQPFWALPALAIAGLGAKDIMGYCVLTLIFVGLVVCGVFYFLV

SEQ ID NO: 20869 - DNA, 1326 bp, Bacillus halodurans C-125
  CDS (1)..(1326): transl_table=11
ttgaagtatatgatttcattgtcaaatcgattgatgcagcgctatttaccggacccttttctctttgttgttcttctcacgtttctcgtatttgctctatccttgatcttcacggagagtacacctcttacaattgttcaatactggggagaaggcttttgggggctgctgtcgttttccatgcagatggttcttgtgcttgtaacaggacatgtgctagcaagcagtcctttgtttaaaaaggggctcggtgcgctagctgggcttccagcttctccagggcaggcgattttattagtaaccgtcgtttctttagtcgctagttttattaattgggggtttggtttagtcataggtgccttgtttgcaaaagagttagcgaaaaaagtagacaacgttgattatcggttgttgatcgcgagcgcctacagtgggtttatgatttggcatggcggattatcaggctccgtgcctttgacgattgctacaccagatcacttcgcccaagatatgattggagtcattccgacaagtgagacgatttttgcgccgtataacttggcgattgtttttgcactatttattgcgattccccttgccaatcgcttaatgatgccgggaaaatcagatacggtgacggtggatcgctccttgttggacgatggacgggatctgcaagcggcttcccttgaattagaggcgatgacaccttcagaccgccttgagaatagtcggatgatctccctgttggttggtgtgctcggacttgtttttttaggttattactttgcaaccaatggatttgagttaaaccttgatatcgtcaactccttgtttctcttcctcgggattttatttcacggcacgccaaaattgtttttgaaagcggtaacaagtgcggtgaaaggggcgagtggcattatcattcaatttcctttttacgcggggttaatggggatcatggtttcctctgggctggctaccgtgatgtccgaagcctttgtgtcgttttcaaacgaagtgaccttcccgctgttcgtttttctcagtgcgggcattgttaatgtgtttgttccttccggtggcggccagtgggcggtgcaagcgcccgttgtgctagaagctgcgcaaagcttaggagttcctgcggctaaggcagcgatggccgttgcgtggggagatgcgtggacgaatatgattcaaccgttttgggcgcttcccgctcttgcgattgctggtttgaaagcgaaagacattatgggcttttgcgtgatgattttagttgtgagcggcgtagtgatatcgctcggatttttgcttatgtaa

SEQ ID NO: 20870 - protein, 441 aa, Bacillus halodurans C-125
MKYMISLSNRLMQRYLPDPFLFVVLLTFLVFALSLIFTESTPLTIVQYWGEGFWGLLSFSMQMVLVLVTGHVLASSPLFKKGLGALAGLPASPGQAILLVTVVSLVASFINWGFGLVIGALFAKELAKKVDNVDYRLLIASAYSGFMIWHGGLSGSVPLTIATPDHFAQDMIGVIPTSETIFAPYNLAIVFALFIAIPLANRLMMPGKSDTVTVDRSLLDDGRDLQAASLELEAMTPSDRLENSRMISLLVGVLGLVFLGYYFATNGFELNLDIVNSLFLFLGILFHGTPKLFLKAVTSAVKGASGIIIQFPFYAGLMGIMVSSGLATVMSEAFVSFSNEVTFPLFVFLSAGIVNVFVPSGGGQWAVQAPVVLEAAQSLGVPAAKAAMAVAWGDAWTNMIQPFWALPALAIAGLKAKDIMGFCVMILVVSGVVISLGFLLM

SEQ ID NO: 20871 - DNA, 1425 bp, Pseudomonas aeruginosa PAO1
  CDS (1)..(1425): transl_table=11
atgaccgctatccttcccatccaagaaagccgctccgcgcgcttcgccatgcgttgctcgaactgggccgagcgctggtttcccgactcctgggtgttcgccgccctggccatcctcatcgtcagcctggccgcgctggccatgggcgccggaccgaccgccacggcgaaagccttcggcgacggtttctggagcctgatcccgttcaccatgcagatggccttcgtggtcatcggcggctatgtggtggccagttcaggccccgcctcgcgtctcatcgacctgctcgcgcgggtgccgaagaatggccgctcggcggtctgctgggtggcgctggtgtcgatgctcgcctcgctgctcaactggggcctcagcctggtcttcggcggcctgctggtacgcgccctggcgcgccgcagcgacctgcgcatggactatcgcgccgccggcgccgcggcctacctcgggctgggcgcggtgtgggcgctgggcctgtcgtcgtcggccgcgcagttgcaggccaacccggccagcctgccaccgtcgatcctggcgatcaccggggtgatcccgttcaccgagaccatcttcctctggcagtccggggtcatgctgctggcgctgatcctggtctcgctggtgatcgcctacatgaccgcgccgagcgccgccagcgcccgcgacgccaaggattgcggggtcgacgtgagcttcaccgctccggccaggctggcgccgacccggcccggcgagtggctggagcacagcccgttgctgatcatcctgctggtactgctggccggcggctggctggtacacgagttctcgaccaagccggcgatcctggcgatctccgggttgaacacctataacctgctgttcctgatgctcggcgcgttgctgcactggcgcccgcgcagcttcctcgacgcggtggcgcgcgcggtgccgaccaccaccggggtgctgatccagttcccgctgtacggctcgatcgcggcgatcatgaccacggtcaacggcagcgacggcgagaccctggcccaccatatctcgaccttcttcgtacagatcgcctcccacgacacctacgcgctgctgatgggcgtgtactcggcggtgctgggcttcttcattccctccggcggcggcaagtggatcatcgaggcgccgtacgtgatgcaggtggccaacgagctgcaataccacctcggctgggcggtgcagatctacaacgccgccgaggcgctgccgaacctgatcaacccgttctacatgctgccgttgctcggcgtgctggggctgaaggcgcgcgacctgatcggcttctcgttcgtccagttgctggtgcacatcccgctggtgctggtgctgctctgggccctgggcagcaccctggcgtacatcccgccggtgatgccgtag

SEQ ID NO: 20872 - protein, 474 aa, Pseudomonas aeruginosa PAO1
MTAILPIQESRSARFAMRCSNWAERWFPDSWVFAALAILIVSLAALAMGAGPTATAKAFGDGFWSLIPFTMQMAFVVIGGYVVASSGPASRLIDLLARVPKNGRSAVCWVALVSMLASLLNWGLSLVFGGLLVRALARRSDLRMDYRAAGAAAYLGLGAVWALGLSSSAAQLQANPASLPPSILAITGVIPFTETIFLWQSGVMLLALILVSLVIAYMTAPSAASARDAKDCGVDVSFTAPARLAPTRPGEWLEHSPLLIILLVLLAGGWLVHEFSTKPAILAISGLNTYNLLFLMLGALLHWRPRSFLDAVARAVPTTTGVLIQFPLYGSIAAIMTTVNGSDGETLAHHISTFFVQIASHDTYALLMGVYSAVLGFFIPSGGGKWIIEAPYVMQVANELQYHLGWAVQIYNAAEALPNLINPFYMLPLLGVLGLKARDLIGFSFVQLLVHIPLVLVLLWALGSTLAYIPPVMP

SEQ ID NO: 20873 - DNA, 1377 bp, Fusobacterium nucleatum subsp. nucleatum ATCC 25586
  CDS (1)..(1377): transl_table=11
atggaaagtgtaaaagaaagaaaaggaatctttaagagatttacttcaatgtgtgtgcgtgttatggaaagatggcttccagatccatttatattttgtgctttgttaacttttatagtgtttataggagctatatttcttacaaaagcaactcctttacaagtagttggattttgggctgatggtttttggtctttactttctttctcaatgcaaatggcattagttttggttacagggcatactttggcaagttccagattatttaaaaagatgttgtcaacatttgcttctggaataaaaggaccaaaacaagcaatacttattgtatcaatagtttcaggaatagcttgtgcattaaactggggttttggacttgttataggagctttatttgcaaaagaaattgcaaaaaaagtgaaaggagtagattatagacttcttatagcttcagcttacacaggattcttagtatggcatggtggattatcaggttctattccattacaacttgcaagtggaggagaaggattagcaaaacaaacagcaggagtagtaacagaagctataccaacaagtcaaactttattttcaccaatgaatatttttataattgttggacttttaataatagtacctttgttgaatatggcaatgttcccaagtaaagatgaaattgttgaagttgatccaaaattattagtggaaccagaagaagttgttatggatacttcaaaaatgacaccagcagaaagagttgaaaatagtagtgcagtatctattttactttcaattatgggctttgtatacataggatattatttaaagacaaaaggatttgcattaaatcttaatttagtaaactttatattcttattcttaggaattttattacatggaactccaagaagatatttgaatgcactagcagaagcaacaaaaggtgcaggaggaatattactacaatttccattttatgcaggtatcatgggaataatggtaggagcagatgcagatggaatgtctcttgcaaaacttatgtctaatttctttgtaagtatatctactgaaaaaacattcccagtattttcatttataagtgctggagtagtaaatttctttgttccatcaggtggaggacaatgggcagttcaagctccaatagtaatgccagcaggacaagcaattggtgtatcagcagcaaagtcagctatggcaatagcttggggagatgcttggacaaatatgatacaaccattctgggctttaccagcattaggaatagcaggtttgggagctaaagatataatgggttattgtctgatagtaactgttgtatcaggaatatttatttgtacaggtttcttattattctaa

SEQ ID NO: 20874 - protein, 458 aa, Fusobacterium nucleatum subsp. nucleatum ATCC 25586
MESVKERKGIFKRFTSMCVRVMERWLPDPFIFCALLTFIVFIGAIFLTKATPLQVVGFWADGFWSLLSFSMQMALVLVTGHTLASSRLFKKMLSTFASGIKGPKQAILIVSIVSGIACALNWGFGLVIGALFAKEIAKKVKGVDYRLLIASAYTGFLVWHGGLSGSIPLQLASGGEGLAKQTAGVVTEAIPTSQTLFSPMNIFIIVGLLIIVPLLNMAMFPSKDEIVEVDPKLLVEPEEVVMDTSKMTPAERVENSSAVSILLSIMGFVYIGYYLKTKGFALNLNLVNFIFLFLGILLHGTPRRYLNALAEATKGAGGILLQFPFYAGIMGIMVGADADGMSLAKLMSNFFVSISTEKTFPVFSFISAGVVNFFVPSGGGQWAVQAPIVMPAGQAIGVSAAKSAMAIAWGDAWTNMIQPFWALPALGIAGLGAKDIMGYCLIVTVVSGIFICTGFLLF

SEQ ID NO: 20875 - DNA, 1407 bp, Streptococcus pyogenes MGAS8232
  CDS (1)..(1407): transl_table=11
atgaataacatcaaaaccaaaaaaaggtttatggatcgctatattgatggctttatgaaatggatgccagaatcgctttttatctgttttattttaacctttttagtcgttactatgtctgtgttgatgacggatagtccctttattggtacggaaaagacgggcgggattatctatggctgggtaaatggtttttgggggctgttgtcctttgccatgcagatgactattttacttgcgacagggaatgctgtagcgagttctccacctgctcataagatgtttaagttccttgccaaactgcctcaaaccaggactcagatttttattttttctattgtagtaggctctatctttggctttttacactggggtcttggtatgatggttgccattgtgtttgggaaagagttgcttgttcaggctaggcaaaaagggattaaggtgcatacacctttgtttgttgctactttattttttacctttttaccagctacttctggtttatcaggtgctgcggtgctttattcggccactccagattatttgcgaaatagtgtcgcagatgcttataaacaggttgttcctgaaagtgttcctctgacagaatcagttttgaatcttccatttatcagtcttttagtggtgtgtatgctggtaccgttttgctttgctttattggcgcatccaaaagatgaaactaaaatcatggaacttgatgatgagatctatcaccatagtcttgataccgcttcacatgttgttattgcaagaaacacacctgctgaaaagatgaacgcatctcgtttagtgatgtatcttgttggtggggccattgttagctatagcctttatcatttttcggtggtgggcttgtctggtctagatctcaatagttttaactttttatttttaggcttagggttgcttctttgtggtcaacaaggaccagaatattatggttccttattcaaagatggggtcatgtcatcttggggcttggtgcttcagtttccattttacgctggtatttttggaatcattcaaagtacaggtctaggactagagatttcccatttctttgtcgctatttcaaatgggacaacatggccggtttttgcttatctttactcggctttgctgaatattgcggtaccatcaggaggctcaaaatttgtgattgaagctccctatatcgtccctgcaactatcgaagttggtaatgacctaggtaagattttgcaggcttatcaattaggagatgccacaacaaacttgatagttcctttttgggccttatcttacctctcaaacttcaaactaaaattcaatcagattgtggcttatactattccttgtgtcttggtggtcacaggtattgccatcatttacctatttgtattttag

SEQ ID NO: 20876 - protein, 468 aa, Streptococcus pyogenes MGAS8232
MNNIKTKKRFMDRYIDGFMKWMPESLFICFILTFLVVTMSVLMTDSPFIGTEKTGGIIYGWVNGFWGLLSFAMQMTILLATGNAVASSPPAHKMFKFLAKLPQTRTQIFIFSIVVGSIFGFLHWGLGMMVAIVFGKELLVQARQKGIKVHTPLFVATLFFTFLPATSGLSGAAVLYSATPDYLRNSVADAYKQVVPESVPLTESVLNLPFISLLVVCMLVPFCFALLAHPKDETKIMELDDEIYHHSLDTASHVVIARNTPAEKMNASRLVMYLVGGAIVSYSLYHFSVVGLSGLDLNSFNFLFLGLGLLLCGQQGPEYYGSLFKDGVMSSWGLVLQFPFYAGIFGIIQSTGLGLEISHFFVAISNGTTWPVFAYLYSALLNIAVPSGGSKFVIEAPYIVPATIEVGNDLGKILQAYQLGDATTNLIVPFWALSYLSNFKLKFNQIVAYTIPCVLVVTGIAIIYLFVF

SEQ ID NO: 20877 - DNA, 1326 bp, Oceanobacillus iheyensis HTE831
  CDS (1)..(1326): transl_table=11
ttgaaaacggtaacttctttttttgacagaatggttcaacggtatctgccagatgcttttttattcgccatcatcttaaccattatcgtattttttattgggttgttatttcctgataacggaccacttgaaatggttcaattttggggtaatggattttggggattattagaatttgcaatgcagatgtcacttgtcgtaattactggatacatcctagcaagcaccaatgtggtcaaaagatttttatctaggctgagtaaactagcaaacacacctgctcaagcaattattttagttacttttattgcattaatcgcatgttttatcaattatggttttggactcgtagtaggggctttatttgccactcatgttgcaaaacaagttccttccgttgattatcggttattaatcgccagcgcttatagtggttttctaatttggcatggtggattttccggatctgtaccattaactatcgctacagctggtcattttctggaaggacaagtaggtatcattcctattacagaaacattatttagtccttataatttgtttattgttatcactttattagtggcactaccattatttaatcgctaccttttaaatggaattgcagataataatacttactttgcagaaaaaattcaacaaacagagcaaaaaccaaatgttgatgctaatagtataccaacaacacctgctgaaaaattagaaaatagcccaatcgtctcgatgataattggaattttaggcttaagttttatcgtgtattattttgtaactaacggatttaatttaaatattaatattgttaattttatatttttgtttctgggaataattttacaccggacaccgagacaatttcttgataatgtcagtcaaggagttaaaaatgctggcgcgatcattatccaatttccattttatgccggaattatgggaatgatggttgattcaggtatttcagaggcattgtctttgtggtttgtaaatatttctactgagtatacactcccatttctatcttttattagtgcgggtatcgtaaatttcttcattccatctggtggtggtcagtgggcaatacagggtccaattatgattgaatctgcacttgaattaggggcagacacagctaaaacagccatggggattgcatggggagatgcatggacaaatatgattcagcctttttgggcacttccagcacttgctattgcaggcttaaaagtgagagatattatgggattctgtgtcatgattttaatatttagctttatccccatatcaattggactgttattcttttaa

SEQ ID NO: 20878 - protein, 441 aa, Oceanobacillus iheyensis HTE831
MKTVTSFFDRMVQRYLPDAFLFAIILTIIVFFIGLLFPDNGPLEMVQFWGNGFWGLLEFAMQMSLVVITGYILASTNVVKRFLSRLSKLANTPAQAIILVTFIALIACFINYGFGLVVGALFATHVAKQVPSVDYRLLIASAYSGFLIWHGGFSGSVPLTIATAGHFLEGQVGIIPITETLFSPYNLFIVITLLVALPLFNRYLLNGIADNNTYFAEKIQQTEQKPNVDANSIPTTPAEKLENSPIVSMIIGILGLSFIVYYFVTNGFNLNINIVNFIFLFLGIILHRTPRQFLDNVSQGVKNAGAIIIQFPFYAGIMGMMVDSGISEALSLWFVNISTEYTLPFLSFISAGIVNFFIPSGGGQWAIQGPIMIESALELGADTAKTAMGIAWGDAWTNMIQPFWALPALAIAGLKVRDIMGFCVMILIFSFIPISIGLLFF

SEQ ID NO: 20879 - DNA, 1332 bp, Shewanella oneidensis MR-1
  CDS (1)..(1332): transl_table=11
atgttaaccaaagcagcaaaacctctggtcaagctggtcgaccgttatttacccgatccctatatctttgtcttactcctcacgttagtcgtgatgatctcggccgtggtggccgagcaaaaaacacccctggacgtcatcagctactggggcgatggtttttgggcactgctgagtttttcaatgcagatgctattagtgctggtggcgggatttatgctcgccagctcgccaccgattaaaaaattgcttgatgcgattgctggattcgctaagtctgcgccgcaggcgattatcttagtgacgttggtttctctggctgccagttggattaactggggctttggtttggtggtcggcgcgttatttgccaaagcgttagcccgcaagttacgagtggactaccgtttgttggttgccagtgcgtactcgggttttgtggtttggcacggtggcttggcgggttcgattccgttaaccattgccactgctgggcactttgcagaagcacagattggcattattcctaccagtgataccatttttgccagttttaacttgctgttagtgttgattttatttgtggtgatgccgctggtaaaccgctttatgttgccagaagacaaagacagcatctatatcgaccctaaggcgcttgaagatgtgagcagtgaagagagcaacacagggcatgcgccaaacgcgatgatgcgtcccgcggataaattagaaaacagccgtttactgggctggagtgtaggcggcgcagggctggtgtacttaggttattattttgcggtgcaaggcggcagcttaaaccttaatttagttaactttttgtttttgttcctcgcgattgtgctgcatcaaacgccacgcagtttactgcttagccttaacgaagcgattaaaggcggcgcgggtattgtgattcagtttcctttctacgctggcattatggcggtgatgatgcaatcgggattagcccaaagcatctccgaaggattcgtggccattgccagcgctgaaagcctgccattttggagttttatcagcgcaggcatcgtgaatatttttgtgccttcgggcggcggacaatgggcggtgcaggccccgattatgttgcctgctgccgaagccttgggcgccgatgtggcacgtgttgccatggctgtagcatggggtgatgcgtggacgaatcttattcagcctttctgggcactgcctgtgctggccattgccggattaaaggcgcgggatattatgggattttgtttaatgcagttgattatcacaggtgtgattatcagtatcgcgttgagctggttttaa

SEQ ID NO: 20880 - protein, 443 aa, Shewanella oneidensis MR-1
MLTKAAKPLVKLVDRYLPDPYIFVLLLTLVVMISAVVAEQKTPLDVISYWGDGFWALLSFSMQMLLVLVAGFMLASSPPIKKLLDAIAGFAKSAPQAIILVTLVSLAASWINWGFGLVVGALFAKALARKLRVDYRLLVASAYSGFVVWHGGLAGSIPLTIATAGHFAEAQIGIIPTSDTIFASFNLLLVLILFVVMPLVNRFMLPEDKDSIYIDPKALEDVSSEESNTGHAPNAMMRPADKLENSRLLGWSVGGAGLVYLGYYFAVQGGSLNLNLVNFLFLFLAIVLHQTPRSLLLSLNEAIKGGAGIVIQFPFYAGIMAVMMQSGLAQSISEGFVAIASAESLPFWSFISAGIVNIFVPSGGGQWAVQAPIMLPAAEALGADVARVAMAVAWGDAWTNLIQPFWALPVLAIAGLKARDIMGFCLMQLIITGVIISIALSWF

SEQ ID NO: 20881 - DNA, 1419 bp, Pseudomonas putida KT2440
  CDS (1)..(1419): transl_table=11
gtggccgctgaaattcaagacagccgctccgcgcgctttgccttgcgctgctccaactgggctgaacgctggttccccgactcctgggtgttcgccgcgctggcggtgctgctggtgtgtatcggcgcactggccatgggcgccaaaccgaccgacaccgccaaggcgtttggcgacggcttctggagcctgataccgttcaccatgcagatggcattcgtggtcatcggcggttatgtggtggccagctcgccgcccgccgcgaggctgatcgatcgtttggcgcgcatccccggcaatgggcgctcggcagtgtgctgggtagcactgatctcgatgctggcctccttgctcaactgggggctgtcgctggtgtttggaggtttgctggtgcgcgccctggcaaggcgcaccgacctgaagatggattaccgcgcagcgggtgcggccgcttacctgggcctgggtgcggtgtgggcgttgggcctgtcatcctcggcggcgcagctgcaggccaacccggccagcctgccaccttcaatcctgtcgataaccggggtgatcccctttaccgaaaccatctttctctggcagtccggcgtgatgctggcggcgctggtggtggtctcgctggtgatcgcctacgccaccgctccgggcccgaacagcgcccgtagcgcagaagactgcggtgtcgaccccagcttcacagcgccacccgcgccgcaacgcacgcgcccgggagagtggctggaacacagcccgatccttatcctgctgttggtggccttggctgctggctggctgtatcaggagtttgcgacgaaacctgcgattaccgccatctcggggctcaacacctacaacctgttgttcatcatgctcggtgctttgctgcactggcgcccacgcagcttccttgacgcggtggcgcgtgcggtaccgaccaccaccggtgtgctgatccagttcccgctgtatggttcgatcgccgccatcctcacccaggtgaagggcgtcgatgaacagaccctggcccaccatatttcactgttcttcacccagattgccacccatgacacgtatgccgtgctgatgggcgtgtattcggctgtgctgggcttcttcatcccttcgggcggcggcaagtggatcatcgaggccccttacgtgatgctggtggccaacgacctgcagtaccacctggggtgggccgtgcagatctacaacgcggccgaagccttgccgaacctgatcaacccgttctacatgctgccgttgctgggcgtgctggggctcaaggcgcgcgacctgatcggtttctcgttcgtgcaattgctggtgcatgtgccgttggtgctggtgttgctgtgggcgctgggtacaacgctgcagtacgtgccgccagtgatgccttga

SEQ ID NO: 20882 - protein, 472 aa, Pseudomonas putida KT2440
MAAEIQDSRSARFALRCSNWAERWFPDSWVFAALAVLLVCIGALAMGAKPTDTAKAFGDGFWSLIPFTMQMAFVVIGGYVVASSPPAARLIDRLARIPGNGRSAVCWVALISMLASLLNWGLSLVFGGLLVRALARRTDLKMDYRAAGAAAYLGLGAVWALGLSSSAAQLQANPASLPPSILSITGVIPFTETIFLWQSGVMLAALVVVSLVIAYATAPGPNSARSAEDCGVDPSFTAPPAPQRTRPGEWLEHSPILILLLVALAAGWLYQEFATKPAITAISGLNTYNLLFIMLGALLHWRPRSFLDAVARAVPTTTGVLIQFPLYGSIAAILTQVKGVDEQTLAHHISLFFTQIATHDTYAVLMGVYSAVLGFFIPSGGGKWIIEAPYVMLVANDLQYHLGWAVQIYNAAEALPNLINPFYMLPLLGVLGLKARDLIGFSFVQLLVHVPLVLVLLWALGTTLQYVPPVMP

SEQ ID NO: 20883 - DNA, 1419 bp, Pseudomonas syringae pv. tomato str. DC3000
  CDS (1)..(1419): transl_table=11
atggccgccaacatcgaagaaagccgctccgcccgatttgccttgcggtgtgccgcctgggctgagcgctggtttccggattcgtgggtattcgccgcactagcggtggtcatcgtcacgctggcgacgctcgccatcggtgcgcgtccgaccgacgccgccaaggccttcggagacggtttctggagcctgattccgttcaccatgcagatggccttcgtggtcatcggtggttacgtggtcgccagctcaccgcccgcagtacgcctgatcgaccgtctggcacgggtgccgcgcaacggccgctcggcggtggcctgggtggcgctgatttccatgctggcctcgctgctcaactgggggctgtcactggtgttcggcggtttgctggtgcgtgcgctcgcccgccgcaccgacctgcgtatggactaccgcgcagccggtgccgccgcctatctggggcttggcgcggtatgggcgctggggctgtcatcgtccgctgcacagttgcaggccaacccggccagcctgccgccatcgattctggcgatcaccggtgtaattccgttcactgaaaccatctttctctggcagtccggagtcatgctcgcagcgctgctcgtcatctcgctgatcgtcgcctatgccacggcgcccggccccaacagcgcccgcgacgccaaggcctgcggcatcgacccggcgttcaatctgccgccgctgcccgccagaacccggccaggcgaatggctggaatacagcccgctgctgattatcctgatggttgtgctgggggttggctggctgttcaacgagttttccaacaagcctgcaatcactgcgatatcggggctcaatacctacaactttctgttcatcatgctcggtgcgctattgcactggcggccgcgcagttttctcgatgccgtggcgcgggccgtgccgaccaccaccggcgtgctgattcagtttccgctgtacggctcgatcgccgccttgctgacaacggtcaagggcgctgatgcccagaccctggcgcattacatttcgacgttcttcaccagcattgcttcccacgacacctacgcgattctgatgggcgtctattcggcgattctggggttcttcattccctcgggtggcggcaagtggatcatcgaagccccttacgtgatgcaggtggccaatgatctgcagtatcacctcggctgggcagtgcagatctacaacgcagccgaagccttgcccaacctgatcaacccgttctacatgctgccgctactgggcgtgctgggcctgaaggcgcgggacctgatcggcttttcgttcgtgcagttgcttgtccatgcgccgctggtgctgtttctgctttgggcgctgggcaccaccctgacgtatacgccgccgatcatgccctga

SEQ ID NO: 20884 - protein, 472 aa, Pseudomonas syringae pv. tomato str. DC3000
MAANIEESRSARFALRCAAWAERWFPDSWVFAALAVVIVTLATLAIGARPTDAAKAFGDGFWSLIPFTMQMAFVVIGGYVVASSPPAVRLIDRLARVPRNGRSAVAWVALISMLASLLNWGLSLVFGGLLVRALARRTDLRMDYRAAGAAAYLGLGAVWALGLSSSAAQLQANPASLPPSILAITGVIPFTETIFLWQSGVMLAALLVISLIVAYATAPGPNSARDAKACGIDPAFNLPPLPARTRPGEWLEYSPLLIILMVVLGVGWLFNEFSNKPAITAISGLNTYNFLFIMLGALLHWRPRSFLDAVARAVPTTTGVLIQFPLYGSIAALLTTVKGADAQTLAHYISTFFTSIASHDTYAILMGVYSAILGFFIPSGGGKWIIEAPYVMQVANDLQYHLGWAVQIYNAAEALPNLINPFYMLPLLGVLGLKARDLIGFSFVQLLVHAPLVLFLLWALGTTLTYTPPIMP

SEQ ID NO: 20885 - DNA, 1407 bp, Streptococcus pyogenes SSI-1
  CDS (1)..(1407): transl_table=11
atgaataacatcaaaaccaaaaaaaggtttatggatcgctatattgatggctttatgaaatggatgccagaatcgctttttatctgttttattttaacctttttagtcgttactatgtctgtgttgatgacggatagtccctttattggtacggaaaagacgggcgggattatctatggctgggtaaatggtttttgggggctgttgtcctttgccatgcagatgactattttacttgcgacagggaatgctgtagcgagttctccacctgctcataaaatgtttaagtcccttgccaaactgcctcaaacaaggactcagatttttattttttctattgtagtaggctctatctttggctttttacactggggtcttggtatgatggttgccattgtgtttgggaaagagttgcttgttcaggctaggcaaaaagggattaaggtgcatacacctttgtttgttgctactttattttttacctttttaccagctacttctggtttatctggtgctgcggtgctttattcggctactccagattatttgcgaaatagtgtcgcagatgcttataaacaggttgttcctgaaagtgttcctctgacagaatcagttttgaatcttccatttatcagtcttttagtggtgtgtatgctggtaccgctttgctttgctttattggcgcacccaaaagatgaaactaaaatcatggaacttgatgatgagatctatcaccatagtcttgataccgcttcacatgttgttattgcaagaaacacacctgctgaaaagatgaacgcatctcgcttagtgatgtatcttgttggtggggccattgttagctatagcctttatcatttttcggtggtgggcttgtctggtctagatctcaatagttttaactttttatttttaggcttagggttgcttctttgtggtcaacaaggaccagaatattatggttccttattcaaagatggggtcatgtcatcttggggcttggtgcttcagtttccattttacgctggtatttttggaatcattcaaagtacaggtctaggactagagatttcccatttctttgtcgctatttcaaatgggacaacatggccggtctttgcttatctttactcggctttgctgaatattgcggtaccatcaggaggctcaaaatttgtgattgaagctccctatatcgtccctgcaactatcgaagttggtaatgacttaggtaagattttgcaggcttatcaattaggagatgccacaacaaacttgatagttcctttttgggccttatcttacctctcaaacttcaaactaaaattcaatcaaattgtggcttatactattccttgtgtcttggtggtcacaggtattgccatcatttacctatttgtattttag

SEQ ID NO: 20886 - protein, 468 aa, Streptococcus pyogenes SSI-1
MNNIKTKKRFMDRYIDGFMKWMPESLFICFILTFLVVTMSVLMTDSPFIGTEKTGGIIYGWVNGFWGLLSFAMQMTILLATGNAVASSPPAHKMFKSLAKLPQTRTQIFIFSIVVGSIFGFLHWGLGMMVAIVFGKELLVQARQKGIKVHTPLFVATLFFTFLPATSGLSGAAVLYSATPDYLRNSVADAYKQVVPESVPLTESVLNLPFISLLVVCMLVPLCFALLAHPKDETKIMELDDEIYHHSLDTASHVVIARNTPAEKMNASRLVMYLVGGAIVSYSLYHFSVVGLSGLDLNSFNFLFLGLGLLLCGQQGPEYYGSLFKDGVMSSWGLVLQFPFYAGIFGIIQSTGLGLEISHFFVAISNGTTWPVFAYLYSALLNIAVPSGGSKFVIEAPYIVPATIEVGNDLGKILQAYQLGDATTNLIVPFWALSYLSNFKLKFNQIVAYTIPCVLVVTGIAIIYLFVF

SEQ ID NO: 20887 - DNA, 1350 bp, Bordetella pertussis Tohama I
  CDS (1)..(1350): transl_table=11
atgaataaactcacgtcctttttcacggagctgatgcgcaagtatctgcccgatccattcgttttcgcgatcgcgctgaccctgttgaccgtgctgatggctttcggcatcgaaggccagccgctggaccagatcacccgtgaatggggcaagggattctggagcctgctggccttcaccacccagatggccgtcatcctggccatgggctatgtgctggccaccgcgccgctgaccgaccgcctgctcgaccgcatcgtcagccacgtgcaccagccgcgcaccgccatcattgtcgcgaccctggtcggcggcgtcggcagctacctgaactgggggttcggcctggtgatcggcggcgtggtcgccaagaaactggcgctgaaggtcaagggcgtgcactacccgctgatcatcgccgccgcctacagcggcttcacgatgtacggcctgggcctgtcggccagcatcccggtgctggtcaccacgcccggccatccgacggccgaccagatgggcgtgattccgctgtcggaaaccattttctcgctgcccatgctgatcaccagcctggtgatcatcgtcaccttgccgctgctcaacgcctggctgcaccccaagcagggcgaacaggtcgtcgaagtggacccggccatcgaccagagcagcgcgccggccaagaccgccgacgagctgaccgccgaggatacgctggccagccgcctgaacaacagccgcatcctcagcctgctgatcggcctgctgggcatcgcctatgtggtgttctacttcatggacggcaagtcgctggacctgaacctgatcaacttcatcatcctgttcctgggcatcatcctgctgggcacccccgcggcctatgtggccaagctgaacgaaggcatcaagaccatctccggcatcatcctgcagtaccccttctatgcgggcatcatggccatcatggccatcatggccggctccgggctggtggccaccatttccaaggtgttcgtcgacgtcgcctcgccgggcagcctgccgttctggggcctgatcagctcgttcgtcatcaacttcttcgcgccctcggccggcggccactgggtgatccagggcccgttcatgatcgacgccgccaaggagatcggcagcgcgctcaaccagaccaccatggccgtgatgctgggcaacgcctggaacgacctggtgcagccgttctggatcctgcccgccctggcgctgtcgaagctgaaactgcgcgacgtgatgggctataccgtcatcatgatgctgtgggtcggcgtcatccacattgccgcggtgcttgcctggggttacctgacccactga

SEQ ID NO: 20888 - protein, 449 aa, Bordetella pertussis Tohama I
MNKLTSFFTELMRKYLPDPFVFAIALTLLTVLMAFGIEGQPLDQITREWGKGFWSLLAFTTQMAVILAMGYVLATAPLTDRLLDRIVSHVHQPRTAIIVATLVGGVGSYLNWGFGLVIGGVVAKKLALKVKGVHYPLIIAAAYSGFTMYGLGLSASIPVLVTTPGHPTADQMGVIPLSETIFSLPMLITSLVIIVTLPLLNAWLHPKQGEQVVEVDPAIDQSSAPAKTADELTAEDTLASRLNNSRILSLLIGLLGIAYVVFYFMDGKSLDLNLINFIILFLGIILLGTPAAYVAKLNEGIKTISGIILQYPFYAGIMAIMAIMAGSGLVATISKVFVDVASPGSLPFWGLISSFVINFFAPSAGGHWVIQGPFMIDAAKEIGSALNQTTMAVMLGNAWNDLVQPFWILPALALSKLKLRDVMGYTVIMMLWVGVIHIAAVLAWGYLTH

SEQ ID NO: 20889 - DNA, 1464 bp, Bordetella pertussis Tohama I
  CDS (1)..(1464): transl_table=11
atgcccaacaatcatctagccgccgctgcccccgcacagggcaggcaggccatagccagtcccatggaacgcttctcccaggccatggtcgcctgggcggagaaatggtttcccgatgcctacgtcttcgtggtcgtggcgtgcgcggtggtcgcgctcggcgccgtcctgcacggcggcgacccgctggccgtcagcaaggccttcggcgaaggcttctggagcatcatccccttcacgatgcagatggccatggtggccattaccggctacgtgctggccttgtccccgcccgtggcgcggctgctgcgggcgctggcgcacgtgccctcgaccccgcgcggcgccgtggtgttcatcggcaccctgagcatcctgctgtcgctggtcaactggggcctgagcctgattttctcgggcttgctggtgcgcgaaatggcccgtcgcaccgacctgcgtctggattaccgggcagccggcgccgccgggtacctggggctgggctgcgggttcacgctgggcatgagctcgtcggccgcgcagctgcaggccacgccggccagcattccggcgtcgctgatgcccatcaccggcgtgatcggcttctccgaaaccatactgacctggcagaacctggtggtggtgatcctggttaccgtggtttcgggactggtgtgctacttcacggcgcccagcccggagcgctccttgaccgcccaggaccttggcgtggacctgacggaacccgaggcgcaggcggcgcaacgccagcgccccggcgattacctggagttcagcccctggctgaccgtggccgttgtcgggctggcgtcgggatggctgtacctcaccttccgcagcggcaaccccttcatcacgatgtcgcagctgaacacctacaacttcgtgttcctgttgctgggcctgctgctgcactggcggccgcgcagcttcctggagagtttcggccgcgccatgcccagcatcggcggcgtgatgctgcagttcccgttctacggcggcatcggctacgtgctcaccaaggtcgccaacgtgcaggggcatacgttgtcggatgcgatcgcgcactggttcgtcagcctggcgcacgacagcagcgtgttctcgatactggtcagcatctattcggcgttcctcggcttcttcatcccgtcggccggcggcaagtgggtgatcgaggcgccgtacatcatggacgcggccaaccagatccaggcccacctgggctggaccgtcatggtctacaacatcgccgaaacgctgcccaacttcatcaacccgttctggatgctgccgctgctggggatactgcgcctcaaatccaaggacctggtcggctataccgccatgcagttcctggtgcacttccccatcgtcgtggccgccggcgcgatcctgatgcacaccttcagctatgttccgcccgtcatcccgggacagtga

SEQ ID NO: 20890 - protein, 487 aa, Bordetella pertussis Tohama I
MPNNHLAAAAPAQGRQAIASPMERFSQAMVAWAEKWFPDAYVFVVVACAVVALGAVLHGGDPLAVSKAFGEGFWSIIPFTMQMAMVAITGYVLALSPPVARLLRALAHVPSTPRGAVVFIGTLSILLSLVNWGLSLIFSGLLVREMARRTDLRLDYRAAGAAGYLGLGCGFTLGMSSSAAQLQATPASIPASLMPITGVIGFSETILTWQNLVVVILVTVVSGLVCYFTAPSPERSLTAQDLGVDLTEPEAQAAQRQRPGDYLEFSPWLTVAVVGLASGWLYLTFRSGNPFITMSQLNTYNFVFLLLGLLLHWRPRSFLESFGRAMPSIGGVMLQFPFYGGIGYVLTKVANVQGHTLSDAIAHWFVSLAHDSSVFSILVSIYSAFLGFFIPSAGGKWVIEAPYIMDAANQIQAHLGWTVMVYNIAETLPNFINPFWMLPLLGILRLKSKDLVGYTAMQFLVHFPIVVAAGAILMHTFSYVPPVIPGQ

SEQ ID NO: 20891 - DNA, 1434 bp, Bordetella parapertussis 12822
  CDS (1)..(1434): transl_table=11
ttgccgcccgtcttccggggcctgtccccgcggggacaggccccccacaccacgcaaacgcaacgccttaccaagaaatatgtaggaagcaccatgaataaactcacgtcctttttcacggagctgatgcgcaagtatctgcccgatccattcgttttcgcgatcgcgctgaccctgttgaccgtgctgatggctttcggcatcgaaggccagccgctggaccagatcacccgtgaatggggcaagggattctggagcctgctggccttcaccacccagatggccgtcatcctggccatgggctatgtgctggccaccgcgccgctgaccgaccgcctgctcgaccgcatcgtcagccacgtgcaccagccgcgcaacgccatcattgtcgcgaccctggtcggcggcgtcggcagctacctgaactggggtttcggcctggtgatcggcggcgtggtcgccaagaaactggcgctgaaggtcaagggcgtgcactacccgctgatcatcgccgccgcctacagcggcttcacgatgtacggcctgggcctgtcggccagcatcccggtgctggtcgccacgcccggccatccgacggccgaccagatgggcgtgattccgctgtcggaaaccattttctcgctgcccatgctgatcaccagcctggtgatcatcgtcaccctgccgctgctcaacgcctggctgcaccccaagcagggcgaaaaggtcgtcgaagtggacccggccatcgaccagggcagcgcgccggccaaggccgccgacgagctgaccgccgaggatacgctggccagccgcctgaacaacagccgcatcctcagcctgctgatcggcctgctgggcatcgcctatgtggtgttctatttcatggacggcaagtcgctggacctgaacctgatcaacttcatcatcctgttcctgggcatcatcctgctgggcacccccgcggcctatgtggccaagctgaacgaaggcatcaagaccatctccggcatcatcctgcagtaccccttctatgcgggcatcatggccatcatggccggctccgggctggtggccaccatttccaaggtcttcgtcgacgtcgcctcgccgggcagcctgccgttctggggcctgatcagctcgttcgtcatcaacttcttcgcgccctcggccggcggccactgggtgatccagggcccgttcatgatcgacgccgccaaggaaatcggcagcgcgctcaaccagaccaccatggccgtgatgctgggcaacgcctggaacgacctggtgcagccgttctggatcctgcccgccctggcgctgtcgaagctgaaactgcgcgacgtgatgggctataccgtcatcatgatgctgtgggtcggcgtcatccacattgccgcggtgcttgcctggggttacctgacccactga

SEQ ID NO: 20892 - protein, 477 aa, Bordetella parapertussis 12822
MPPVFRGLSPRGQAPHTTQTQRLTKKYVGSTMNKLTSFFTELMRKYLPDPFVFAIALTLLTVLMAFGIEGQPLDQITREWGKGFWSLLAFTTQMAVILAMGYVLATAPLTDRLLDRIVSHVHQPRNAIIVATLVGGVGSYLNWGFGLVIGGVVAKKLALKVKGVHYPLIIAAAYSGFTMYGLGLSASIPVLVATPGHPTADQMGVIPLSETIFSLPMLITSLVIIVTLPLLNAWLHPKQGEKVVEVDPAIDQGSAPAKAADELTAEDTLASRLNNSRILSLLIGLLGIAYVVFYFMDGKSLDLNLINFIILFLGIILLGTPAAYVAKLNEGIKTISGIILQYPFYAGIMAIMAGSGLVATISKVFVDVASPGSLPFWGLISSFVINFFAPSAGGHWVIQGPFMIDAAKEIGSALNQTTMAVMLGNAWNDLVQPFWILPALALSKLKLRDVMGYTVIMMLWVGVIHIAAVLAWGYLTH

SEQ ID NO: 20893 - DNA, 1464 bp, Bordetella parapertussis 12822
  CDS (1)..(1464): transl_table=11
atgcccaacaatcatctaaccgccgctgcccccgcacagggcagagaggccatagccagtcccatggaacgcttctcccaggccatggtcgcctgggcggagaaatggtttcccgatgcctacgtcttcgtggtcgtggcgtgcgcggtggtcgcgcttggcgccatcctgcacggcggcgatccgcttgccgtcagcaaggcgttcggcgaaggcttctggagcatcatccccttgaccatgcagatggccatggtggccatcaccggctacgtgctggccttgtcgccgcccgtggcgcggctgctgcgggcgctggcgcgcgtgccctcgaccccgcgcggcgccgtggtgttcatcggcaccctgagcatcctgctgtcgctggtcaactggggcctgagcctgattttctcgggcctgctggtgcgcgaaatggcccgtcgcaacgatctgcgcctggactaccgcgcggccggcgcggccgggtacctggggctgggctgcgggttcacgctgggcatgagctcgtcggccgcgcagctgcaggccacgccggccagcattccggcctcgctgatgcccatcaccggcgtgatcggcttctccgaaaccatactgacctggcagaacctggtggtagtgatcctggttaccgtggtttcgggactggtgtgctacttcacggcgcccagcccggagcgctccttgaccgcccaggacctgggcgtggacctgaccgaacccgaggcgcaggcggcgcaacgccagcgccccggcgattacctggagttcagcccctggctgaccgtggccgtggtcgggctggcctcggggtggctgtatctcaccttccgcagcggcaacccgttcatcaccatgtcgcagctgaacacctacaacttcgtgttcctgctgctgggcctgctgctgcactggcggccgcgcagcttcctggagagtttcggccgcgccatgcccagcatcggcggcgtgatgctgcagtttccgttctacggcggcatcggctacgtgctgaccaaggtcgccaacgtgcaggggcataccctgtcggacgcgatcgcgcactggttcgtcagcctggcgcacgacagcagcgtgttctcgatactggtcagcatctattcggcattcctcggcttcttcattccgtcggccggcggcaagtgggtgatcgaggcgccgtacatcatggacgcggccaaccagatccaggcccacctgggctggaccgtcatggtctacaacatcgccgaaacgctgcccaacttcatcaacccgttctggatgctgccgctgctggggatactgcgcctcaaatccaaggacctggtcggctataccgccatgcagttcctggtgcacttccccatcgtcgtggccgccggcgcgatcctgatgcacaccttcagctatgtcccgcccgtcatcccgggacagtga

SEQ ID NO: 20894 - protein, 487 aa, Bordetella parapertussis 12822
MPNNHLTAAAPAQGREAIASPMERFSQAMVAWAEKWFPDAYVFVVVACAVVALGAILHGGDPLAVSKAFGEGFWSIIPLTMQMAMVAITGYVLALSPPVARLLRALARVPSTPRGAVVFIGTLSILLSLVNWGLSLIFSGLLVREMARRNDLRLDYRAAGAAGYLGLGCGFTLGMSSSAAQLQATPASIPASLMPITGVIGFSETILTWQNLVVVILVTVVSGLVCYFTAPSPERSLTAQDLGVDLTEPEAQAAQRQRPGDYLEFSPWLTVAVVGLASGWLYLTFRSGNPFITMSQLNTYNFVFLLLGLLLHWRPRSFLESFGRAMPSIGGVMLQFPFYGGIGYVLTKVANVQGHTLSDAIAHWFVSLAHDSSVFSILVSIYSAFLGFFIPSAGGKWVIEAPYIMDAANQIQAHLGWTVMVYNIAETLPNFINPFWMLPLLGILRLKSKDLVGYTAMQFLVHFPIVVAAGAILMHTFSYVPPVIPGQ

SEQ ID NO: 20895 - DNA, 1446 bp, Bordetella parapertussis 12822
  CDS (1)..(1446): transl_table=11
gtgctgtctgtgcgcatccccgggcctgcgcgccaggcctgggctatcgtcgaacaacgaccatggcttgcgcgccgcccgttcattatccatggacctccgtggcgcctggccagccaacaggaggatgatgtgttcaaactgatgtctcgttcagccgtgaaaatggttgagcgctatttgcccgacccttacgtattcgtggtgctgctgacgctggtcgccgccggcgcggccatgatcatcgagggccagacccccatggccgtcgtgcgctggtggggcaacggcttctgggggctgctgactttcgcgatgcagatgctgctggtgctggtcaccggctacatgctggccagcacgccgctggtcaagcggatgctggcgcggctggccagcctggccaccagcgccggcggggcgatcatcctggtcagcgtggtgtcgctggccgccagctggatcaactggggcttcgggctggtggtgggcgcgctgttcgccaagcagatcgcccgccaggtgcgggtcgattaccggctgctggtggccagcgcctattccggcttcatcatctggcacggcggtctggccggctcgattccgctgaccatcgcgaccgaggggcatttctccgccgacaagatcggcatcattcccaccggcgatacgattttcgcggtattcaacctggtgatcgtggtggcgatgttcatcctcgtgccgctggtcaaccggctgatgctgcccgacgagaaggaaagcgtctatgtcgatccggcgcgcctggaagaggcctcggtgccggcctcggacgacgacaagcgtccggccgcgcgcctggagaacagcaggctgctggcctggctgatcgccgcgggcgggctggcctacatgttcgactactacgtcgtgcgcggcgccggcttgaacctcaatgtcatcaacttcagcttcctgatcctggccatcctgctgcacggcacgccgcgccgcctgctgaccagcctggacgaagccatcaagggaggcgcgggcatcgtgatccagttcccgttctatgcgggaatcatggccatcatgatggactcggggctggccgccaccttgtccgagtggttcgtgtcgatcgcctcggccgccacgctgccgttctggaccttcatcagcgccggcatcgtgaacatcttcattccgtcgggcggcgggcaatgggcggtgcaaagccccatcgtgatcagcgcggcgcaggcgctcggcgcggatatgccgagggtggcgatggccgttgcctggggcgacgcctggaccaacatgctccagccgttctgggccttgccggtgctggcgattgccggcctgaaggccaaggacatcatgggctattgcatcatccagctgctggtgaccggcgtcatcatttcggtgggactgagcttcttctag

SEQ ID NO: 20896 - protein, 481 aa, Bordetella parapertussis 12822
MLSVRIPGPARQAWAIVEQRPWLARRPFIIHGPPWRLASQQEDDVFKLMSRSAVKMVERYLPDPYVFVVLLTLVAAGAAMIIEGQTPMAVVRWWGNGFWGLLTFAMQMLLVLVTGYMLASTPLVKRMLARLASLATSAGGAIILVSVVSLAASWINWGFGLVVGALFAKQIARQVRVDYRLLVASAYSGFIIWHGGLAGSIPLTIATEGHFSADKIGIIPTGDTIFAVFNLVIVVAMFILVPLVNRLMLPDEKESVYVDPARLEEASVPASDDDKRPAARLENSRLLAWLIAAGGLAYMFDYYVVRGAGLNLNVINFSFLILAILLHGTPRRLLTSLDEAIKGGAGIVIQFPFYAGIMAIMMDSGLAATLSEWFVSIASAATLPFWTFISAGIVNIFIPSGGGQWAVQSPIVISAAQALGADMPRVAMAVAWGDAWTNMLQPFWALPVLAIAGLKAKDIMGYCIIQLLVTGVIISVGLSFF

SEQ ID NO: 20897 - DNA, 1464 bp, Bordetella bronchiseptica RB50
  CDS (1)..(1464): transl_table=11
atgcccaacaatcatctaaccgccgctgcccccgcacagggcagagaggccatagccagtcccatggaacgcttctcccaggccatggtcgcctgggcggagaaatggtttcccgatgcctacgtcttcgtggtcgtggcgtgcgcggtggtcgcgcttggcgccatcctgcacggcggcgatccgcttgccgtcagcaaggcgttcggcgaaggcttctggagcatcatccccttcaccatgcagatggccatggtggccatcaccggctacgtgctggccttgtcgccgcccgtggcgcggctgctgcgggcgctggcgcgcgtgccctcgaccccgcgcggcgccgtggtgttcatcggcaccctgagcatcctgctgtcgctggtcaactggggcctgagcctgattttctcgggcctgctggtgcgcgaaatggcccgtcgcaacgatctgcgcctggactaccgcgcggccggcgcggccgggtacctggggctgggctgcgggttcacgctgggcatgagctcgtcggccgcgcagctgcaggccacgccggccagcattccggcctcgctgatgcccatcaccggcgtgatcggcttctccgaaaccatactgacctggcagaacctggtggtggtggtcctggttaccgtggtttcgggactggtgtgctacttcacggcgcccagcccggagcgctccttgaccgcccaggacctgggcgtggacctgaccgaacccgaggcgcaggcggcgcaacgccagcgccccggcgattacctggagttcagcccctggctgaccgtggccgtggtcgggctggcctcggggtggctgtatctcaccttccgcagcggcaacccgttcatcaccatgtcgcagctgaacacctacaacttcgtgttcctgctgctgggcctgctgctgcactggcggccgcgcagcttcctggagagtttcggccgcgccatgcccagcatcagcggcgtgatgctgcagtttccgttctacggcggcatcggctacgtgctgaccaaggtcgccaacgtgcaggggcataccctgtcggacgcgatcgcgcactggttcgtcagcctggcgcacgacagcagcgtgttctcgatactggtcagcatctattcggcattcctcggcttcttcattccgtcggccggcggcaagtgggtgatcgaggcgccgtacatcatggacgcggccaaccagatccaggcccacctgggctggaccgtcatggtctacaacatcgccgaaacgctgcccaacttcatcaacccgttctggatgctgccgctgctggggatactgcgcctcaaatccaaggacctggtcggctataccgccatgcagttcctggtgcacttccccatcgtcgtggccgccggcgcgatcctgatgcacaccttcagctatgtcccgcccgtcatcccgggacagtga

SEQ ID NO: 20898 - protein, 487 aa, Bordetella bronchiseptica RB50
MPNNHLTAAAPAQGREAIASPMERFSQAMVAWAEKWFPDAYVFVVVACAVVALGAILHGGDPLAVSKAFGEGFWSIIPFTMQMAMVAITGYVLALSPPVARLLRALARVPSTPRGAVVFIGTLSILLSLVNWGLSLIFSGLLVREMARRNDLRLDYRAAGAAGYLGLGCGFTLGMSSSAAQLQATPASIPASLMPITGVIGFSETILTWQNLVVVVLVTVVSGLVCYFTAPSPERSLTAQDLGVDLTEPEAQAAQRQRPGDYLEFSPWLTVAVVGLASGWLYLTFRSGNPFITMSQLNTYNFVFLLLGLLLHWRPRSFLESFGRAMPSISGVMLQFPFYGGIGYVLTKVANVQGHTLSDAIAHWFVSLAHDSSVFSILVSIYSAFLGFFIPSAGGKWVIEAPYIMDAANQIQAHLGWTVMVYNIAETLPNFINPFWMLPLLGILRLKSKDLVGYTAMQFLVHFPIVVAAGAILMHTFSYVPPVIPGQ

SEQ ID NO: 20899 - DNA, 1314 bp, Bordetella bronchiseptica RB50
  CDS (1)..(1314): transl_table=11
gtgttcaaactgatgtctcgttcagccgtgaaaatggttgagcgctatttgcccgacccttacgtattcgtggtgctgctgacgctggtcgccgccggcgcggccatgatcatcgagggccagacccccatggccgtcgtgcgctggtggggcaacggcttctgggggctgctgactttcgcgatgcagatgctgctggtgctggtcaccggctacatgctggccagcacgccgctggtcaagcggatgctggcgcggctggccagcctggccaccagcgccggcggggcgatcatcctggtcagcgtggtgtcgctggccgccagctggatcaactggggcttcgggctggtggtgggcgcgctgttcgccaagcagatcgcccgccaggtgcgggtcgattaccggctgctggtggccagcgcctattccggcttcatcatctggcacggcggtctggccggctcgattccgctgaccatcgcgaccgaggggcatttctccgccgacaagatcggcatcattcccaccggcgatacgattttcgcggtattcaacctggtgatcgtggtggcgatgttcatcctcgtgccgctggtcaaccggctgatgctgcccgacgagaaggaaagcgtctatgtcgatccggcgcgcctggaagaggcctcggtgccggcctcggacgacgacaagcgtccggccgcgcgcctggagaacagcaggctgctggcctggctgatcgccgcgggcgggctggcctacatgttcgactactacgtcgtgcgcggcgccggcctgaacctcaatgtcatcaacttcagcttcctgatcctggccatcctgctgcacggcacgccgcgccgcctgctggccagcctggacgaagccatcaagggaggcgcgggcatcgtgatccagttcccgttctatgcgggaatcatggccatcatgatggactcggggctggccgccaccttgtccgagtggttcgtgtcgatcgcctcggccgccacgctgccgttctggaccttcatcagcgccggcatcgtgaacatcttcattccgtcgggcggcgggcaatgggcggtgcaaagccccatcgtgatcagcgcggcgcaggcgctcggcgcggatatgccgagggtggcgatggccgttgcctggggcgacgcctggaccaacatgctccagccgttctgggccttgccggtgctggcgattgccggcctgaaggccaaggacatcatgggctattgcatcatccagctgctggtgaccggcgtcatcatttcggtgggactgagcttcttctag

SEQ ID NO: 20900 - protein, 437 aa, Bordetella bronchiseptica RB50
MFKLMSRSAVKMVERYLPDPYVFVVLLTLVAAGAAMIIEGQTPMAVVRWWGNGFWGLLTFAMQMLLVLVTGYMLASTPLVKRMLARLASLATSAGGAIILVSVVSLAASWINWGFGLVVGALFAKQIARQVRVDYRLLVASAYSGFIIWHGGLAGSIPLTIATEGHFSADKIGIIPTGDTIFAVFNLVIVVAMFILVPLVNRLMLPDEKESVYVDPARLEEASVPASDDDKRPAARLENSRLLAWLIAAGGLAYMFDYYVVRGAGLNLNVINFSFLILAILLHGTPRRLLASLDEAIKGGAGIVIQFPFYAGIMAIMMDSGLAATLSEWFVSIASAATLPFWTFISAGIVNIFIPSGGGQWAVQSPIVISAAQALGADMPRVAMAVAWGDAWTNMLQPFWALPVLAIAGLKAKDIMGYCIIQLLVTGVIISVGLSFF

SEQ ID NO: 20901 - DNA, 1365 bp, Bdellovibrio bacteriovorus HD100
  CDS (1)..(1365): transl_table=11
atgaacccagcccgcgacaatgcctttcaaaaactcattcgattcagtgtgaagctcgtcaatgaatacctgcctgatccctttatcttctgcgcgcttttgacttttatcgtatttgccgcggcaatgcccgtaactggcatgagcttccttgaaactgtgaacggttggtatgaaggcttctggggcttgttgggattctcgatgcagatggtcctggtgctcgtgctcggccatgcgttggcgaactcgcgcccctgctccagcttgttgtcatctttggcctcccacctgcgcacccctggtcaggcgatcgttgtcgtttctttggtctcgctgctgggttcctggttcaactggggttttggcctggtgatcggtgctctttttgccaaagagatcgcgaaaaaagtaaaaactgtcgactaccgcctgctgatcgcttctgcttattccggctttctaatctggcacggcggtctttccggatctattcctttgacgattgccacggacgggaatctggccaaggcctctaacaatgtcgtcaccggaatgatcccagtatctgaaaccctgttttcaacctacaacctggttatcgtaattgtccttttggtgacagtgcccctgctgaacatgttcatgcacccacgcctggaagaaaccgtgagtgtggatccggctttgctaaatgacgaagtttcagacacggaaaacggcaacagtacgtgggcagatcgcattgaaaacagcaaatgggtttctttgatcttgtgcgcccttgccagcgtgtacatcgcaaactacttcttcaaaaaaggtttggatctgaatctgaacattgtgaatttcatcttcctgttcctgggcattctgttgcacgggactccacgtcgctacattctggcgattcgttctgccgtgatcagctccagcgggatcatcctgcaattcccgttctatgcgggaatcatgggtctgatggtggccagcggcagcagcggtgtttcgctggccggagccctgtctaatgtgtttgtgaacatctccaccgtcacaacattcccgttctttacctttatcagcgcgggtattgtgaatttctttgtgccctccggcggtggtcagtgggccgtacaagctccgatcatgctgcctgcggcgcaagagctgggcgtgtctgtcgccaagacctcgatggcgattgcctggggtgacgcatggacaaacatgatccagcccttctgggccttgccagccttgggaatcgcaggccttggcgcccgcgacatcatgggcttttgtttgatcgtccttttgtactcaggccttgtgatctcggcgggattcttgttcctgtaa

SEQ ID NO: 20902 - protein, 454 aa, Bdellovibrio bacteriovorus HD100
MNPARDNAFQKLIRFSVKLVNEYLPDPFIFCALLTFIVFAAAMPVTGMSFLETVNGWYEGFWGLLGFSMQMVLVLVLGHALANSRPCSSLLSSLASHLRTPGQAIVVVSLVSLLGSWFNWGFGLVIGALFAKEIAKKVKTVDYRLLIASAYSGFLIWHGGLSGSIPLTIATDGNLAKASNNVVTGMIPVSETLFSTYNLVIVIVLLVTVPLLNMFMHPRLEETVSVDPALLNDEVSDTENGNSTWADRIENSKWVSLILCALASVYIANYFFKKGLDLNLNIVNFIFLFLGILLHGTPRRYILAIRSAVISSSGIILQFPFYAGIMGLMVASGSSGVSLAGALSNVFVNISTVTTFPFFTFISAGIVNFFVPSGGGQWAVQAPIMLPAAQELGVSVAKTSMAIAWGDAWTNMIQPFWALPALGIAGLGARDIMGFCLIVLLYSGLVISAGFLFL

SEQ ID NO: 20903 - DNA, 1347 bp, Bacillus cereus ATCC 10987
  CDS (1)..(1347): transl_table=11
ttgtttcgttcttttactaatggctgcgtcgccttagtgcaacgtttcttgccagaaccgtttattttatcatgtttattaaccgtatttgttattttcttcggcatgtttgcaacgcatcaaacacctgtggaaatgattaatcactgggggaatggcatttggggacttctcgccttttctatgcaaatggcacttgtactcgtgacaggatctgctttagcaaacgctcctctcattaaaaaatggttaacgaaagctgcaagactaccgaaaacgaatggacaaggtattattgccatttcaatcgtaagtttactaggggcgtacataaactggggctttggtattgttgtatctgttttatatgcaaaggaagtagcaaggcaacttgaaggattagattataggttagccattgcctcttcttactctggatttctcatttggcatgcggggctttctgcttctatccctctcacgttagcaactggaggcgaaacgttaatgaaaacgacagctggaagtattaaagaagcgattccaataacagaaacgttattctcaccatacgctctcgtgccagttattatttttctcgttacgatgcctctcattaataaagcgatgcatccagatgaaaaacatacgataacggtagatcctagcgtattccatgaagaagctgccgctcaagaagtaggaaacaatacgttcgctgagaaaatggaaaatagcatcattattacactttgcgttggattgttaggtctcatttatattttcaattacttttatacgaaaggttttaaccttacacttgatatcgttatttttatgttattaattgctggacttattttccaccgtactccgattcaatatattcgtgctttttcagattctacaaaaagtgcttctggtattttacttcagtttccattttatgcaggaattatgggcatgatgattggagcaaatagtgaaggactttcacttggaggagctatttcaaatttctttattagcatttcaaacgaaacgactttcccactctttacttttttaagtgctggcatcgttaatattttcgttccatctggtggcggtcaatgggctgtgcaagcacccattatgattccagctggtgctgaacttggtgtacctgctgcaaaaacagcaatggccattgcatggggcgatgcttggacgaatttaattcaacctttctgggcattacccgcattggcaatagctggtttaggcgctcgtgatattatgggattttgcgtcgtgaacttactatatgcaggatttatcataagtctatgtttcttatttatttaa

SEQ ID NO: 20904 - protein, 448 aa, Bacillus cereus ATCC 10987
MFRSFTNGCVALVQRFLPEPFILSCLLTVFVIFFGMFATHQTPVEMINHWGNGIWGLLAFSMQMALVLVTGSALANAPLIKKWLTKAARLPKTNGQGIIAISIVSLLGAYINWGFGIVVSVLYAKEVARQLEGLDYRLAIASSYSGFLIWHAGLSASIPLTLATGGETLMKTTAGSIKEAIPITETLFSPYALVPVIIFLVTMPLINKAMHPDEKHTITVDPSVFHEEAAAQEVGNNTFAEKMENSIIITLCVGLLGLIYIFNYFYTKGFNLTLDIVIFMLLIAGLIFHRTPIQYIRAFSDSTKSASGILLQFPFYAGIMGMMIGANSEGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLFI

SEQ ID NO: 20905 - DNA, 1347 bp, Bacillus anthracis str. Sterne
  CDS (1)..(1347): transl_table=11
ttgtttcgttcttttactaatggttgcgtcgccttagtgcaacgtttcttgccagaaccgtttatattatcatgtttattaactgtttttgttattttcttcggcatgtttgcaacgcatcaaacacctgtggaaatgattaatcactggggtaatggcatttggggacttctcgccttttctatgcaaatggcacttgtactcgtgacaggatctgctttagcaaacgctcctcttattaaaaaaggattaatgaaagcggcaagactaccaaaaacaaatggacaaggtattattgccatttcaatcgtaagtttactaggggcatacataaactggggatttggtattgttgtatctgttttatacgcaaaagaagtggcaagacaattagaaggattggattatagactagcaatcgcttcttcttactctggatttctcatttggcatgcggggctttctgcttctatccctcttacgttagcaacaggcggagaaacgttaatgaaaacgacagctggaagtattaaagaagcgattccaatcactgaaacgttattctcaccatatgctctcgttccagttattatctttttagttacgatgcctctcattaataaggcgatgcatccagatgcaaaacatacaataacagtagatcctagcgtattccatgaagaagctgccgctcaagaggcaggaaaaaatacgttcgcggaaaaaatggaaaatagcattattattacactttgcgttggattgttaggtctcatttatattttcaactacttttatacgaaaggctttaaccttacactcgatatcgttatttttatgttattaattgctggactcattttccaccgtactccaattcaatatattcgcgctttttcagattccacgaaaagtgcttctggtattttacttcaatttccgttttacgcaggaattatggggatgatgatcggagcaaatagtgaaggcctttcacttggaggagctatttcgaatttctttattagcatttcaaacgaaacaactttcccgctctttacttttttaagtgcgggcatcgttaatattttcgttccatctggtggcggtcaatgggctgtgcaagcacccattatgattccagctggcgctgaacttggtgtacctgctgcaaaaacagcaatggccattgcgtggggcgatgcttggacaaatttaattcaacctttctgggcattaccagcattagcgatagctggtttaggtgctcgtgatattatgggattttgcgttgtgaacttactatatgcaggatttatcataagtctatgtttcttatttatttaa

SEQ ID NO: 20906 - protein, 448 aa, Bacillus anthracis str. Sterne
MFRSFTNGCVALVQRFLPEPFILSCLLTVFVIFFGMFATHQTPVEMINHWGNGIWGLLAFSMQMALVLVTGSALANAPLIKKGLMKAARLPKTNGQGIIAISIVSLLGAYINWGFGIVVSVLYAKEVARQLEGLDYRLAIASSYSGFLIWHAGLSASIPLTLATGGETLMKTTAGSIKEAIPITETLFSPYALVPVIIFLVTMPLINKAMHPDAKHTITVDPSVFHEEAAAQEAGKNTFAEKMENSIIITLCVGLLGLIYIFNYFYTKGFNLTLDIVIFMLLIAGLIFHRTPIQYIRAFSDSTKSASGILLQFPFYAGIMGMMIGANSEGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLFI

SEQ ID NO: 20907 - DNA, 1347 bp, Bacillus thuringiensis serovar konkukian str. 97-27
  CDS (1)..(1347): transl_table=11
ttgtttcgttcttttactaatggttgcgtcgccttagtgcaacgtttcttgccagaaccgtttatattatcatgtttattaactgtttttgttattttctttggcatgtttgcaacgcatcaaacacctgtggaaatgattaatcactggggtaatggcatttggggacttctcgccttttctatgcaaatggcacttgtactcgtgacaggatctgctttagcaaacgctcctcttattaaaaaaggattaacgaaagcggcaagactaccaaaaacaaatggacaaggtattattgccatttcaatcgtaagtttactaggggcatacataaactggggatttggtattgttgtatctgttttatacgcaaaagaagtagcaagacagctggaaggattagattatagactggcaattgcttcttcttactctggatttctcatttggcatgcggggctttctgcttctatccctcttacgttagcaacaggcggagaaacattaatgaaaacgacagctggaagtattaaagaagcaatcccaatcactgaaacgttattctcatcatacgctctcgttccggttattatctttttagttacgatgcctcttattaataaggcgatgcatccagatgaaaaacatacaataacggtagatcctagcgtatttcatgaagaagctgcggctcaagaagtaggaaataatacgttcgctgaaaaaatggaaaatagtatcattattacactttgcattggattgttaggtctcatttatattttcaactacttttatacgaaaggctttaaccttacgctagatatcgttatttttatgttattaattgctggacttattttccaccgtactccgattcaatatattcgtgctttttcagattccacgaaaagtgcttctggtattttacttcaatttccgttttacgcaggaattatggggatgatgattggagcaaatagtgaaggactttcacttggaggagctatttcgaatttctttattagcatttcaaacgaaacaactttcccgctctttacttttttaagtgctggcattgttaacattttcgttccatctggtggtggtcaatgggctgtgcaagcaccaattatgattccagctggtgctgaacttggtgtacctgctgcaaaaacagcaatggccattgcgtggggagatgcttggacaaatttaattcaacctttctgggcattaccagcattggcgatagctggtttaggcgctcgtgatattatgggattttgcgttgtgaacttactatatgcaggttttatcattagtctatgcttcttatttatttaa

SEQ ID NO: 20908 - protein, 448 aa, Bacillus thuringiensis serovar konkukian str. 97-27
MFRSFTNGCVALVQRFLPEPFILSCLLTVFVIFFGMFATHQTPVEMINHWGNGIWGLLAFSMQMALVLVTGSALANAPLIKKGLTKAARLPKTNGQGIIAISIVSLLGAYINWGFGIVVSVLYAKEVARQLEGLDYRLAIASSYSGFLIWHAGLSASIPLTLATGGETLMKTTAGSIKEAIPITETLFSSYALVPVIIFLVTMPLINKAMHPDEKHTITVDPSVFHEEAAAQEVGNNTFAEKMENSIIITLCIGLLGLIYIFNYFYTKGFNLTLDIVIFMLLIAGLIFHRTPIQYIRAFSDSTKSASGILLQFPFYAGIMGMMIGANSEGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLFI

SEQ ID NO: 20909 - DNA, 1410 bp, Acinetobacter sp. ADP1
  CDS (1)..(1410): transl_table=11
atggataaacaacctgcgcttttggagcgttttgccttaaaagtcagtgactggtcagaaaaatggtttcctgattcttatatttttgcgctacttggcgtcattattgtgtcgcttgccgcaattttcattggtgcgccagtcaaagatgtggcaggcgcatttggaaacggtttttggagtctcatcccgtttacactgcaaatgaccatgctgattattgtcggttatgtggtttctgtttctgcacctgtgaaaaaactcattcagaaaatggcacgtttgccacattcaggtcgcggtgccattgtaatggtggccaccgtgagtttgctcatttctttggtcaactgggcaattagtacgatcttgacagcattactggtcattgcgctggcaaaacgcaaagaactcaacatggattatcgtgctgctgccgctgccgcaattattggcatgggcgccacttgggcactcggtattagctcatcggctgcacagttgcaggccaataaaaccagtttgccagaatccatttataacctgacaggtgtgattccatttacccaaactattttcttatggcaatcactggtcatgacactggtgctggtgattgtgtctattgtgattgcatattggtcggcacctaaaggtcaaaatgtcaaaaccatgcaggattttcatctggattttgaagatgaagaaaaagctgaacccaaatcgacccgccctggtgactggctagaaaattcgcctattttaaccattttaattgtggtacttgggctgggctggatgcttatggaattttccaaaaacaatcctattattgcaatttctagtttgaatacttacaactttatctttttgatgctcggtctggcgttgcatcggacaccccgtaatttcctcaatgccgtgagcaaggccgttcctgcggtttcaggcgtgctgatccagtttccactgtatggcagcattgctttcattatgacgcaagcggtcaatgctcaggacttttcgctctctcattatattgctgaattttttgtttcgattgcatcacatgatacttttgcagtggtgatgggaatttactctgccattctgggattttttgtaccttctggcggtggcaaatggattatcgaagcaccttatgtcatgcaggctgcaaacgatcttcagtatcatttgggttggtcagttcaaatttacaatgcagccgaagccttacccaacctgatcaatccattttttatgttgcccatgctaggcattcttaaactcaaacccaaagatgtcattgggtttaccgtaacgcaactggtggtacatttaccgctggtgatgtttttattatggattcttggaaaaacactgagctataccccacccgtattttaa

SEQ ID NO: 20910 - protein, 469 aa, Acinetobacter sp. ADP1
MDKQPALLERFALKVSDWSEKWFPDSYIFALLGVIIVSLAAIFIGAPVKDVAGAFGNGFWSLIPFTLQMTMLIIVGYVVSVSAPVKKLIQKMARLPHSGRGAIVMVATVSLLISLVNWAISTILTALLVIALAKRKELNMDYRAAAAAAIIGMGATWALGISSSAAQLQANKTSLPESIYNLTGVIPFTQTIFLWQSLVMTLVLVIVSIVIAYWSAPKGQNVKTMQDFHLDFEDEEKAEPKSTRPGDWLENSPILTILIVVLGLGWMLMEFSKNNPIIAISSLNTYNFIFLMLGLALHRTPRNFLNAVSKAVPAVSGVLIQFPLYGSIAFIMTQAVNAQDFSLSHYIAEFFVSIASHDTFAVVMGIYSAILGFFVPSGGGKWIIEAPYVMQAANDLQYHLGWSVQIYNAAEALPNLINPFFMLPMLGILKLKPKDVIGFTVTQLVVHLPLVMFLLWILGKTLSYTPPVF

SEQ ID NO: 20911 - DNA, 1347 bp, Bacillus cereus E33L
  CDS (1)..(1347): transl_table=11
ttgtttcgttcttttactaatggttgcgtcgccttagtgcaacgcttcttgccagaaccgtttattttatcatgtttattaactgtttttgttattttctttggcatgtttgcaacgcatcaaacacctgtggaaatgattaatcactgggggaatggcatttggggacttctcgccttttctatgcaaatggcacttgtactcgtaacaggatctgctttagcaaacgctcctcttattaaaaaaggattaacgaaagcggcaagactaccaaaaacaaatggacaaggtattattgctatttcaatcgtaagtttactaggggcatacataaactggggatttggtattgttgtatctgttttatacgcaaaagaagtggcaagacaattagaaggattggattatagactagcaatcgcttcttcttactctggatttctcatttggcatgctgggctttctgcttctatccctcttacgttagcgacaggcggagaaacgttaatgaaaacgacagctggtagtattaaagaagcgattccaatcactgaaacgttattctcaccatacgctctcgttccagttattatctttttagttacgatgcctctcattaataaggcgatgcatccagatgaaaaacatacgattacagtagaccctagcgtgttccatgaagaagctgcagctcaagaggtagggaaaaatacgttcgctgagaaaatggaaaatagtatcatcattacactttgcgttggattgttaggtctcatttatattttcaattacttttatacgaaaggctttaaccttacacttgatatcgttattttcatgctattaattgctggacttattttccaccgtactccgattcaatatattcgcgctttctcagactctacgaaaagtgcttctggcattctacttcaatttccgttttatgcaggaattatggggatgatgatcggagcaaatagtgaaggactttcacttggaggagctatttcgaatttctttattagcatttcaaacgaaacaactttcccgctctttacttttttaagtgctggcatcgttaatattttcgttccatctggtggcggtcaatgggctgtgcaagcacccattatgattccagctggcgctgaacttggtgtacctgctgcaaaaacagcaatggccattgcgtggggggatgcttggacgaatttgattcaacctttctgggcattaccggcattagcgatagccggtttaggcgctcgtgatattatgggattttgcgttgtgaacttactatatgcaggatttatcataagtctatgtttcttatttatttaa

SEQ ID NO: 20912 - protein, 448 aa, Bacillus cereus E33L
MFRSFTNGCVALVQRFLPEPFILSCLLTVFVIFFGMFATHQTPVEMINHWGNGIWGLLAFSMQMALVLVTGSALANAPLIKKGLTKAARLPKTNGQGIIAISIVSLLGAYINWGFGIVVSVLYAKEVARQLEGLDYRLAIASSYSGFLIWHAGLSASIPLTLATGGETLMKTTAGSIKEAIPITETLFSPYALVPVIIFLVTMPLINKAMHPDEKHTITVDPSVFHEEAAAQEVGKNTFAEKMENSIIITLCVGLLGLIYIFNYFYTKGFNLTLDIVIFMLLIAGLIFHRTPIQYIRAFSDSTKSASGILLQFPFYAGIMGMMIGANSEGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLFI

SEQ ID NO: 20913 - DNA, 1404 bp, Haloarcula marismortui ATCC 43049
  CDS (1)..(1404): transl_table=11
atgtcagctaataacacaggcgaaactgccctcgaacgtatcggctatcgactctctgcgtgggtggaacggtggatgccaagcccgttcctgttcgcgctcatcctcagttacgtcgtatttctggccggcgtcggcctcaccggggccggtcccgtggagatggtcgggttctggtacgacggcttctgggccttcctgacgttctcgatgcagatggtcctcatcctgatgacgggcttcgtcgtcgcgtaccacccgcgtgtcaacgccggcatccggcggctgacagagattcccagcaccggaaaacaggcggttgtcctcgtcggcctgttgacgatgctgctcggctgggtccactggggactgagcctcatcctcggcgcgattttcgcccgggagatgggcaagaccgcccacgagaacggcatcgatgtccactatccggtcctctgcgtggcgggctatctcggcctcggtctcacctggcactgggggctgtccgggtccgcgccgctcctgcttgcgacagagggcaacgagttcatccagcagggcgtcatcgacgtcgtcgtctccgcctcggagaccatcttccacccctacggcctcattctgaccggcctgtcgatagcctacgcgctcgtcgtcctctacgtcatcacgccgactggtgaccaggcgcggggcatcacgcactacatccccgaagacgatttgttcgagtccgcgagtgacggcggtgttgagacgactgcgaccaccaagcaggtcccggccgagcgtctcaaccacagccgcgttctcggcgggattatcggtctgaccggtattgcgctggtcgcctcgcagttcgttcagtccggcatcgacgcgctcggactgaacatcgtcaatttcggcttcctgacgattgggatcttcatctacatggacccacagacctaccgggagaagttcggcgaggcggcgaccgccgcgtcgggcatcgtgttgctctttccgttcttcgctggcattcaggggatgatggctacctccgggctggcgcagctgatggccaacgcgctcatctcggtctcgacaccacagacgttcccggtcatcgcctggctcactggtgccacggtcaacattttcgcaccgtccggcggcggtgagtggatcattctcgggccgccgattctcgaagccgcgcagaacctcggcgtcccggccgggcaggcgacgatggcctacgccgtcggtgacgcccacacgaacctcctgaaccccttctgggcgctgccgctgctcgccatcacccgcatcaaggcccgggagatgttcggctacgccatcgcaatgttgctcgcgctcacgccattcctggctgtcgtgctgttcgtcctgccgtactga

SEQ ID NO: 20914 - protein, 467 aa, Haloarcula marismortui ATCC 43049
MSANNTGETALERIGYRLSAWVERWMPSPFLFALILSYVVFLAGVGLTGAGPVEMVGFWYDGFWAFLTFSMQMVLILMTGFVVAYHPRVNAGIRRLTEIPSTGKQAVVLVGLLTMLLGWVHWGLSLILGAIFAREMGKTAHENGIDVHYPVLCVAGYLGLGLTWHWGLSGSAPLLLATEGNEFIQQGVIDVVVSASETIFHPYGLILTGLSIAYALVVLYVITPTGDQARGITHYIPEDDLFESASDGGVETTATTKQVPAERLNHSRVLGGIIGLTGIALVASQFVQSGIDALGLNIVNFGFLTIGIFIYMDPQTYREKFGEAATAASGIVLLFPFFAGIQGMMATSGLAQLMANALISVSTPQTFPVIAWLTGATVNIFAPSGGGEWIILGPPILEAAQNLGVPAGQATMAYAVGDAHTNLLNPFWALPLLAITRIKAREMFGYAIAMLLALTPFLAVVLFVLPY

SEQ ID NO: 20915 - DNA, 1320 bp, Bacillus clausii KSM-K16
  CDS (1)..(1320): transl_table=11
ttgtttgcggccgttactaggtggtttgaccgcatcgtgcaacgctatttgccagatgcctttttgtttgcgggattgttaaccattcttgtttttctattgggcgtgtttgttacagatgcttcgcctgtacaaatggttgattattggggctctggcttttgggatttgctttcctttacgatgcaaatggcgctcattgttgtaaccggttacattttggcgaatacgccactgtttaagcgcctattatcaacgttggccgtattagcaaaaacgccaggccaggcaattgtgcttgtaacgtttgtggccagcattgcttgtctgatcaattatggctttggcctcgttgtcggagcgctttttgccaggcacgttgttcgccaagtaccaagcgtcgactatcgtatactggtggcggctgcctacagtggttttcttgtatggcatgggggattatcggcgtctatccctctgacgattgcaacagaggaccactttttggcggatgtaatggggacgattccaattgccgatacattgctgtctccggccaacctttttattgtatgcgctttcttaattagcttgcctgtcgtgaattatttccttctcaaaacgtcgacttcttcttacacaattgatatggctcgatttgctgaagaaaaacgtgaggaagcggcagctgttgcggaaacgccagcggaaaagttggagaatagtcaatgggtgtcacttgccattgctctgcttggcttaacgtatgtcgtactgtattttatcgaaaacggccttgacttgaacattaatattgtcaattttacgtttttgtttttaggcattttatgccatcgtacgccaaggcgctttttaacagcagttggcgaaggcgtgaaaaacgccggaggcattattattcaattcccattttacgccggaattatggggatgatggtcggctcagggctgtctgaacagctttccctttggtttgtgtcgatttcatcagcagagacgttcccgctatggacgtttcttagcgcagggttactaaacatgtttatcccttctggaggcggacaatgggctgttcaagggccgattatggtgccggcagcactggaactcggtgcggatatggcgaaaacagctatggctgtcgcttggggagacgcatggacgaacatgatccaaccattttgggcgctgccattattagcgatcgcaggcttaaaagtccgtgacatcatgggcttttgtgtcatattgcttttttgggcatttgtgccaattgccattggcctgatgtttttttaa

SEQ ID NO: 20916 - protein, 439 aa, Bacillus clausii KSM-K16
MFAAVTRWFDRIVQRYLPDAFLFAGLLTILVFLLGVFVTDASPVQMVDYWGSGFWDLLSFTMQMALIVVTGYILANTPLFKRLLSTLAVLAKTPGQAIVLVTFVASIACLINYGFGLVVGALFARHVVRQVPSVDYRILVAAAYSGFLVWHGGLSASIPLTIATEDHFLADVMGTIPIADTLLSPANLFIVCAFLISLPVVNYFLLKTSTSSYTIDMARFAEEKREEAAAVAETPAEKLENSQWVSLAIALLGLTYVVLYFIENGLDLNINIVNFTFLFLGILCHRTPRRFLTAVGEGVKNAGGIIIQFPFYAGIMGMMVGSGLSEQLSLWFVSISSAETFPLWTFLSAGLLNMFIPSGGGQWAVQGPIMVPAALELGADMAKTAMAVAWGDAWTNMIQPFWALPLLAIAGLKVRDIMGFCVILLFWAFVPIAIGLMFF

SEQ ID NO: 20917 - DNA, 1419 bp, Pseudomonas syringae pv. syringae B728a
  CDS (1)..(1419): transl_table=11
atggccgccaacatagaagaaagccgctccgcccgatttgccttgcgctgtgctgcgtgggctgaacgctggtttcccgattcatgggtatttgccgcactggcggtggtcatcgtcacgctggcgacgctggccatcggcgcacgtccggtcgaggccgccaaggcgttcggtgacgggttctggagcctgattccgttcaccatgcaaatggccttcgtggtcatcggcggttacgtggtcgccagctcaccgcctgcggtacgcctgatcgaccgcctggcccgggtaccgcgcaacggccgttcggcggtggcctgggtggcgctgatttccatgctcgcttcgctgctcaactggggcctgtcgctggtgttcggcggcctgctggtgcgcgccctcgcccgccgcactgacctgcgcatggattaccgtgcagccggcgccgcggcctatctgggcctgggcgcggtctgggcgctggggctgtcgtcttcggccgcgcaattgcaggccaacccggccagtctgccgccgtcgatcctggcgattaccggggtgatcccgttcaccgaaaccatctttctctggcaatccggggtcatgctcgccgcgctggtggtcatctcactgatcgttgcctacgccaccgcgcccggcccgaacagcgcccgcgacgccaaggcctgcggtgtcgacccggccttcaacctgccgccgctgccgccccgcacacggcccggggaatggctggaatacagcccgctgctgatcatcctcatggtgctgctgggggttggctggctgttcaacgagttttcgagcaaaccggtgatcacagcgatttccgggctcaatacctacaatttcctgttcatcatgctcggtgccctgctgcactggcggccgcgcagttttctcgatgccgtcgcacgggcggtgcccaccaccaccggcgtgctgattcaattccctctgtacggttcgatcgccgcgctactgaccacggtcaagggcggcgatgcgcaaaccctggcgcattacatctcgacgttcttcaccagcattgcttcccacgatacttacgcgattctgatgggggtctattcagccatattgggctttttcattccgtcaggcggcggcaagtggattatcgaagcgccctacgtgatgcaggtcgccaacgacctgcagtatcacctcggctgggcagtacagatctacaacgcagccgaagccctgcccaacctgataaacccgttctacatgctgccgctgctgggtgtactgggcctgaaggcgcgtgacctgatcggcttctcgttcgtgcaactgctggtccacacgccgctggtgctgtttctgctctgggcactgggcaccacgctggcctatgtgccgccggtaatgccctga

SEQ ID NO: 20918 - protein, 472 aa, Pseudomonas syringae pv. syringae B728a
MAANIEESRSARFALRCAAWAERWFPDSWVFAALAVVIVTLATLAIGARPVEAAKAFGDGFWSLIPFTMQMAFVVIGGYVVASSPPAVRLIDRLARVPRNGRSAVAWVALISMLASLLNWGLSLVFGGLLVRALARRTDLRMDYRAAGAAAYLGLGAVWALGLSSSAAQLQANPASLPPSILAITGVIPFTETIFLWQSGVMLAALVVISLIVAYATAPGPNSARDAKACGVDPAFNLPPLPPRTRPGEWLEYSPLLIILMVLLGVGWLFNEFSSKPVITAISGLNTYNFLFIMLGALLHWRPRSFLDAVARAVPTTTGVLIQFPLYGSIAALLTTVKGGDAQTLAHYISTFFTSIASHDTYAILMGVYSAILGFFIPSGGGKWIIEAPYVMQVANDLQYHLGWAVQIYNAAEALPNLINPFYMLPLLGVLGLKARDLIGFSFVQLLVHTPLVLFLLWALGTTLAYVPPVMP

SEQ ID NO: 20919 - DNA, 1344 bp, Haemophilus influenzae 86-028NP
  CDS (1)..(1344): transl_table=11
atgattagtcgcgtttctcgttttatgacgacattcgtcagtaaatacctgccagacccacttatttttgccgtgttacgcacctttgtcacattcatttgtgcttggggattaaccgatagtacacctgttgatttagttaatatgtggggtaatggcttttggaatttacttggttttggtatgcaaatggcattaattgtcgtaactggtaatgctcttgcaacctcaccacaaattcgtaagtttctttctacaatcgcttcaatagcaaaaacaccagcacaaggtgttgtcttagttacgtttatgggttcaattgcctgtatcattaactggggcttcggtttggtcgttggtgcgatgtttgcaaaagaagtcgcgcggagaataaaaggcagtgactacgccttactgattgcctgcgcctatattgcatttatgacatggggtggaggtttttcaggctcaatgccacttttagccgcaacaccaggcaacccagttgctcatttaatggtgagcgaaagcaacccacaaggtattattcctgcagttagtacgcttttctctgggtacaatatttttatcacgttaagtttagtcatttgcttgcctttcattacctatatgatgatgcccaaaaatggcgaagcaaaaagtattgatccaaaacttattgcgcccgatccaacatttgataaaaaattggataaagatgcaacacttgctgaaaaaatggaagaaagccgcttcttagcctatacaatcggggcattaggatatagttacctcggtatgtatttctacaaaaacggattcaatctcacaattaataatgtaaaccttattttcttaatcacaggaattgtgcttcatggctcgccaatggcctatatgcgagcaattattaatgccacaagaagcacagcagggatcttagtgcaattcccattctatgcgggtgtgcaactaatgatggagcattcaggcttaggtggtttaatcacagaattctttatcaatgttgctaacaaagattctttcccattattaaccttctttagttctgcctttattaactttgcagtgccttctggtggcggtcactgggtcatccaaggaccatttgttatccctgctgctcaagcattaggtacagatctgggtaagtctacaatggcaattgcctatggtgagcaatggatgaacatggctcagccattttgggcattaccagcactgggtatcgcagggcttggcgtgagagatattatgggcttctgtatgaccgcacttatcttcaccgcaccaatttttattattggtttatatttcttatag

SEQ ID NO: 20920 - protein, 447 aa, Haemophilus influenzae 86-028NP
MISRVSRFMTTFVSKYLPDPLIFAVLRTFVTFICAWGLTDSTPVDLVNMWGNGFWNLLGFGMQMALIVVTGNALATSPQIRKFLSTIASIAKTPAQGVVLVTFMGSIACIINWGFGLVVGAMFAKEVARRIKGSDYALLIACAYIAFMTWGGGFSGSMPLLAATPGNPVAHLMVSESNPQGIIPAVSTLFSGYNIFITLSLVICLPFITYMMMPKNGEAKSIDPKLIAPDPTFDKKLDKDATLAEKMEESRFLAYTIGALGYSYLGMYFYKNGFNLTINNVNLIFLITGIVLHGSPMAYMRAIINATRSTAGILVQFPFYAGVQLMMEHSGLGGLITEFFINVANKDSFPLLTFFSSAFINFAVPSGGGHWVIQGPFVIPAAQALGTDLGKSTMAIAYGEQWMNMAQPFWALPALGIAGLGVRDIMGFCMTALIFTAPIFIIGLYFL

SEQ ID NO: 20921 - DNA, 1419 bp, Pseudomonas fluorescens Pf-5
  CDS (1)..(1419): transl_table=11
gtggccgctgatattcaagatagccgctccgcccgctttgccctgcgctgctcgaactgggccgaacgctggtttcccgactcctgggtgttcgccgcgctggcggtgatcatcgttgccctggccacgctggccatgggcgccaagcccaccgatgccgccatggcgtttggcgacggcttctggagcctgatccccttcaccatgcagatggccttcgtggtcattggcggctatgtggtagccagctcgccgccggcggtgaagctgatcgacaagctggcgcgcattcccaggaacggccgctcggcggtggcctgggtggcgctgatttccatggtcgcctccctgctcaactggggcctgtccctggtgttcggtggcctgctggtgcgggccctggcccggcgtaccgaactgcgcatggactaccgcgccgccggcgctgccgcctacctgggcctgggcgcggtctgggccctggggctgtcgtcttcggcggcgcagttgcaggccaaccccggcagcctgccaccgtcgatcctggccatcaccggggtcattcccttcacccagaccatctttctctggcaatccggcgtcctgctgctggccctggtggtggtctcgctgatcgtcgcctacgccacggcgcccggccccggcagcgcccgggatgcccaggcctgcggggtcgacccgagcttcagcatgcccaagccgcaaccccggacccgacctggcgaatggctggaatacagcccgctgctgacccttctcctggcgctgctggcggccggctggctgtatcacgagttcgccaccaaaccggcgatcaccgcgatctccgggctcaacacctacaacttcctgttcctgatggccggcgccctgctgcactggcgcccgcgcagcttcctcgatgccgtggcccgggcagtgcccaccaccaccggggtgctgatccagttcccgctgtacggttcgatcgccgcgctgatgaccgtggtcaagggcgtggatggccagaccctggcccaccacatctcgaccttcttcgtgcagatcgcttcccacgacacctacgcgctgctgatggggctgtactcagcggtgctgggcttcttcattccttcgggcggcggcaagtggatcatcgaggcgccctacgtgatgcaggtggccaatgacctgcagtaccacctgggctgggcggtacagatctacaacgccgccgaggccctgccgaacctgatcaaccccttctacatgctgccgctgctgggggtgctgggcttgaaggcccgggacctgatcggcttctcctttgtccagttgctggtgcatgcgcccctggtgctggtgctgctctgggccctggggaccaccctgtcctacctgccgccggtcattccctga

SEQ ID NO: 20922 - protein, 472 aa, Pseudomonas fluorescens Pf-5
MAADIQDSRSARFALRCSNWAERWFPDSWVFAALAVIIVALATLAMGAKPTDAAMAFGDGFWSLIPFTMQMAFVVIGGYVVASSPPAVKLIDKLARIPRNGRSAVAWVALISMVASLLNWGLSLVFGGLLVRALARRTELRMDYRAAGAAAYLGLGAVWALGLSSSAAQLQANPGSLPPSILAITGVIPFTQTIFLWQSGVLLLALVVVSLIVAYATAPGPGSARDAQACGVDPSFSMPKPQPRTRPGEWLEYSPLLTLLLALLAAGWLYHEFATKPAITAISGLNTYNFLFLMAGALLHWRPRSFLDAVARAVPTTTGVLIQFPLYGSIAALMTVVKGVDGQTLAHHISTFFVQIASHDTYALLMGLYSAVLGFFIPSGGGKWIIEAPYVMQVANDLQYHLGWAVQIYNAAEALPNLINPFYMLPLLGVLGLKARDLIGFSFVQLLVHAPLVLVLLWALGTTLSYLPPVIP

SEQ ID NO: 20923 - DNA, 1425 bp, Pseudomonas syringae pv. phaseolicola 1448A
  CDS (1)..(1425): transl_table=11
atggccgccaacgccaacatagaagaaagccgctctgcccgattcgccttgcgctgcgccgcatgggctgaacgctggtttcccgattcatgggtatttgccgcgctggcggtggtcatcgtcacactggcaacactggccattggcgcacgtccggccgaggctgccaaagcgttcggtgacgggttttggagcctgattccgttcaccatgcaaatggccttcgtggtcatcggcggttacgtcgtggccagttcgccgcccgcggtgcgcctgatcgaccgcttggcccttgtgccgcgtaacggtcgttcggcagtggcatgggtggcgctgatttccatgctggcttcgctgctcaactgggggctgtcactggtgttcggcggcctgctggtgcgcgccctcgcccgccgtaccgacctgcgcatggattatcgtgcagccggtgctgccgcgtatctggggctgggcgcagtctgggcgttggggctgtcgtcttcggcggcacagttgcaggccaacccggccagtctgccgccttcgatcctggcgataaccggcgtgatccctttcactgaaaccatctttctctggcaatccggggtcatgctcgccgcgctggtagtcatatcgctgatcgtggcctatgccaccgcccctggcccgaacagcgcccgggacgccaaagcctgcggtgtcgacccggcattcagcctgccgccactggcacctcgcacacggcccggcgaatggctggaatacagcccgctgttgatcatcctgatggtgctgctgggggtcggctggctgttcagcgagttttcgagcaaaccggcgatcaccgcaatctccgggctcaacacctacaattttctgttcatcatgctcggagcgttgctgcactggcgaccacgcagctttctcgatgccgtagcgcgggccgtgcccaccaccaccggcgtgttgattcaattcccgctttacggctcgatcgctgcgttactgaccacagtcaaaggcgctgatgcgcagaccctggcgcactacatctcgacattctttaccagcattgcctcccacgacacctacgcgattctgatgggcgtctattcggccattctgggcttcttcattccgtcgggcggcggcaagtggatcattgaagcgccttacgtgatgcaagtcgccaacgacctgcagtatcacctcggttgggcggtgcagatctacaatgcagccgaagcgctgcccaacctgatcaatccgttctacatgctgccgctgctgggcgtgctgggcctcaaggcacgtgacctgatcggtttctcgttcgtgcagttgctggtccacacgccgctggtgctgtttctgctctgggcattgggcactacgctggtctatacgccaccggtaatgccctga

SEQ ID NO: 20924 - protein, 474 aa, Pseudomonas syringae pv. phaseolicola 1448A
MAANANIEESRSARFALRCAAWAERWFPDSWVFAALAVVIVTLATLAIGARPAEAAKAFGDGFWSLIPFTMQMAFVVIGGYVVASSPPAVRLIDRLALVPRNGRSAVAWVALISMLASLLNWGLSLVFGGLLVRALARRTDLRMDYRAAGAAAYLGLGAVWALGLSSSAAQLQANPASLPPSILAITGVIPFTETIFLWQSGVMLAALVVISLIVAYATAPGPNSARDAKACGVDPAFSLPPLAPRTRPGEWLEYSPLLIILMVLLGVGWLFSEFSSKPAITAISGLNTYNFLFIMLGALLHWRPRSFLDAVARAVPTTTGVLIQFPLYGSIAALLTTVKGADAQTLAHYISTFFTSIASHDTYAILMGVYSAILGFFIPSGGGKWIIEAPYVMQVANDLQYHLGWAVQIYNAAEALPNLINPFYMLPLLGVLGLKARDLIGFSFVQLLVHTPLVLFLLWALGTTLVYTPPVMP

SEQ ID NO: 20925 - DNA, 1407 bp, Streptococcus pyogenes MGAS5005
  CDS (1)..(1407): transl_table=11
atgaataacatcaaaaccaaaaaaaggtttatggatcgctatattgatggctttatgaaatggatgccagaatcgctttttatctgttttattttaacctttttagtcgttactatgtctgtgttgatgacggatagtccctttattggtacggaaaagacgggcgggattatctatggctgggtaaatggtttttgggggctgttgtcctttgccatgcagatgactattttacttgcgacagggaatgctgtagcgagttctccacctgctcataagatgtttaagtcccttgccaaactgcctcaaaccaggactcagatttttatcttttccattgtagtaggctctatctttggctttttacactggggtcttggtatgatggttgctattgtgtttgggaaagagttgcttgttcaggctaggcaaaaagggattaaggtgcatacgcctttgtttgttgctactttattttttacctttttaccagctacttctggtctatctggtgctgcggtgctttattcggctactccagattatttgcgaaatagtgtcgcagatgcttataaacaggttgttcctgaaagtgttcctctgacagaatcagttttgaatcttccatttatcagtcttttagtggtgtgtatgctggaaccgctttgctttgctttattggcgcacccaaaagatgaaactaaaatcatggaacttgatgatgagatctatcaccatagtcttgataccgcttcacatgttgttattgcaagaaacacacctgctgaaaagatgaacgcatctcgcttagtgatgtatcttgttggtggggccattgttagctatagcctttatcatttttcggtggtgggcttgtctggtctagatctcaattgttttaactttttatttttaggcttaggcttgcttctttgtggtcaacaaggaccagaatattatggttccttattcaaagatggggtcatgtcatcttggggcttggtgcttcagtttccattttacgctggtatttttggaatcattcaaagtacaggtttaggattagagatttcccatttctttgtcgctatttcaaatgggacaacatggccggtctttgcttatctttactcggctttgctgaatattgcggtaccatcaggaggctcaaaatttgtgattgaagctccctatatcgtccctgcaactatcgaagttggtaatgacttaggtaagattttgcaggcttatcaattaggagatgccacaacaaacttgatagttcctttttgggccttatcttacctctcaaacttcaaactaaaattcaatcaaattgtggcttatactattccttgtgtcttggtggtcacaggtattgccatcatttacctatttgtattttag

SEQ ID NO: 20926 - protein, 468 aa, Streptococcus pyogenes MGAS5005
MNNIKTKKRFMDRYIDGFMKWMPESLFICFILTFLVVTMSVLMTDSPFIGTEKTGGIIYGWVNGFWGLLSFAMQMTILLATGNAVASSPPAHKMFKSLAKLPQTRTQIFIFSIVVGSIFGFLHWGLGMMVAIVFGKELLVQARQKGIKVHTPLFVATLFFTFLPATSGLSGAAVLYSATPDYLRNSVADAYKQVVPESVPLTESVLNLPFISLLVVCMLEPLCFALLAHPKDETKIMELDDEIYHHSLDTASHVVIARNTPAEKMNASRLVMYLVGGAIVSYSLYHFSVVGLSGLDLNCFNFLFLGLGLLLCGQQGPEYYGSLFKDGVMSSWGLVLQFPFYAGIFGIIQSTGLGLEISHFFVAISNGTTWPVFAYLYSALLNIAVPSGGSKFVIEAPYIVPATIEVGNDLGKILQAYQLGDATTNLIVPFWALSYLSNFKLKFNQIVAYTIPCVLVVTGIAIIYLFVF

SEQ ID NO: 20927 - DNA, 1449 bp, Ralstonia eutropha JMP134
  CDS (1)..(1449): transl_table=11
atgaaagagacaacaagcatggcattcccggatgccgggaagctgcaacaaggcggactggaacgccttgcgatacgggtgactgactggtccgagcggtggttcccggactcgtatatttttgcggccatcgccgtggtcgtggtggcgttgggcgcaatgttggtgggcgcgccagcgcaggccgtggcgaaggcctttggcgacggcttctggagcctgatccctttcaccatgcagatggcagtggtcgcgattgccggctacgtggtggcggtgtcgccgccggcagccatgctgatcaaccgtctggcagccttgccgcggacagcgcgcggtgccgtggctttcgtcgcgctcgtgagcctgtcgacgtcgctgctcaactgggcaatcagtttgatcttcagtggcttgctggtacgcgcaattgccaggcggcgcggcttccgtgtcgactacagggcagccagcgcggcagcctaccttggcatgggggcaacctgggcactgggactcagctcctccgccgcgcagctacaggcaaatgccgccagcctgcccaaatctctgctggatatcaccggggtcatcccgttctccgatacgatctttctttggcaatccatggcgatgaccgccgtattgatcgtcgtgtccctggcggtggcgtacttctcggcccctaccgaggcgcgtgctcgcacggcggccgatatgggggttgacctgaacgatgccgatgaagcggtcgcgcggccatctcggccaggtgaatggctggaatacagtccgatcctgacgttggttctggtcgccatgggcgcgagctggctctatcaggagttttcgaccaagaatccgattctcgccatctccaacctgaatacctacaacttcctgttcctgctgctcggcatgctgctgaactggcgtccgaagcgctttctgcgcgccgtcgcgaagtccgtgccgtccacggccggcgtcctgatccagtttccgctgtatggcggcattgcctttatcctgaccaaggcgaccggcggcaacggcgccccgctgtcgcaccatctggcgtcagcctttgtctccatggcgaccacggagtcgttctccgcggtcatgggagtgtattccgccgtgctcggcttcttcgtaccgtccggcggcggcaaatggatcatcgaagctccttacgtgatgcaggccgccaacgaactaaaggtacaccttggctgggcagtacaggtctacaacgccgctgaagcgctgccgaatttgatcaatcctttttggatgctgccgttgctcggtgtgctcggcatccgggccaaggacgtggtcggcttcaccttcacccagttgctggtgcatacgccgttagttctgctcatgttatgggctttcgccgcgacgctttcctaccatcctccggtgatgccctga

SEQ ID NO: 20928 - protein, 482 aa, Ralstonia eutropha JMP134
MKETTSMAFPDAGKLQQGGLERLAIRVTDWSERWFPDSYIFAAIAVVVVALGAMLVGAPAQAVAKAFGDGFWSLIPFTMQMAVVAIAGYVVAVSPPAAMLINRLAALPRTARGAVAFVALVSLSTSLLNWAISLIFSGLLVRAIARRRGFRVDYRAASAAAYLGMGATWALGLSSSAAQLQANAASLPKSLLDITGVIPFSDTIFLWQSMAMTAVLIVVSLAVAYFSAPTEARARTAADMGVDLNDADEAVARPSRPGEWLEYSPILTLVLVAMGASWLYQEFSTKNPILAISNLNTYNFLFLLLGMLLNWRPKRFLRAVAKSVPSTAGVLIQFPLYGGIAFILTKATGGNGAPLSHHLASAFVSMATTESFSAVMGVYSAVLGFFVPSGGGKWIIEAPYVMQAANELKVHLGWAVQVYNAAEALPNLINPFWMLPLLGVLGIRAKDVVGFTFTQLLVHTPLVLLMLWAFAATLSYHPPVMP

SEQ ID NO: 20929 - DNA, 1344 bp, Haemophilus somnus 2336
  CDS (1)..(1344)
atgattagccgtatttctcggtttatgacaactatcgttagtaagtatatgccagagccactggttttagcagtgctattgagtatcatcatcttcttttgggcactttggggcacagaacacagtacaggtgcattggttgagatgtggggtaatggtttttggaatttgcttgctttctcaatgcagatggcgatggtggtagtaactggtaatgctcttgcttcagctccacaaattcgtcgatttctttcaactgctgcatctattgcgaaaacaccaactcaaagcattatgcttgttacctttatgagttgtgttgcctgtgcaattaactgggggtttggcttggttgtgggagcaatgtttgcaaaagaagttgcacgccgtattaaaggtgtggactacgccttgctgattgcctgtgcatacattggctttatgacttggggaggtggcttttcaggctcaatgccactccaagcggcaacgccaaataacccaattgcacgttttatcacagatggaaattatgctgatggtattattcctgttactaaaacactattaaccagctataacatattcattattggtatgttaatcattacgttaccgtttctcactaaaatgatgcacccaaaagcagaaaatgtaaaaataattgatcctcgcttattacaagaagatccaaaattcagcaaaaagttaacagaatcttccactattgctgagaaaattgaagagagttgcattctggcttacattattgcagggacaggttttgcttatcttgcaatatattttgcgaaaaacggcttcaatttaacgatcaacaccgtaaatcttatctttttaatggctggtttagccttgcatggctcaccagctgcttatgttcgtgctattacccatgcagcacacagtacagcaggaatattaattcaatttccgttctatgctggtatgcagttaatgatggagcattccggtttaggtggcatgattacagaattttttgtaaatatttcaacgaaagacacctttccggtattaacctttttcagttcagcattagtgaattttgcagtaccgtctggcggtggtcactgggtagtgcaaggtccatttattattcccgcagcacaagaactgggtgcagatttaggcaaatcagtcatgggtattgcgtatggtgatatgtgggcgaatatggcacagccattttgggcattgcctgctttaggtatagcaggacttggtgtgcgtgacattatgggctactgcatgacagcattacttttcacagcaccaattttcgttattggactttatttcctttaa

SEQ ID NO: 20930 - protein, 447 aa, Haemophilus somnus 2336
MISRISRFMTTIVSKYMPEPLVLAVLLSIIIFFWALWGTEHSTGALVEMWGNGFWNLLAFSMQMAMVVVTGNALASAPQIRRFLSTAASIAKTPTQSIMLVTFMSCVACAINWGFGLVVGAMFAKEVARRIKGVDYALLIACAYIGFMTWGGGFSGSMPLQAATPNNPIARFITDGNYADGIIPVTKTLLTSYNIFIIGMLIITLPFLTKMMHPKAENVKIIDPRLLQEDPKFSKKLTESSTIAEKIEESCILAYIIAGTGFAYLAIYFAKNGFNLTINTVNLIFLMAGLALHGSPAAYVRAITHAAHSTAGILIQFPFYAGMQLMMEHSGLGGMITEFFVNISTKDTFPVLTFFSSALVNFAVPSGGGHWVVQGPFIIPAAQELGADLGKSVMGIAYGDMWANMAQPFWALPALGIAGLGVRDIMGYCMTALLFTAPIFVIGLYFL

SEQ ID NO: 20931 - DNA, 1326 bp, Fusobacterium nucleatum subsp. vincentii ATCC 49256
  CDS (1)..(1326): transl_table=11
gtgtgtttcgtgtatggaaagatggcttccagatccatttatattttgtgcttgttaacttttatagtgtttataggggctatatttcttacaaaagcaactcctttacaagtagttggattttgggctgatggtttttggtctttacttgctttctcaatgcaaatggcattagttttagttacagggcatactttggcaagttcaagattatttaaaaagatgttgtcaacatttgcttctggaataaagggacctaaacaagcaatacttattgtatcaatagtttcaggaatagcttgtgcattaaactggggttttggactagtaattggggctatttttgccaaagaaattgctaaaaaagtaaaaggagtggattatagacttcttatagcttcagcttatacagggttcttagtatggcatggaggattatcaggttctattccattacaacttgcaagtggtggagaaggattagcaaagcaaacagcaggtgctgtaacagaggctgttccaataagtcaaacattgttttcaccaatgaacatttttataattgtagggcttttaataatagtacctttattgaatatggcaatgtttccaagtaaggatgaagttgtagaagttgatccaaaattattagcagaaccaaaagaaattgtacttgatgtttctaaaatgactccagctgaaagaatagaaaatagcagagtagtttctatcttactttcaattatgggatttatatatataggatattatttaatgacaaaaggatttgcattaaatcttaatatagtaaactttatattcttattcttaggaattttattacatggaactccaagaagatatttgaatgcacttgcagaagcagtaaagggtgcagggggaatattattacaatttccattttatgcaggtattatgggaataatggtaggaatggatgctgatggaatatctcttgcaaagcttatgtctaatttctttgtaaatatttctactgaaagaacattcccagtattttcatttatcagtgcaggagttgtaaatttctttgttccatcaggtggaggacaatgggcagttcaagctccaatagtaatgccagcaggacaagcaataggagtaacagcagcaaaatctgctatggcaatagcttggggagatgcttggacaaatatgatacaaccattctgggctttaccagcattaggaattgcaggattaggtgctaaggatataatgggctattgtttaattgtaacagtggtatcaggattattcatttgcacaggtttcttattattctaa

SEQ ID NO: 20932 - protein, 441 aa, Fusobacterium nucleatum subsp. vincentii ATCC 49256
MCFVYGKMASRSIYILCLLTFIVFIGAIFLTKATPLQVVGFWADGFWSLLAFSMQMALVLVTGHTLASSRLFKKMLSTFASGIKGPKQAILIVSIVSGIACALNWGFGLVIGAIFAKEIAKKVKGVDYRLLIASAYTGFLVWHGGLSGSIPLQLASGGEGLAKQTAGAVTEAVPISQTLFSPMNIFIIVGLLIIVPLLNMAMFPSKDEVVEVDPKLLAEPKEIVLDVSKMTPAERIENSRVVSILLSIMGFIYIGYYLMTKGFALNLNIVNFIFLFLGILLHGTPRRYLNALAEAVKGAGGILLQFPFYAGIMGIMVGMDADGISLAKLMSNFFVNISTERTFPVFSFISAGVVNFFVPSGGGQWAVQAPIVMPAGQAIGVTAAKSAMAIAWGDAWTNMIQPFWALPALGIAGLGAKDIMGYCLIVTVVSGLFICTGFLLF

SEQ ID NO: 20933 - DNA, 1344 bp, Haemophilus influenzae R2866
  CDS (1)..(1344)
atgattagtcgtgtttctcgttttatggcgacattcgtcagtaaatacctgccagacccacttatttttgccgtgttactcacctttgtcacattcatttgtgcttggggattaaccgatagtacacctgttgatttagttaatatgtggggtaatggcttttggaatttacttggttttggtatgcaaatggcattaattgtcgtaactggtaatgctcttgcaacctcaccacaaattcgtaagtttctttctacaatcgcttcaatagcaaaaacaccggcacaaggtgttgtcttagttacgtttatgggttcaattgcctgtatcattaactggggcttcggtttggtcgttggtgcgatgtttgcaaaagaagtcgcgcggagaataaaaggcagtgactacgccttactgattgcctgtgcctatattgcatttatgacatggggtggaggtttttcaggctcaatgccacttttagccgcaacaccaggcaacccagttgctcatttaatggtgagcgaaagcaacccacaaggtattattcctgcagttagtacgcttttctctgggtacaatatttttatcacgttaagtttagtcatttgcttgcctttcattacctatatgatgatgcccaaaaatggcgaaacaaaaagtattgatccaaaacttattgcgcccgatccaacatttgataaaaaattggataaagatgcaacacttgctgaaaaaatggaagaaagccgcttcttagcctatacaatcggggcattaggatatagttacctcggtatgtatttctacaaaaacggattcaatctcacaattaataatgtaaaccttattttcttaatcacaggaattgtgcttcatggctcgccaatggcctatatgcgagcaattattaatgccacacgaagcacagcagggatcttagtgcaattcccattctatgcgggtgtgcaactaatgatggagcattcaggcttaggtggtttaatcaccgaattctttatcaatgttgctaacaaagattctttcccattattaaccttctttagttctgcctttattaactttgcagtgccttctggtggcggtcactgggtcatccaaggaccatttgttatccctgctgctcaagcattaggtgcagatctaggtaagtctacaatggcgattgcctatggtgagcaatggatgaacatggctcagccattttgggcattaccagcactgggtatcgcagggcttggcgtgagagatattatgggcttctgtatgaccgcacttatcttcaccgcaccaatttttattattggtttatatttcttatag

SEQ ID NO: 20934 - protein, 447 aa, Haemophilus influenzae R2866
MISRVSRFMATFVSKYLPDPLIFAVLLTFVTFICAWGLTDSTPVDLVNMWGNGFWNLLGFGMQMALIVVTGNALATSPQIRKFLSTIASIAKTPAQGVVLVTFMGSIACIINWGFGLVVGAMFAKEVARRIKGSDYALLIACAYIAFMTWGGGFSGSMPLLAATPGNPVAHLMVSESNPQGIIPAVSTLFSGYNIFITLSLVICLPFITYMMMPKNGETKSIDPKLIAPDPTFDKKLDKDATLAEKMEESRFLAYTIGALGYSYLGMYFYKNGFNLTINNVNLIFLITGIVLHGSPMAYMRAIINATRSTAGILVQFPFYAGVQLMMEHSGLGGLITEFFINVANKDSFPLLTFFSSAFINFAVPSGGGHWVIQGPFVIPAAQALGADLGKSTMAIAYGEQWMNMAQPFWALPALGIAGLGVRDIMGFCMTALIFTAPIFIIGLYFL

SEQ ID NO: 20935 - DNA, 1452 bp, Burkholderia cepacia R18194
  CDS (1)..(1452)
atgaaggatctgatggaagtgccgcacgttggtgcggcggcgacggaccgtgaaggggcgctcgagcggatggccgccggcgtggcgcgctggtcggagaagtggttcccggacgcttatattttcgccgcgattgccgtggtcgtcgtggcggcgggcgcgacggcaatcggcgcgccaatcaggcaggtcggtgtggcgttcggcgacggcttctggagtctcatcccgttcacgatgcagatggcgatcgttgccatttcgggttatgtcgtcgcggtatcgccacccgcgtcgaaactgatcggcgcgctcgcgcgctttccgtcgtccggacgggcggccgtggcgttcgttgcattcgtcagcatcgtcgcgtccctgttcaactgggcgatcagcctgatcttcagcggcctgctggttcgggcactggcgcgtcgcgccgatctccgcatggactaccgggcagcgggcgcggcggcttatctcggcatgggggcgacgtgggcgcttggattgagctcgtccgcatcgcaactgcaagcgaatccggacagcctgcccaagacgctgctcgccatctccggcgtcattcccttcgcggaaaccatcttcctgccgcagtcgatgttgatggccgccgtgctgacggtcgtgtcgctgctgattgcctggctgtccgcgcccggcggcacgcgtgcaaagacggcggcggagctcgggattccgctcgacgaggcccacgcgacgatcccgcgcccgactcgcccgggtgactggctcgagtacagcccgctcatcaccctcgcgatcgttgcgatcgggtcggtctgggtcgcgcacgaattcacgacgaaaaacccgatgatcgcgatttcgaacctgaacacgtacaacttcctgttcctgatgctgggcatgctgctgaactggcgaccgaggcgattcctcaatgccgtcgcgcgtgccgtgccatcggtcgcaggtgtactgatccagtttccgttgtacggcggcatcgcctacatcctgaccaaggcgtcggcgcctgccggactgccgctctccgatcatctcgcgcatttcttcgtcgcgctgtcgtcgcaatcgtcgtttcccgcggtgatgggggcgtactcggccgtcctcggattcttcgtgccgtccggcggcggcaagtggatcatcgaagcgccctacgtgatcgaggcggcaaaactgctgcacgtccatctgggctgggcggtgacggtctacaacgcggccgaggcattgccgaacctggtcaatccgttctggatgctgccgctcctcggtgtgctcgggctgcgcgcccgcgacatcgtgggattcacgttcacgcagctggcggtgcatcttccgctggtgattttcatgctctgggcgcttgcgagcacgctcagctaccatccgccagtcatgccgtga

SEQ ID NO: 20936 - protein, 483 aa, Burkholderia cepacia R18194
MKDLMEVPHVGAAATDREGALERMAAGVARWSEKWFPDAYIFAAIAVVVVAAGATAIGAPIRQVGVAFGDGFWSLIPFTMQMAIVAISGYVVAVSPPASKLIGALARFPSSGRAAVAFVAFVSIVASLFNWAISLIFSGLLVRALARRADLRMDYRAAGAAAYLGMGATWALGLSSSASQLQANPDSLPKTLLAISGVIPFAETIFLPQSMLMAAVLTVVSLLIAWLSAPGGTRAKTAAELGIPLDEAHATIPRPTRPGDWLEYSPLITLAIVAIGSVWVAHEFTTKNPMIAISNLNTYNFLFLMLGMLLNWRPRRFLNAVARAVPSVAGVLIQFPLYGGIAYILTKASAPAGLPLSDHLAHFFVALSSQSSFPAVMGAYSAVLGFFVPSGGGKWIIEAPYVIEAAKLLHVHLGWAVTVYNAAEALPNLVNPFWMLPLLGVLGLRARDIVGFTFTQLAVHLPLVIFMLWALASTLSYHPPVMP

SEQ ID NO: 20937 - DNA, 1290 bp, Burkholderia cepacia R18194
  CDS (1)..(1290)
atggtccaccgcgtgttgcccgacccgttgattttcgcgatcctgctgacggtcgtcgcgttcgcactcgcgttcggcctcacgccgaacacgcccgtgcagctcacgacgatgtggggttcgggtttctggaacctgctcgcgttctcgatgcagatggtgatgattctcgtcaccggccacgcactcgcgagttcgccgccggtgaagcgcatgctcgtcgcgctcgcgagcaccgcgcgcacgccggggcagggcgtgatgctcgtcgcgttcgtcggcgcgctcgcgtgcgcgatcaactggggcttcggcctcgtgctcggtgcgatgctcgcgcgcgaagtggcgcgccgtgtcgccggcagcgattaccggctgctcgttgcgtccgcgtacatgggcttcctgagctggcacggcggattgtcgggttcggtcccgctcgtcgcggccacgaagggcaatccgatggaaaagaccatcgggctgattcccgtgtcgcagacgatcttcaccggctacaacgcgttcatcacgatcggcctgatcgtgatgctgccgttcctcgcgcggatgatgatgccgaagccgggtgaggtcgtcagcgtcgatccggcgctgctggccgaaccgccgagcgtggagcgccagctcgggcccgacgcgacgttcgcggaacggctggaggaaagccgcttgctgtcggttctcgtcgcggcgctgtgcgcggcgttcctcgtgctgaagttcgtgcagaagggcttcgcgctcgacatcgacaccgtgaaccttgcgttcctcgcggccggcatcctgctgcaccgtacgccgatggcctatgcgcgcgcggtggccggtgcggcgcgcggcgcgtcggggatcatgatccagttcccgttctacgcgggcatccaggcgctgatggatcactcggggctcgcgggcgtgatcacgaaatggttcgtcgatatcgcgaacgtgcacacgttcccgctgctcgcgttcctgagctcggccgtgatcaatttcgcggtgccgtccggcggcggccactgggtcgtgcagggtccgttcgtgatgccggccgcccaggcgctcggcgccgatctcggcaaggccgcgatggcgatcgcgtatggcgaagcgtggaccaacatggcgcagccgttctgggcgctgcccgcgctggcgattgccgggctcggcgtgcgcgacatcatggggtattgcgtgacgacgctgctgttctcgggtgttgtgttcgtcgcggggatgtatctgttctga

SEQ ID NO: 20938 - protein, 429 aa, Burkholderia cepacia R18194
MVHRVLPDPLIFAILLTVVAFALAFGLTPNTPVQLTTMWGSGFWNLLAFSMQMVMILVTGHALASSPPVKRMLVALASTARTPGQGVMLVAFVGALACAINWGFGLVLGAMLAREVARRVAGSDYRLLVASAYMGFLSWHGGLSGSVPLVAATKGNPMEKTIGLIPVSQTIFTGYNAFITIGLIVMLPFLARMMMPKPGEVVSVDPALLAEPPSVERQLGPDATFAERLEESRLLSVLVAALCAAFLVLKFVQKGFALDIDTVNLAFLAAGILLHRTPMAYARAVAGAARGASGIMIQFPFYAGIQALMDHSGLAGVITKWFVDIANVHTFPLLAFLSSAVINFAVPSGGGHWVVQGPFVMPAAQALGADLGKAAMAIAYGEAWTNMAQPFWALPALAIAGLGVRDIMGYCVTTLLFSGVVFVAGMYLF

SEQ ID NO: 20939 - DNA, 1347 bp, Bacillus cereus G9241
  CDS (1)..(1347): transl_table=11
ttgtttcgttcctttacaaatggttgcgtcgccttagtgcaacgtttcttgccagagccgtttattttatcatgtttattaactgtttttgttatcttcttcggcatgtttgcaacgcatcaaacacctgtggaaatgattaatcattggggtaatggcatttggggactactcgccttttctatgcaaatggcacttgtacttgtgacaggatctgctttagcaaacgcgcctctcattaaaaaaggactaacgaaagcggcaaaactaccgaaaacgactggacaaggtattattgccatttcaatcgtaagtttacttggggcatacataaactggggatttggtattgttgtatctgttttatatgcaaaagaagtggcaaggcagctggaaggattagattatagactggcaattgcttcttcttactctggatttctcatttggcatgcggggctttctgcttctattcctcttacgttagcaactggcggtgaaacgttaattaaaacgacagcaggaagtataaaagaagcgattccaataacagaaacgttattctcaccatacgctctcgtgccagttattatttttctcgttacgatgcctctcattaataaagcgatgcatccagatgaaaaacatacgataacggtagatcctagtgtattccatgaagaagctgccgctcaagaagtaggaaacaatacgttcgctgagaaaatggaaaatagtatcatcattacactttgtgttggattgttaggtctcatttatatttccaattacttttatacgaaaggttttaaccttacgctagacatcgttatttttatgttattaattgctggacttatttttcaccgtactccgattcaatatattcgcgctttttcagactctacgaaaagtgcttctggtattttactccagtttccgttttatgctggaattatgggaatgatgattggagcaaatagtgacggactttcacttggaggagctatttcgaatttctttattagcatttcaaatgaaacgactttcccactctttacatttttaagtgctggcatcgttaatatttttgttccatctggtggcggtcaatgggctgtgcaagcccccattatgattccagctggagctgaacttggtgtacctgctgcaaaaacagcgatggccattgcttggggagatgcttggacgaatttaattcaaccattctgggcattaccggcattagcgatagcaggtttaggcgctcgtgatattatgggattttgcgttgtgaacttactatatgcaggatttatcataagtctatgtttcttatttatttaa

SEQ ID NO: 20940 - protein, 448 aa, Bacillus cereus G9241
MFRSFTNGCVALVQRFLPEPFILSCLLTVFVIFFGMFATHQTPVEMINHWGNGIWGLLAFSMQMALVLVTGSALANAPLIKKGLTKAAKLPKTTGQGIIAISIVSLLGAYINWGFGIVVSVLYAKEVARQLEGLDYRLAIASSYSGFLIWHAGLSASIPLTLATGGETLIKTTAGSIKEAIPITETLFSPYALVPVIIFLVTMPLINKAMHPDEKHTITVDPSVFHEEAAAQEVGNNTFAEKMENSIIITLCVGLLGLIYISNYFYTKGFNLTLDIVIFMLLIAGLIFHRTPIQYIRAFSDSTKSASGILLQFPFYAGIMGMMIGANSDGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLFI

SEQ ID NO: 20941 - DNA, 1332 bp, Pseudomonas fluorescens PfO-1
  CDS (1)..(1332)
atgttcgccgcactggcggtgatcatcgtcgcgctggcgaccctggccatgggcgccaaacccaccgacgccgccatggcgttcggggacggattctggagcctgatcccgttcaccatgcagatggcgttcgtggtgatcggtggttatgtcgtggccagttcgccgcccgccgtgaaactgatcgatcgcctggcgcggatcccgaagaacggtcgctctgccgtggcgtgggtcgcgctgatctcgatggtcgcgtccttgctcaactggggcctgtcgctggtgttcggcggtctgctggttcgcgccctcgcccgccgcaccgatctgaaaatggactatcgcgccgccggtgccgccgcctaccttggcctcggcgccgtgtgggcactgggactgtcgtcgtccgccgcgcagttgcaggccaacccggccagcctgccgccgtcgatcctgtcgatcaccggggtgattccgttcacccagacgattttcctctggcagtcgggcgtgatgctgctggcgctgatcgtgatttcgatcatcatcgcctacgccaccgcgcccggcccgaactcggcgcgtgacgccaaggcctgcggcatcgacccggccttcaacctgccaccgctgcaaccgcgcacccgccctggcgaatggctggaacacagcccgctgctgatcatcctgctggtgctgctggcggccggatggctgttccacgagttttcgaccaaacctgcgatcaccgcgatttccgggctcaacacctacaacttcctgttcatcatgctcggcgcgttgctgcactggcgcccgcgcagtttcctcgatgcggtgtcgcgcgccgtgccgaccaccaccggggtactgatccagttcccgctgtacggctcgattgccgcgctgatgaccacggtcaagggcaccgacgcccagaccctggcccatcacatctcgacgttcttcgtaagcatcgcttcccacgacacctatgcgttgctgatgggtgtgtactcggcgattctcggtttcttcattccgtccggcggcggcaaatggatcatcgaggcgccgtacgtaatgcaggtggccaacgatctcaactatcacctcggctgggcggtgcagatctacaacgccgcagaagccctgccgaatctgatcaacccgttttatatgctgccgctgctgggcgtgctggggctcaaggcgcgggatctgatcggtttttcgttcgtgcaattactggtgcacacgccgctggtattggtgctgctgtgggctctgggtacgacgctgtcgtatctgccgcccgtcatgccctaa

SEQ ID NO: 20942 - protein, 443 aa, Pseudomonas fluorescens PfO-1
MFAALAVIIVALATLAMGAKPTDAAMAFGDGFWSLIPFTMQMAFVVIGGYVVASSPPAVKLIDRLARIPKNGRSAVAWVALISMVASLLNWGLSLVFGGLLVRALARRTDLKMDYRAAGAAAYLGLGAVWALGLSSSAAQLQANPASLPPSILSITGVIPFTQTIFLWQSGVMLLALIVISIIIAYATAPGPNSARDAKACGIDPAFNLPPLQPRTRPGEWLEHSPLLIILLVLLAAGWLFHEFSTKPAITAISGLNTYNFLFIMLGALLHWRPRSFLDAVSRAVPTTTGVLIQFPLYGSIAALMTTVKGTDAQTLAHHISTFFVSIASHDTYALLMGVYSAILGFFIPSGGGKWIIEAPYVMQVANDLNYHLGWAVQIYNAAEALPNLINPFYMLPLLGVLGLKARDLIGFSFVQLLVHTPLVLVLLWALGTTLSYLPPVMP

SEQ ID NO: 20943 - DNA, 1434 bp, Rhodospirillum rubrum
  CDS (1)..(1434)
atggaaaccaccgcggaccaggaaagccgcggcaagaccggggttgaatcccaaggtcgtctggcgcatatggccttcgagttcacccgcatcgccgagaagtggtttcccgacgccttcgtcttcgtcgtcctgaccacccttgtcgtcaccgccgccgatctggccatcggcgcctcgcccttgcagatcgccaagggcttcggagcggggttctggacgctcattcccttcaccatgcagatggcgatggtcgccatcaccggctatgtggtcgccacctcgccgccctgcacccggctgatcaccaaattagccgccttcccgtcaacgccggccggcgccgtcgcctgggtggccttcatctcgatggcggcctcctatctcaactgggcgctcagtctagtgctgggtggtttgctcgtccgcgccctcgcccgccgcgtcgacctgaagatggactatcgcgccgccggagccgccgcctatatgggcctgggctcgacctgggcgctggggctcagttcgtcctcggccatgctgcaggccaatccgctgtccctgcccaagtcgatctccgacatcagcggcgtcattccgctcagccaaacgatcttcctgtggcagtcggtggttctgtatctcagcttgatgaccctggccgtcgtcgtcttctacttcgccgcgccgcgcggcaagcatgtgcgcaccgcccaggacatgggcgtggacgtctcgatcgagcccgagcccgcgcagaagcccaagcgccccggcgaatggctggaattcacccccgtcctgcccatcctcgtcgtcatcttgtcggtcggctacttctgggagcagttcagcagccagggcgtgctggtcacggtttccagcctcaacaactataacttcgccttcctgatgctcggcctgctgctgcaccgcaatatccgcagcttcctgaccgccgtcacccgggcggtgccgacctcggcgggcgtgctgatccagttcccgttctatggcgccatcgccgccatgctgaccggcgtgctgggatcggacgggatctcgatctcccaccacatctcggagctgttcgtcagcatcgccaccaccaacagcttcccgatcgtcatcggcatctattcggccatcctcggcttcctcatcccctcgggtggcggcaagtggatcatcgaggcgccctatgtgttgcaggcggccaaggacatccacgcccacatgggctgggcggttcaggtctacaacgcggccgaagccctgcccaatctgatcaaccccttctggatgctccccttgctcggcatcctcaagcttcaggcccgcgacatcgtcggcttctgcttcacccagctgatcttcagcgccccggtggtgatgctgttgctgtgggtttttgcccagactctcgcgccctga

SEQ ID NO: 20944 - protein, 477 aa, Rhodospirillum rubrum
METTADQESRGKTGVESQGRLAHMAFEFTRIAEKWFPDAFVFVVLTTLVVTAADLAIGASPLQIAKGFGAGFWTLIPFTMQMAMVAITGYVVATSPPCTRLITKLAAFPSTPAGAVAWVAFISMAASYLNWALSLVLGGLLVRALARRVDLKMDYRAAGAAAYMGLGSTWALGLSSSSAMLQANPLSLPKSISDISGVIPLSQTIFLWQSVVLYLSLMTLAVVVFYFAAPRGKHVRTAQDMGVDVSIEPEPAQKPKRPGEWLEFTPVLPILVVILSVGYFWEQFSSQGVLVTVSSLNNYNFAFLMLGLLLHRNIRSFLTAVTRAVPTSAGVLIQFPFYGAIAAMLTGVLGSDGISISHHISELFVSIATTNSFPIVIGIYSAILGFLIPSGGGKWIIEAPYVLQAAKDIHAHMGWAVQVYNAAEALPNLINPFWMLPLLGILKLQARDIVGFCFTQLIFSAPVVMLLLWVFAQTLAP

SEQ ID NO: 20945 - DNA, 1035 bp, Haemophilus influenzae 86-028NP
  CDS (1)..(1035)
atgattagtcgcgtttctcgttttatgacgacattcgtcagtaaatacctgccagacccacttatttttgccgtgttacgcacctttgtcacattcatttgtgcttggggattaaccgatagtacacctgttgatttagttaatatgtggggtaatggcttttggaatttacttggttttggtatgcaaatggcattaattgtcgtaactggtaatgctcttgcaacctcaccacaaattcgtaagtttctttctacaatcgcttcaatagcaaaaacaccagcacaaggtgttgtcttagttacgtttatgggttcaattgcctgtatcattaactggggcttcggtttggtcgttggtgcgatgtttgcaaaagaagtcgcgcggagaataaaaggcagtgactacgccttactgattgcctgcgcctatattgcatttatgacatggggtggaggtttttcaggctcaatgccacttttagccgcaacaccaggcaacccagttgctcatttaatggtgagcgaaagcaacccacaaggtattattcctgcagttagtacgcttttctctgggtacaatatttttatcacgttaagtttagtcatttgcttgcctttcattacctatatgatgatgcccaaaaatggcgaagcaaaaagtattgatccaaaacttattgcgcccgatccaacatttgataaaaaattggataaagatgcaacacttgctgaaaaaatggaagaaagccgcttcttagcctatacaatcggggcattaggatatagttacctcggtatgtatttctacaaaaacggattcaatctcacaattaataatgtaaaccttattttcttaatcacaggaattgtgcttcatggctcgccaatggcctatatgcgagcaattattaatgccacaagaagcacagcagggatcttagtgcaattcccattctatgcgggtgtgcaactaatgatggagcattcaggcttaggtggtttaatcacagaatttctttatcaatgttgctaa

SEQ ID NO: 20946 - protein, 344 aa, Haemophilus influenzae 86-028NP
MISRVSRFMTTFVSKYLPDPLIFAVLRTFVTFICAWGLTDSTPVDLVNMWGNGFWNLLGFGMQMALIVVTGNALATSPQIRKFLSTIASIAKTPAQGVVLVTFMGSIACIINWGFGLVVGAMFAKEVARRIKGSDYALLIACAYIAFMTWGGGFSGSMPLLAATPGNPVAHLMVSESNPQGIIPAVSTLFSGYNIFITLSLVICLPFITYMMMPKNGEAKSIDPKLIAPDPTFDKKLDKDATLAEKMEESRFLAYTIGALGYSYLGMYFYKNGFNLTINNVNLIFLITGIVLHGSPMAYMRAIINATRSTAGILVQFPFYAGVQLMMEHSGLGGLITEFLYQCC

SEQ ID NO: 20947 - DNA, 1431 bp, Ralstonia eutropha JMP134
  CDS (1)..(1431)
atggcattcccggatgccgggaagctgcaacaaggcggactggaacgccttgcgatacgggtgactgactggtccgagcggtggttcccggactcgtatatttttgcggccatcgccgtggtcgtggtggcgttgggcgcaatgttggtgggcgcgccagcgcaggccgtggcgaaggcctttggcgacggcttctggagcctgatccctttcaccatgcagatggcagtggtcgcgattgccggctacgtggtggcggtgtcgccgccggcagccatgctgatcaaccgtctggcagccttgccgcggacagcgcgcggtgccgtggctttcgtcgcgctcgtgagcctgtcgacgtcgctgctcaactgggcaatcagtttgatcttcagtggcttgctggtacgcgcaattgccaggcggcgcggcttccgtgtcgactacagggcagccagcgcggcagcctaccttggcatgggggcaacctgggcactgggactcagctcctccgccgcgcagctacaggcaaatgccgccagcctgcccaaatctctgctggatatcaccggggtcatcccgttctccgatacgatctttctttggcaatccatggcgatgaccgccgtattgatcgtcgtgtccctggcggtggcgtacttctcggcccctaccgaggcgcgtgctcgcacggcggccgatatgggggttgacctgaacgatgccgatgaagcggtcgcgcggccatctcggccaggtgaatggctggaatacagtccgatcctgacgttggttctggtcgccatgggcgcgagctggctctatcaggagttttcgaccaagaatccgattctcgccatctccaacctgaatacctacaacttcctgttcctgctgctcggcatgctgctgaactggcgtccgaagcgctttctgcgcgccgtcgcgaagtccgtgccgtccacggccggcgtcctgatccagtttccgctgtatggcggcattgcctttatcctgaccaaggcgaccggcggcaacggcgccccgctgtcgcaccatctggcgtcagcctttgtctccatggcgaccacggagtcgttctccgcggtcatgggagtgtattccgccgtgctcggcttcttcgtaccgtccggcggcggcaaatggatcatcgaagctccttacgtgatgcaggccgccaacgaactaaaggtacaccttggctgggcagtacaggtctacaacgccgctgaagcgctgccgaatttgatcaatcctttttggatgctgccgttgctcggtgtgctcggcatccgggccaaggacgtggtcggcttcaccttcacccagttgctggtgcatacgccgttagttctgctcatgttatgggctttcgccgcgacgctttcctaccatcctccggtgatgccctga

SEQ ID NO: 20948 - protein, 476 aa, Ralstonia eutropha JMP134
MAFPDAGKLQQGGLERLAIRVTDWSERWFPDSYIFAAIAVVVVALGAMLVGAPAQAVAKAFGDGFWSLIPFTMQMAVVAIAGYVVAVSPPAAMLINRLAALPRTARGAVAFVALVSLSTSLLNWAISLIFSGLLVRAIARRRGFRVDYRAASAAAYLGMGATWALGLSSSAAQLQANAASLPKSLLDITGVIPFSDTIFLWQSMAMTAVLIVVSLAVAYFSAPTEARARTAADMGVDLNDADEAVARPSRPGEWLEYSPILTLVLVAMGASWLYQEFSTKNPILAISNLNTYNFLFLLLGMLLNWRPKRFLRAVAKSVPSTAGVLIQFPLYGGIAFILTKATGGNGAPLSHHLASAFVSMATTESFSAVMGVYSAVLGFFVPSGGGKWIIEAPYVMQAANELKVHLGWAVQVYNAAEALPNLINPFWMLPLLGVLGIRAKDVVGFTFTQLLVHTPLVLLMLWAFAATLSYHPPVMP

SEQ ID NO: 20949 - DNA, 1380 bp, Brevibacterium linens BL2
  CDS (1)..(1380)
atgtcggcaccgaagccgtcgacccaggtcaacgccgcggcctcaaaagggttcatgcgtccgatcaaccgtttcctcgaacagtggattccgtcagcactgacgttcgccatcgttctcactctcatcgtcgccgtcctggcgttcatccttaccggggccagtcccgtcgacgttgtcaccggctggggtgagggactggccgggctcctcgagttcatgacccagatggccctcattctgttgctcggtcacatcctcgcgaacaccggacccgtgcagaagctgctgacatggctagcccgagttcccggcaacccggccttcgcctatgtcttcgtcttcgtcatcgccgcagtggcctgtctcatcacctggggcctcggcctcgtcgtcggcgctctgctgtctcgcgagatcgctgttcaggcccgcgagcgcgggtacaaggtccacttccctctcctcgtggccgccggctattcggggatggtcgtctggcacatggggtattcgggttcgggccccctgaccgcggcgacccctgattccttcctcgccgagtccttgggcggtgaggtcattcctgtcagcgagaccatcttctcgacctggaatctcctcgccatccttgccgtcatcgtcgtctgtgcgctcctgttcttcttcgttgcgccgaagaaggacgcgcccgtctacgaattgtccgactcggtcaattccgaatcgcgggcagccttcgacgaagatgtcgtcacgcccgccgaccgcatcgatgcttcgcgggtcctcacgctcatcatcggtctggcgctcgtgatctacctgatcatccacttcgcccagggtggtggactgacgctggacatcgtcaattggtcattcctcgcactcatcttcctgctcgtgaagaaccccttcgaactcatccacctgacgaaggaagccgcctcgaacgtcggcgagatcctgctgcagttccccctctacgcaggaattctgggcatcatgtccggcaccggcctcatcgcagtcttctccgacgctctcgtctcgatcgcgaacccgacgaccttcggcgtcctcgcgctgctctcggcaggactggtcaacttcttcgtcccttcaggcggcggccagttcgccgtccaggggccgatcatgctcgatgccgccaaccagctgggagtcgatccgtcgatcgcgatcatggcggtctcctacggtgaccagtggacgaacatgctccagcccttctgggctctgccggtgctggccatcgcgggactgaagatgcgtgacattctcggctacacctcggtgaccttcctcggatccggtgtcgtcatggctctggctctgttactcgtctcactgtga

SEQ ID NO: 20950 - protein, 459 aa, Brevibacterium linens BL2
MSAPKPSTQVNAAASKGFMRPINRFLEQWIPSALTFAIVLTLIVAVLAFILTGASPVDVVTGWGEGLAGLLEFMTQMALILLLGHILANTGPVQKLLTWLARVPGNPAFAYVFVFVIAAVACLITWGLGLVVGALLSREIAVQARERGYKVHFPLLVAAGYSGMVVWHMGYSGSGPLTAATPDSFLAESLGGEVIPVSETIFSTWNLLAILAVIVVCALLFFFVAPKKDAPVYELSDSVNSESRAAFDEDVVTPADRIDASRVLTLIIGLALVIYLIIHFAQGGGLTLDIVNWSFLALIFLLVKNPFELIHLTKEAASNVGEILLQFPLYAGILGIMSGTGLIAVFSDALVSIANPTTFGVLALLSAGLVNFFVPSGGGQFAVQGPIMLDAANQLGVDPSIAIMAVSYGDQWTNMLQPFWALPVLAIAGLKMRDILGYTSVTFLGSGVVMALALLLVSL

SEQ ID NO: 20951 - DNA, 1242 bp, Bacillus anthracis str. A2012
  CDS (1)..(1242): n means a or g or c or t/u, s means g or c
atgtttgcaacgcatcaaacacctgtggaaatgattaatcactggggtaatggcatttggggacttctcgccttttctatgcaaatggcacttgtactcgtgacaggatctgctttagcaaacgctcytcttattaaaaaaggattaatgaaagcggcaagactaccaaaaacaaatggacaaggtattattgccatttcaatcgtaagtttactaggggcatacataaactggggatttggtatwgttgtatctgttttatacgcaaaagaagtggcaagacaattagaaggattggattatagactagcaatcgcttcttcttactctggatttctcatttggcatgcggggctttctgcttctatccctcttacgttagcamcaggcggagaaacgttaatgaaaacgacagctggaagtattaaagaagcgattccaatcactgaaacgttattctcaccatatgctctcgttccagttattatctttttagttacgatgcctctcattaataaggcgatgcatccagatgcaaaacatacaataacagtagatcctagcgtattccatgaagaagctgccgctcaagaggcaggaaaaaatacgttcgcggaaaaaatggaaaatagcattattattacactttgcgttggattgttaggtctcatttatattttcaactacttttatacgaaaggctttaaccttacactcgatatcgttatttttatgttattaattgctggactcattttccaccgtactccaattcaatatattcgcgctttttcagattccacgaaaagtgcttctggtattttacttcaatttccgttttacgcaggaattatggggatgatgatcggagcaaatagtgaaggcctttcacttggaggagctatttcgaatttctttattagcatttcaaacgaaacaactttcccgctctttacttttttaagtgcgggcatcgttaatattttcgttccatctggtggcggtcaatgggctgtgcaagcacccattatgattccagctggcgctgaacttggtgtacctgctgcaaaaacagcaatggccattgcgtggggcgatgcttggacaaatttaattcaacctttctgggcattaccagcattagcgatagctggtttaggtgctcgtgatattatgggattttgcgttgtgaacttactatatgcaggatttatcataagtctatgtttcttatttatttaa

SEQ ID NO: 20952 - protein, 413 aa, Bacillus anthracis str. A2012
  Xaa in the positions 43 and 129 is unknown
MFATHQTPVEMINHWGNGIWGLLAFSMQMALVLVTGSALANAXLIKKGLMKAARLPKTNGQGIIAISIVSLLGAYINWGFGIVVSVLYAKEVARQLEGLDYRLAIASSYSGFLIWHAGLSASIPLTLAXGGETLMKTTAGSIKEAIPITETLFSPYALVPVIIFLVTMPLINKAMHPDAKHTITVDPSVFHEEAAAQEAGKNTFAEKMENSIIITLCVGLLGLIYIFNYFYTKGFNLTLDIVIFMLLIAGLIFHRTPIQYIRAFSDSTKSASGILLQFPFYAGIMGMMIGANSEGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLFI

SEQ ID NO: 20953 - DNA, 1440 bp, Azotobacter vinelandii AvOP
  CDS (1)..(1440): transl_table=11
atggcaacctgtgccgaagaccgtcgctacatcgaagaagacagtcgctatgcccgtttcgcaatcaattgttcgaactgggccgagcgctggtttcccgattcctgggtattcgccgtgctggcggtggtcgtcgtcgcgctggcggcgctggccatgggcgcgcgcccggccgagaccgccaaggccttcggcgacggtttctggagcctgatcccgttcaccatgcagatggccttcgtggtcatcggcggctacgtggtcgccagctcgccgccggcctcccggctgatcggcctgctcgcggccgtgccgaacaacggtcgctcggcggtctgctgggtggccctgatctcgatgctcgcctcgctgctgaactggggcctgagcctggtgttcggcggcttgctggtgcgcgcgctggcgcgccgcgaggagttgcgcatggactaccgggcggccggcgccgccgcctacctgggcctgggcgcggtgtgggcgctcggcctgtcgtcctcggcggcgcagttgcaggcgaatccgggcagcctgccgccttcgatcctgtcgatcaccggcgtcattcccttcaccgagaccatcttcctctggcagtccggcgtactgctggtggcgctcgtgctggtgtcgctgctggtcgcctatgtcaccgcgccgggcgccgccagcgcgcgcaccgcgcaggcctgcggggtcgacccgggcttcgcgccgccgccaccggcgcagcgcacgcgccccggcgagtggctggaatacagcccgctgctgatcatcctgctggttctgctcgccgccggctggctggcccaggagttcgccagcaagccggccatcgaggcgatttccgggctcaacacctacaacctgctgttcctgatgctcggcgcgctgcttcactggcggccgcgcagcttcctcgatgccgtggcgcgcgcggtgccggccaccgccggggtgctgatccagtttccgctgtacggttccatcgccgcgatcatgaccaaggtcgccggtggcgacggccagacccttacccatcacatttccacgctcttcgtgcaggtcgcctcgcacgacacctacgctctgctgatgggggtgtattcggccgtgctcgggttcttcattccgtcggggggcggcaagtggatcatcgaggcgccctacgtgatgcaggtcgccaacgaactgcgctaccacctgggctgggcggtgcagatctacaatgccgccgaggcgctgcccaacctgatcaacccgttctacatgctgcctctgctgggtgtgctgggactgaaggcgcgcgacgtgatcggcttttccttcgtccaactggtggtgcatgcgccgttggtgctggtacttctctgggcgttgggaacgacattggaataccgaccgccgcttgtgccctga

SEQ ID NO: 20954 - protein, 479 aa, Azotobacter vinelandii AvOP
MATCAEDRRYIEEDSRYARFAINCSNWAERWFPDSWVFAVLAVVVVALAALAMGARPAETAKAFGDGFWSLIPFTMQMAFVVIGGYVVASSPPASRLIGLLAAVPNNGRSAVCWVALISMLASLLNWGLSLVFGGLLVRALARREELRMDYRAAGAAAYLGLGAVWALGLSSSAAQLQANPGSLPPSILSITGVIPFTETIFLWQSGVLLVALVLVSLLVAYVTAPGAASARTAQACGVDPGFAPPPPAQRTRPGEWLEYSPLLIILLVLLAAGWLAQEFASKPAIEAISGLNTYNLLFLMLGALLHWRPRSFLDAVARAVPATAGVLIQFPLYGSIAAIMTKVAGGDGQTLTHHISTLFVQVASHDTYALLMGVYSAVLGFFIPSGGGKWIIEAPYVMQVANELRYHLGWAVQIYNAAEALPNLINPFYMLPLLGVLGLKARDVIGFSFVQLVVHAPLVLVLLWALGTTLEYRPPLVP

SEQ ID NO: 20955 - DNA, 1311 bp, Chromohalobacter salexigens DSM 3043
  CDS (1)..(1311): transl_table=11
atgctgaagctgctgtctcgccccgcggtacgcctggtcgaacgctacctgcccgatccttacatcttcgtgctgatcctgaccctggtggcggccatcgcggccatgctggtcgagcggcagtcgccactggcgatcatgcgctactggggagatggcttctggggactgctgtccttctcgatgcagatgctgctggtgctggtcactggcttcatgctggccagcagcccacccgtcaagcgcctgctcgacaggatcgcccggctcgccaagagcccggccggcgccatcgtgctggtgtcgctggtctcgctggccgccagctggatcaactggggcttcggcctggtcatcggcgccctgttcgccaaggccctcgcacgacaggtgcgtgtcgactaccgcctgttgatcgccagcgcctattcgggcttcgtggtatggcacggcggcctggccggctcgattcccttgaccatcgccaccgaagggcatttcacggcggaccagatcggtgtcattcccacctccgagaccatcttcgcgttcttcaacctggccatcgtgctggcgatgttcgtggccgtgccgctggtcaaccggttcatgcttcccgacgagcgtgacagcgtctacatcgaccccgcacaactcgacgacgccccgcgcgacctcggtcccgccacgcgtccggcggaacgcctggaaaagagctcctggctgtcatggctggtcggcattcccggcttgctgttcctgctcgaccatttcgtgttccgtgacggcggcctgaacctcaacgtggtcaatttcctgttcctgtccctggccatcgtgctgcatcgcacgccccgcagcctgctggacagcctccacgaggccatcaagggtggtaccggtatcgtcatccagtttcccttctacgccggcatcatggcgatcatcatgcagtccgggctggcacagacgctttccgaggggttcgtggcgatctccaccgcccagacgctgcctttctggtcattcatcagtgccggcatcgtcaacctgttcgtgccttcgggcggcgggcaatgggccgtccaggccccggtcatgctgcccgccgccgcctccctgggcgcggatatcccccgcgtcgccatggcggtcgcctggggcgatgcctggaccaacctgctgcagccgttctgggcgcttcccatgctcgccatcgcggggctcaaggccaaggacatcatgggcttctgcctgatccagctggtggtgacgggcgtcatcatcgcgctcgggctgacctttctgtga

SEQ ID NO: 20956 - protein, 436 aa, Chromohalobacter salexigens DSM 3043
MLKLLSRPAVRLVERYLPDPYIFVLILTLVAAIAAMLVERQSPLAIMRYWGDGFWGLLSFSMQMLLVLVTGFMLASSPPVKRLLDRIARLAKSPAGAIVLVSLVSLAASWINWGFGLVIGALFAKALARQVRVDYRLLIASAYSGFVVWHGGLAGSIPLTIATEGHFTADQIGVIPTSETIFAFFNLAIVLAMFVAVPLVNRFMLPDERDSVYIDPAQLDDAPRDLGPATRPAERLEKSSWLSWLVGIPGLLFLLDHFVFRDGGLNLNVVNFLFLSLAIVLHRTPRSLLDSLHEAIKGGTGIVIQFPFYAGIMAIIMQSGLAQTLSEGFVAISTAQTLPFWSFISAGIVNLFVPSGGGQWAVQAPVMLPAAASLGADIPRVAMAVAWGDAWTNLLQPFWALPMLAIAGLKAKDIMGFCLIQLVVTGVIIALGLTFL

SEQ ID NO: 20957 - DNA, 1356 bp, Shewanella baltica OS155
  CDS (1)..(1356): transl_table=11
atgttaaacaaagcggcaaaacctttggtcaaactcgtcgaccgatatctacccgatccctatattttcgtccttttactcaccttagtggtgttaattgcagctgtggtcgcagaacacaaaactccgctggaagtcatcaactattggggcgatggcttttggaccttgctgagtttttcgatgcagatgctgttagtgctggtggcgggattcatgctggcaagctcgccgccgattaaaaagctgctcgatgcgattgcaggatgcgctaaatcggcaccgcaagccattattttagtaaccttggtctcactggccgccagttgggttaactggggattcgggctagtggtgggcgcgttatttgccaaagccttagcgcgtaaagtgaaagtggattatcggctgctggtcgccagcgcctattctggctttgtggtttggcatggtgggcttgcgggttctatcccattaaccatagcaacggcggggcatttctccgaagcacaaattggcattatccccaccagtgaaaccattttcgcgagctttaacttattgttagtggcgattctgtttgtggtcatgcccttagtgaatcgctttatgttgcctgaagacaaggactgcatttatgtcgacccaagtgcccttgacgacaaaggcagcgaacccgcagcttcggcgctggagtttacccctgccaatgtgagtgagcgtcagcttgaaaaccgtcctgcggataagttagaaaatagccgcttactcggctggagcgtgggtggcgcagggcttgtgtacttaggctattacttttgggtacagggcggcagcttaaaccttaacttagtgaacttcttattcttgttcctcgccatcctcttacaccaaacgccacgcagtttattaaccagcttgaatgaggccattaagggcggcgcagggattgtgatccaattccctttctatgcgggcattatggcggtgatggtgcagtcgggtttagcccaaagtatttcggaaggttttgtggccatagccagtgccgagagcctgccattttggagctttattagcgcgggaattgtaaatatttttgtgccatcgggaggcggtcaatgggccgtgcaggcgccgattatgttacccgctgccgaagccttgggtgccgatgttgctcgggtggctatggccgtagcttggggtgatgcctggactaacctaattcaacctttctgggcactgcccgtgctggcaattgcgggcttaaaagcacgggatattatgggtttttgtttaatgcagctgatgatcacaggcgtgattatcagtatcgcgttgagctggttttaa

SEQ ID NO: 20958 - protein, 451 aa, Shewanella baltica OS155
MLNKAAKPLVKLVDRYLPDPYIFVLLLTLVVLIAAVVAEHKTPLEVINYWGDGFWTLLSFSMQMLLVLVAGFMLASSPPIKKLLDAIAGCAKSAPQAIILVTLVSLAASWVNWGFGLVVGALFAKALARKVKVDYRLLVASAYSGFVVWHGGLAGSIPLTIATAGHFSEAQIGIIPTSETIFASFNLLLVAILFVVMPLVNRFMLPEDKDCIYVDPSALDDKGSEPAASALEFTPANVSERQLENRPADKLENSRLLGWSVGGAGLVYLGYYFWVQGGSLNLNLVNFLFLFLAILLHQTPRSLLTSLNEAIKGGAGIVIQFPFYAGIMAVMVQSGLAQSISEGFVAIASAESLPFWSFISAGIVNIFVPSGGGQWAVQAPIMLPAAEALGADVARVAMAVAWGDAWTNLIQPFWALPVLAIAGLKARDIMGFCLMQLMITGVIISIALSWF

SEQ ID NO: 20959 - DNA, 1338 bp, Ralstonia metallidurans CH34
  CDS (1)..(1338): transl_table=11
ttgagtaaggtcgccgggttctttactgaactgatgcgccggtatttgccggacccctttgtattcgccatcggcctgacgttgctgacgatggtcatggcaatgctggtagaaggacaggccgcccaggcggtcatcacgaactggggcaaggggttctggaacctgctctcgttcaccacccagatggcggtgattctggcgatgggctacgtgctggccaccgcgccgctggtcgaccgcttcctcaatgccatcgtcgcccgcgtgcagacgccgcgcggcgccatcatcgtggccacactggtcggcggtatcggcagctacctgaactggggcttcggcctggtgatcggcggcatcatcgcccgcaagctggcgctgaaggtcaagggcgtgcattaccccctgatcatcgcctcggcctacagcggcttcacgatgtatggcctgggcctgtctgccagcatcccggtactgatctccaccccgggccacccgatggaaaagctgatgggcgtgatcggtctcaaggagacgatcttctccacaccgatgctgctgacgagccttgccgtcatcgtcacgctgccgctgctcaacgcgatgctgcacccgcgtgacgccaaggaagtggtggaaatccgcgaggagaacagctccgaggaccgcgccgccgggcacggccacagcatgggcatcgagaacacgcttgccacgcgcatgaacaacagccgcctgctgagcctgatcatcggcctgtgcgggctggcctacgcgggtctgcatttctcgcagggtggttcgctggacctgaacctgatcaacttcctgatcctgtttatcggcgtgctgttgctgggcaccccggccaactacgtggccaagctgaacgaaggcatcaagacgatctccggcatcatcctgcagtatccgttctacgcaggcatcatggcggtcatggccggctccgggctggtggacagcatctcgcgcgtgttcgtcgatatcgccacgccgcagacgctgccgttctggggtctggtcagctcgttcgtgatcaacttcttcgcgccgtccggcggtggccactgggtgatccagggtccgttcatgatcgacgcggccaaggccatcaacagctcggtggcgcagacgtcgatgtcggtcatgctcggcaacgcctggaatgacctggtgcagccgttctggattctgccggcgctggcgctgtcgaagctgaagctcaaggacgtgatgggctacaccgtgatcatgatgttctgggtcggcgcgatctatatcgtcgccatgctggcctggggcgcgcagatctga

SEQ ID NO: 20960 - protein, 445 aa, Ralstonia metallidurans CH34
MSKVAGFFTELMRRYLPDPFVFAIGLTLLTMVMAMLVEGQAAQAVITNWGKGFWNLLSFTTQMAVILAMGYVLATAPLVDRFLNAIVARVQTPRGAIIVATLVGGIGSYLNWGFGLVIGGIIARKLALKVKGVHYPLIIASAYSGFTMYGLGLSASIPVLISTPGHPMEKLMGVIGLKETIFSTPMLLTSLAVIVTLPLLNAMLHPRDAKEVVEIREENSSEDRAAGHGHSMGIENTLATRMNNSRLLSLIIGLCGLAYAGLHFSQGGSLDLNLINFLILFIGVLLLGTPANYVAKLNEGIKTISGIILQYPFYAGIMAVMAGSGLVDSISRVFVDIATPQTLPFWGLVSSFVINFFAPSGGGHWVIQGPFMIDAAKAINSSVAQTSMSVMLGNAWNDLVQPFWILPALALSKLKLKDVMGYTVIMMFWVGAIYIVAMLAWGAQI

SEQ ID NO: 20961 - DNA, 1395 bp, Rubrobacter xylanophilus DSM 9941
  CDS (1)..(1395): transl_table=11
atgcaggagcggctcagcgccccgcgcagcttcgggggaaacagggtgaccggcttcttcgtcgggctcgccgagaggtacctgccggacgcctacctcttcgcggtcgtgctcaccctcatagccggcctgctcacggccatcttcgtcacggcggacatcttcgtgttggtggacgcctggtacaacgggatgtggaacatcctcaccttcgccctgcagatggcgctcatcctgctcaccggctacaccgtggcccgctcgcggcccgtctcgcggctgctcgactggatagcctccaagcccaagaaccaggggcaggcgctcgccttcatcatcgtcgtctcctccgtcgccagcctcatcaactggggcttcgggctggtcgtcgccgcgatcatggcccgctacatcggcaagcggctggagaacgtggactacgccatcctggtctccgccgggtacgccgggttcatcgtgtgggccagcggcctctcctcctccatagccctcgccgtctccacccccggcagcgaggccaacataacccagcaggtcaccgggcaggtgctggacttcggccggaccatcctcacctggtggaacatcgtccccgtggtgctcatcgtcgtgctgctcgtccccctgtactggtggatgatgcccaagcggcccgagcacatgcgcaaggtcgaccgcgccctgctcgcccgcgaggacgaggaggccgggcgggcggagaccccggacaccccggccggcaggctggagcgcttctggcccctcaacctcgcgatagccggcgccatcttcctctacttcgggcatcagctcgccgccggcgagttcgtcttcgacttcaacgccgtcatcgcgctgtttctggctgtcggcctgatcctccactggacccccatctcctacgtccggtccttcaccggcagcgcgggggccatgggccccatagccctccagtacccgctctacggcggcatccaggggctcatggtgctcaccgtgggcgggatcagcctcgccgggaccatcgccgactggttcctggccttctccaacgagtacaccttcgccttctggaccttcgtctcctccaacgtcatcagcctcttcatcccctccggcggcgggcactgggtggtgcaggggccggtgatggtcccggcggccgagaggctcggcgtggaccaggggctgaccgcgatggcggtggcctggggggaggggacggcgaacatggtgcagcccttctgggcgctccccattctgggcatcgtgggcctcgggatccgggacatcatgggctacggggtcttcaccctcgggctgagcttcgcgatctacggggccttcaccctcatagcccccttcttcctgtag

SEQ ID NO: 20962 - protein, 464 aa, Rubrobacter xylanophilus DSM 9941
MQERLSAPRSFGGNRVTGFFVGLAERYLPDAYLFAVVLTLIAGLLTAIFVTADIFVLVDAWYNGMWNILTFALQMALILLTGYTVARSRPVSRLLDWIASKPKNQGQALAFIIVVSSVASLINWGFGLVVAAIMARYIGKRLENVDYAILVSAGYAGFIVWASGLSSSIALAVSTPGSEANITQQVTGQVLDFGRTILTWWNIVPVVLIVVLLVPLYWWMMPKRPEHMRKVDRALLAREDEEAGRAETPDTPAGRLERFWPLNLAIAGAIFLYFGHQLAAGEFVFDFNAVIALFLAVGLILHWTPISYVRSFTGSAGAMGPIALQYPLYGGIQGLMVLTVGGISLAGTIADWFLAFSNEYTFAFWTFVSSNVISLFIPSGGGHWVVQGPVMVPAAERLGVDQGLTAMAVAWGEGTANMVQPFWALPILGIVGLGIRDIMGYGVFTLGLSFAIYGAFTLIAPFFL

SEQ ID NO: 20963 - DNA, 1320 bp, Psychrobacter cryohalolentis K5
  CDS (1)..(1320): transl_table=11
atgaaagggattacccgtttttcgaatagcttaatggagaagtatttaccggatccatttttgttcgttattatcttaacagtggttatttttgtactgggtttaggattaactgattcttcaccggtacaaatggtggcgttttggggtgaaggtttttgggcattactcgcattctcaatgcagatggtgttggtattagtcacaggttttgtattggcaagcagtccgatatttaaaaaaggtttaggaaggctggcaagtttagcaaaatcgccgggcagtgccattatcttggtaactttagtatcccttgcagcaagctggatcaactggggatttgggttggtgattggagcattattcgccaaagaattggcaaagcgtgtagagaatgtcgattaccgtttattgattgccagtgcttattctggttttattatttggcatgctgggttttcgggttccattccgttatccattgcgacagcaggtcatccgttcgctgataagattggtgttattccaaccagtgaaacgatttttgccagctataacttaattattgtggctgcattgattgtcatcgttcctttactcaaccgtttgatgatgccaaaaacagaagatacggtgacggtagatccgagacttctggttgaaccaattgatgaagtgctgccagcaaaatcggatatgacaccagcagagcgtttagaaaacagctggattttgtcaatggttatcggtatgttgggcattgcttttatcgtctattattttgtgcaaaatggctttgccttgacactagatttggtcaactttatgtttttgttcctcggaattatctttcacggaacgcctcgtaagtatttgattgccgttcaagaagcggtcaaaggcgccggtgctattattgtccagtttccgttttatgcaggaatcatgggtatgatgacagcgtcaggcttggcaggcgtgatgtcagaagcattcgtcaatatttcgtcagctgagacattaccacttttcgccttcttaagcgcaggactggttaacttctttgttccttcaggtggcggacagtgggcagtgcaagcacccattatgttagaggcggcagagatgctgggcagcgatcctgcaaaggttgctatggcagttgcatggggtgatgcatggacaaatatgattcagccattttgggcattgccagccttggcaattgcgggactcaaagccaaagatatcatgggtttttgtgtcattgtcctgattgttagtggtgttgtgattggtttagggctattgtttttataa

SEQ ID NO: 20964 - protein, 439 aa, Psychrobacter cryohalolentis K5
MKGITRFSNSLMEKYLPDPFLFVIILTVVIFVLGLGLTDSSPVQMVAFWGEGFWALLAFSMQMVLVLVTGFVLASSPIFKKGLGRLASLAKSPGSAIILVTLVSLAASWINWGFGLVIGALFAKELAKRVENVDYRLLIASAYSGFIIWHAGFSGSIPLSIATAGHPFADKIGVIPTSETIFASYNLIIVAALIVIVPLLNRLMMPKTEDTVTVDPRLLVEPIDEVLPAKSDMTPAERLENSWILSMVIGMLGIAFIVYYFVQNGFALTLDLVNFMFLFLGIIFHGTPRKYLIAVQEAVKGAGAIIVQFPFYAGIMGMMTASGLAGVMSEAFVNISSAETLPLFAFLSAGLVNFFVPSGGGQWAVQAPIMLEAAEMLGSDPAKVAMAVAWGDAWTNMIQPFWALPALAIAGLKAKDIMGFCVIVLIVSGVVIGLGLLFL

SEQ ID NO: 20965 - DNA, 1353 bp, Burkholderia ambifaria AMMD
  CDS (1)..(1353): transl_table=11
atgtccgtatcaggaaacgaggagctcaagttggtccaacgcatttcccgctttttcacgcaggtggtccaccgcgtgctgcccgacccgttgattttcgcgatcctgctgacgatcgtcacgttcgcgctcgccttcggtctcacgccgaccacgccggtgcaactcacgacgatgtggggttcaggcttctggaacctgctcgcgttttcgatgcagatggtgatgatcctcgtcaccggccacgcgctcgcgagttcgccgccggtgcgccgcctgctcgttgcgctcgcaagcaccgcgcgcacgccggggcagggcgtgatgctcgtcgcgttcgtcggcgcgctcgcctgcgcgatcaactggggcttcggcctcgtgctcggcgcgatgcttgcgcgcgaagtcgcgcgccgcgtcgccggcagcgactaccggctgctcgtcgcatccgcgtacatgggtttcctgagctggcacggtgggctgtcgggttcggtcccgctcgtcgccgcgacgaagggcaatccgatggaaaagaccatcgggctgattcccgtgtcggacacgatcttcaccggctacaacgcgttcatcacgatcgggctgatcgtgatgctgccgtttctcgcgcggatgatgatgccgaagccgggcgacgtcgtcagcgtcgatccggcgctgctcgcggaaccgccgagcgtcgagcgccagctcgggcccgacgcgacgttcgcggaacggatggaagagagccgcgcgctgtcggtcgtcgttgcggcgctgtgcgcggcgttcctcgtgctgcgtttcatgcagaagggcttcgcgctcgacatcgacaccgtgaacctcgcgttcctcgcggccggcatcctgctgcaccgtacgccgatggcctatgcgcgcgcggtggccggcgcggcgcgcggcgcatcggggatcatgatccagtttcccttttacgcgggcatccaggcgctgatggatcactcggggctcgcgggcgtgatcacgaagtggttcgtcgatatcgcgaacgtgcacacgttcccgctgctcgcgttcctcagttcggccgtgatcaatttcgcggtgccgtcgggcggcggccactgggtcgtgcagggcccgtttgtgatgccggccgcgcaggcgctcggtgccgatctcggcaaggccgcgatggcgatcgcctacggcgaggcgtggaccaacatggcgcagccgttctgggcgctgcccgccctcgcgatcgccgggctcggcgtgcgcgacatcatggggtactgcgtgacgacgctgttgttctcgggcgtggtgttcgtcgcagggatgtatctgttctga

SEQ ID NO: 20966 - protein, 450 aa, Burkholderia ambifaria AMMD
MSVSGNEELKLVQRISRFFTQVVHRVLPDPLIFAILLTIVTFALAFGLTPTTPVQLTTMWGSGFWNLLAFSMQMVMILVTGHALASSPPVRRLLVALASTARTPGQGVMLVAFVGALACAINWGFGLVLGAMLAREVARRVAGSDYRLLVASAYMGFLSWHGGLSGSVPLVAATKGNPMEKTIGLIPVSDTIFTGYNAFITIGLIVMLPFLARMMMPKPGDVVSVDPALLAEPPSVERQLGPDATFAERMEESRALSVVVAALCAAFLVLRFMQKGFALDIDTVNLAFLAAGILLHRTPMAYARAVAGAARGASGIMIQFPFYAGIQALMDHSGLAGVITKWFVDIANVHTFPLLAFLSSAVINFAVPSGGGHWVVQGPFVMPAAQALGADLGKAAMAIAYGEAWTNMAQPFWALPALAIAGLGVRDIMGYCVTTLLFSGVVFVAGMYLF

SEQ ID NO: 20967 - DNA, 1344 bp, Bacillus cereus
  CDS (1)..(1344): transl_table=11
ttgtttcgttcttttacaaatggttgcgtcaccttagtgcaacgtttcttgccagaaccgtttattttatcatgtttattaactgtttttgttatcttcttcggcatgtttgcaactcaccaaacaccggtcgaaatgattaatcattggggtaatggcatttggggacttctcgccttttctatgcaaatggcactagtacttgtcactggatctgctttagcgaacgctcctcttattaaaaaggggttaacgaaagctgccaggctaccgaaaacgaatggccaaggtattattgccatttcaattgtaagtttacttggtgcatacataaactggggatttggtattgttgtatctgttttatatgcaaaagaagttgcaagacaacttgaaggattagattacagattagcaattgcttcttcttactctggacttctcatttggcatgcgggtctttctgcttctatccctcttacgttagctactggcggtgaaacgttaattaaaacgacagctggaagtattaaagaagtgattccaataacagaaacgttattctcaccatacgctctcgttccagttattatctttctcattacgatgccactcattaaccgggcaatgcatcccgatgaaaaacatacggtaacagtagatcctagcgtatttcatgaagaagctgctgctatagaagtagagccaaaaacagtcgctgaaaaaatggaaaatagcatcattattacactttgcgttgggttattaggtctcatttatattttcaattacttttatacgaaaggttttaaccttacactcgatatcgttatttttatgttattaattgctggtcttatttttcaccggactccgattcaatatattcgtgcattttcagactctacaaaaagtgcttctggcattctacttcagtttccgttttacgcaggaattatgggtatgatgattggagtaaatagtgaaggtctttctcttggaggagctatttctaatttctttattagtatttcaaacgaaacgactttcccgctctttacttttttaagtgctggcatcgttaatatttttgttccatctggtggcggtcaatgggctgtacaggcacccattatgattccagctggtgctgaacttggtgtacctgctgcaaaaacagcaatggcaattgcgtggggcgatgcttggacgaatttaattcaacctttctgggcattaccagcgttagcgatagctggtttaggtgctcgtgatattatgggattttgcgttgtgaacttactatatgcaggatttatcattagtttatgcttcttattttag

SEQ ID NO: 20968 - protein, 447 aa, Bacillus cereus
MFRSFTNGCVTLVQRFLPEPFILSCLLTVFVIFFGMFATHQTPVEMINHWGNGIWGLLAFSMQMALVLVTGSALANAPLIKKGLTKAARLPKTNGQGIIAISIVSLLGAYINWGFGIVVSVLYAKEVARQLEGLDYRLAIASSYSGLLIWHAGLSASIPLTLATGGETLIKTTAGSIKEVIPITETLFSPYALVPVIIFLITMPLINRAMHPDEKHTVTVDPSVFHEEAAAIEVEPKTVAEKMENSIIITLCVGLLGLIYIFNYFYTKGFNLTLDIVIFMLLIAGLIFHRTPIQYIRAFSDSTKSASGILLQFPFYAGIMGMMIGVNSEGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLF

SEQ ID NO: 20969 - DNA, 1341 bp, Alcaligenes eutrophus
  CDS (1)..(1341): transl_table=11
atgagcaagattgccgggttcttcaccgaactcatgcgccggtacctgccggatccctttgtatttgccatcggcctgaccttgctgacgatggcgctggcggtgacggtgcaagggcaggcagcgccggccgtgatcgccagctggggcaaggggttctggaacctgctggcatttaccacgcagatggcggtgatcctggcgatgggctacgtgctggccaccgcgccgttcactgaccgcatgctcgaccgcatcgtcagtgccgtgcactcgccgcgcaccgcggtgatcgtcgccacgctggtgggcggcatcggcagctacctgaactggggcttcgggctggtgatcggcggcatcatcgccaggaagctggcgctgaaggtccgtggcgtgcattacccgctcatcatcgccgccgcgtacagcggcttcaccctgtacgggctgggcctgtcggccagcatcccggtgctgatctccaccccgggccacccgatggaaaagctgatgggcgtgatcccgctgtctgaaaccatcttctccacgccgatgctgctgaccagcctggcggtgatcgtcacgctgccgctgctcaatgcctggctgcatccgcgcaacccggccgatgtggtggagatccgccgcgaccaggaacccgccaaggccgaggccggctcggcccacagcatgggcggcgagaacaccctggccgcgcgcctgaacaacagccgtatcctgagcctggccatcggcctgtgcggcatggcctacgcggtcatctacttcacgcagggcggctcgctcgacctgaacctgatcaacttcctgatcctgttcgcgggcgtgctgctgctgggcacgccggtcaactacgtggccaagctgaacgaaggcatcaagaccatttccggcatcatcctgcagtatccgttctatgcaggcatcatggcgatcatggccggctcggggctggtggataccatctcgcgtgtgttcgtggagatcgccacgccgcagacgctgccgttctgggggctgctcagttcgttcgtgatcaacttcttcgcaccgtcgggcggtggccactggatgatccagggcccgttcatggtcgatgcggccaaggccatcaacagctcggtcagccagacctcgatgtcggtgatgctcggcaatgcctggaacgacctggtgcagccgttctggatattgccggcgctggcgctgtccaggctgaacctgaaggacgtgatgggctacaccgtgatcatgatgttctgggtgggcctgatctacattgccgcgctgctgctgtggggcgcgcagattgcctga

SEQ ID NO: 20970 - protein, 446 aa, Alcaligenes eutrophus
MSKIAGFFTELMRRYLPDPFVFAIGLTLLTMALAVTVQGQAAPAVIASWGKGFWNLLAFTTQMAVILAMGYVLATAPFTDRMLDRIVSAVHSPRTAVIVATLVGGIGSYLNWGFGLVIGGIIARKLALKVRGVHYPLIIAAAYSGFTLYGLGLSASIPVLISTPGHPMEKLMGVIPLSETIFSTPMLLTSLAVIVTLPLLNAWLHPRNPADVVEIRRDQEPAKAEAGSAHSMGGENTLAARLNNSRILSLAIGLCGMAYAVIYFTQGGSLDLNLINFLILFAGVLLLGTPVNYVAKLNEGIKTISGIILQYPFYAGIMAIMAGSGLVDTISRVFVEIATPQTLPFWGLLSSFVINFFAPSGGGHWMIQGPFMVDAAKAINSSVSQTSMSVMLGNAWNDLVQPFWILPALALSRLNLKDVMGYTVIMMFWVGLIYIAALLLWGAQIA

SEQ ID NO: 20971 - DNA, 1239 bp, Aeropyrum pernix
  CDS (1)..(1239): transl_table=11
gtgggctcattgggggacgagtctaggcgtcccttcctagaggctttcggcgaggcgctggagcgaagggtcaggggcgtcatgccagaccccttcatcttcgccatactccttacattcatagcaatagtgctcgacctcatcctcctgaggcccatacagcatgtggggctggggggtactgtcaagtttctagtctacagtgcatggtacggcggcttctggaagctcctgaccttcagcatgcagatgacccttatactggtgacgggctacgttatagcctaccacccactcgtatacagggttctctccaggatagccggcctacctagggacacgaagcaggcagccgtcctcgccgcagccgtcgccatagcactctcatacctcagctggggcctgagcctgataggcggggccatactggccagggagatagggaggcaggccgccttccgcggaaggaagatccactatccagtagtggtcgtcgctgcatacagcggcctagggctaacatggcactggggtctcacggcaagcgccccgctgctcatgaacactcccggccacttcctggccaacgttgtgaaggagctctacggcgtcgagacaataccgctctcacagacgattttccacccctacactatcataaacttcctgctgataaccctggcagcactggcgatatactggctcataagcccctcccgagggcccgtcagggggatagaggagttcgaccccgacgccctcaaggaagaggctgcgcccgctggtgagaagcccaggatcgagaccctggcggacaggcttgagaactccaggacactggccatactcaccgtcatactgggtttcacggcggttgcaatagagctgtatacacggggcataagcagggcgctcaacctcaacaccatgaacttcatcttcctaatgacaggactcctgctctacgccaaccccatgagctacgcaagggccttctacaggagcgtctcatcggccgcgggcgtcatactacagttccacttctacgccggcatcttcggcctcctaaacacgcccttcgagcctctcggcaagagctcggcccagatcatcgcagaaggcctggccgacgtttcaacacccttcatatggccggtagtggccttcctaaccgcgggcatagtgaacctcttcataccaagcgggggcggcgagtgggctgcgataggagaatactag

SEQ ID NO: 20972 - protein, 412 aa, Aeropyrum pernix
MGSLGDESRRPFLEAFGEALERRVRGVMPDPFIFAILLTFIAIVLDLILLRPIQHVGLGGTVKFLVYSAWYGGFWKLLTFSMQMTLILVTGYVIAYHPLVYRVLSRIAGLPRDTKQAAVLAAAVAIALSYLSWGLSLIGGAILAREIGRQAAFRGRKIHYPVVVVAAYSGLGLTWHWGLTASAPLLMNTPGHFLANVVKELYGVETIPLSQTIFHPYTIINFLLITLAALAIYWLISPSRGPVRGIEEFDPDALKEEAAPAGEKPRIETLADRLENSRTLAILTVILGFTAVAIELYTRGISRALNLNTMNFIFLMTGLLLYANPMSYARAFYRSVSSAAGVILQFHFYAGIFGLLNTPFEPLGKSSAQIIAEGLADVSTPFIWPVVAFLTAGIVNLFIPSGGGEWAAIGEY

SEQ ID NO: 20973 - DNA, 1344 bp, Haemophilus influenzae
  CDS (1)..(1344): transl_table=11
atgattagtcgcgtttctcgttttatgacgacattcgtcagtaaatacctgccagacccacttatttttgccgtgttactcacctttgtcacattcatttgtgcttggggattaaccgatagtacacctgttgatttagttaatatgtggggtaatggcttttggaatttacttggttttggtatgcaaatggcattaattgtcgtaactggtaatgctcttgcaacctcaccacaaattcgtaagtttctttctacaatcgcttcaatcgcaaaaacaccagcacaaggtgttgtcttagttacgtttatgggttcaattgcctgtatcattaactggggcttcggtttggtcgttggtgcgatgtttgcaaaagaagtcgcgcggagaataaaaggcagtgactacgccttactgattgcctgtgcctatattgcatttatgacatggggtggaggtttttcaggctcaatgccacttttagccgcaacaccaggcaacccagttgctcatttaatgatgagcgaaagcaacccacaaggtattattcctgcagttagtacgcttttctctgggtacaatatttttatcacgttaagtttagtcatttgcttgcctttcattacctatatgatgatgcccaaaaatggcgaaacaaaaagtattgatccaaaacttattgcgcccgatccaacatttgataaaaaattggataaagatgcaacacttgctgaaaaaatggaagaaagccgcttcttagcctatacaatcggggcattaggatatagttacctcggtatgtatttctacaaaaacggattcaatctcacaattaataatgtaaaccttattttcttaatcacaggaattgtgcttcatggctcgccaatggcctatatgcgagcaattattaatgccacacgaagcacagcagggatcttagtgcaattcccattctatgcgggtgtgcaactaatgatggagcattcaggcttaggtggtttaatcaccgaattctttatcaatgttgctaacaaagattctttcccattattaaccttctttagttctgcctttattaactttgcagttccttctggtggcggtcactgggtcatccaaggaccatttgttatccctgctgctcaagcattaggtgcagatctaggtaagtctacaatggcgattgcctatggtgagcaatggatgaacatggctcagccattttgggcattaccagcactgggtatcgcagggcttggcgtgagagatattatgggcttctgtatgaccgcacttatcttcaccgcaccaatttttattattggtttatatttcttatag

SEQ ID NO: 20974 - protein, 447 aa, Haemophilus influenzae
MISRVSRFMTTFVSKYLPDPLIFAVLLTFVTFICAWGLTDSTPVDLVNMWGNGFWNLLGFGMQMALIVVTGNALATSPQIRKFLSTIASIAKTPAQGVVLVTFMGSIACIINWGFGLVVGAMFAKEVARRIKGSDYALLIACAYIAFMTWGGGFSGSMPLLAATPGNPVAHLMMSESNPQGIIPAVSTLFSGYNIFITLSLVICLPFITYMMMPKNGETKSIDPKLIAPDPTFDKKLDKDATLAEKMEESRFLAYTIGALGYSYLGMYFYKNGFNLTINNVNLIFLITGIVLHGSPMAYMRAIINATRSTAGILVQFPFYAGVQLMMEHSGLGGLITEFFINVANKDSFPLLTFFSSAFINFAVPSGGGHWVIQGPFVIPAAQALGADLGKSTMAIAYGEQWMNMAQPFWALPALGIAGLGVRDIMGFCMTALIFTAPIFIIGLYFL

SEQ ID NO: 20975 - DNA, 24 bp, Artificial sequence
  (1)..(24): primer
atgattggtcgcatatcgcgtttt

SEQ ID NO: 20976 - DNA, 26 bp, Artificial sequence
  (1)..(26): primer
ttagaacagcgttaaaccaatgacga

SEQ ID NO: 20977 - protein, 465 aa, Artificial sequence
  Variant (3)..(3): xaa in position 3 is any amino acid
  Variant (6)..(7): xaa in position 6 to 7 is any amino acid
  Variant (9)..(11): xaa in position 9 to 11 is any amino acid
  Variant (13)..(15): xaa in position 13 to 15 is any amino acid
  Variant (17)..(34): xaa in position 17 to 34 is any amino acid
  Variant (35)..(44): xaa in position 35 to 44 is any or no amino acid
  Variant (47)..(47): xaa in position 47 is any amino acid
  Variant (51)..(51): xaa in position 51 is any amino acid
  Variant (54)..(54): xaa in position 54 is any amino acid
  Variant (56)..(56): xaa in position 56 is any amino acid
  Variant (60)..(60): xaa in position 60 is any amino acid
  Variant (65)..(65): xaa in position 65 is any amino acid
  Variant (67)..(68): xaa in position 67 to 68 is any amino acid
  Variant (71)..(71): xaa in position 71 is any amino acid
  Variant (74)..(76): xaa in position 74 to 76 is any amino acid
  Variant (78)..(78): xaa in position 78 is any amino acid
  Variant (80)..(81): xaa in position 80 to 81 is any amino acid
  Variant (84)..(91): xaa in position 84 to 91 is any amino acid
  Variant (94)..(95): xaa in position 94 to 95 is any amino acid
  Variant (97)..(98): xaa in position 97 to 98 is any amino acid
  Variant (100)..(101): xaa in position 100 to 101 is any amino acid
  Variant (103)..(105): xaa in position 103 to 105 is any amino acid
  Variant (110)..(111): xaa in position 110 to 111 is any amino acid
  Variant (114)..(115): xaa in position 114 to 115 is any amino acid
  Variant (118)..(119): xaa in position 118 to 119 is any amino acid
  Variant (121)..(121): xaa in position 121 is any amino acid
  Variant (125)..(127): xaa in position 125 to 127 is any amino acid
  Variant (128)..(132): xaa in position 128 to 132 is any or no amino acid
  Variant (134)..(134): xaa in position 134 is any amino acid
  Variant (136)..(139): xaa in position 136 to 139 is any amino acid
  Variant (144)..(144): xaa in position 144 is any amino acid
  Variant (146)..(148): xaa in position 146 to 148 is any amino acid
  Variant (149)..(149): xaa in position 149 is any or no amino acid
  Variant (151)..(152): xaa in position 151 to 152 is any amino acid
  Variant (156)..(156): xaa in position 156 is any amino acid
  Variant (158)..(162): xaa in position 158 to 162 is any amino acid
  Variant (164)..(175): xaa in position 164 to 175 is any amino acid
  Variant (176)..(183): xaa in position 176 to 183 is any or no amino acid
  Variant (186)..(188): xaa in position 186 to 188 is any amino acid
  Variant (192)..(195): xaa in position 192 to 195 is any amino acid
  Variant (197)..(203): xaa in position 197 to 203 is any amino acid
  Variant (205)..(208): xaa in position 205 to 208 is any amino acid
  Variant (210)..(214): xaa in position 210 to 214 is any amino acid
  Variant (216)..(241): xaa in position 216 to 241 is any amino acid
  Variant (242)..(256): xaa in position 242 to 256 is any or no amino acid
  Variant (259)..(259): xaa in position 259 is any amino acid
  Variant (262)..(262): xaa in position 262 is any amino acid
  Variant (264)..(265): xaa in position 264 to 265 is any amino acid
  Variant (267)..(269): xaa in position 267 to 269 is any amino acid
  Variant (271)..(273): xaa in position 271 to 273 is any amino acid
  Variant (275)..(276): xaa in position 275 to 276 is any amino acid
  Variant (279)..(281): xaa in position 279 to 281 is any amino acid
  Variant (283)..(289): xaa in position 283 to 289 is any amino acid
  Variant (290)..(293): xaa in position 290 to 293 is any or no amino acid
  Variant (295)..(297): xaa in position 295 to 297 is any amino acid
  Variant (299)..(299): xaa in position 299 is any amino acid
  Variant (303)..(304): xaa in position 303 to 304 is any amino acid
  Variant (310)..(311): xaa in position 310 to 311 is any amino acid
  Variant (312)..(313): xaa in position 312 to 313 is any or no amino acid
  Variant (315)..(316): xaa in position 315 to 316 is any amino acid
  Variant (319)..(319): xaa in position 319 is any amino acid
  Variant (321)..(323): xaa in position 321 to 323 is any amino acid
  Variant (325)..(329): xaa in position 325 to 329 is any amino acid
  Variant (337)..(337): xaa in position 337 is any amino acid
  Variant (342)..(343): xaa in position 342 to 343 is any amino acid
  Variant (346)..(349): xaa in position 346 to 349 is any amino acid
  Variant (350)..(356): xaa in position 350 to 356 is any or no amino acid
  Variant (358)..(360): xaa in position 358 to 360 is any amino acid
  Variant (363)..(364): xaa in position 363 to 364 is any amino acid
  Variant (367)..(367): xaa in position 367 is any amino acid
  Variant (370)..(372): xaa in position 370 to 372 is any amino acid
  Variant (373)..(373): xaa in position 373 is any or no amino acid
  Variant (375)..(380): xaa in position 375 to 380 is any amino acid
  Variant (382)..(382): xaa in position 382 is any amino acid
  Variant (387)..(389): xaa in position 387 to 389 is any amino acid
  Variant (396)..(396): xaa in position 396 is any amino acid
  Variant (398)..(398): xaa in position 398 is any amino acid
  Variant (400)..(400): xaa in position 400 is any amino acid
  Variant (403)..(403): xaa in position 403 is any amino acid
  Variant (406)..(406): xaa in position 406 is any amino acid
  Variant (409)..(410): xaa in position 409 to 410 is any amino acid
  Variant (412)..(415): xaa in position 412 to 415 is any amino acid
  Variant (417)..(424): xaa in position 417 to 424 is any amino acid
  Variant (427)..(429): xaa in position 427 to 429 is any amino acid
  Variant (437)..(437): xaa in position 437 is any amino acid
  Variant (440)..(440): xaa in position 440 is any amino acid
  Variant (444)..(445): xaa in position 444 to 445 is any amino acid
  Variant (447)..(448): xaa in position 447 to 448 is any amino acid
  Variant (455)..(458): xaa in position 455 to 458 is any amino acid
  Variant (461)..(464): xaa in position 461 to 464 is any amino acid
RWXPDXXIXXXLXXXVXXXXXXXXXXXXXXXXXXXXXXXXXXXXWGXGFWXLLXFXMQMXLVLVXGXXLAXSPXXXKXLXXLAXXXXXXXXAIXXVXXVXXLXXXINWGXXLVXXALXXKXLARXXXXXXXXVXYXXXXAAAYXGXXXXWXXGLSXSXXXXXAXXXXXXXXXXXXXXXXXXXXIPXXXTIFXXXXLXXXXXXXVXXXXIXXXXXPXXXXXXXXXXXXXXXXXXXXXXXXXXXXXXXXXXXXXXXXXAEXLEXSXXLXXXIXXXGXXYLXXXFXXXXXXXXXXXLXXXNXLFLXXGILLHXXXXPXXYLXAXXXAXXXXXGILLQFPXYAGIXXIMXXXXXXXXXXXLXXXISXXFVXIAXXXXTXXXXXXLXSAIVXXXVPSGGGXWXIXAPXVIXAAXXLXXXXGXXXXXXXXGDXXXNLIQPFWXLPXLAIXXLXXRDIMGFXXXXLLXXXXI

SEQ ID NO: 20978 - protein, 36 aa, Artificial sequence
  Variant (2)..(2): xaa in position 2 is any amino acid
  Variant (3)..(3): xaa in position 3 is any or no amino acid
  Variant (5)..(5): xaa in position 5 is any amino acid
  Variant (7)..(7): xaa in position 7 is Ile or Leu
  Variant (8)..(8): xaa in position 8 is any amino acid
  Variant (10)..(10): xaa in position 10 is Ala, Gly, Ser or Thr
  Variant (14)..(14): xaa in position 14 is any amino acid
  Variant (15)..(15): xaa in position 15 is Phe, Ile, Leu, Met or Val
  Variant (16)..(16): xaa in position 16 is Ile, Leu or Val
  Variant (17)..(17): xaa in position 17 is Ala, Ile, Leu or Val
  Variant (18)..(18): xaa in position 18 is Ala, Ile or Val
  Variant (19)..(19): xaa in position 19 is any amino acid
  Variant (21)..(22): xaa in position 21 to 22 is any amino acid
  Variant (23)..(23): xaa in position 23 is Ile, Leu or Val
  Variant (25)..(32): xaa in position 25 to 32 is any amino acid
  Variant (33)..(35): xaa in position 33 to 35 is any or no amino acid
GXXWXLXXFXMQMXXXXXXGXXXAXXXXXXXXXXXL

SEQ ID NO: 20979 - protein, 29 aa, Artificial sequence
  Variant (2)..(2): xaa in position 2 is any amino acid
  Variant (3)..(3): xaa in position 3 is Ala, Leu or Val
  Variant (4)..(4): xaa in position 4 is Ala, Ile, Leu or Val
  Variant (5)..(5): xaa in position 5 is any amino acid
  Variant (6)..(6): xaa in position 6 is Ala or Val
  Variant (7)..(7): xaa in position 7 is Ala, Cys or Ser
  Variant (8)..(8): xaa in position 8 is Ala, Gly or Ser
  Variant (10)..(10): xaa in position 10 is any amino acid
  Variant (12)..(15): xaa in position 12 to 15 is any amino acid
  Variant (16)..(18): xaa in position 16 to 18 is any or no amino acid
  Variant (20)..(20): xaa in position 20 is Phe, Leu or Met
  Variant (21)..(21): xaa in position 21 is Ala, Gly, Ser or Thr
  Variant (22)..(22): xaa in position 22 is Ala, Gly or Ser
  Variant (24)..(24): xaa in position 24 is any amino acid
  Variant (25)..(25): xaa in position 25 is Ala, Pro or Ser
  Variant (26)..(28): xaa in position 26 to 28 is any amino acid
  Variant (29)..(29): xaa in position 29 is Ala, Asn, Ser or Thr
YXXXXXXXYXGXXXXXXXGXXXSXXXXXX

SEQ ID NO: 20980 - protein, 48 aa, Artificial sequence
  Variant (2)..(2): xaa in position 2 is Phe or Leu
  Variant (3)..(3): xaa in position 3 is any amino acid
  Variant (4)..(4): xaa in position 4 is Phe, Ile or Leu
  Variant (5)..(7): xaa in position 5 to 7 is any amino acid
  Variant (8)..(8): xaa in position 8 is Ala, Gly or Ile
  Variant (9)..(10): xaa in position 9 to 10 is any amino acid
  Variant (12)..(14): xaa in position 12 to 14 is any amino acid
  Variant (15)..(21): xaa in position 15 to 21 is any or no amino acid
  Variant (23)..(28): xaa in position 23 to 28 is any amino acid
  Variant (29)..(29): xaa in position 29 is Phe, Ile, Leu or Val
  Variant (30)..(31): xaa in position 30 to 31 is any amino acid
  Variant (32)..(32): xaa in position 32 is Ala, Gly or Ser
  Variant (33)..(34): xaa in position 33 to 34 is any amino acid
  Variant (35)..(35): xaa in position 35 is Ala, Gly, Ser or Thr
  Variant (36)..(37): xaa in position 36 to 37 is any amino acid
  Variant (39)..(39): xaa in position 39 is Ile, Leu or Val
  Variant (40)..(40): xaa in position 40 is Ile, Leu, Met or Val
  Variant (41)..(41): xaa in position 41 is Ile, Leu or Val
  Variant (43)..(43): xaa in position 43 is Phe or Tyr
  Variant (45)..(45): xaa in position 45 is Phe or Leu
  Variant (47)..(47): xaa in position 47 is Ala or Gly
  Variant (48)..(48): xaa in position 48 is Gly or Ser
NXXXXXXXXXLXXXXXXXXXXPXXXXXXXXXXXXXXXGXXXQXPXYXX

SEQ ID NO: 20981 - protein, 52 aa, Artificial sequence
  Variant (5)..(5): xaa in position 5 is Gly or Ser
  Variant (6)..(6): xaa in position 6 is any amino acid
  Variant (7)..(7): xaa in position 7 is Phe or Trp
  Variant (8)..(8): xaa in position 8 is Ala, Ile or Val
  Variant (9)..(9): xaa in position 9 is Ile or Val
  Variant (10)..(10): xaa in position 10 is any amino acid
  Variant (11)..(11): xaa in position 11 is Ala, Gly or Ser
  Variant (13)..(16): xaa in position 13 to 16 is any amino acid
  Variant (17)..(17): xaa in position 17 is any or no amino acid
  Variant (19)..(39): xaa in position 19 to 39 is any amino acid
  Variant (40)..(40): xaa in position 40 is any or no amino acid
  Variant (42)..(42): xaa in position 42 is Leu or Met
  Variant (43)..(43): xaa in position 43 is Ala, Ile, Leu or Val
  Variant (44)..(44): xaa in position 44 is any amino acid
  Variant (47)..(47): xaa in position 47 is Phe, Trp or Tyr
  Variant (48)..(48): xaa in position 48 is any amino acid
  Variant (50)..(50): xaa in position 50 is Pro or Ser
  Variant (51)..(51): xaa in position 51 is any amino acid
PSGGXXXXXXXPXXXXXAXXXXXXXXXXXXXXXXXXXXXXNXXXPFXXLXXL

SEQ ID NO: 20982 - DNA, 1185 bp, Saccharomyces cerevisiae; identical to SEQ ID NO: 19013
  CDS (1)..(1185)

SEQ ID NO: 20983 - protein, 394 aa, Saccharomyces cerevisiae; identical to SEQ ID NO: 19014

SEQ ID NO: 20984 - DNA, 1362 bp, Saccharomyces cerevisiae; identical to SEQ ID NO: 19015
  CDS (1)..(1362)

SEQ ID NO: 20985 - protein, 453 aa, Saccharomyces cerevisiae; identical to SEQ ID NO: 19016

SEQ ID NO: 20986 - DNA, 1338 bp, Saccharomyces cerevisiae; identical to SEQ ID NO: 19017
  CDS (1)..(1338)

SEQ ID NO: 20987 - protein, 445 aa, Saccharomyces cerevisiae; identical to SEQ ID NO: 19018

SEQ ID NO: 20988 - DNA, 1287 bp, Schizosaccharomyces pombe; identical to SEQ ID NO: 19019
  CDS (1)..(1287)

SEQ ID NO: 20989 - protein, 428 aa, Schizosaccharomyces pombe; identical to SEQ ID NO: 19020

SEQ ID NO: 20990 - DNA, 1621 bp, Arabidopsis thaliana; identical to SEQ ID NO: 19021
  CDS (86)..(1342)

SEQ ID NO: 20991 - protein, 418 aa, Arabidopsis thaliana; identical to SEQ ID NO: 19022

SEQ ID NO: 20992 - DNA, 1068 bp, Caenorhabditis elegans; identical to SEQ ID NO: 19023
  CDS (1)..(1068)

SEQ ID NO: 20993 - protein, 355 aa, Caenorhabditis elegans; identical to SEQ ID NO: 19024

SEQ ID NO: 20994 - DNA, 1152 bp, Oryza sativa; identical to SEQ ID NO: 19025
  CDS (1)..(1152)

SEQ ID NO: 20995 - protein, 383 aa, Oryza sativa; identical to SEQ ID NO: 19026

SEQ ID NO: 20996 - DNA, 1485 bp, Debaryomyces hansenii CBS767; identical to SEQ ID NO: 19027
  CDS (1)..(1485)

SEQ ID NO: 20997 - protein, 494 aa, Debaryomyces hansenii CBS767; identical to SEQ ID NO: 19028

SEQ ID NO: 20998 - DNA, 1329 bp, Debaryomyces hansenii CBS767; identical to SEQ ID NO: 19029
  CDS (1)..(1329)

SEQ ID NO: 20999 - protein, 442 aa, Debaryomyces hansenii CBS767; identical to SEQ ID NO: 19030

SEQ ID NO: 21000 - DNA, 1413 bp, Debaryomyces hansenii CBS767; identical to SEQ ID NO: 19031
  CDS (1)..(1413)

SEQ ID NO: 21001 - protein, 470 aa, Debaryomyces hansenii CBS767; identical to SEQ ID NO: 19032

SEQ ID NO: 21002 - DNA, 1404 bp, Debaryomyces hansenii CBS767; identical to SEQ ID NO: 19033
  CDS (1)..(1404)

SEQ ID NO: 21003 - protein, 467 aa, Debaryomyces hansenii CBS767; identical to SEQ ID NO: 19034

SEQ ID NO: 21004 - DNA, 1260 bp, Yarrowia lipolytica CLIB99; identical to SEQ ID NO: 19035
  CDS (1)..(1260)

SEQ ID NO: 21005 - protein, 419 aa, Yarrowia lipolytica CLIB99; identical to SEQ ID NO: 19036

SEQ ID NO: 21006 - DNA, 1470 bp, Yarrowia lipolytica CLIB99; identical to SEQ ID NO: 19037
  CDS (1)..(1470)

SEQ ID NO: 21007 - protein, 489 aa, Yarrowia lipolytica CLIB99; identical to SEQ ID NO: 19038

SEQ ID NO: 21008 - DNA, 1230 bp, Kluyveromyces lactis NRRL Y; identical to SEQ ID NO: 19039
  CDS (1)..(1230)

SEQ ID NO: 21009 - protein, 409 aa, Kluyveromyces lactis NRRL Y; identical to SEQ ID NO: 19040

SEQ ID NO: 21010 - DNA, 1086 bp, Xenopus laevis; identical to SEQ ID NO: 19041
  CDS (1)..(1086)

SEQ ID NO: 21011 - protein, 361 aa, Xenopus laevis; identical to SEQ ID NO: 19042

SEQ ID NO: 21012 - DNA, 1161 bp, Candida glabrata CBS138; identical to SEQ ID NO: 19043
  CDS (1)..(1161)

SEQ ID NO: 21013 - protein, 386 aa, Candida glabrata CBS138; identical to SEQ ID NO: 19044

SEQ ID NO: 21014 - DNA, 1356 bp, Candida glabrata CBS138; identical to SEQ ID NO: 19045
  CDS (1)..(1356)

SEQ ID NO: 21015 - protein, 451 aa, Candida glabrata CBS138; identical to SEQ ID NO: 19046

SEQ ID NO: 21016 - DNA, 1272 bp, Candida glabrata CBS138; identical to SEQ ID NO: 19047
  CDS (1)..(1272)

SEQ ID NO: 21017 - protein, 423 aa, Candida glabrata CBS138; identical to SEQ ID NO: 19048

SEQ ID NO: 21018 - DNA, 1155 bp, Ashbya gossypii; identical to SEQ ID NO: 19049
  CDS (1)..(1155)

SEQ ID NO: 21019 - protein, 384 aa, Ashbya gossypii; identical to SEQ ID NO: 19050

SEQ ID NO: 21020 - DNA, 1602 bp, Neurospora crassa; identical to SEQ ID NO: 19051
  CDS (1)..(1602)

SEQ ID NO: 21021 - protein, 533 aa, Neurospora crassa; identical to SEQ ID NO: 19052

SEQ ID NO: 21022 - DNA, 1080 bp, Caenorhabditis elegans; identical to SEQ ID NO: 19053
  CDS (1)..(1080)

SEQ ID NO: 21023 - protein, 359 aa, Caenorhabditis elegans; identical to SEQ ID NO: 19054

SEQ ID NO: 21024 - DNA, 1029 bp, Mus musculus; identical to SEQ ID NO: 19055
  CDS (1)..(1029)

SEQ ID NO: 21025 - protein, 342 aa, Mus musculus; identical to SEQ ID NO: 19056

SEQ ID NO: 21026 - DNA, 1029 bp, Homo sapiens; identical to SEQ ID NO: 19057
  CDS (1)..(1029)

SEQ ID NO: 21027 - protein, 342 aa, Homo sapiens; identical to SEQ ID NO: 19058

SEQ ID NO: 21028 - DNA, 1328 bp, Homo sapiens; identical to SEQ ID NO: 19059
  CDS (7)..(1056)

SEQ ID NO: 21029 - protein, 349 aa, Homo sapiens; identical to SEQ ID NO: 19060

SEQ ID NO: 21030 - DNA, 25 bp, Artificial sequence
  (1)..(25): primer
atgtggacaaacactttcaaatggt

SEQ ID NO: 21031 - DNA, 25 bp, Artificial sequence
  (1)..(25): primer
ttactttgacaggaacgagactaaa

SEQ ID NO: 21032 - protein, 474 aa, Artificial sequence; identical to SEQ ID NO: 19063
  Variant (9)..(12): xaa in position 9 to 12 is any amino acid
  Variant (14)..(19): xaa in position 14 to 19 is any amino acid
  Variant (21)..(29): xaa in position 21 to 29 is any amino acid
  Variant (30)..(35): xaa in position 30 to 35 is any or no amino acid
  Variant (38)..(38): xaa in position 38 is any amino acid
  Variant (40)..(40): xaa in position 40 is any amino acid
  Variant (42)..(42): xaa in position 42 is any amino acid
  Variant (44)..(55): xaa in position 44 to 55 is any amino acid
  Variant (56)..(108): xaa in position 56 to 108 is any or no amino acid
  Variant (110)..(111): xaa in position 110 to 111 is any amino acid
  Variant (114)..(115): xaa in position 114 to 115 is any amino acid
  Variant (118)..(118): xaa in position 118 is any amino acid
  Variant (121)..(124): xaa in position 121 to 124 is any amino acid
  Variant (126)..(129): xaa in position 126 to 129 is any amino acid
  Variant (130)..(134): xaa in position 130 to 134 is any or no amino acid
  Variant (140)..(140): xaa in position 140 is any amino acid
  Variant (145)..(147): xaa in position 145 to 147 is any amino acid
  Variant (149)..(149): xaa in position 149 is any amino acid
  Variant (153)..(164): xaa in position 153 to 164 is any or no amino acid
  Variant (166)..(167): xaa in position 166 to 167 is any amino acid
  Variant (169)..(170): xaa in position 169 to 170 is any amino acid
  Variant (172)..(172): xaa in position 172 is any amino acid
  Variant (174)..(175): xaa in position 174 to 175 is any amino acid
  Variant (177)..(177): xaa in position 177 is any amino acid
  Variant (179)..(205): xaa in position 179 to 205 is any amino acid
  Variant (206)..(279): xaa in position 206 to 279 is any or no amino acid
  Variant (282)..(283): xaa in position 282 to 283 is any amino acid
  Variant (286)..(286): xaa in position 286 is any amino acid
  Variant (287)..(287): xaa in position 287 is any or no amino acid
  Variant (289)..(290): xaa in position 289 to 290 is any amino acid
  Variant (292)..(324): xaa in position 292 to 324 is any amino acid
  Variant (325)..(354): xaa in position 325 to 354 is any or no amino acid
  Variant (356)..(362): xaa in position 356 to 362 is any amino acid
  Variant (364)..(364): xaa in position 364 is any amino acid
  Variant (367)..(379): xaa in position 367 to 379 is any amino acid
  Variant (380)..(405): xaa in position 380 to 405 is any or no amino acid
  Variant (409)..(411): xaa in position 409 to 411 is any amino acid
  Variant (414)..(417): xaa in position 414 to 417 is any amino acid
  Variant (419)..(427): xaa in position 419 to 427 is any amino acid
  Variant (428)..(454): xaa in position 428 to 454 is any or no amino acid
  Variant (456)..(457): xaa in position 456 to 457 is any or no amino acid
  Variant (461)..(461): xaa in position 461 is any amino acid
  Variant (464)..(464): xaa in position 464 is any amino acid
  Variant (467)..(469): xaa in position 467 to 469 is any amino acid
  Variant (471)..(473): xaa in position 471 to 473 is any amino acid

SEQ ID NO: 21033 - protein, 9 aa, Artificial sequence
  Variant (2)..(2): xaa in position 2 is any or no amino acid
  Variant (4)..(4): xaa in position 4 is any or no amino acid
  Variant (6)..(6): xaa in position 6 is any amino acid
  Variant (8)..(8): xaa in position 8 is any amino acid
DXLXGXGXS

SEQ ID NO: 21034 - protein, 26 aa, Artificial sequence
  Variant (3)..(3): xaa in position 3 is Phe or Tyr
  Variant (4)..(4): xaa in position 4 is any amino acid
  Variant (5)..(5): xaa in position 5 is Ala, Ser or Thr
  Variant (6)..(7): xaa in position 6 to 7 is any amino acid
  Variant (9)..(9): xaa in position 9 is any amino acid
  Variant (10)..(10): xaa in position 10 is Phe, Ile, Leu, Met or Val
  Variant (11)..(11): xaa in position 11 is any amino acid
  Variant (12)..(12): xaa in position 12 is His or Tyr
  Variant (13)..(13): xaa in position 13 is Asn or Pro
  Variant (14)..(18): xaa in position 14 to 18 is any amino acid
  Variant (19)..(19): xaa in position 19 is Ala or Leu
  Variant (20)..(23): xaa in position 20 to 23 is any amino acid
  Variant (24)..(24): xaa in position 24 is Pro, Gln or Ser
  Variant (25)..(25): xaa in position 25 is any amino acid
  Variant (26)..(26): xaa in position 26 is Ala, Gly or Ile
GGXXXXXYXXXXXXXXXXXXXXXXXX

SEQ ID NO: 21035 - protein, 12 aa, Artificial sequence
  Variant (3)..(3): xaa in position 3 is Ala, Asp, Glu, Gln or Ser
  Variant (4)..(4): xaa in position 4 is any amino acid
  Variant (5)..(5): xaa in position 5 is Asp, Ser or Thr
  Variant (6)..(6): xaa in position 6 is any amino acid
  Variant (7)..(7): xaa in position 7 is Ile, Met or Val
  Variant (8)..(8): xaa in position 8 is Asp or Asn
  Variant (9)..(10): xaa in position 9 to 10 is any amino acid
  Variant (11)..(11): xaa in position 11 is Ala, Gly, Ser or Thr
  Variant (12)..(12): xaa in position 12 is Ala or Gly
YGXXXXXXXXXX

SEQ ID NO: 21036 - protein, 13 aa, Artificial sequence
  Variant (2)..(2): xaa in position 2 is any or no amino acid
  Variant (4)..(4): xaa in position 4 is any amino acid
  Variant (5)..(5): xaa in position 5 is Ile, Leu or Val
  Variant (6)..(6): xaa in position 6 is Phe or Tyr
  Variant (7)..(7): xaa in position 7 is any amino acid
  Variant (9)..(9): xaa in position 9 is Asp, Asn or Gln
  Variant (10)..(12): xaa in position 10 to 12 is any amino acid
GXHXXXXDXXXXF

SEQ ID NO: 21037 - DNA, 1113 bp, Saccharomyces cerevisiae
  CDS (1)..(1113)
atggctgaagcaagcatcgaaaagactcaaattttacaaaaatatctagaactggaccaaagaggtagaataattgccgaatacgtttggatcgatggtactggtaacttacgttccaaaggtagaactttgaagaagagaatcacatccattgaccaattgccagaatggaacttcgacggttcttctaccaaccaagcgccaggccacgactctgacatctatttgaaacccgttgcttactacccagatcccttcaggagaggtgacaacattgttgtcttggccgcatgttacaacaatgacggtactccaaacaagttcaaccacagacacgaagctgccaagctatttgctgctcataaggatgaagaaatctggtttggtctagaacaagaatacactctatttgacatgtatgacgatgtttacggatggccaaagggtgggtacccagctccacaaggtccttactactgtggtgttggtgccggtaaggtttatgccagagacatgatcgaagctcactacagagcttgtttgtatgccggattagaaatttctggtattaacgctgaagtcatgccatctcaatgggaattccaagtcggtccatgtaccggtattgacatgggtgaccaattatggatggccagatactttttgcacagagtggcagaagagtttggtatcaagatctcattccatccaaagccattgaagggtgactggaacggtgccggttgtcacgctaacgtttccaccaaggaaatgagacaaccaggtggtacgaaatacatcgaacaagccatcgagaagttatccaagagacacgctgaacacattaagttgtacggtagcgataacgacatgagattaactggtagacatgaaaccgcttccatgactgccttttcttctggtgtcgccaacagaggtagctcaattagaatcccaagatccgtcgccaaggaaggttacggttactttgaagaccgtagaccagcttccaacatcgacccatacttggttacaggtatcatgtgtgaaactgtttgcggtgctattgacaatgctgacatgacgaaggaatttgaaagagaatcttcataa

SEQ ID NO: 21038 - protein, 370 aa, Saccharomyces cerevisiae
MAEASIEKTQILQKYLELDQRGRIIAEYVWIDGTGNLRSKGRTLKKRITSIDQLPEWNFDGSSTNQAPGHDSDIYLKPVAYYPDPFRRGDNIVVLAACYNNDGTPNKFNHRHEAAKLFAAHKDEEIWFGLEQEYTLFDMYDDVYGWPKGGYPAPQGPYYCGVGAGKVYARDMIEAHYRACLYAGLEISGINAEVMPSQWEFQVGPCTGIDMGDQLWMARYFLHRVAEEFGIKISFHPKPLKGDWNGAGCHANVSTKEMRQPGGTKYIEQAIEKLSKRHAEHIKLYGSDNDMRLTGRHETASMTAFSSGVANRGSSIRIPRSVAKEGYGYFEDRRPASNIDPYLVTGIMCETVCGAIDNADMTKEFERESS

SEQ ID NO: 21039 - DNA, 1389 bp, Aeropyrum pernix
  CDS (1)..(1389)
atgaaggcacacatgcctgagaccggaccacagagagataaagacggtcaaagggagggacgcgtcctagttcactatacagatatagctgggtacctaagacaagtcgaggttccgctaaggaacgtcgagaaggagtttgtggcatcatttgacggtagcagcgtctacggcttcacccctgtagaggacagcgatcttcttctaaaacatgtgccggagaccctagtcagcgtcccttggaggagcgggctttggagggttatagctactgtctacaacgctactcgtgagagaagcccgagggatccgaggttagcagcagaaacagctgaaaagataatgtcgtctatgggctatagggtcaaggctggcgctgagatagagttcttcattttcgataagataggtgtcgacgttctaaacccggccagggggcttggctacattgttgagagtagggaacaacccggcgggcaggacggcatttttggccaggtcaagaagtcgtaccacatgccagaacctccagacagcctccttgactatagacttatgctcacagaaactctgcagaggttcaaagttgacgtggcagtctcccaccacgaggtggccgttagccaggtcgaggtctctatcggatctaggacgagcttggcaagacttggagatgacataatgacagtcaagtgggtttcaaaggttttagcccgcatggacgggagggtggctacatttatgccaaaacctatattcggcgacaacggctccggcatgcacatccacctgagtctatggagtccaggtggtgagaacctcttcgccggccatggagacagtgatctctcggaaacagcgctgcatttcatagccgggattctcgagcacgcgcgaagcctaagcgctattctatctcccacgaccaactcgtatcgcaggctagtagcaggctatgaggctccggtttatgttgcctggggttggagaaacaggagtgctatgattaggatacctgcgtccgctggcaatatagatgctgtaaggatcgaggtaaggagccccgatcccacagccaatccttacctggctttggcggcgctgtttatggcaggactcgacggtgtaaaaaagaagctcgctccgccagatccctatgagggcaacctctacaagattagccctgaggagcttagagaaaagggtataaagacgctacctaggaacctagatgaggcgctagacgagctggagtccgacaatgactatttgaagccagcattcactagggagatgctagagtcttatatagaggtaaagaggaaggaatcggaggatacgagactgtatccccatcccatcgaagtatataaatatttaaacctgtag

SEQ ID NO: 21040 - protein, 462 aa, Aeropyrum pernix
MKAHMPETGPQRDKDGQREGRVLVHYTDIAGYLRQVEVPLRNVEKEFVASFDGSSVYGFTPVEDSDLLLKHVPETLVSVPWRSGLWRVIATVYNATRERSPRDPRLAAETAEKIMSSMGYRVKAGAEIEFFIFDKIGVDVLNPARGLGYIVESREQPGGQDGIFGQVKKSYHMPEPPDSLLDYRLMLTETLQRFKVDVAVSHHEVAVSQVEVSIGSRTSLARLGDDIMTVKWVSKVLARMDGRVATFMPKPIFGDNGSGMHIHLSLWSPGGENLFAGHGDSDLSETALHFIAGILEHARSLSAILSPTTNSYRRLVAGYEAPVYVAWGWRNRSAMIRIPASAGNIDAVRIEVRSPDPTANPYLALAALFMAGLDGVKKKLAPPDPYEGNLYKISPEELREKGIKTLPRNLDEALDELESDNDYLKPAFTREMLESYIEVKRKESEDTRLYPHPIEVYKYLNL

SEQ ID NO: 21041 - DNA, 1035 bp, Agrobacterium tumefaciens
  CDS (1)..(1035)
atgactaagttcaaactcgagtacatctggctggacggatacaagccggtcgcaaacctgcgcggcaagacacagatcaaggaattcgatgaattccccacactcgagcagttgccgctttggggttttgacggctcctccacccagcaggccgaaggccactcatcggattgcgtgctgaagcccgttgcgatctacccggatccggcccgcaccaacggcgcgctcgtcatgtgcgaagtcatgatgcccgatggcgtcaccccgcacgcttccaacagccgcgccacgatcctcgaagacgaagacgcatggttcggtttcgaacaggaatatttcttctaccaggacggccgcccgctcggtttcccggaacagggttaccccgctccgcagggtccgtattacaccggcgtcggcttcaagaacgtcggctcggttgcccgcgaaatcgttgaagagcacctcgatctctgcctcgaagccggcatcaaccatgaaggcatcaacgccgaagtggccaagggccagtgggaattccaggtattcggcaagggctccaagcgcgccgccgaccagatctggatcgcccgttacctgctgctgcgtctttgcgaacagtacggcatcgacgtcgagttccattgcaagccgctcggcgataccgactggaacggctccggcatgcattgcaacttctcgaccaagttcatgcgcgaagttggcggcaaggactatttcgaagccctcatggccgctttcgccaagaattggcaggagcacatcgacgtttacggtccggacaaccatctgcgcctgaccggcaagcacgaaaccgctccgtggaacaagttctcctatggcgtggcagaccgtggcgcctcgatccgcgttccgcactccttcgtcaacaacggttaccgtggttacctcgaagaccgtcgtccgaattcgcagggctgcccctaccagatcgcttccgtcgttctgaagacgatcgcagaagtgccgctcgcaaagtcggctgctgcctga

SEQ ID NO: 21042 - protein, 344 aa, Agrobacterium tumefaciens
MTKFKLEYIWLDGYKPVANLRGKTQIKEFDEFPTLEQLPLWGFDGSSTQQAEGHSSDCVLKPVAIYPDPARTNGALVMCEVMMPDGVTPHASNSRATILEDEDAWFGFEQEYFFYQDGRPLGFPEQGYPAPQGPYYTGVGFKNVGSVAREIVEEHLDLCLEAGINHEGINAEVAKGQWEFQVFGKGSKRAADQIWIARYLLLRLCEQYGIDVEFHCKPLGDTDWNGSGMHCNFSTKFMREVGGKDYFEALMAAFAKNWQEHIDVYGPDNHLRLTGKHETAPWNKFSYGVADRGASIRVPHSFVNNGYRGYLEDRRPNSQGCPYQIASVVLKTIAEVPLAKSAAA

SEQ ID NO: 21043 - DNA, 1338 bp, Medicago sativa (alfalfa)
  CDS (121)..(1191)
gcgccgacatcataacggttctggcaaatattctgaaatgagctgttgacaattaatcatcggctcgtataatgtgtggaattgtgagcggataacaatttcacacaggaaacagtcgacatgtctctcctttcagatcttatcaaccttgacctctccgaaaccaccgagaaaatcatcgccgaatacatatggattggtggatctggtttggacttgaggagcaaagcaaggactctaccaggaccagttactgacccttcacagcttcccaagtggaactatgatggttccagcacaggtcaagctcctggagaagatagtgaagttattatctacccacaagccattttcaaggacccatttagaaggggtaacaatatcttggttatgtgtgatgcatacactccagctggagagcccattcccaccaacaagagacatgcagctgccaagattttcagccatcctgatgttgttgctgaagtaccatggtatggtattgagcaagaatacaccttgttgcagaaagacatcaattggcctcttggttggccagttggtggttttcctggacctcagggaccatactattgtggagctggtgctgacaaggcatttggccgtgacattgttgactcacattacaaagcctgtctttatgccggcatcaacatcagtggaatcaatggtgaagtgatgcctggtcaatgggaattccaagttggtccctcagttggtatctctgctggtgatgagatatgggttgctcgttacattttggagaggatcactgaggttgctggtgtggtgctttcctttgacccaaaaccaattaagggtgattggaatggtgctggtgctcacacaaattacagcaccaagtctatgagagaagatggtggctatgaagtcatcttgaaagcaattgagaagcttgggaagaagcacaaggagcacattgctgcttatggagaaggcaacgagcgtagattgacagggcgacatgagacagctgacattaacaccttcttatggggtgttgcaaaccgtggtgcgtcgattagagttggaagggacacagagaaagcagggaaaggttatttcgaggataggaggccatcatctaacatggatccatatgttgttacttccatgattgcagacaccaccattctctggaaaccataagccaccacacacacatgcattgaagtatttgaaagtcattgttgattccgcattagaatttggtcattgttttttctaggatttggatttgtgttattgttatggttcacactttgtttgtttgaatttgaggcctctgcctcgcgc

SEQ ID NO: 21044 - protein, 356 aa, Medicago sativa (alfalfa)
MSLLSDLINLDLSETTEKIIAEYIWIGGSGLDLRSKARTLPGPVTDPSQLPKWNYDGSSTGQAPGEDSEVIIYPQAIFKDPFRRGNNILVMCDAYTPAGEPIPTNKRHAAAKIFSHPDVVAEVPWYGIEQEYTLLQKDINWPLGWPVGGFPGPQGPYYCGAGADKAFGRDIVDSHYKACLYAGINISGINGEVMPGQWEFQVGPSVGISAGDEIWVARYILERITEVAGVVLSFDPKPIKGDWNGAGAHTNYSTKSMREDGGYEVILKAIEKLGKKHKEHIAAYGEGNERRLTGRHETADINTFLWGVANRGASIRVGRDTEKAGKGYFEDRRPSSNMDPYVVTSMIADTTILWKP

SEQ ID NO: 21045 - DNA, 1950 bp, Azotobacter vinelandii
  CDS (478)..(1881)
gtcgaggttgtcccacacgcccgtcaccgccagctccggatccaggtcgcgcacgacggtgcggatgttcttcgccagttggcgaatgaagcgcttgcgcaccggcgggctcttgatggtgatttccgggaagaccttgacgatgagtttcatggaggctgcacgggccggtcaggcaaaagagggggcgggattatagcggatcttgttcaagacttgaccaactatcggcaaggcgcccacagcgcaccaaaatgaaacaaatcttctgacccaggcacataaacagagcagaaattttcgccagaatagccggtaccgggcaggcccgaccggcgaagaattcccctactccgccaaggtagtggcatgaaacttgctcccttgtggcgcggcttgccttggcggatgatcgccgcccggttttacccgaattcccgagggtcttttcgaggctctctccacctggaggacaatatgtcgaagtcgcttcaactgatcaaagaacatgacgtgaagtggattgatctccgcttcaccgacaccaaaggcaagcagcaacacgtaaccatgccggcgcgtgacgtggacgacgacttcttcgaatacggcaagatgttcgacggctcctccatcgccggctggaagggcatcgaagcctccgacatgatcctgatgccggacgacagcaccgccgtgctggatccgttcaccgaagagccgaccctgatcatcgtctgcgacatcatcgagccctcgaccatgcagggctacgatcgcgacccgcgcgccatcgcccgccgcgccgaggaatacctgaagtccaccggcatcggcgacaccgccttcttcggtccggagcccgagttcttcatcttcgacgaagtgaagtacaagtccgacatctccggctccatgttcaagatcttctccgaacaggctgcctggaacaccgacgccgacttcgaaggcggcaacaagggccatcgtccgggcgtcaagggcggctacttcccggttccgccggtcgaccacgaccacgaaatccgcaccgccatgtgcaacgccctggaagagatgggcctgaaggtcgaggttcaccaccacgaagtggccaccgccggccagaacgagatcggcgtcagcttcaacaccctggtggccaaggccgacgaagtgcagaccctgaagtactgcgtgcacaacgtcgccgacgcctacggcaagaccgtgaccttcatgccgaagccgctgtacggcgacaacggctcgggcatgcacgtgcacatgtccatcgccaaagacggcaagaacaccttcgccggcgaaggctatgccggcctgtccgacaccgccctgtacttcatcggcggcatcatcaagcacggcaaggcgctgaacggcttcaccaacccgtcgaccaactcctacaagcgtctggtccccggtttcgaagctccggtcatgctggcctactcggcccgcaaccgttccgcctccatccgcatcccctacgtcaacagcccgaaagcccgccgcatcgaagcgcgcttcccggacccgtcggccaacccctacctggccttcgccgcgctgctgatggccggcctggacggcatccagaacaagatccatcccggcgatgccgccgacaagaacctgtacgacttgccgccggaagaagccaaggaaatcccgcaggtgtgcggcagcctgaaggaggccctggaagaactggacaagggccgcgccttcctgaccaagggcggcgtcttctccgacgacttcatcgatgcctacctcgagctgaagagcgaagaggaaatcaaggtgcgcaccttcgtgcacccgctggaatacgacctgtactacagcgtctgatccagccggcgatactctggaaggcctcctcgggaggcctttcttttttgagtgatcgccataacgctt

SEQ ID NO: 21046 - protein, 467 aa, Azotobacter vinelandii
MSKSLQLIKEHDVKWIDLRFTDTKGKQQHVTMPARDVDDDFFEYGKMFDGSSIAGWKGIEASDMILMPDDSTAVLDPFTEEPTLIIVCDIIEPSTMQGYDRDPRAIARRAEEYLKSTGIGDTAFFGPEPEFFIFDEVKYKSDISGSMFKIFSEQAAWNTDADFEGGNKGHRPGVKGGYFPVPPVDHDHEIRTAMCNALEEMGLKVEVHHHEVATAGQNEIGVSFNTLVAKADEVQTLKYCVHNVADAYGKTVTFMPKPLYGDNGSGMHVHMSIAKDGKNTFAGEGYAGLSDTALYFIGGIIKHGKALNGFTNPSTNSYKRLVPGFEAPVMLAYSARNRSASIRIPYVNSPKARRIEARFPDPSANPYLAFAALLMAGLDGIQNKIHPGDAADKNLYDLPPEEAKEIPQVCGSLKEALEELDKGRAFLTKGGVFSDDFIDAYLELKSEEEIKVRTFVHPLEYDLYYSV

SEQ ID NO: 21047 - DNA, 1600 bp, Hordeum vulgare (barley)
  CDS (281)..(1585)
cttggtttctggcctggtttgcctccgttgcagctgcaaggggcgcctcaaatctcgtccacccagagccctatcgcctaatgacgagccagatgccatgcccgccccgcgccactcagaatctccccccgcaatctaaaatacttataccacccaccccccgcttccataaatattatttccagcgcgatctcacaggtcgcccccccttccctccctcgcctccgccgcgtccgccgtctctctggtttaggggccgcggagtcgctgtacgtaagtaatgcaagtacgtagagacgacgatggcgcaggcggttgtgcaggcgatgcagtgccaggtgggggtgaggggcaggacggcgtcccggcgaggcagcccgcgggcagggtgtggggcgtcagcagggccgcccgcgccacctccgggttcaaggtgctggcgctcggcccggagaccaccggggtcatccagaggatgcagcagctgctcgacatggacaccacgcccttcaccgacaagatcatcgccgagtacatctgggttggaggatctggaattgacctcagaagcaaatcaaggacgatttcgaagccagtggaggacccgtcagagctgccgaaatggaactacgacggatcgagcacggggcaggctcctggggaagacagtgaagtcatcctatacccacaggccatattcaaggacccattccgaggaggcaacaacatactggttatctgtgacacctacacaccacagggggaacccatccctactaacaaacgccacatggctgcacaaatcttcagtgaccccaaggtcacttcacaagtgcaatggttcggaatcgaacaggagtacactctgatgcagagggatgtgaactggcctcttggctggcctgttggagggtaccctggcccccagggtccatactactgcgccgtaggatcagacaagtcatttggccgtgacatatcagatgctcactacaaggcgtgcctttacgctggaattgaaatcagtggaacaaacggggaggtcatgcctggtcagtgggagtaccaggttggacccagcgttggtattgatgcaggagaccacatatgggcttccagatacattctcgagagaatcacggagcaagctggtgtggtgctcacccttgacccaaaaccaatccagggtgactggaacggagctggctgccacacaaactacagcacattgagcatgcgcgaggatggaggtttcgacgtgatcaagaaggcaatcctgaacctttcacttcgccatgacttgcacatagccgcatatggtgaaggaaacgagcggaggttgacagggctacacgagacagctagcatatcagacttctcatggggtgtggcgaaccgtggctgctctattcgtgtggggcgagacaccgaggcgaagggcaaaggatacctggaggaccgtcgcccggcctccaacatggacccgtacaccgtgacggcgctgctggccgagaccacgatcctgtgggagccgaccctcgaggcggaggccctcgctgccaagaagctggcgctgaaggtatgaaggacctgaaaaaag

SEQ ID NO: 21048 - protein, 434 aa, Hordeum vulgare (barley)
MQVRRDDDGAGGCAGDAVPGGGEGQDGVPARQPAGRVWGVSRAARATSGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICDTYTPQGEPIPTNKRHMAAQIFSDPKVTSQVQWFGIEQEYTLMQRDVNWPLGWPVGGYPGPQGPYYCAVGSDKSFGRDISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRDTEAKGKGYLEDRRPASNMDPYTVTALLAETTILWEPTLEAEALAAKKLALKV

SEQ ID NO: 21049 - DNA, 1335 bp, Bacillus subtilis
  CDS (1)..(1335)
atggcaaagtacactagagaagatatcgaaaaattagtaaaagaagaaaacgtgaagtatatccgccttcaatttactgacattcttggaacaatcaagaatgttgagattcctgtaagccagcttggaaaagcgcttgataataaagtcatgtttgacggttcttctattgagggattcgttcgtatcgaagagtcagacatgtacctgtatccagatctaaatacatttgttatcttcccatggacagctgaaaaaggtaaagtagcacgtttcatctgtgatatttacaatccggatggcacaccttttgaaggtgacccgcgaaacaacttaaaacggattctgaaagaaatggaagacctcggcttcagtgattttaaccttgggcctgagcctgaattcttcttattcaaattggacgaaaaaggcgagccgacgcttgaactaaacgacaaaggcggatatttcgacttagctccaactgatttaggagaaaactgccgccgcgatatcgtacttgagcttgaagagatgggctttgaaatcgaagcgtctcaccacgaagtagcacctggtcagcacgaaatcgactttaaatatgctggagcagtccgctcttgtgatgacatccaaacatttaaactagttgtcaaaacaattgcccgtaaacacggcctgcatgcgacatttatgccaaaaccattgttcggtgtaaacggttcaggtatgcactgcaatctatcactcttcaaaaatggtgttaacgcattctttgacgaaaacgcagatcttcagttaagtgaaacagcgaagcacttcattgcaggtatcgtgaagcacgcaacaagctttacagcagtaacaaacccgacagtaaactcttacaaacgtcttgttcctggctatgaagcaccttgttatgtagcatggagcgcgcaaaacagaagcccgcttatccgtatcccggcttctcgcggcatcagcacacgtgttgaagtacgcagtgtagacccagctgcaaacccataccttgcacttagcgtattgcttgctgcaggattagacggaatcaaaaacaaactggaagcgccggctccaatcgaccgcaacatctatgtgatgagcaaagaagagcgcatggaaaacggaatcgttgaccttccagcaacacttgcggaagcactagaagaattcaaatcaaacgaagtcatggtcaaagcgctgggcgagcacctattcgaacacttcatcgaagcaaaagaaatcgaatgggatatgttccgcacgcaagtacatccttgggaacgcgaacagtatatgtctcagtattaa

SEQ ID NO: 21050 - protein, 444 aa, Bacillus subtilis
MAKYTREDIEKLVKEENVKYIRLQFTDILGTIKNVEIPVSQLGKALDNKVMFDGSSIEGFVRIEESDMYLYPDLNTFVIFPWTAEKGKVARFICDIYNPDGTPFEGDPRNNLKRILKEMEDLGFSDFNLGPEPEFFLFKLDEKGEPTLELNDKGGYFDLAPTDLGENCRRDIVLELEEMGFEIEASHHEVAPGQHEIDFKYAGAVRSCDDIQTFKLVVKTIARKHGLHATFMPKPLFGVNGSGMHCNLSLFKNGVNAFFDENADLQLSETAKHFIAGIVKHATSFTAVTNPTVNSYKRLVPGYEAPCYVAWSAQNRSPLIRIPASRGISTRVEVRSVDPAANPYLALSVLLAAGLDGIKNKLEAPAPIDRNIYVMSKEERMENGIVDLPATLAEALEEFKSNEVMVKALGEHLFEHFIEAKEIEWDMFRTQVHPWEREQYMSQY

SEQ ID NO: 21051 - DNA, 2352 bp, Bacillus cereus
  CDS (860)..(2194)
atgcatccccgattaattctcacttcactccatatgctaactatatgccggggtatgaagatgatgtaattatggctgcgggaacttttattcaaggtgcaagtattgaattgtcagctgatggtccaattcgtccgccttatgttgcttacgtacaaggtgggctaacttattcgcatgtgaagattgcgatctgttctgcaattgatgcattaattgaaaaagaattattaacaatttcttaaagggaagctgtcgatttcgacagctttttttcgtgtgaaagtaatgatttattgcattagaaaaaagaatgaaaaaacttttaaaaaaatcatgtaagaaaagctaacatctattgacatcaaacataacatggtataaaatgagaagcagttaaggcgaaggaggaactgaaacgatgaaagaagatagacgttctgccccgctgtttcctattggtattgttatggatttaacacaattatctgcacgtcaaattcgctactatgaagagcataatcttgtttctccaacccgtacaaaggggaatcgtagattattttcatttaacgatgtagataagttgttagagattaaagatttattagatcaaggcttgaatatggctggtattaaacaagtgttactaatgaaagaaaatcaaacagaagcagtgaaagtaaaagaagaaacgaaagaaatttcaaaaactgagcttcgcaaaatacttcgagacgaactacaacatacaggtagatttaatcgaacttcattgcgacaaggtgatatttcaaggttttttcactaaagagaactgattctgaaggtgtttagagggactaaggaggaatttataatggctaggtacacaaaagaagatattttccgtttggcgaaagaagagaatgtaaagtatatacgtttacaatttacggaccttttaggagtaattaagaacgtagaaattccagtgagccaattaacaaaagctcttgataacaaaatgatgtttgatggatcttctattgaaggtttcgtacgtattgaagaatctgatatgtacttatatccagacttagatacttgggtgattttcccttggacagctgaaaaaggtaaagtagctcgattgatctgtgatatttacaatgcagatggcactccatttgaaggggatccacgtaacaacttaaaacgtgtattaaaagaaatggaagctttaggattctcagatttcaatcttggaccagagccagaattcttcctattcaaagtagatgaaaaaggaaatccaacattagaattaaacgataacggtggatacttcgaccttgcgccgatggatctaggggaaaactgtcgtcgtgatatcgttcttgaacttgaagaaatgggctttgaaattgaagcgtctcaccatgaggttgctccagggcagcacgaaattgacttcaaatatgcaaatgcaattcgttcatgtgatgacattcaaacattcaaacttgttgtaaaaacaattgctcgtaaacacggtttacacgcaacatttatgccaaaaccattatacggtgtgaacggttcaggtatgcactgtaacttatcactattcaaaaatggtgagaacgtattctatgatcaaaacggtgacttacaattaagtgatgatgctcgtcacttcatcgcaggtattttaaaacacgcaccagcatttacagcggtggcaaacccaactgtaaactcttacaagcgtttagtacctggatacgaagctccttgttacgtagcatggtctgcacaaaaccgtagtccattagtacgtatccctgcatctcgtggtattagtacacgcgtagaagtacgtagtgttgacccagctgcaaacccatatttagtaatggctacattattagcagcaggtcttgatggaattaaaaacaaattaactccaccagctgcagtagatcgtaacatctacgtaatgacaaaagaagagcgcgaagaagcaggtatcgttgacttaccagcaacattagcgcaagctttagttacattacaatctaacgaagtaattagtaacgcattaggagatcacttacttgagcacttcatcgaagcgaaagaatttgagtgggatatcttccgtacgcaagttcaccaatgggaacgcgatcaatatatgtctctttactaagaggtgaggtgaggagccctgatactacggtatcagggcttttttatttgttggcaatataggtgttagttgaaatgaattgaatagatgtctgaaaaaattatgacggtatttaaatttctattccatatctttaatgtaacgtggtgaaattcgaa

SEQ ID NO: 21052 - protein, 444 aa, Bacillus cereus
MARYTKEDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFYDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQSNEVISNALGDHLLEHFIEAKEFEWDIFRTQVHQWERDQYMSLY

SEQ ID NO: 21053 - DNA, 1122 bp, Gallus gallus (chicken)
  CDS (1)..(1122)
atggccacctcggcgagctcccacctgagcaaagccatcaagcacatgtacatgaagctgccgcagggtgagaaggtccaagccatgtacatctggatcgacgggactggggagcacctccgctgcaaaacccgcactctggaccacgaacccaagagcctggaagatctccccgagtggaactttgatggctccagcaccttccaagccgaaggctccaacagcgacatgtacctgcgacctgctgccatgttccgggacccttttcgcaaggatcccaacaaattagttctctgtgaggtcttcaaatacaaccgccagtctgcagacacaaatcttcggcacacctgtaggcggattatggatatggtgtccaaccagcacccctggtttgggatggagcaggagtacacccttctgggaacagatggtcatccgtttggctggccttccaattgcttccctggaccccaaggtccgtactactgcggtgtaggagctgacaaagcctatggcagagacattgtggaggcccactaccgagcgtgcctgtatgctggtgtgaaaattggaggaaccaacgcagaagtgatgccagcccagtgggagttccaggtgggaccgtgcgaagggattgagatgggggatcacctctggatagcacgtttcatcctccaccgggtgtgcgaagactttggtgtcattgtgtccttcgatcccaaacccatccctgggaactggaacggtgctggctgtcacaccaacttcagcaccaagaacatgagggaagatggaggtctcaagcacatcgaggaggccatcgagaagctgagcaagcgccaccagtaccacatccgtgcctacgaccccaaaggagggctggacaacgcccggcgcctgacgggcttccacgagacgtccagcatccacgagttctccgccggcgtggccaaccgcggcgccagcatccgcatcccacgcaacgtgggccatgagaagaaaggctacttcgaggaccgcgggccttcagccaactgcgatccctacgccgtgacggaggccctggtccgtacgtgtctcctcaacgaaaccggggacgagccttttgagtacaagaactaa

SEQ ID NO: 21054 - protein, 373 aa, Gallus gallus (chicken)
MATSASSHLSKAIKHMYMKLPQGEKVQAMYIWIDGTGEHLRCKTRTLDHEPKSLEDLPEWNFDGSSTFQAEGSNSDMYLRPAAMFRDPFRKDPNKLVLCEVFKYNRQSADTNLRHTCRRIMDMVSNQHPWFGMEQEYTLLGTDGHPFGWPSNCFPGPQGPYYCGVGADKAYGRDIVEAHYRACLYAGVKIGGTNAEVMPAQWEFQVGPCEGIEMGDHLWIARFILHRVCEDFGVIVSFDPKPIPGNWNGAGCHTNFSTKNMREDGGLKHIEEAIEKLSKRHQYHIRAYDPKGGLDNARRLTGFHETSSIHEFSAGVANRGASIRIPRNVGHEKKGYFEDRGPSANCDPYAVTEALVRTCLLNETGDEPFEYKN

SEQ ID NO: 21055 - DNA, 2192 bp, Clostridium acetobutylicum
  CDS (396)..(1727): n means a or g or c or t/u, s means g or c
cgtctcgtgacttcgttttttttgtaaatttatgcattatttataaaattttttcattacaatattatatacaaaattacagaatggagcatagtataatgttaaataaaatttatataataaaggatatatattgtaataaaaaatgagactataaatttttaaaatggaaaaataatcctgataactttagaatctaaagaaaaacgtatcaaattatttatattgtaaagtttttagtacgaaaatatttatttactaaaaaaatcacttgatttcttaaaaaaaagggaagtataatttagttattatatgaattgagcaaaggcgttcgatagaagtttatacttgtctattgtgcgctttttttaaaaatgtaaagggggagttgtaaaatggcaaaatacacaaaggaagatatcattaatttagtaaaagaaaacggcgtaaaatttataagacttcaatttactgatatctttggaacattaaagaatgtggcgattacagacaaacaattggaaaaagcattagataatgaatgtatgtttgatggatcatctattgatggttttgttagaattgaagaatcagacatgaatttaagacctaatttagatagttttgttatttttccatggagaccacaacaaggcaaagttgcaagattaatttgtgatgtatataagccagatggtacaccatttgaaggagatccaagacatgtcctaaagagagcaaatgcagatgcaaaagaattaggatatacaatgaatgttggaccagaatgtgaattcttcttatttgaaacagatgaaaatggcagagcaacaactaatactcaagataaagctggatattttgatttagcacctacagatttaggagaaaatgctagaagagacatgactttagctttagaagaaatgggattcgaaattgaagcatctcatcatgaagttgctgagggtcaaaatgaaattgactttaagtatggagatgcattaactacagctgataatattatgacatttaaactagttgttaaatctattgcacaaagacatggattacatgcatcgtttatgccaaaaccaatattcggaattaatggttctggaatgcatgtaaatatgtcattattcaaagatggaaaaaatgcttttgttgatgaaaatgataaaaatggattaagtaaagttgcttatcaatttatcgctggattattaaagaacattaaaggaatggctgctgtaactaatccattagttaactcatataagagattagtaccaggatatgaagcaccagtatatctagcttggtcttgcaaaaacagaacagcattaataagagtaccagcagctagaggtgcagggactagagtagaattaagatgtccagatccaagttctaatccatatttagtattagcatgtttattacaagcaggattagatggaattaaaaataatttacaaccacctgctgaagttgaagcaaacatttttgcaatgactgagcaagaaagaaaagaaaatggaattgataatctgccaaacaatttatatgaagcagtaaattacatgaaagaaaatgaattagctaaaaaagctttaggagatcatgtatatggaaattatgttgcaggaaaagcagcagaatgggatgattacagaacaaaagtacatgattgggaattagagaattatctaaataaatactaaggcacaatcaaaaaaataatggaccagtatgcttgtctgttttgcttcatactgcgtcggaactttcagttaattgcttgctatgagctaaaagttcctacttccatgacacaaaatatacgtcgcatctttggtctattattttctttcatgtgcctaatctagtaatgtaattacttttagttaaggcggggattgcaatggtccaaagtgaaaaaggaaaacttattatagcattaagcaatgttgagatagcaaaaaaattaaaaacttcgtaacgcaagaagggtttgatatcatagccctatgtacttcaggaaatgaattaattagattagttatgcaatattccccagacctggttttagtaggatataagtttaaggacatgagtttactggatgtgtatgaaaacttagtagatttaactagctttttggctantgtaaatgagccatatagatc

SEQ ID NO: 21056 - protein, 443 aa, Clostridium acetobutylicum
MAKYTKEDIINLVKENGVKFIRLQFTDIFGTLKNVAITDKQLEKALDNECMFDGSSIDGFVRIEESDMNLRPNLDSFVIFPWRPQQGKVARLICDVYKPDGTPFEGDPRHVLKRANADAKELGYTMNVGPECEFFLFETDENGRATTNTQDKAGYFDLAPTDLGENARRDMTLALEEMGFEIEASHHEVAEGQNEIDFKYGDALTTADNIMTFKLVVKSIAQRHGLHASFMPKPIFGINGSGMHVNMSLFKDGKNAFVDENDKNGLSKVAYQFIAGLLKNIKGMAAVTNPLVNSYKRLVPGYEAPVYLAWSCKNRTALIRVPAARGAGTRVELRCPDPSSNPYLVLACLLQAGLDGIKNNLQPPAEVEANIFAMTEQERKENGIDNLPNNLYEAVNYMKENELAKKALGDHVYGNYVAGKAAEWDDYRTKVHDWELENYLNKY

SEQ ID NO: 21057 - DNA, 1410 bp, Escherichia coli
  CDS (1)..(1410)
atgtccgctgaacacgtactgacgatgctgaacgagcacgaagtgaagtttgttgatttgcgcttcaccgataccaaaggtaaagaacagcacgtcactatccctgctcatcaggtgaatgctgaattcttcgaagaaggcaaaatgtttgacggctcctcgattggcggctggaaaggcattaacgaatccgacatggtgctgatgccagacgcatccaccgcagtgattgacccgttcttcgccgactccaccctgattatccgttgcgacatccttgaacctggcaccctgcaaggctatgaccgtgacccgcgctctattgcgaagcgcgccgaagattacctgcgttccactggcattgccgacaccgtactgttcgggccagaacctgaattcttcctgttcgatgacatccgtttcggatcatctatctccggttcccacgttgctatcgacgatatcgaaggcgcatggaactcctccacccaatacgaaggtggtaacaaaggtcaccgtccggcagtgaaaggcggttacttcccggttccgccggtagactctgctcaggatattcgttctgaaatgtgtctggtgatggaacagatgggtctggtggttgaagcccatcaccacgaagtagcgactgctggtcagaacgaagtggctacccgcttcaataccatgaccaaaaaagctgacgaaattcagatctacaaatatgttgtgcacaacgtagcgcaccgcttcggtaaaaccgcgacctttatgccaaaaccgatgttcggtgataacggctccggtatgcactgccacatgtcgctgtctaaaaacggcgttaacctgttcgcaggcgacaaatacgcaggtctgtctgagcaggcgctgtactacattggcggcgtaatcaaacacgctaaagcgattaacgccctggcaaacccgaccaccaactcttataagcgtctggtcccgggctacgaagctccggtaatgctggcttactctgcacgcaaccgttctgcgtctatccgtattccggtggtttcttctccgaaagcacgtcgtatcgaagtacgtttcccggatccggcggctaacccgtacctgtgctttgctgccctgctgatggccggtcttgatggcatcaagaacaagatccatccgggcgaagccatggacaaaaacctgtatgacctgccgccggaagaagcgaaagagatcccacaggttgcaggctctctggaagaagcactgaacgagctggatctggaccgcgagttcctgaaagccggtggcgtgttcacggatgaagcgatcgatgcgtacatcgctctgcgtcgcgaagaagatgaccgcgtgcgtatgactccgcatccggtagagtttgagctgtactacagcgtctaa

SEQ ID NO: 21058 - protein, 469 aa, Escherichia coli
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRSTGIADTVLFGPEPEFFLFDDIRFGSSISGSHVAIDDIEGAWNSSTQYEGGNKGHRPAVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 21059 - DNA, 1448 bp, Phaseolus vulgaris (kidney bean)
  CDS (69)..(1139)
attgaaaggaagagaaagagaaaatttctctgtgaagagtctctgctgaaagttttggtttcttgaagatgtcatcaatctccgatcttgttaaccttaacctctctgactccaccgagagggtgatcgccgagtatatatgggttggtggatctggcatggacatgaggagcaaagcaagaactctctccggaccggttaaagacccttcaaaacttccaaagtggaactacgatggttccagcacaggtcaagctcctggacaagatagtgaagttatcttatacccacaaacaattttcagggatccattcaggaggggtaacaatatcctggttatgtgtgatgcttacactcctgctggggaacccatccctaccaataagagacataatgcggcaaagatatttagcaatcctgaagttgttgctgaagaaccctggtatggcattgagcaggaatataccttgttgcagaaagatgttcagtggcctgttggatggcctcttggtggttttcctgggccccagggaccatactattgtggtattggtgctaacaaggctttcgggcgtgatattgttgattcacattacaaagcatgtctttatgcgggcattaacataagtggaattaatggagaagtgatgcctggtcaatgggaattccaagttggtccatcagtaggcatctctgctgctgacgagttatgggttgcccgttacattttggagagaatcactgagattgctggagtggtgctttcgtttgaccctaaaccaattcagggtgattggaatggtgctggtgctcacacgaattacagtaccaagtccatgagaaacgatggtggctacgaagtcataaaaaaagcaatcactaagttggaaaagaggcacaaggagcacattgctgcttacggagaaggcaacgaacgtcgtttgacagggaaacacgagacagcagacatgaacaccttcatatggggtgttgcaaaccgtggtgcttctataagggtagggagagacacagagaaggcagggaagggatactttgaggataggaggcctgcatctaacatggacccttatgtcgtcacttccatgattgctgagacaacccttctttggaaaccatgagcaacctcaaaaacacaaccacagatggcttctacaatgcgtagttgcttgtaccttaggattgtcaatttgttcttctctctgttttgtgacctgcttgcctgttgttaggcattgtttgttagtggtactcactgccaagcgaggaattgttgcttcattccctcaatgaacgttttaagttgtagaataatgcaatggctttcaagtattagtgttgttgtttggttcgaatttcaagtattagtgtggttgtttggttcgaatttcaggtttttatttgactaaacaaaggcatgcgcatctctc

SEQ ID NO: 21060 - protein, 356 aa, Phaseolus vulgaris (kidney bean)
MSSISDLVNLNLSDSTERVIAEYIWVGGSGMDMRSKARTLSGPVKDPSKLPKWNYDGSSTGQAPGQDSEVILYPQTIFRDPFRRGNNILVMCDAYTPAGEPIPTNKRHNAAKIFSNPEVVAEEPWYGIEQEYTLLQKDVQWPVGWPLGGFPGPQGPYYCGIGANKAFGRDIVDSHYKACLYAGINISGINGEVMPGQWEFQVGPSVGISAADELWVARYILERITEIAGVVLSFDPKPIQGDWNGAGAHTNYSTKSMRNDGGYEVIKKAITKLEKRHKEHIAAYGEGNERRLTGKHETADMNTFIWGVANRGASIRVGRDTEKAGKGYFEDRRPASNMDPYVVTSMIAETTLLWKP

SEQ ID NO: 21061 - DNA, 1353 bp, Phaseolus vulgaris (kidney bean)
  CDS (116)..(1186)
agaatgtaactgtcatcaggggcttcagattcattcacttcaccctatcaagctttttcaccttttggtatcttctacaatatcctctcatactatctttttcctctttatcaccatgtctttgctttcagatctcatcaacctcaacctctcagaatccacagaaaagatcattgctgagtacatatgggttggtggatctggtatggacctcagaagcaaagccaggactcttcctggaccagtggatgaccctgcaaaacttccaaaatggaactatgatgggtctagcacagatcaagctcctggggatgacagtgaagtcatcctatacccacaagctattttcaaggacccctttaggagaggcaataatattcttgtgatttgtgatgtttacaccccagctggtgagccacttccaaccaacaagaggtatgatgctgccaaaattttcagtcaccctgatgttgttgcagaggtaccatggtatggaattgagcaagagtacaccttgttgcagaaagatgtgaattggccacttgggtggccacttggtgggtatcctgggccacagggaccctactactgtggagttggtgctgataaagcctatggtcgtgatattgtagatgcacattacaaagcttgtgtttatgcaggaattaacatcagtggcatcaatggagaggttatgcctggccagtgggaattccaagttggtccttctgttggcatctctgctggagatgaagtgtgggctgctcgctacattttggagaggattacagagttagcaggagcagttgtttcatttgatcccaagcctattccgggagattggaatggagctggagcacactcaaactatagcactaagtccatgagagaagagggtggttatgaggtgattaagaaagccattgaaaagcttggattgagacacaaagagcacattgcagcatatggaaaaggtaatgagagacgtctcacaggaagacatgaaactgcagacatcaacaccttttcttggggtgtggcaaaccgtggaagttcagttagagttggaagagacacagagaaacaagggaaaggttactttgaggacagaaggcctgcttctaacatggatccttatgtagtcacctccatgattgcagagaccaccattctctggaaaccatgaacatgtggttagaccactcaaaattgtgttttcaataccatttgattccacaatttggttatatctccaaggagttgttgtttttttaggtcttctaagccttctgtgttctctgatggttgaaaataacttctttaataacaagaattgattcttgagttcactct

SEQ ID NO: 21062 - protein, 356 aa, Phaseolus vulgaris (kidney bean)
MSLLSDLINLNLSESTEKIIAEYIWVGGSGMDLRSKARTLPGPVDDPAKLPKWNYDGSSTDQAPGDDSEVILYPQAIFKDPFRRGNNILVICDVYTPAGEPLPTNKRYDAAKIFSHPDVVAEVPWYGIEQEYTLLQKDVNWPLGWPLGGYPGPQGPYYCGVGADKAYGRDIVDAHYKACVYAGINISGINGEVMPGQWEFQVGPSVGISAGDEVWAARYILERITELAGAVVSFDPKPIPGDWNGAGAHSNYSTKSMREEGGYEVIKKAIEKLGLRHKEHIAAYGKGNERRLTGRHETADINTFSWGVANRGSSVRVGRDTEKQGKGYFEDRRPASNMDPYVVTSMIAETTILWKP

SEQ ID NO: 21063 - DNA, 1454 bp, Phaseolus vulgaris (kidney bean)
  CDS (123)..(1193)
ggctcacgtacgagttgaatctcaggattcagagagaaaaggagagagagagagagaaagagagattttttttttctgtgaagaagggtctttccttgtttcttcgtctcttcatttctaccatgtcgctgctctcagatctcatcaaccttaacctctccgacaccaccgagaaggtcatcgcagagtacatatggatcggtggatcaggattggatctaaggagcaaagcaaggactctcccaggaccagttaagaacccttcagagctgcctaagtggaactatgatggttccagcacaggtcaagcccctggacaagacagtgaagtgattatatacccacaagccattttcaaggatccattcagaaggggtaacaatatcttggttatttgtgatgcttacactccagctggagaacccattcccactaacaagaggcacaatgctgccaagatattcagcaatcctgatgttgttgctgaagaaccctggtacggtattgagcaggaatacaccttgttgcagaaagaagtgaactggcctgttgggtggcctgttggtggtttccctggacctcagggaccttactattgtggtgttggtgctgacaaggcttttgggcgtgacattgttgacgcacattacaaagcctgtgtctatgctggcatcaacatcagtggaattaatggagaggtgatgcctggtcagtgggaattccaagttggacctgcagttgggatctcagctggtgacgagttgtgggtagctcgttacatcttggagaggatcactgaggttgctggtgtggtgctttcctttgaccccaagccaatcaagggtgattggaatggtgctggtgctcacaccaactacagcaccaagaccatgagaaacgatggtggctatgaagaaatcaaatcagctatacagaaattggggaagaggcacaaggagcatatcgctgcttatggagaaggcaatgaacgccgtctgacaggacgacacgaaactgccgacatcaacaccttcctatggggagttgcaaaccgtggagcttctattagagttgggagggacacagagaaagcagggaagggttactttgaggacaggagacctgcttctaacatggacccctatgttgtcacttccatgattgcagacacaaccattctgtggaagccatgagcaacacctgcactttgtctcttctttcggatgaaacaaggaacactactacttgtgcttttctaagtaggatttggtcctttatttttcacctcttactttttaggatttggatttgtggtaattgctgtggttcgctctctgcttggagccttgttggttggtacaactaactaccaaggattcttcattgctttccatttctttcccatgttttcctattgttataataataataatatcattaataatcataataat

SEQ ID NO: 21064 - protein, 356 aa, Phaseolus vulgaris (kidney bean)
MSLLSDLINLNLSDTTEKVIAEYIWIGGSGLDLRSKARTLPGPVKNPSELPKWNYDGSSTGQAPGQDSEVIIYPQAIFKDPFRRGNNILVICDAYTPAGEPIPTNKRHNAAKIFSNPDVVAEEPWYGIEQEYTLLQKEVNWPVGWPVGGFPGPQGPYYCGVGADKAFGRDIVDAHYKACVYAGINISGINGEVMPGQWEFQVGPAVGISAGDELWVARYILERITEVAGVVLSFDPKPIKGDWNGAGAHTNYSTKTMRNDGGYEEIKSAIQKLGKRHKEHIAAYGEGNERRLTGRHETADINTFLWGVANRGASIRVGRDTEKAGKGYFEDRRPASNMDPYVVTSMIADTTILWKP

SEQ ID NO: 21065 - DNA, 1510 bp, Phaseolus vulgaris (kidney bean)
  CDS (64)..(1353)
ccactttccaagttccaacctttccccattttttctactctgtattgagcagaactgcagaacatggcacagattttggctccctctacacaatggcagatgagattcacaaaatcctctcgccatgcaagtcccattacatcaaacacgtggagttctttattgatgaaacaaaataagaaaaccagttctgctaaatttagagtgctggcagttaagtctgatggtagcaccatcaacaggctggagggtctacttaatttggatatcactccattcacggacaagataattgctgagtacatttggattggggggacaggaattgatgtgcgcagtaaatcaagaacaatatcaaagcctgttgaacatccctctgagcttcctaaatggaactatgatggatctagtactggacaggcacccggtgaagatagtgaagtaatcctatatcctcaggcaattttcaaagatcctttccgtggtggtaacaatattttggtcatttgtgatgcttacacacctgctggtgaacctatccctacaaataagcgacacagagctgctgaagttttcagtaacccaagggtcattgctgaagttccatggtttggaatagaacaagagtacaccttacttcaaacaaatgtgaactggcctttaggttggcctgttggtggctatcctggtcctcagggtccttattattgcagtgctggggcagataagtcatttggacgtgatatatctgatgctcactacaaggcttgcttatttgctggaattaacattagtggcaccaacggggaggttatgcctgggcagtgggagtatcaagttggtcctagtgtaggtattgaggctggtgatcatatctgggcatcaaggtacatcctcgagagaattactgaacaagctggtgttgtgctctctcttgatccaaaaccaatagagggtgactggaatggtgcaggatgccacaccaattacagtacaaagagcatgagggaagatggaggctttgaggtaataaagaaggcaattttgaatctatcacttcgccacaaagagcacattagtgcatatggagaaggaaatgaaagaaggttgacaggaaagcatgagacagcaagcattaacacattttcttggggagttgccaatcgtggttgctcaatccgtgtgggaagagacaccgagaagaatggcaaaggttacttggaggacaggcgccctgcttcaaacatggatccatatgtcgtgacatctttacttgcagagagtacactattgtgggagccaactctggaggctgaagctcttgcagctcagaagttagcattgaaggtctaaatttattgattgatggcattctggacggagcctgtagtttgtaaggagcttgaaagctctcgcactttccttttacatcattacttgtttggaccaaagaggttaccatgcccagttatattggttgtcatatgaaatgcacatcgtaatatcagaa

SEQ ID NO: 21066 - protein, 429 aa, Phaseolus vulgaris (kidney bean)
MAQILAPSTQWQMRFTKSSRHASPITSNTWSSLLMKQNKKTSSAKFRVLAVKSDGSTINRLEGLLNLDITPFTDKIIAEYIWIGGTGIDVRSKSRTISKPVEHPSELPKWNYDGSSTGQAPGEDSEVILYPQAIFKDPFRGGNNILVICDAYTPAGEPIPTNKRHRAAEVFSNPRVIAEVPWFGIEQEYTLLQTNVNWPLGWPVGGYPGPQGPYYCSAGADKSFGRDISDAHYKACLFAGINISGTNGEVMPGQWEYQVGPSVGIEAGDHIWASRYILERITEQAGVVLSLDPKPIEGDWNGAGCHTNYSTKSMREDGGFEVIKKAILNLSLRHKEHISAYGEGNERRLTGKHETASINTFSWGVANRGCSIRVGRDTEKNGKGYLEDRRPASNMDPYVVTSLLAESTLLWEPTLEAEALAAQKLALKV

SEQ ID NO: 21067 - DNA, 1421 bp, Cricetulus griseus (Chinese hamster)
  CDS (147)..(1268): n means a or g or c or t/u, s means g or c
nnccgagccgagaatgggagtagagccgactgcttgattcccacaccaatctcctcgccgctctcacttcgcctcgttctcgtggctcgtggccctgtccaccccgtccatcatcccgccggccaccgctcagagcaccttccaccatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagaccaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggaattccaaataggaccctgtgaaggaatccgcatgggagatcatctctgggtggcccgtttcatcttgcatcgagtatgtgaagactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccggtaccacattcgagcctacgatcccaaggggggcctggacaatgcccgtggtctgactgggttccacgaaacgtccaacatcaacgacttttctgctggtgtcgccaatcgcagtgccagcatccgcattccccggactgtcggccaggagaagaaaggttactttgaagaccgccgcccctctgccaattgtgacccctttgcagtgacagaagccatcgtccgcacatgccttctcaatgagactggcgacgagcccttccaatacaaaaactaattagactttgagtgatcttgagcctttcctagttcatcccaccccgccccagctgtctcattgtaactcaaaggatggaatatcaaggtctttttattcctcgtgcccagttaatcttgcttttattggtcagaatagaggagtcaagttctt

SEQ ID NO: 21068 - protein, 373 aa, Cricetulus griseus (Chinese hamster)
MATSASSHLNKNIKQMYLCLPQGEKVQAMYIWVDGTGEGLRCKTRTLDCEPKCVEELPEWNFDGSSTFQSEGSNSDMYLSPVAMFRDPFRRDPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWVARFILHRVCEDFGVIATFDPKPIPGNWNGAGCHTNFSTKAMREENGLKHIEEAIEKLSKRHRYHIRAYDPKGGLDNARGLTGFHETSNINDFSAGVANRSASIRIPRTVGQEKKGYFEDRRPSANCDPFAVTEAIVRTCLLNETGDEPFQYKN

SEQ ID NO: 21069 - DNA, 1910 bp, Azospirillum brasilense
  CDS (351)..(1757)
ggacggcaagatcttcgtcacccccgtggaagaagttgtccgcatccggaccggcgagaagggaggcgacgcgatctgatcgcgtcccgagaacccgaccaccggccaccatgaaccagccccgcccacaaccgacgcagagccggccgactccgatcgggccgacgcagaccgtcgcaacgcgagcggaacgatccgtgcgtggatgcccatccgggcgcgactttttgtgctgtcacgttgtgtgcttgggaaaggcatgacataacgtccgccgcgagcgccgtcacccgccccttggtcggtttgacgcagcgggacccaaacctcttaagcgtggaaaaagagatatgtccgacatcagcaaggtcttcgacctgatcaaggaacacgacgtcaagtacgtggacctccgcttcaccgacccgcgcggcaagctgcaccacaccgctcagcacgtctcgaccatcgacgaggacgtgtttgaagacggcatcatgttcgacggctcctcgatcgccggttggaaggcgatcaacgagtcggacatgatcctccagctcgacccgaccaccgccgtcatggacccgttctcggcccagccgacgctgaacatcctctgcgacgtgtacgagccgtcgaccggccagccctacgcccgctgcccgcgcggtatcgcgaaggccgccgagaagtacatggcgtcggccggcatcgcggacaccgcctacttcggcccggaagccgagttcttcgtcttcgacgacgtcaagttcaaggtcgagatgaacaaggtgtcctacgagttcgactcggaggaaggcccgtacacctcggacaaggactatgaggacggcaacctgggccaccgcccgggcgtcaagggcggctacttcccggtcgctccggtcgacagcggctcggacctgcgcgccgagatgctgagcgtgctcgccgagatgggcgtgccggtcgagaagcaccaccacgaggtggccgcttcgcagcatgagctgggcatcaagttcgacacgctggtccgcaccggcgacaacatgcagtactacaagtacgtcgtgcacaatgtcgcccacgcctacggcaagaccgcgaccttcatgccgaagcccgtcttcggcgacaacggctcgggcatgcacatgcaccagtcgatctggaaggaaggccagccgctgttcgccggcaaccagtacgccgacctgtcggaactggcgctgtactacatcggcggcatcatcaagcacgccaaggcgctgaacgccttcaccaacccgacgaccaactcgtacaagcgtctggtcccgggctacgaggctccggttctgctggcctactcggcccgcaaccgttcggcctcctgccgcatcccgtacgtcgcctcgccgaagggcaagcgcgtcgaggtccgcttcccggacccgtcggccaacccgtacctggccttcgccgccctgctgatggccggtctggacggcatccagaacaagatccatccgggcgaggcgatggacaagaacctgtacgacctgccggccgaagagctggccaaggttccgacggtttgcggctcgcgcgaggccctggacagcctgaaggccgacagcgccttcctgcagaagggcgacgtgttcaccaaggacatgatcgagtcctacatcgacctgcgcaccgaggagctgctggccttcgagaccatgccgcacccgatcgagtacaagatgtactactcggtctgatccatcggacttcggtccaccggattccggtgtccgccccgccctcgcgcgcggcgggcaccaccggagggccggaccgcggagcagagcacaaaaaaagcccacggcgacacgtcggtgggcttttttgtgtccaggagtgaagagatgcta

SEQ ID NO: 21070 - protein, 468 aa, Azospirillum brasilense
MSDISKVFDLIKEHDVKYVDLRFTDPRGKLHHTAQHVSTIDEDVFEDGIMFDGSSIAGWKAINESDMILQLDPTTAVMDPFSAQPTLNILCDVYEPSTGQPYARCPRGIAKAAEKYMASAGIADTAYFGPEAEFFVFDDVKFKVEMNKVSYEFDSEEGPYTSDKDYEDGNLGHRPGVKGGYFPVAPVDSGSDLRAEMLSVLAEMGVPVEKHHHEVAASQHELGIKFDTLVRTGDNMQYYKYVVHNVAHAYGKTATFMPKPVFGDNGSGMHMHQSIWKEGQPLFAGNQYADLSELALYYIGGIIKHAKALNAFTNPTTNSYKRLVPGYEAPVLLAYSARNRSASCRIPYVASPKGKRVEVRFPDPSANPYLAFAALLMAGLDGIQNKIHPGEAMDKNLYDLPAEELAKVPTVCGSREALDSLKADSAFLQKGDVFTKDMIESYIDLRTEELLAFETMPHPIEYKMYYSV

SEQ ID NO: 21071 - DNA, 1205 bp, Frankia sp
  CDS (59)..(1117)
cccaggccgatcacgaagtcgcaccgtttcgtgcaggaccaaccacggggagtattgaatgagttatcaggccgagtacatctggatcgacggcaccgagcccgagcctttgatgcgtagcaagacgcgcatcatcaaggacggcaaggagccggagatctggggcttcgacggctcgagcaccaaccaggcgccgggatcgaactcggactgcgtgctgcgtcccgtcttcgagacgcccgacccgatccggggaggcgacaaccgcctggtgctgtgcgaggtccagctgaccgacttcacgccaccgacgaacacccgggcggccgccctcggtgtcgccgagcggtacgccgacatgtcgcccatgttcggcatcgagcaggagtacaccttcttcaaggacggccgcccgtacggctggccggaggtcggctaccccgcgccgcagggtccgtactactgcggcgtcggcggctcgaagatgcccggtcgccagatcgtcgagcggcacacccaggcatgcctcgacgccggcctcgccatcgagggcaccaacgccgaggtcatgatgggccagtgggagttccagatcggcgtcctgcccgcgcccgccatcggcgaccagatctggttgggccgctggctgctccaccggatcgccgaggactacggcgtcgaggtgtccttcgccgcgaagccgatccccggtgactggaacggtgccggcgcgcacaccaacttctccaccaagcagacgatggagggctgggacgccatcgtcacgtgctgcgaggcgctcggcacgcgcgtcaccgagcacgtcacccactacgggaagggcatcgaggaccggctgaccggcaagcacgagaccgccccctggaacaagtactcctggggcgcctcggaccgcggcgcctcggtccgcatcccctgggccgtcgagaaggccaagaagggctggctggaggaccgtcgtccgaacgcgaacatggacccgtacctggtcaccgcgctcatgatcgacacctgctgcagcgccctggccggcgacaagccgaccctgttcgtgccgtcacagaccactccggcgcccgccgaggcgagcgtctgagcctgaccgacacgtctgcccggaccggtcggccgagcagtccgccgggccggaaacacgccggcgcggcggaggcaggcaggtcgac

SEQ ID NO: 21072 - protein, 352 aa, Frankia sp
MSYQAEYIWIDGTEPEPLMRSKTRIIKDGKEPEIWGFDGSSTNQAPGSNSDCVLRPVFETPDPIRGGDNRLVLCEVQLTDFTPPTNTRAAALGVAERYADMSPMFGIEQEYTFFKDGRPYGWPEVGYPAPQGPYYCGVGGSKMPGRQIVERHTQACLDAGLAIEGTNAEVMMGQWEFQIGVLPAPAIGDQIWLGRWLLHRIAEDYGVEVSFAAKPIPGDWNGAGAHTNFSTKQTMEGWDAIVTCCEALGTRVTEHVTHYGKGIEDRLTGKHETAPWNKYSWGASDRGASVRIPWAVEKAKKGWLEDRRPNANMDPYLVTALMIDTCCSALAGDKPTLFVPSQTTPAPAEASV

SEQ ID NO: 21073 - DNA, 1429 bp, Lactuca sativa (garden lettuce)
  CDS (16)..(1092)
catcaattcgatctcatggctcttctttcggatctcgtcaacctcgacctctctagtatcaacgataagattatcgccgagtatatatggatcggcggatcgggtatggatcttagaagcaaagcaagaacaatttcaaggcctgtgtcggatcccagtgagcttccgaagtggaactacgatggctctagcacagggcaagctcccggagaagacagtgaagtcatcatataccctcaagcaatcttcaaagatccattcaagagaggcaaccatatcttggtgatgtgtgatgcttacactcccgccggcgaaccaatccccaccaacaagagggccgccgccgccaaaatcttcagcaacccagaagtcgaaaaggaggttacatggtacggaattgagcaagaatacaccttgttgcagaaggacaccaactggccattgggttggcctctaggtggtttccctggtccacagggcccatactactgtggaattggcgctgataaagcttttggacgtgatattgttcatgcacactacaaagcttgcctttacgctggcgtcaacattagcggcatcaatggcgaagttatgcctggacaatgggaatttcaagtaggaccttccgtaggcatagctgcagctgatcaaatctgggtcgctcgttacattcttgagaggatcactgagatttatggggtggtggtttcatttgaccccaagcctattccgggtgactggaatggagctggtgctcacacaaattacagtacaaaaaccatgagggaagagggaggatatgaggtgatcaagaaagctatcgagaagttgggattgaggcacaaggaacacattgctgcatatggtgaaggcaatgaacgtaggctcactggtcgacatgaaacagctgatatcaacacctttttatggggtgttgcaaaccgtggagcttctattcgtgttggaagagacacagagaaagaagggaaaggttactttgaggacagaaggccagcttcaaacatggatccatatgtcgtgacttccatgattgctgagactaccattctgtgggacaacaaatcttgaaaagagtatcgaaaattgatgaagcactgattgggagggagatttgaaaaaattgaaattagaatggggaacaaacaaaacacccttcttgtttattttcttgaaaattagatattgttcttgtttgtttgtgttgcatgttgacgttatggttattatggtatggtagtttgtgtttcatgtttcttgtagcaaagcattttgagtccaaaatgcatgtaaagctactacttgatttgagatttctcccatggtgattcatgggaatattgtcgatattgtctatgataataacaaatatgaagggttgatttttatccaaaaaaaaaaaaaaaaa

SEQ ID NO: 21074 - protein, 358 aa, Lactuca sativa (garden lettuce)
MALLSDLVNLDLSSINDKIIAEYIWIGGSGMDLRSKARTISRPVSDPSELPKWNYDGSSTGQAPGEDSEVIIYPQAIFKDPFKRGNHILVMCDAYTPAGEPIPTNKRAAAAKIFSNPEVEKEVTWYGIEQEYTLLQKDTNWPLGWPLGGFPGPQGPYYCGIGADKAFGRDIVHAHYKACLYAGVNISGINGEVMPGQWEFQVGPSVGIAAADQIWVARYILERITEIYGVVVSFDPKPIPGDWNGAGAHTNYSTKTMREEGGYEVIKKAIEKLGLRHKEHIAAYGEGNERRLTGRHETADINTFLWGVANRGASIRVGRDTEKEGKGYFEDRRPASNMDPYVVTSMIAETTILWDNKS

SEQ ID NO: 21075 - DNA, 1434 bp, Pisum sativum (garden pea)
  CDS (83)..(1150)
cgcatagaatctgaggattcatcatccaacgatccacagtgattcaatttcaagtttcttttttcttcactttttcaaaaccatgtctctttcagatctcatcaaccttgatctctcaggaaccaccgagaaaatcatagcagaatacatatggattggtggttctggtttggacttgaggtgcaaagcaaggactcttcccggaccagttactgacccttcagagctccccaagtggaattatgatggttccagcacaggacaagctcctggacaagatagtgaagttatcttatacccacaagccatttttaaggatccattcagaaggggtaaccatatcttggttatgtgtgatgcatacagtcctgctggagaaccaattcccactaacaaaagacacgcagctgctaaggtttttagccatcctgatgttgttgctgaagaaacatggtatggtatagagcaggaatacaccttgttgcagaaagacatcaattggcctcttggttggccagctggtggttatcctggacctcagggaccatattattgcagtgttggtgctgacaaggcttttggccgtgacgttgttgaggcacattacaaagcctgtctttttgccggcatcaacatcagtggaatcaatggagaagtcatgcctggtcaatgggaatttcaagttggtccctcagtcggtatctctgctggtgatgagatatgggttgctcgctacattttggagaggatcactgaggttgctggtgtggttcttacctttgaccctaaaccaattaagggtgactggaatggtgctggtgctcacacaaactacagcaccaagtctatgagagaagacggtggatatgaaatcatcaagaaagcaattgagaagctcgggaagaggctgcccgagcacatctccgcttatggagaaggcaacgagcgcagattgacagggaaacacgaaacagctgacattaataccttctcatggggtgttgcaaaccgaggcgcttcggttcgggttggaagggacacagagaaagaagggaagggttattttgaggacaggaggccagcatctaacatggacccatacgttgttacttccatgattgcagagactaccatcctcttgaaaccataagctaccacttgtaccacaaaaaacttatactacattgtattgcaacctttgagagtcattgttggttcctcgttagagattggttcttggtttttctaggacatggctttgtgttcttgttatggttcacacgttgtttgtttctttctcttgttttacttatgtgtcacaataataatgtaatggttatcagtataataattattgttgattgtgattattaataaaaatgtatgaattgaaaatgcccatgataatgaatatgaatgagggtgtctttgtag

SEQ ID NO: 21076 - protein, 355 aa, Pisum sativum (garden pea)
MSLSDLINLDLSGTTEKIIAEYIWIGGSGLDLRCKARTLPGPVTDPSELPKWNYDGSSTGQAPGQDSEVILYPQAIFKDPFRRGNHILVMCDAYSPAGEPIPTNKRHAAAKVFSHPDVVAEETWYGIEQEYTLLQKDINWPLGWPAGGYPGPQGPYYCSVGADKAFGRDVVEAHYKACLFAGINISGINGEVMPGQWEFQVGPSVGISAGDEIWVARYILERITEVAGVVLTFDPKPIKGDWNGAGAHTNYSTKSMREDGGYEIIKKAIEKLGKRLPEHISAYGEGNERRLTGKHETADINTFSWGVANRGASVRVGRDTEKEGKGYFEDRRPASNMDPYVVTSMIAETTILLKP

SEQ ID NO: 21077 - DNA, 1540 bp, Pisum sativum (garden pea)
  CDS (68)..(1360)
gctcattctcacttgaacccattttcaacctttgctgtttttgccatttttcaactctgtattgaaaatggcgcagattttggcaccttcgacgcaatggcagatgagaatcacaaaaacctctccttgtgcaactccaatcacatcaaagatgtggagttctttggttatgaaacaaactaagaaagttgcgcattctgctaaatttagagttatggcagtcaactctgaaaatggcaccatcaatagggtagaggatttgcttaatttggacatcactccgttcaccgacagcattattgctgagtacatatggattggtgggacaggaattgatgtgcgcagcaaatcaaggaccatatcaaagcctgtttcgcatccctctgaggttcctaagtggaactatgatggatctagcactggacaagcccctggtgaagatagtgaagtgatcctatatcctcaagcaattttcaaagatcctttccgtggcggaaacaatattttggtcgtttgtgatgcgtatacaccagcaggtgagcctatccctacaaataagagacacagagctgctgaaatcttcagtaacccaaaggttgaggctgagattccatggtatggaatagaacaagagtacactttacttcaaacaaatgtgaaatggccattaggttggcctgtaggtggctatcccggtcctcagggtccttattactgtgctgccggagcagataagtcatttggacgtgatatatctgatgctcattacaaggcttgcatatatgctggaattaacattagtggcaccaatggagaagttatgcctggacagtgggagtatcaagttggtcctagtgtaggtattgaagctggtgatcatatctgggcttcacggtacatccttgagagaattactgaacaagctggtgttgtgctcactcttgatccaaaaccaatagagggtgattggaatggtgcaggatgtcacaccaattacagtacaaagagcatgagggaagatggagggtttgaggtgataaagaaggccattttgaacctttcccttcgccacaagatccacattgaagcatacggagaaggaaacgaaagaaggttgacaggaaagcatgagacagccagcattaacgacttttcttggggagtggctaaccggggatgctcaatccgtgtgggaagagacaccgagaagaatggcaaaggttacttggaagacaggcgtccggcttcgaacatggatccatatgtggtaacagcattactggcagaaagtacattattgtgggaaccaactctagaggctgaagctcttgcagctcagaagattgcattaaaggtctaaatctattgacttccagatggaggctgtgaggaactgagaagctgttttagatgatttatattatattatgaagatcttgttttctggactcgccatgcctagttactggttatgagatgagtgcacattgtatttgcatatatggtatggacagaattgcattgatgatttgctttggtt

SEQ ID NO: 21078 - protein, 430 aa, Pisum sativum (garden pea)
MAQILAPSTQWQMRITKTSPCATPITSKMWSSLVMKQTKKVAHSAKFRVMAVNSENGTINRVEDLLNLDITPFTDSIIAEYIWIGGTGIDVRSKSRTISKPVSHPSEVPKWNYDGSSTGQAPGEDSEVILYPQAIFKDPFRGGNNILVVCDAYTPAGEPIPTNKRHRAAEIFSNPKVEAEIPWYGIEQEYTLLQTNVKWPLGWPVGGYPGPQGPYYCAAGADKSFGRDISDAHYKACIYAGINISGTNGEVMPGQWEYQVGPSVGIEAGDHIWASRYILERITEQAGVVLTLDPKPIEGDWNGAGCHTNYSTKSMREDGGFEVIKKAILNLSLRHKIHIEAYGEGNERRLTGKHETASINDFSWGVANRGCSIRVGRDTEKNGKGYLEDRRPASNMDPYVVTALLAESTLLWEPTLEAEALAAQKIALKV

SEQ ID NO: 21079 - DNA, 1169 bp, Oryza sativa (rice)
  CDS (59)..(1132)
ttctacacctcattttccgcttgcatcttgctcattcagatctcttctgctttgagcaatggccaacctcaccgacctcgttaacctcaacctcagcgactgcagcgacaagatcatcgccgagtacatctgggttggaggatcgggcatagacctcaggagcaaagcgaggactgtgaaaggccccatcaccgatgtgagccagctgccgaagtggaactacgacggctccagcaccgggcaggctcccggcgaggacagcgaagtgatcctctaccctcaagccattttcaaggacccgttcaggaggggcgacaacatccttgtgatgtgcgactgctacacgccacaaggtgagccaatccccactaacaagaggcacagtgccgccaagatcttcagccaccctgatgttgttgctgaggtgccatggtacggtattgagcaggagtacacactccttcaaaaggatgtgaactggccccttggctggccagttggtggcttccctggcccacagggaccatactactgcgctgccggtgccgaaaaggcgttcggccgcgacatcgtggacgcccactacaaggcctgcatctacgccgggatcaacatcagtggcatcaacggggaagtcatgcccggccagtgggagttccaagttggcccgtcagttggcatcgccgctgctgaccaagtgtgggttgcccgctacatcctcgagagggtcacagaggtggccggagtcgtgctctcccttgacccgaagccgatcccgggtgactggaatggcgctggtgcccacaccaacttcagcaccaagtcgatgagggagccgggaggctacgaggtgatcaagaaggcgatcgacaagctcgcgctgaggcacaaggagcacatcgccgcctacggcgagggcaacgagcgccgcctcaccggccgccacgagaccgccgacatcaacaccttcaaatggggcgtggcgaaccgcggcgcgtccatccgcgtggggcgcgacacggagaaggagggcaaggggtacttcgaggacaggaggccggcgtccaacatggacccatacgtcgtcaccggcatgatcgccgagaccacgctgctgtggaagcagaactaagccgtccggcgggcctctcccgtgcatttctgcgccc

SEQ ID NO: 21080 - protein, 357 aa, Oryza sativa (rice)
MANLTDLVNLNLSDCSDKIIAEYIWVGGSGIDLRSKARTVKGPITDVSQLPKWNYDGSSTGQAPGEDSEVILYPQAIFKDPFRRGDNILVMCDCYTPQGEPIPTNKRHSAAKIFSHPDVVAEVPWYGIEQEYTLLQKDVNWPLGWPVGGFPGPQGPYYCAAGAEKAFGRDIVDAHYKACIYAGINISGINGEVMPGQWEFQVGPSVGIAAADQVWVARYILERVTEVAGVVLSLDPKPIPGDWNGAGAHTNFSTKSMREPGGYEVIKKAIDKLALRHKEHIAAYGEGNERRLTGRHETADINTFKWGVANRGASIRVGRDTEKEGKGYFEDRRPASNMDPYVVTGMIAETTLLWKQN

SEQ ID NO: 21081 - DNA, 1287 bp, Oryza sativa (rice)
  CDS (1)..(1287)
atggcgcaggcggtggtgccggcgatgcagtgccaggtcggggccgtgcgggcgaggccggcggcggctgcggcggcggcgggggggagggtgtggggagtcaggaggaccgggcgcggcacgtcggggttcagggtgatggccgtgagcacggagaccaccggggtggtgacgcggatggagcagctgctcaacatggacaccacccccttcaccgacaagatcatcgccgagtacatctgggttggaggaactggaattgacctcagaagcaaatcaaggacaatatcaaaaccagtggaggacccctcggagctaccaaaatggaactacgatggatcaagcacagggcaagctccaggagaagatagtgaagtcatcttatacccacaggctatattcaaggacccatttcgaggtggcaacaacatattggttatgtgtgatacctacacaccagctggggaacccatccctactaacaaacgtaacagggctgcacaagtattcagtgatccaaaggttgtcagccaagtgccatggtttggaatagaacaggagtacactttgctccagagagacgtaaactggcctcttggctggcccgttggaggctaccctgggccccagggtccatactactgcgctgtaggatcggacaaatcgtttggccgtgacatatcagatgctcactacaaggcatgtctttatgctggaattaacattagtggaacaaatggagaggtcatgcctggtcagtgggagtaccaggttggacctagtgtcggtattgaagctggagaccacatatggatttcaagatatattcttgagagaataacggagcaggctggtgtagtgcttacccttgaccccaaaccaattcagggagactggaatggagctgggtgccacacaaactacagcaccaagagtatgcgtgaagatggaggatttgaggtgatcaagaaggcaatcctaaacctatcacttcgccatgacttgcatataagtgcatatggtgaaggaaatgaaaggaggttgacaggtttacacgagacagctagcattgacaatttctcatggggtgtggcaaaccgtggatgctctattcgggtggggcgagacaccgaggcgaagggaaaaggctacttggaagaccgtcgcccggcatcaaacatggacccgtacgtcgtgacagcgctattggctgaaaccacaattctttgggagccaaccctcgaagcggaggttcttgctgctaagaagttggccctgaaggtatga

SEQ ID NO: 21082 - protein, 428 aa, Oryza sativa (rice)
MAQAVVPAMQCQVGAVRARPAAAAAAAGGRVWGVRRTGRGTSGFRVMAVSTETTGVVTRMEQLLNMDTTPFTDKIIAEYIWVGGTGIDLRSKSRTISKPVEDPSELPKWNYDGSSTGQAPGEDSEVILYPQAIFKDPFRGGNNILVMCDTYTPAGEPIPTNKRNRAAQVFSDPKVVSQVPWFGIEQEYTLLQRDVNWPLGWPVGGYPGPQGPYYCAVGSDKSFGRDISDAHYKACLYAGINISGTNGEVMPGQWEYQVGPSVGIEAGDHIWISRYILERITEQAGVVLTLDPKPIQGDWNGAGCHTNYSTKSMREDGGFEVIKKAILNLSLRHDLHISAYGEGNERRLTGLHETASIDNFSWGVANRGCSIRVGRDTEAKGKGYLEDRRPASNMDPYVVTALLAETTILWEPTLEAEVLAAKKLALKV

SEQ ID NO: 21083 - DNA, 1553 bp, Oryza sativa (rice)
  CDS (55)..(1125)
accctccttgttacagctgtgccgcctcttgcttcctcctcctcatcgtccgccatggcttctctcaccgatctcgtcaacctcaacctctccgacaccacggagaagatcatcgccgagtacatatggatcggtggatctggcatggatctcaggagcaaggctaggactctctccggccctgtgactgatcccagcaagctgcccaagtggaactacgatggctccagcaccggccaggcccccggcgaggacagtgaggtcatcctgtacccacaggctatcttcaaggacccattcaggaagggaaacaacatccttgtcatgtgcgattgctacacgccagccggagaaccgatccccaccaacaagaggcacaatgctgccaagatcttcagctcccctgaggttgcttctgaggagccctggtacggtattgagcaagagtacaccctcctccagaaggacatcaactggccccttggctggcctgttggtggcttccctggtcctcagggtccttactactgtggtatcggtgctgacaagtcttttgggcgtgatattgttgactcccactacaaggcttgcctctatgccggcatcaacatcagtggaatcaacggcgaggtcatgccaggacagtgggagttccaagttggcccgtctgtcggcatttctgccggtgatcaggtgtgggttgctcgctacattcttgagaggatcaccgagatcgccggagtcgtcgtctcatttgaccccaagcccatcccgggagactggaacggtgctggtgctcacaccaactacagcaccaagtcgatgaggaacgatggtggctacgagatcatcaagtccgccattgagaagctcaagctcaggcacaaggagcacatctccgcctacggcgagggcaacgagcgccggctcaccggcaggcacgagaccgccgacatcaacaccttcagctggggagttgccaaccgcggcgcctcggtccgcgtcggccgggagacggagcagaacggcaagggctacttcgaggatcgccggccggcgtccaacatggacccttacatcgtcacctccatgatcgccgagaccaccatcatctggaagccctgaagcggcttcttgacgccacgacatcctcgtcatcgtcctccccagctcgccgtgtcgctccggttgctccattgatcggacgatctggtgaattgcatttgtgctgggagaagtaaaaaaaaaaggaaagagaaaaaaaagaaaatcacgccaaaaaaaattctcattccatttcgatttggttgcatgctaccactactactacattgctcatctgccatttagattagctcctttttcttcgtcttttgggtgagtgcgtttgggtgctcttgtgtaatcctccaataatggccgtacctacggtacttgtcccatcctgtggatcatcgtcctcctttccacatgtggttttatcatcattgttattagtgatcacctttatataaagttcttgctgggcttccaatagccgtggcttttgcgtt

SEQ ID NO: 21084 - protein, 356 aa, Oryza sativa (rice)
MASLTDLVNLNLSDTTEKIIAEYIWIGGSGMDLRSKARTLSGPVTDPSKLPKWNYDGSSTGQAPGEDSEVILYPQAIFKDPFRKGNNILVMCDCYTPAGEPIPTNKRHNAAKIFSSPEVASEEPWYGIEQEYTLLQKDINWPLGWPVGGFPGPQGPYYCGIGADKSFGRDIVDSHYKACLYAGINISGINGEVMPGQWEFQVGPSVGISAGDQVWVARYILERITEIAGVVVSFDPKPIPGDWNGAGAHTNYSTKSMRNDGGYEIIKSAIEKLKLRHKEHISAYGEGNERRLTGRHETADINTFSWGVANRGASVRVGRETEQNGKGYFEDRRPASNMDPYIVTSMIAETTIIWKP

SEQ ID NO: 21085 - DNA, 1208 bp, Streptomyces hygroscopicus
  CDS (136)..(1158)
gaattccttggaaacggctggatgtccggctcggtaacctgtggttcacaaacgggcaacggacgagaaatggcgcgttgcgagagtgcggaggtacgcccgcaccgtacccgcaccgaccgtgaagaggaccccatgagcatcaaggccgagtacatctggatcgacggcacgcagccgaccgccaagctccgctccaagaccaagatcctgtccgacggcagccggcttccgcggtggggcttcgacggttccagcaccaaccaggccgaaggccacgcctcggacctcgtactggagccggtgttcagctgcccggacccgatccgcggcggcgaccacctgctggtgctgtgcgaggtgctgcacaccgacctcaccccgcacccctccaacacccgggcgctgctgcgcccggtcgcggagcggttcgccggccaggagccgatcttcggcatcgagcaggagtacaccttcctcaagggcgaccgcccgctcggcttccccgagggcggcggctacccggccccgcaggccgactactactgcggcgtgggcgccgacgcgatcttcggccgggagatcgtcgagaagcacctcgacctgtgcctggcggccggtctgggcctgtccggcatcaacgccgaggtcatgcccggccagtgggagttccaggtcggcgcgctgccgccgctggaggtctcggaccacatgtgggtggcgcgctggctgctgcaccgggtggcggaggagttcggcgtcaccgcgtcgctggacgccaagccggccaagggcgactggaacggcgcgggcgcgcacaccaacttctccacccgcgcgatgcgcgagggctacgacccgatcatcaccgcctgcgaggcgctgggccaggacgacaagccgctggagcacgtccgccagtacggcaccggcatcgaggaccggctgaccggcgcgcacgagaccgccccctgggacgcgtactcctacggcgcctccgaccgcggcgcctcggtgcgcatcccctggcaggtcgaggtcgagaagaagggctacatcgaggaccggcgcccgaacgccaacgtcgacccgtacgtggtcacccggctgatggtggacacctgctgcacggagctggcgcggcgcgagcagatctgacgcctgcggtcacgtggccgtgcggtcacgtgaccgcacggtcgcgcgag

SEQ ID NO: 21086 - protein, 340 aa, Streptomyces hygroscopicus
MSIKAEYIWIDGTQPTAKLRSKTKILSDGSRLPRWGFDGSSTNQAEGHASDLVLEPVFSCPDPIRGGDHLLVLCEVLHTDLTPHPSNTRALLRPVAERFAGQEPIFGIEQEYTFLKGDRPLGFPEGGGYPAPQADYYCGVGADAIFGREIVEKHLDLCLAAGLGLSGINAEVMPGQWEFQVGALPPLEVSDHMWVARWLLHRVAEEFGVTASLDAKPAKGDWNGAGAHTNFSTRAMREGYDPIITACEALGQDDKPLEHVRQYGTGIEDRLTGAHETAPWDAYSYGASDRGASVRIPWQVEVEKKGYIEDRRPNANVDPYVVTRLMVDTCCTELARREQI

SEQ ID NO: 21087 - DNA, 1032 bp, Streptomyces viridochromogenes
  CDS (1)..(1032)
atgaccttcaaggctgagtacatctggatcgacggcaccgagccgacggccaagctccgttccaagaccaagatcatcacgggtcagcccgccggtctcgacgcgctgccgatctggggcttcgacgggtcctccaccaaccaggccgaggggcactcctcggactgtgtcctgaagccggtcttcacctgcccggacccgatccgtggcggcgacgacatcctggtgctgtgcgaggtcctgaacatcgacctcaccccgcacgccagcaacacccgtgccgcgctggccgaggtcgccgagaggttcgccgctcaggagccgatcttcggcatcgagcaggagtacaccttcttccaggacggctacccgctcggcttccccaagggcggcttcccggccccgcagggcggctactactgcggtgtcggcgccgacgagatcttcggccgtgacgtcgtcgaggcgcacctcgacaactgcctgaaggccggtctcgccatctccggcatcaacgccgaggtcatgcccggccagtgggagttccaggtcggcccggtctccccgctggaggtctccgaccacctgtgggtggcccgctggctgctctaccgaaccgccgaggacttcgacgtcgccgccaccctggacccgaagccggtcaagggcgactggaacggcgccggcgcgcacaccaacttctccaccaaggcgatgcgcgagtcctacgacgcgatcatcaccgcggccgagtcgctcggtgagggctccaagccgctcgaccacgtcaagaactacggcgccggcatcgacgaccgcctgaccggtctgcacgagaccgccccgtggaacgagtactcctacggcgtctccgaccgcggtgcctcggtccgtatcccgtggcaggtcgagaaggacggcaagggctacatcgaggaccgccgtccgaacgccaacgtggacccgtacgtggtgacgcgtctgctcgtcgacacctgctgctcggcgctggagaaggccggccaggtctga

SEQ ID NO: 21088 - protein, 343 aa, Streptomyces viridochromogenes
MTFKAEYIWIDGTEPTAKLRSKTKIITGQPAGLDALPIWGFDGSSTNQAEGHSSDCVLKPVFTCPDPIRGGDDILVLCEVLNIDLTPHASNTRAALAEVAERFAAQEPIFGIEQEYTFFQDGYPLGFPKGGFPAPQGGYYCGVGADEIFGRDVVEAHLDNCLKAGLAISGINAEVMPGQWEFQVGPVSPLEVSDHLWVARWLLYRTAEDFDVAATLDPKPVKGDWNGAGAHTNFSTKAMRESYDAIITAAESLGEGSKPLDHVKNYGAGIDDRLTGLHETAPWNEYSYGVSDRGASVRIPWQVEKDGKGYIEDRRPNANVDPYVVTRLLVDTCCSALEKAGQV

SEQ ID NO: 21089 - DNA, 1270 bp, Bradyrhizobium japonicum
  CDS (281)..(1270)
catcggcaacctccggcaccggccggcctgctccagaatcaggcgttttccgcgggatttttgcagtgcagcttcacgcaaaggtgcgccgctatgacgcacgccgccggggacgaccggccgctcgcggggggggggggggcggccgcggtggaaaacctcccgcaatgcggccttttggcacgctaaatgcttgtaaacggtcggccgatggtggccgggtacaaacgtggggggcccccgggcccccaacctttcgcatcatctacagagaggctcaatgaccaagtataagctcgagtacatctggctcgacggatatacgccgactccgaacttgcgcggcaaaactcagatcaaggaattcgcgtcgttcccgacgctcgagcacgttccgctctggggcttcgatggctcctccacccagcaggccgaaggccacagctctgattgcgtgctgaagccagtcgccgtcttcccggacgccgcgcgcaccaacggcgtgctcgtgatgtgcgaagtcatgatgcccgatggcaagaccccgcacgcctccaacaagcgcgccaccattctcgacgacgccggcgcctggttcggcttcgagcaggaatacttcttctacaaggacggccgtccgctcggcttcccgacctccggttatccggcgccgcagggcccgtactacaccggcgtcggcttctcgaacgtcggcgacgtggcccgcaagatcgtcgaagagcatctcgacctctgcctcgcggccggcatcaaccatgaaggcatcaacgcggaagtcgcgaagggccagtgggaattccagatcttcggcaagggctccaagaaggccgctgacgaaatgtggatggcccgctacctgatgctgcgcctgaccgagaagtacggcatcgacatcgagttccactgcaagccgcttggcgacacggactggaacggctccggcatgcacgccaacttctcgaccgagtacatgcgcacggtcggcggcaaggagtacttcgaggcgctgatggctgccttcgacaagaacctgatggaccacatcgccgtctacggcccggacaacgacaagcgtctgaccggcaagcacgagaccgcgccgtggaacaagttcagctacggcgtggccgaccgcggcgcttcgatccgcgtgccgcactccttcgtcaacaacggctacaagggctatctggaagaccgtcgcccgaactcgcagggcgacccataccagatcgttcgcagatcctga

SEQ ID NO: 21090 - protein, 329 aa, Bradyrhizobium japonicum
MTKYKLEYIWLDGYTPTPNLRGKTQIKEFASFPTLEHVPLWGFDGSSTQQAEGHSSDCVLKPVAVFPDAARTNGVLVMCEVMMPDGKTPHASNKRATILDDAGAWFGFEQEYFFYKDGRPLGFPTSGYPAPQGPYYTGVGFSNVGDVARKIVEEHLDLCLAAGINHEGINAEVAKGQWEFQIFGKGSKKAADEMWMARYLMLRLTEKYGIDIEFHCKPLGDTDWNGSGMHANFSTEYMRTVGGKEYFEALMAAFDKNLMDHIAVYGPDNDKRLTGKHETAPWNKFSYGVADRGASIRVPHSFVNNGYKGYLEDRRPNSQGDPYQIVRRS

SEQ ID NO: 21091 - DNA, 1446 bp, Helicobacter pylori
  CDS (1)..(1446)
atggtagtaagaactcaaaatagcgaaagcaagatcaaagagttttttgaattttgcaaagaaaatgaagtagaatttgtggattttagattcagcgatattaaaggcacttggaaccatatcgcttattcttttggggctttaacgcatgatatgtttaaagaagggattccttttgatgcgagctcttttaaaggctggcaaggcattgaacactccgatatgattttaacccccgatttggtgcgttatttcattgacccttttagtgcggatgtgagcgcggtcgtgttttgcgatgtgtatgatgtgtataaaaaccagccttatgaaaaatgccctagaagtatcgctaaaaaagccctaaaacatttaagagatttaggcttgggcgatgtggcttattttggcgcggagaatgaattttttatctttgattctattaagattaaagacgcttccaattcccaatactacgaagtggatagcgaagagggcgaatggaatagggataaaagctttgaaaacggcgtgaattttgggcatagaccgggaaagcaaggaggctatatgcctgtgcctccaacggatacgatgatggatattcgcacagaaatcgtgaaagtcttaaaccaagtggggttagaaacttttgtcgttcatcatgaagtcgcgcaagcgcaaggcgaagtgggcgtaaaatttggggatttagtggaagccgctgataatgtccaaaaactcaaatatgtggttaaaatggtcgctcatttaaatgggaaaacggctactttcatgccaaaacccctatatggggataatgggagtgggatgcacacccatgtgagtatttggaagaataacgaaaacctttttggtggcgaaacttacaagggcttgagcgagtttgcgttgtattttttagggggcgtgttgcgccacgctagagggttagccgctttcactaacgcttccaccaattcttacaaacgcctgattccgggatatgaagccccatccattttaacttattcagccagcaataggagcgctagcgtgcgtatcccttatgggatttctaaaaatagtgctaggtttgaattcaggtttcctgacagctcatcaaacccctacctggcttttggggctattttaatggcgggcattgatggcattaaaaataaaatggatcccggcgaagcgatggacattaaccttttcaagctaactttggacgaaatcagagaaaaaggcatcaaacaaatgccccacactttaaggagatcgttagaagaaatgctagccgataagcagtatttaaaagagggtcaggtctttagcgaagaatttatccaggcctatcagtctcttaaattccattctgaagtgttcccatgggagagtaaaccccatccttttgaatttatcaccacttattcatgctaa

SEQ ID NO: 21092 - protein, 481 aa, Helicobacter pylori
MVVRTQNSESKIKEFFEFCKENEVEFVDFRFSDIKGTWNHIAYSFGALTHDMFKEGIPFDASSFKGWQGIEHSDMILTPDLVRYFIDPFSADVSAVVFCDVYDVYKNQPYEKCPRSIAKKALKHLRDLGLGDVAYFGAENEFFIFDSIKIKDASNSQYYEVDSEEGEWNRDKSFENGVNFGHRPGKQGGYMPVPPTDTMMDIRTEIVKVLNQVGLETFVVHHEVAQAQGEVGVKFGDLVEAADNVQKLKYVVKMVAHLNGKTATFMPKPLYGDNGSGMHTHVSIWKNNENLFGGETYKGLSEFALYFLGGVLRHARGLAAFTNASTNSYKRLIPGYEAPSILTYSASNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQVFSEEFIQAYQSLKFHSEVFPWESKPHPFEFITTYSC

SEQ ID NO: 21093 - DNA, 1368 bp, Bacillus halodurans
  CDS (1)..(1368)
atgaagatgacgaccgtttcagtgccgacgcgtgagagtttgatcgaggaaattaaagagacaatcaaaacgaaaaacgttgaacttctacacctacagttcgtagatattgaaggaattttaaagcatgtaactgttactgcggaacaaatcgatagcgtggttgatggaaaaattatgttcgatggttcatccattactggtttcacaccgatcaaccagtcagatttatacttgcagcctgacctaacaacatttgctgtattgccttggacggaagaagagggctattcagaagggcgttttctctgtagcgtaaaaaagccagatgggtctgactttgaaggagatccgcgtaacatcttaaagaaaacggtagaacgtgcaaaagaaaaagggtattccatcagtgtcggacccgaattagaattcttcctttttgaaacagatgagtatggacttcctacaaagcaaacacaagacatcggtggatacttcgaaccatctccaaaagataacggagaaaaagttcgccttgaaatttatcgtacgttaaaggccatgggctttaccattgaggcgtctcaccacgaggtagctgagggccagcatgagatcaactttaaatatgctgatgctttaggatctgctgatgcagcgacaacgtataaatgggtcgttaaaaccgttgcgaagcaattcgggcttcacgcaacatttatgccgaagccacttggtggtgcaaacggtagcggaatgcatacaaacatctcattgtttgatgatgagaagcaagaaaatgcattctatgatgaaagtgacaaactaggactctcaaaaacagcttatcaatttattgctggtttaattgaaaatgtaaaagatttcgttgcggtaacgaacccgcttgtaaactcttataagcgccttgtgccaggatatgaagcaccttgctacatcgcatggtctgcttccaaccgttcggccctaatccgtattccagcaacacgcggagctggaacacgtgtggaaatccgttgcccagacccagctgctaacccttatttagcattcgctgttgtcgcttctgctggtttggacggagtggaacaagagcttacagcaccagcttctgttgatgctgatatcttccacatgagcgcagaggaaattgctgagcgcggaattgaaaacttacctacaagccttgaagaagcaattaatcgctttgaagaaggggaaattggtaagaaaacattcggtgagcacgctttcggcgagtatgtagcgttgaaacgtggagagtgggatgaattccgtacaacggttcacgattgggaagtagcagcttaccaaggtaaattctaa

SEQ ID NO: 21094 - protein, 455 aa, Bacillus halodurans
MKMTTVSVPTRESLIEEIKETIKTKNVELLHLQFVDIEGILKHVTVTAEQIDSVVDGKIMFDGSSITGFTPINQSDLYLQPDLTTFAVLPWTEEEGYSEGRFLCSVKKPDGSDFEGDPRNILKKTVERAKEKGYSISVGPELEFFLFETDEYGLPTKQTQDIGGYFEPSPKDNGEKVRLEIYRTLKAMGFTIEASHHEVAEGQHEINFKYADALGSADAATTYKWVVKTVAKQFGLHATFMPKPLGGANGSGMHTNISLFDDEKQENAFYDESDKLGLSKTAYQFIAGLIENVKDFVAVTNPLVNSYKRLVPGYEAPCYIAWSASNRSALIRIPATRGAGTRVEIRCPDPAANPYLAFAVVASAGLDGVEQELTAPASVDADIFHMSAEEIAERGIENLPTSLEEAINRFEEGEIGKKTFGEHAFGEYVALKRGEWDEFRTTVHDWEVAAYQGKF

SEQ ID NO: 21095 - DNA, 1410 bp, Caulobacter crescentus
  CDS (1)..(1410)
atgagcaccgccaaggacatcctgaacctgatcaaggaaaaggacgtgaagtacgtcgacgtccgtttcacggacgtgcgcggcaagatgcagcacgtgaccttcgacatcgacctcgtcgacgacgacttcctgaacgacggcaccatgttcgacggttcgtcgatcgccggctggaaggccatcaacgagtcggacatgaagctgcgccccgacctgtcgagcgcgatcatcgacccgttctaccagcagaccacgctggcgctgttctgcgacgtcgtgaaccccgacaccggcacgccctacaaccgcgacccgcgttcgatcgccaaggccgcgctgaactacctgaagtcggccggcgtgggcgacaccgtctacttcggccctgaagccgagttcttcatcttcgacgacgtgcgctggtcgaccgccccgcacgacaccagctactcgttcgattcgaccgaactgccggtcaactcgaacaagcagtacgccgaaggcaacatgggccaccgcccgggcccgaagggcggctacttcccggtgaacccggtcgacagctgccaagacctgcgcggcgaaatgctggccgtcatgggcgagctgggcatgaagccggaaaagcaccaccacgaagtggcgccggcccagcacgagcttggcctgaagttcgacaccatggtcaccatggccgaccggatgcagctctataagtacgtcatccacaacgtcgcggccgcctacggcaagaccgccaccttcatggccaagccgatgttcgccgacaacggttcgggcatgcacgtgcaccagtcgatctggcaggacggcaagccgctgttcgccggcgacaagtatgctggcctgtcgcaggaatgcctgtggtacatcggcggcatcatcaagcacgccaaggccatcaacgcgttctcgaactcgacgacgaactcgtacaagcgcctggtgcccggctacgaagccccggtgaagctggcctacagctcgcgcaaccgctcggcctcgatccgcatcccgcacgtcgactcgccgaaggctaagcgtctggaagcccgcttccccgacccgatgggcaacccctacctgacgttcgtcgctctgctgatggccggcctggacggcatcatcaacaagatcgatccgggcgctccggccgacaagaacctgtacgatctgccgccccgcgagcagaagaagatcccggaagtctgcggctcgctgcgcgaagccctggaaaacctcgacaaggaccgcgccttcctgaaggccggcggtgtcatggatgacgacttcatcgacagctacatcgagctgaagatggaagaggtgatgcgcctgcaactgcacccgcacccggtcgaattcgagatgtactacaagtgctaa

SEQ ID NO: 21096 - protein, 469 aa, Caulobacter crescentus
MSTAKDILNLIKEKDVKYVDVRFTDVRGKMQHVTFDIDLVDDDFLNDGTMFDGSSIAGWKAINESDMKLRPDLSSAIIDPFYQQTTLALFCDVVNPDTGTPYNRDPRSIAKAALNYLKSAGVGDTVYFGPEAEFFIFDDVRWSTAPHDTSYSFDSTELPVNSNKQYAEGNMGHRPGPKGGYFPVNPVDSCQDLRGEMLAVMGELGMKPEKHHHEVAPAQHELGLKFDTMVTMADRMQLYKYVIHNVAAAYGKTATFMAKPMFADNGSGMHVHQSIWQDGKPLFAGDKYAGLSQECLWYIGGIIKHAKAINAFSNSTTNSYKRLVPGYEAPVKLAYSSRNRSASIRIPHVDSPKAKRLEARFPDPMGNPYLTFVALLMAGLDGIINKIDPGAPADKNLYDLPPREQKKIPEVCGSLREALENLDKDRAFLKAGGVMDDDFIDSYIELKMEEVMRLQLHPHPVEFEMYYKC

SEQ ID NO: 21097 - DNA, 1035 bp, Sinorhizobium meliloti
  CDS (1)..(1035)
atgaccaagtataagctcgagtacatctggctcgatggctacacgcccgtcccaaatctccgcgggaagacgcagatcaaggaattcgacgcgtttccgacgctcgagcagcttccgctctggggcttcgacggcagctcgacgcagcaggccgaagggcgcagctccgattgcgtcctgaagccggttgccgtctatcccgatccggtccgcacgaatggcgcattggtcatgtgcgaggtcatgatgcctgacggcaagacgccgcatccgtcgaatacccgtgcaacggttctcgacgatgaaagcgcctggttcggcttcgagcaggaatatttcttctacaagaacggccgcccgctgggcttcccggagcagggctatccggcgccgcagggcccgtactacaccggcgtgggctacaagaatgtcggcgacatcgcgcgccagatcgtcgaagagcatctcgacatctgcctggccgcgggcatcaaccacgaaggcatcaacgccgaagtggccaagggccaatgggaattccaggtcttcggcaagggctccaagaaggctgccgatgaagtctggctggcgcgctaccttctgctgcgcctaacagagaaatacggcatcgacgtcgagttccactgcaagccgctcggcgacacggactggaacggctccggcatgcacgccaacttctcgactgcctatctgcgcgaagtcggcggcaaggactatttcgaagcgctgatggcagccttcgagaagaacctgcacgaccacatcaacgtctatggcccggacaaccacttgcgcctgaccggcaagcacgagacggcgccgtgggacaagttcagctacggcgtggccgaccgcggcgcctccattcgcgttccgcacagcttcgtcaacaacggctatcgcggctatctcgaagatcgccgcccgaactcccagggcgacccctaccagatcgcttcggtcatcctgaagacgatctcgagcgtgccgacggcggttgccaaggtcgcttga

SEQ ID NO: 21098 - protein, 344 aa, Sinorhizobium meliloti
MTKYKLEYIWLDGYTPVPNLRGKTQIKEFDAFPTLEQLPLWGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARQIVEEHLDICLAAGINHEGINAEVAKGQWEFQVFGKGSKKAADEVWLARYLLLRLTEKYGIDVEFHCKPLGDTDWNGSGMHANFSTAYLREVGGKDYFEALMAAFEKNLHDHINVYGPDNHLRLTGKHETAPWDKFSYGVADRGASIRVPHSFVNNGYRGYLEDRRPNSQGDPYQIASVILKTISSVPTAVAKVA

SEQ ID NO: 21099 - DNA, 1212 bp, Squalus acanthias (spiny dogfish)
  CDS (1)..(1212)
atgcggatctgtcgcagtttcctgtttctggtaaaaaaatgcggcaatatcacgccgacgatttggcggaatcaacatacttacaagatggccacgtcagccagcgccaatctcagcaaaatcgtcaagaagaattacatggagctgccccaagatggcaaggtgcaagcgatgtacatctggatagacggcacaggggaggccgtccgctgcaagaccagaaccttggacaatgagcccaagagcattgccgaactcccagaatggaacttcgatggctcaagtacgtatcagtcagaggggtccaacagcgacatgtacctggttccatctgccatgttccgggatcctttccgtagggatccaaacaagctcgtcctctgtgaggtcctcaagtataacaggaagccagcagaatctaatcttagacactcatgccagaaaatcatgtccatgatcgcaaatgaatatccatggtttggaatggaacaagagtacactttgctgggaacggacggtcatccctttggatggccttccaattgctttcctggaccacaagggccctattactgtggagttggtgcagacaaagcttacggcagagatattgtcgaggctcactaccgggcgtgtctgtatgctggaattgaactcagtggaaccaatgctgaagttatggctgctcagtgggaataccaagttggaccttgtgaaggtatccagatgggtgaccacttgtggatttccaggtttattctgcacagggtgtgcgaggacttcggtatcattgctagctttgaccctaagcccattcctggcaactggaatggtgctgggtgccacactaactttagcaccaaagccatgcgggatgatggagggttgaagtacattgaagactcaattgaaaaactgggcaagaggcatcagtaccacattcgtgcctatgatcctaaaggagggttggacaatgctagagctttgacaggccaccatgaaacctcaaatatcaatgagttctcagctggtgttgccaatagaggagccagcatccgaatccctcgatccgttggccaggacaagaaaggctactttgaagaccgccgtccatctgctaattgtgacccttatgcagtcacagaagcattggtccgcacatgcctattggatgagtctggggacaagcctattgagtacaacaaaaattaa

SEQ ID NO: 21100 - protein, 403 aa, Squalus acanthias (spiny dogfish)
MRICRSFLFLVKKCGNITPTIWRNQHTYKMATSASANLSKIVKKNYMELPQDGKVQAMYIWIDGTGEAVRCKTRTLDNEPKSIAELPEWNFDGSSTYQSEGSNSDMYLVPSAMFRDPFRRDPNKLVLCEVLKYNRKPAESNLRHSCQKIMSMIANEYPWFGMEQEYTLLGTDGHPFGWPSNCFPGPQGPYYCGVGADKAYGRDIVEAHYRACLYAGIELSGTNAEVMAAQWEYQVGPCEGIQMGDHLWISRFILHRVCEDFGIIASFDPKPIPGNWNGAGCHTNFSTKAMRDDGGLKYIEDSIEKLGKRHQYHIRAYDPKGGLDNARALTGHHETSNINEFSAGVANRGASIRIPRSVGQDKKGYFEDRRPSANCDPYAVTEALVRTCLLDESGDKPIEYNKN

SEQ ID NO: 21101 - DNA, 1617 bp, Xenopus laevis (African clawed frog)
  CDS (65)..(1243)
aacaaacttgctgaggaaacgaagatcggggcttcttcccttgctcataagatcagctgccgccatgtcagtctcccacagttcgagactcaacaagggggtgagggaacagtacatgaaactgccccaaggagaaaaggtccaggtcacctacgtgtggatcgacggcaccggggaaggagtgaggtgcaaaaccaggactctggatcaggaacccaaaaccatagatgaaatccctgaatggaacttcgatggatccagtactcaccaagcagaaggctcaaacagtgacatgtatctcatcccagtccagatgttcagagacccattctgcctggaccccaataaactggttatgtgtgaagtcttgaaatacaaccgcaagtctgcagagaccaacctgagacacacatgcaagaagatcatggagatggtgaatgaccaccgcccgtggtttggaatggagcaggaatacaccttgctgggcattaatgggcacccgtatggctggccagaaaatggtttcccagggccacaaggtccctattactgcggcgttggagcggacaaggtgtatggccgggatgtggtagagtcgcattataaggcctgtctgtacgctggcattaaaatctgtggcaccaacgcagaagtcatgccctcgcagtgggagttccaagtgggtccgtgcgaaggtatcgacatgggggaccacctgtggatggccaggttcatccttcatcgggtctgtgaagactttggggtggtggcgactctggaccccaaacccatgaccggaaactggaacggagccgggtgccacaccaactacagcacggagagcatgagggtggaaggaggactcaaacacattgaagatgccatagagaagctggggaagagacacgactaccacatctgcgtctacgacccgcggggagggaaagacaactcccggagactcaccggccaacacgagacgtcgagtattcacgagttctcggccggcgtggccaaccggggcgccagtatccgcatcccgcgtcaggtgggccaggaaggctacggctactttgaagaccgacggccggcagccaactgcgacccctacgcagtaaccgaggcgctggtcaggaccaccatcctgaacgaaaccggcagcgagaccaaagactataagaacggagctggattctcccgggcaatcggtatggcatctccccgagacgccgctgtgttttaacccgttagtctcccgacactacttgaattcttgtgaagtaaaaattcctttggaaaggaggggcattcctagaaccagagaccgtaacatggtttctcccgtgttatctgccgagatggagggccaatttgggcatgggggggggggggttgcacagattttataggaataagaaacaaagcaagtgacctgctgaaatgtggccagtgccaagtgattccttcagttgatcccttttggggagggcagaattgttaattggctcctcttggagctcgggctttatataaaacgactgatagggtcttgtacccgccatatgactgtattccattgtattgtttttactgtctaataaaaattttaaactttaa

SEQ ID NO: 21102 - protein, 392 aa, Xenopus laevis (African clawed frog)
MSVSHSSRLNKGVREQYMKLPQGEKVQVTYVWIDGTGEGVRCKTRTLDQEPKTIDEIPEWNFDGSSTHQAEGSNSDMYLIPVQMFRDPFCLDPNKLVMCEVLKYNRKSAETNLRHTCKKIMEMVNDHRPWFGMEQEYTLLGINGHPYGWPENGFPGPQGPYYCGVGADKVYGRDVVESHYKACLYAGIKICGTNAEVMPSQWEFQVGPCEGIDMGDHLWMARFILHRVCEDFGVVATLDPKPMTGNWNGAGCHTNYSTESMRVEGGLKHIEDAIEKLGKRHDYHICVYDPRGGKDNSRRLTGQHETSSIHEFSAGVANRGASIRIPRQVGQEGYGYFEDRRPAANCDPYAVTEALVRTTILNETGSETKDYKNGAGFSRAIGMASPRDAAVF

SEQ ID NO: 21103 - DNA, 1942 bp, Calothrix sp
  CDS (375)..(1790)
tgttactgcatcgcgcattccgatttctcccaatcattactatctatggtttgatattaatttggctgcttcatgcaccagtcattttttgtgccaattacaatatatgaatcggcacaaaacaagtacccgctatttaaggattctatgccaaagttgacccctctgagatggtatgttcgatttttgtacaggtatgaggcaaaggttaatagaaactgtaaaccggagaatctgtaacaaagactacaaaaattcttaatgtcatatccttaggatattccaggtgtgtcacaattggttcatctcagcagggtcagcgtggtttaaagattctagtttgagtttatttaattggcagagaaggagtaacaatgacaaccccacaagaagtcttgaaattgattcaagaccaaaaaattcagatgattgatctgaaattcatcgatacaccagggacatggcagcacctaaccgtgtactacaaccaaatcgatgaaagttcattcactgatggcgtacctttcgacggttccagtattaggggttggaaaggcatcgaagaatcagacatgacaatggttttagatccaaacactgcctggatcgacccattcatgaaagagccaactctaagtataatttgtagcattaaagaacctcgcacaggcgaatggtataaccgttgtccccgcgtgattgcccaaaaagccatagactatttagtttctactggccttggtgacacagctttctttggcccagaagctgagttctttatctttgatgatgcccgttttgaccaaactgccaactcaggttattactacgtagactccgtagaaggtcgttggaattctggtaaagatgaaggccctaacctcgcttacaaaccacgcttcaaagaaggttacttcccagttgcgcccactgatactttccaggatatgcgtacagaaatgctgttgacgatggcagcttgcggcgtacccattgaaaaacaacaccatgaagttgctactggtggtcagtgcgaattgggtttccgctttggtaagctcatcgaagctgctgactggttgatgacttacaagtatgtcatcaagaacgttgccaagaaatatggtagaaccgtgacctttatgccaaaaccaatttttggtgataatggttcggggatgcactgtcaccagtctatttggaaggatggtaaacctctatttggaggtgataagtatgctggtttgagtgacatggcactgtattacatcggtggtatcctcaaacacgcaccagcattgttgggcatcacaaaccccaccaccaactcttacaagcgcttagtacctggttatgaagcacctgttaacttggcttactcccaaggtaaccgttctgcttctgtgcggattcctctgtctggtactaaccccaaagctaaacgtttagagttccgttgcccagatgctacctctaacccttacttggcatttgctgctatgctttgtgctggtattgatggtatcaagaataaaatccatcctggtgaacccttagacagaaatatctatgaactttctccagaagaactagcaaaagttccttctactcctggttctttggaactggcattagaagcactggaaaacgatcacgccttcttgactgaaagcggtgtattcacagaagactttatccaaaactggatcgagtacaagctagttaacgaagttaagcagctacaattacgtcctcatccctacgaattttacctatactacgattgctaattgcgatcgctagtattcttgtacgtagtaagcactttgctgcttactacacaacttcaagctgtactgataattttttccgaccactggggcggcctttttttgacaaaaattagcttaagcactccgaaatcttgagctttatgcctgca

SEQ ID NO: 21104 - protein, 471 aa, Calothrix sp
MTTPQEVLKLIQDQKIQMIDLKFIDTPGTWQHLTVYYNQIDESSFTDGVPFDGSSIRGWKGIEESDMTMVLDPNTAWIDPFMKEPTLSIICSIKEPRTGEWYNRCPRVIAQKAIDYLVSTGLGDTAFFGPEAEFFIFDDARFDQTANSGYYYVDSVEGRWNSGKDEGPNLAYKPRFKEGYFPVAPTDTFQDMRTEMLLTMAACGVPIEKQHHEVATGGQCELGFRFGKLIEAADWLMTYKYVIKNVAKKYGRTVTFMPKPIFGDNGSGMHCHQSIWKDGKPLFGGDKYAGLSDMALYYIGGILKHAPALLGITNPTTNSYKRLVPGYEAPVNLAYSQGNRSASVRIPLSGTNPKAKRLEFRCPDATSNPYLAFAAMLCAGIDGIKNKIHPGEPLDRNIYELSPEELAKVPSTPGSLELALEALENDHAFLTESGVFTEDFIQNWIEYKLVNEVKQLQLRPHPYEFYLYYDC

SEQ ID NO: 21105 - DNA, 1098 bp, Paracentrotus lividus (common urchin)
  CDS (1)..(1098)
atgggtgaatactcagcagctaccgacaagacggtgtcggaccgatatctgacccttgacacagatggccactgccaggtcatgtattgctgggtcgacggctccggagaaaacttgagggccaagacgaaaaccatggatttcgtaccagaaaaagcttcagactgccctgtatggaactttgatggttcgagtacggatcaatcggagggatccaacagcgatatgttccttaaaccttgcgccctcttccgggatccattcaggcgcggagacaacaagctccttatgtgtgaagtctacaagtacgactggagacccgccgaaactaactacagaaagacttgtgatgagatcatgactagggccgcagacacagaaccctggtttggaattgaacaggaatatactcttcttggtagcgacaaatggcccttcggctggccaaagggtggattcccaggaccacagggaccatactactgtggtgttggagccaacaaggtttatggtcgtgacattgtagaatctcactatcgggcctgcctgtacgcaggagtaaagatcgcaggctcaaacgctgaagtcatgccagcccagtgggaataccaggttggaccctgtttaggcattgaaatgggcgatcatctttggatgtctcgcttcatcctccaccgtgtttgtgaagactttggcgtcatcgcgacccttgaccccaaacccatggagggagactggaacggcgctggagctcactgtaatttcagcaccttagccatgcgtgaggatggaggcatcgatgtcatgaatgaagccatcaagaaactaggcaagagacacaaggagcacatccgtgcctacgaccctaagaatggagaggacaacgcccgcagattgaccggccgacatgaaacctccagcatcgacgacttctcctctggagtagccaatcgcggcgccagcatcaggataccacgtcaatgcggcatcgacgggaagggatacatggaggaccgaagaccgtcctcaaattgtgatccgtaccgcgtgaccgaagctctggttaggagtacagttctggacgattgggaaacatag

SEQ ID NO: 21106 - protein, 365 aa, Paracentrotus lividus (common urchin)
MGEYSAATDKTVSDRYLTLDTDGHCQVMYCWVDGSGENLRAKTKTMDFVPEKASDCPVWNFDGSSTDQSEGSNSDMFLKPCALFRDPFRRGDNKLLMCEVYKYDWRPAETNYRKTCDEIMTRAADTEPWFGIEQEYTLLGSDKWPFGWPKGGFPGPQGPYYCGVGANKVYGRDIVESHYRACLYAGVKIAGSNAEVMPAQWEYQVGPCLGIEMGDHLWMSRFILHRVCEDFGVIATLDPKPMEGDWNGAGAHCNFSTLAMREDGGIDVMNEAIKKLGKRHKEHIRAYDPKNGEDNARRLTGRHETSSIDDFSSGVANRGASIRIPRQCGIDGKGYMEDRRPSSNCDPYRVTEALVRSTVLDDWET

SEQ ID NO: 21107 - DNA, 1340 bp, Nicotiana plumbaginifolia (curled-leaved tobacco)
  CDS (16)..(1086)
gtcttctattttattatgtctcttctttcagatcttatcaacctcaatctctctgattctaccgagaaaatcatcgctgaatacatatggattggtggatcaggcatggacttaaggagcaaggccaggactctttctggtcctgttactgatcctgcaaaactacccaaatggaactatgatggatctagcacaggtcaagctcctggagaagatagtgaagtgatcttatacccacaagctatctttaaggatccattcagaagaggcaacaatatcttggtcatgtgtgatgcttatactcctgctggcgagcctatcccgacaaacaagaggcatgctgctgccaagatcttcagcaaccccgatgttgttgctgaggaaccctggtatggtattgagcaagaatacaccttgttgcaaagggatattaactggcctctgggctggcctattggaggcttccctggacctcagggaccatactactgtggaaccggagctgataaggcctttggacgtgatattgtggactcccattacaaggcttatctttatgctgggattaacatcagtggtatcaacggagaagtcatgcccggacagtgggaattccaagtcggaccttctgttggcatctcagccggtgatgaagtgtgggtagctcgttacattcttgagaggattgcggagatagctggagtggttgtgtcatttgaccccaagcctattccgggtgattggaacggtgcaggtgctcacacaaactacagcaccaagtcgatgagggaagatggaggctacgaagtcattttgaaggctattgagaagcttggcctgaagcacaaagagcacattgctgcatatggtgaaggcaatgagcgtcgtctcactggaaagcacgaaacagccaacatcagcaccttcaaatggggggttgccaaccgcggtgcatctgtccgtgtaggaagggacacagagaaggcgggcaagggatactttgaggacagaaggccggcttcaaatatggacccatacgtcgttactgccatgatcgcggacaccaccatcatcgggaaatcttgaagcttttagtatgaattgcttgtttctggtttgcacaatttgggatagaaaaggattgatttatgaaacagccctttcgcttcgccagtgtctttagttaggatagtctggtcttttcttatttcttcttttattccggttgaagttgtattttcatacagcaatgctgatttcattcgcctatgatttggtaatggtgttacaaacaaaacaatgttattcttattaataacaaattatgaaagggttggttc

SEQ ID NO: 21108 - protein, 356 aa, Nicotiana plumbaginifolia (curled-leaved tobacco)
MSLLSDLINLNLSDSTEKIIAEYIWIGGSGMDLRSKARTLSGPVTDPAKLPKWNYDGSSTGQAPGEDSEVILYPQAIFKDPFRRGNNILVMCDAYTPAGEPIPTNKRHAAAKIFSNPDVVAEEPWYGIEQEYTLLQRDINWPLGWPIGGFPGPQGPYYCGTGADKAFGRDIVDSHYKAYLYAGINISGINGEVMPGQWEFQVGPSVGISAGDEVWVARYILERIAEIAGVVVSFDPKPIPGDWNGAGAHTNYSTKSMREDGGYEVILKAIEKLGLKHKEHIAAYGEGNERRLTGKHETANISTFKWGVANRGASVRVGRDTEKAGKGYFEDRRPASNMDPYVVTAMIADTTIIGKS

SEQ ID NO: 21109 - DNA, 2045 bp, Panulirus argus (spiny lobster)
  CDS (56)..(1141)
gatcttgtgaacaacataaccctgtgactgagagaaaggtatcaagattaccacgatgaatcagggtgcaaacaagacggtattagaccgatatttacggttagatatcccggaccagaaatgtcaagctatgtacatctgggtcgatggaaccggcgaaaacctccgctctaagaccaggacactcaactttactcctaaatctcccagtgagctgccaatatggaatttcgatgggtcatcaacgggccaggccgaacggagcaacagtgacgtgtacctgtatccagtcgctgtttatcgagatccattcaggctgggtaacaataagctggtcctctgtgaaacctacaaatacaacaagaagcctgctgatactaaccagcgttggaagtgtatggaagtaatgacaagggcagcagaccagcacccatggttcggcatggaacaagaatatactcttttggacattgacaaacatcccttgggttggcccaagaatggctatccaggccctcagggtccctattactgtggtgtgggtgctaatagggtgtatgggcgcgatgtggtcgaggctcactacagggcgtgtctttgcgctggcatcaacatctctggggagaacgcgaaagtcatgccggcccaatgggagttccaggttggtccgtgtgaaggcataaccatgggcgacgacctctggatggctcgctaccttcttcacagggtcgctgaggactttgatgttgtagtaacactcgaccccaagccaatccctggtgactggaacggcgctggaatgcacactaatttctctactgaagccatgcgtggtcccaatggcattctggaaattgagagtgccatcgacaaattgtcgaaggttcatgagaaacacatcaaggcatacgacccacacgcaggcaaggataacgaaaggcgcttgactggtcattatgaaacttcctccatccatgacttttctgcaggtgtggccaaccgtggtgcctccatccgcatccccagaggagtggctgaggagaaaaccggctacctggaggaccgtcgcccttcctccaacgctgacccttatgtggtgtctgagaggcttgtgcgtaccatctgcctgaacgagcagtgaagagcagtacgtactaacagctcacccattatatcatgtgcaatcccttcagcccccaacaacacagggcttcctaaaaacttatggcaattatgcactgacgcgtgatcactgccaagtgggcgagacttatttttaggtgtgaacaacgccagccaaacaagcgttatcaatgctaattaagcgagccgacgaaacctgggaacagtgataatagagacaaatgaagtatctattaaagcaaataccttatacagtcggcaaagtggcaatatttagtatatgctgataatttaaactgctgaaggaaaatttattatgaatctttctataatcaaatgcttatctttagattttgtgacgaaacacaatttttagattatcagcaatctgcagttttcattcacgaaattatttttataccaaaatactaaaacttagtttttagttttgtgagctttagtctcattttcaagttgaggaaggtgcgcatgattaaaatcaaaggtcttccatgtcatagatttcctaattgttatgttgtcttaagttttattaggatgtaaacatttaaggaagtatacactccaataaggtaacggcacttacaacctcctacttcaaacatagggcctttgtttttggcatttgatattgtctgcggtaactataaggtgtccctttccatgtttcagtaaagagacaagtattatagttactggcactgatagtggtagccatagtatgttcattgtatttatagttatgcataaaattaaagtcaaatgagtacatgtatgataatcgacatattttcttcattttggatctttctgtgtaatttttaatgtatataaaatgtttataataaacatatggttgtacaaaaaaaaaaaaaaaaaaa

SEQ ID NO: 21110 - protein, 361 aa, Panulirus argus (spiny lobster)
MNQGANKTVLDRYLRLDIPDQKCQAMYIWVDGTGENLRSKTRTLNFTPKSPSELPIWNFDGSSTGQAERSNSDVYLYPVAVYRDPFRLGNNKLVLCETYKYNKKPADTNQRWKCMEVMTRAADQHPWFGMEQEYTLLDIDKHPLGWPKNGYPGPQGPYYCGVGANRVYGRDVVEAHYRACLCAGINISGENAKVMPAQWEFQVGPCEGITMGDDLWMARYLLHRVAEDFDVVVTLDPKPIPGDWNGAGMHTNFSTEAMRGPNGILEIESAIDKLSKVHEKHIKAYDPHAGKDNERRLTGHYETSSIHDFSAGVANRGASIRIPRGVAEEKTGYLEDRRPSSNADPYVVSERLVRTICLNEQ

SEQ ID NO: 21111 - DNA, 1450 bp, Glycine max (soybean)
  CDS (78)..(1145)
ccgtgaatctcagaattctctaaaagagatccttttctgctctttgaagaaagaagggtctttgcttgattttggagatgtctctgctctcagatctcatcaaccttaacctctccgataccaccgagaaggtgatcgcagagtacatatggatcggtggatcaggaatggacctgaggagcaaagcaaggactctcccaggaccagttagcgacccttcagagcttcccaagtggaactatgatggttccagcacaggtcaagctcctggtgaagacagtgaagcgatttatacccacaagccatttcaggatccattcagaaggggtaacaatatcttggttatctgtgatgcctacactcctgctggagaacctattcccactaacaagaggcacgctgctgccaaggttttcagccatcctgatgttgttgctgaagtgccatggtacggtattgaacaagaatacaccttgttgcagaaagatatccaatggcctcttgggtggcctgttggtggtttccctggacctcagggtccatactactgtggtgttggcgctgacaaggcttttggccgtgacattgttgacgcacactacaaagcctgtatttatgctggcatcaacatcagtggaattaatggagaagtgatgcccggtcagtgggaattccaagttggaccttcagttggaatctcagctggtgatgagatttgggcagctcgttacatcttggagaggatcactgagattgctggtgtggtggtttcctttgaccccaagccaattccgggtgattggaatggtgctggtgctcacacaaactacagcaccaagtccatgagagaagatggaggctatgaagtgatcaaagcagcaattgacaagttggggaagaagcacaaggagcacattgctgcttatggagaaggcaacgaacgtcgtttgacaggacgccacgaaaccgctgacatcaacaccttcttatggggagttgcaaaccgtggagcttctgttagggttgggagagacacagagaaagcagggaagggatattttgaggacagaaggcctgcttccaacatggacccatacgtggttacttccatgattgcagacacaaccattctgtggaagccatgagcaaaacctgcatgttttctccctttggatggaaaggaacagttatgcttttcttagtaggatttggtctctctctctttttaccttttgattggtactatggttggtgccttgttggttggtgcaactaactggcaagggttgttcattgttttcttctattcctttccctcgttttccgattgttacaatgacaataatttaatggttattatcagtcttgaaggttattatcagtcttgcaagaaatgctgattggaagtataataatatatatgaaattgtcatgttcattgagtaggaaa

SEQ ID NO: 21112 - protein, 355 aa, Glycine max (soybean)
MSLLSDLINLNLSDTTEKVIAEYIWIGGSGMDLRSKARTLPGPVSDPSELPKWNYDGSSTGQAPGEDSEAIYTHKPFQDPFRRGNNILVICDAYTPAGEPIPTNKRHAAAKVFSHPDVVAEVPWYGIEQEYTLLQKDIQWPLGWPVGGFPGPQGPYYCGVGADKAFGRDIVDAHYKACIYAGINISGINGEVMPGQWEFQVGPSVGISAGDEIWAARYILERITEIAGVVVSFDPKPIPGDWNGAGAHTNYSTKSMREDGGYEVIKAAIDKLGKKHKEHIAAYGEGNERRLTGRHETADINTFLWGVANRGASVRVGRDTEKAGKGYFEDRRPASNMDPYVVTSMIADTTILWKP

SEQ ID NO: 21113 - DNA, 1642 bp, Arabidopsis thaliana (mouse-ear cress)
  CDS (138)..(1430)
atattaaaaataaagattcttaaggctcttcatattttgctttttgtcaactctttctttgccatctgttacaaacaccaaactctcctgattcatcagttttaagtcttcttcaagtcccagggatcatcaatccaatggctcagatcttagcagcttctccaacatgtcagatgagagtgcctaaacactcatcagtcattgcatcatcatccaagttatggagctctgttgtgttgaaacagaagaagcagagcaacaacaaagtcagaggctttagagttcttgctctccaatctgataacagtactgtcaatagagttgagactcttctcaatttagacaccaaaccttactctgacaggatcattgctgaatacatttggatcggaggatctggaattgaccttagaagcaagtcaaggactatcgaaaagccggtggaggatccttctgagctacctaagtggaactatgatggttcgagtaccggtcaagcacctggtgaagatagtgaagtgattctatacccgcaagctatcttcagagatcctttccgtggaggcaataacatcttggttatctgtgatacttggacaccagctggtgagccaattccaacaaacaaacgtgctaaagctgctgagatcttcagtaacaagaaggtctctggcgaggttccatggttcggcattgaacaagagtacactttacttcagcaaaacgtcaaatggcctttaggttggcctgttggagcgttccctggtcctcagggtccttactactgtggagttggagctgacaagatttgggggcgtgacatttcagatgctcattacaaagcttgtttatatgctggaattaacattagtggtactaatggtgaagttatgcctggacagtgggagttccaagttggcccgagcgtaggaattgatgcaggtgatcatgtttggtgtgctagataccttcttgagagaatcacagaacaagctggtgttgtcctaacacttgatcccaaaccgatagagggtgactggaacggtgctggttgccacaccaattacagtaccaagagcatgagagaggaaggaggatttgaagtgatcaagaaggctatcttgaacctctcgcttcgccacaaggagcacatcagtgcctacggtgaaggaaacgagagaaggttgaccggaaagcacgagacagctagtattgaccagttctcatggggcgtggctaaccgtggatgctctattcgtgtgggacgtgacaccgaggcgaaaggaaaaggttacttagaagatcgccgtccagcatctaacatggacccatacattgtgacctcacttttggcagagaccacactcctgtgggagccaactcttgaggctgaagcccttgcagctcaaaagctttctttgaatgtttaaaattagtcgaaactttcatgaatctgatgaacacacgtgtctatgtggtctctcaagttgtttaaacattcggattaagacattgtttgttgtcttttcatttgcatttttaaaactcagaattgtatggacaatgttcatccttttatattggttcttttgactgttagagcatgtccaatggttgaatttaagctggttcttaactgttg

SEQ ID NO: 21114 - protein, 430 aa, Arabidopsis thaliana (mouse-ear cress)
MAQILAASPTCQMRVPKHSSVIASSSKLWSSVVLKQKKQSNNKVRGFRVLALQSDNSTVNRVETLLNLDTKPYSDRIIAEYIWIGGSGIDLRSKSRTIEKPVEDPSELPKWNYDGSSTGQAPGEDSEVILYPQAIFRDPFRGGNNILVICDTWTPAGEPIPTNKRAKAAEIFSNKKVSGEVPWFGIEQEYTLLQQNVKWPLGWPVGAFPGPQGPYYCGVGADKIWGRDISDAHYKACLYAGINISGTNGEVMPGQWEFQVGPSVGIDAGDHVWCARYLLERITEQAGVVLTLDPKPIEGDWNGAGCHTNYSTKSMREEGGFEVIKKAILNLSLRHKEHISAYGEGNERRLTGKHETASIDQFSWGVANRGCSIRVGRDTEAKGKGYLEDRRPASNMDPYIVTSLLAETTLLWEPTLEAEALAAQKLSLNV

SEQ ID NO: 21115 - DNA, 1617 bp, Rhizobium leguminosarum
  CDS (569)..(1549)
cagctgtcgagcgcggcatcgcagacttcggctgcctcgcgctccatcaggcgggcgcgttcgaaccggttggcgttgcgtatcgccttgacgggaaactggtagatcgttgcggattcacggtggaaaccggtgggcatgagatcgcctccattcagctcggcgtatcaacatttcaggaccgctaccatagcataatgcacatagtttatgcaaattgcacaaaataagagcaatgttgcaattgtagccggtcggcatgctgtctcgaccaaaagcttccgccaatttgtttaacgcttcatcatttcagcttaacgccgcaattttcatccggttccagacgggaaaagtgccgttttgatcgggcgataccgctgcgagcgttaaaaacagcccgattttccaaaaggggaaaaatcggtcggtatgctgattcgcgatttttctttcgcgtgggcccaaaactggcacgctacgtgcttttaaagcatcatccctggcgatcggatgcgcttgcccgagattgcctccggatttgctcacctttgtagcactgagagagtcgatgacaaaatttaagctcgagtacatttggctcgatgggtacacaccggtaccgaacctgcgtggcaagacgcagatcaaggaattcgatgaattcccgacgctggaacagcttccgctgtggggcttcgacggttcgtcgaccatgcaggccgagggcagctctgactgcgtgctgaagcccgtcgccatttatcccgatccggcccgcaccaacggcgctctcgtcatgtgcgaagtcatgatgccggatggtcacgcgcacgcatcgaatgcccgcgccaccatcctcgacgacgaagatgcctggttcggctttgagcaggagtatttcttctatcagaacggccgtccgctcggcttccctgagcagggctacccggctccgcagccttattacaccggcgtcggctactcgaacgttggcgatgtcgcccgcgaaatcgtcgaagagcacctcgacctctgcctcgctgccggcatcaaccacgaaggcatcaatgccgaagtggccaagggtcagtgggaatttcagattttcggcaagggctccaagaaggccgccgaccagatctggatggcacgctacctcctgcagcgcctgaccgaaaagtacggcatcgacatcgagtatcattgcaagccgctcggcgataccgactggaacggctcgggcatgcattgcaacttctcgaccaagtacctgcgcgaagtcggcggcaaggaatatttcgaagcgctgatggcgagttccgacaagaacctgatggaccacatcgcggtctacggccccgataacgacaagcgcctgaccggcaagcacgagactgctccgtggaacaagttctcctacggcgttgccgaccgtggtgcttcgatccgcgtgccgcactccttcatcaagaacgactacaagggctatctggaagatcgccgcccgaactcgcaaggcgacccctaccagatcgttcgcaggttctgaagacgatctcggaagttccgactgcaagctcggcttctctggccgcctgacctcccaacggcgctaga

SEQ ID NO: 21116 - protein, 326 aa, Rhizobium leguminosarum
MTKFKLEYIWLDGYTPVPNLRGKTQIKEFDEFPTLEQLPLWGFDGSSTMQAEGSSDCVLKPVAIYPDPARTNGALVMCEVMMPDGHAHASNARATILDDEDAWFGFEQEYFFYQNGRPLGFPEQGYPAPQPYYTGVGYSNVGDVAREIVEEHLDLCLAAGINHEGINAEVAKGQWEFQIFGKGSKKAADQIWMARYLLQRLTEKYGIDIEYHCKPLGDTDWNGSGMHCNFSTKYLREVGGKEYFEALMASSDKNLMDHIAVYGPDNDKRLTGKHETAPWNKFSYGVADRGASIRVPHSFIKNDYKGYLEDRRPNSQGDPYQIVRRF

SEQ ID NO: 21117 - DNA, 1575 bp, Brassica napus (rape)
  CDS (95)..(1381)
ttcatatttgtcaactcttcctttgccatttgttgcaaacactcaagtctcctgatatcagagttagagtcttcttcaagttccagggataaaaatggcgcagatcttggcagcttctccaacatgtcaaatgagattgactaaacccagctccattgcatcgtcaaagttatggaactcggttgtgttgaaacagaagaaacagagcagcagcaaagtcagaagcttcaaagtgatggctctccaatctgataacagcacaatcaacagagttgagagtcttctcaatctagacaccaaacctttcactgaccggatcatcgctgagtacatctggattggcggatctggaattgaccttaggagcaagtcaaggacgcttgaaaagcccgtggaagatccttctgaacttcccaagtggaactatgatggttcaagtaccggtcaagcacctggtgaagatagtgaagtgattctctatccgcaagctatcttcagggatcctttccgtggaggcaataacatattggttatctgtgatacctacacaccagctggtgagccaattccaacaaacaaacgtgcaagagctgctgagattttcagcaacaagaaggtcaatgaagagattccatggtttggcattgaacaagagtacactttacttcagccaaacgtgaactggcctttgggttggcccgttggagcgtatcctggtccccagggtccttactactgtggagttggagctgaaaagtcttggggccgtgacatttcagatgctcattacaaagcttgtttgtatgctggaattaacatcagtggtactaatggtgaagttatgccaggacagtgggaattccaagttggcccgagcgtaggaatcgaagcaggtgatcacgtttggtgtgctagataccttcttgagagaatcacagaacaagctggtgttgtcctaacacttgatcccaaaccgattgagggtgactggaacggtgctggttgccataccaattacagcacaaagagcatgagagaggacggaggatttgaggtgattaaaaaggcaatcttgaacctctcgcttcgtcacatggagcacatcagtgcctacggtgaaggcaatgagagaaggttgactggaaagcacgagacagccagtatcgaccaattctcatggggagtggctaaccgtggatgctcaattcgtgtgggacgtgataccgagaagaaaggaaaaggttacttggaagatcggcgtccagcgtctaacatggacccatacattgtgacttcactgttggcagagaccacacttctctgggagccaacccttgaggctgaagcacttgctgctcagaagctttctttaaaagtttaatttattaatgaacacacatgtctgtttatgtggtcttcccgggatcatcagtcttgtttagaacacgtgttcggattacgacattcttgtctcttttttttcatttgcattgtttaaaaaacccagaatttcgtggacaatgttcatccttttctattggttgtttatggtcttaaaaaaaaaaaaaaaaaaaa

SEQ ID NO: 21118 - protein, 428 aa, Brassica napus (rape)
MAQILAASPTCQMRLTKPSSIASSKLWNSVVLKQKKQSSSKVRSFKVMALQSDNSTINRVESLLNLDTKPFTDRIIAEYIWIGGSGIDLRSKSRTLEKPVEDPSELPKWNYDGSSTGQAPGEDSEVILYPQAIFRDPFRGGNNILVICDTYTPAGEPIPTNKRARAAEIFSNKKVNEEIPWFGIEQEYTLLQPNVNWPLGWPVGAYPGPQGPYYCGVGAEKSWGRDISDAHYKACLYAGINISGTNGEVMPGQWEFQVGPSVGIEAGDHVWCARYLLERITEQAGVVLTLDPKPIEGDWNGAGCHTNYSTKSMREDGGFEVIKKAILNLSLRHMEHISAYGEGNERRLTGKHETASIDQFSWGVANRGCSIRVGRDTEKKGKGYLEDRRPASNMDPYIVTSLLAETTLLWEPTLEAEALAAQKLSLKV

SEQ ID NO: 21119 - DNA, 1423 bp, Pinus sylvestris (Scotch pine)
  CDS (34)..(1107)
ttcccttcctctggtttgttttggagagtggccatgtcgagcgtattaacagaccttctcaaccttgacctgagcgacgtgacagagaaggtcattgcagagtatatatggattggaggatcaggaatggatatgcgcagtaaagccagatctctgtcaggacctgtgagtagcgttaaagagcttcccaaatggaactatgacggctccagcactggacaggctcaaggacatgacagcgaagtcattctatatccacaagctatcttccgtgatccatttcgcagaggaaagcacattttggtaatctgtgatgcctactctcctaatgggactgctattccttccaacaagagggctgcagcagcgaaaatttttaacgaaaaggcggttagtgatgaagagacatggtacgggcttgaacaagaatatacactgttgcaaaaggacgtcaaatggcctcttggctggccaattggtggctaccccggtcctcagggcccatattactgtggagttggagctgacaaagcctggggacgagacattgttgatgcccattataaggcttgtctctattcaggaatcaatatcagtggcatcaatggagaagtcatgccagggcagtgggaatttcaagtaggtccgtcagtgggtatctcagcagcagatgagctgtggtgtgctcgttttattatggagaggattacagaaaaggcgggtgtcgttctgtcctttgatcccaagccaattgagggggactggaatggtgctggatgccacacaaattacagcaccaagtccatgcgcaaggagggaggcttcgaagtaattaagaaagcaatagaaaaactgaagttgaggcataaggagcatatttctgcctatggggagggaaatgagagacgcctcactggtcggcacgagacagcagacatgaataccttttcctggggtgttgcaaatcgaggagcttcagttagagtgggccgggacacagaaaaagaaggaaaaggttattttgaggaccgtcgacctgcttcaaacatggatccatacatagtgacttctatgattgctgagacgaccattctatggaaaccttaaattacaaagtggaggccagttacacgcgtggtcgtggtgctttgctttggaggccagcgtcactgataagctaatatgtatgtaaatgtgatgccaatgtttaagtaggttggtaactttgctttggttgtgggtagacctgaactttggtcaaacaatttcctcttgctatatggatatatatatatttttgtatttgttctacttgtaatatggcgagggctttaaaagactctcttttacctttatttattccgttgtggaagatgtattcgacaaattgtttagaatgtttgaatatgatatattctttgtg

SEQ ID NO: 21120 - protein, 357 aa, Pinus sylvestris (Scotch pine)
MSSVLTDLLNLDLSDVTEKVIAEYIWIGGSGMDMRSKARSLSGPVSSVKELPKWNYDGSSTGQAQGHDSEVILYPQAIFRDPFRRGKHILVICDAYSPNGTAIPSNKRAAAAKIFNEKAVSDEETWYGLEQEYTLLQKDVKWPLGWPIGGYPGPQGPYYCGVGADKAWGRDIVDAHYKACLYSGINISGINGEVMPGQWEFQVGPSVGISAADELWCARFIMERITEKAGVVLSFDPKPIEGDWNGAGCHTNYSTKSMRKEGGFEVIKKAIEKLKLRHKEHISAYGEGNERRLTGRHETADMNTFSWGVANRGASVRVGRDTEKEGKGYFEDRRPASNMDPYIVTSMIAETTILWKP

SEQ ID NO: 21121 - DNA, 1359 bp, Zea mays (maize)
  CDS (10)..(1083)
gcccgagtgatggccagcctcaccgacctcgtcaacctcgacctgagtgactgcaccgacaggatcatcgccgagtacatctggattggaggaaccgggatagacctcaggagcaaagcgaggacggtgaaaggccccatcaccgacccgatccagctgccgaaatggaactacgacggctccagcaccgggcaggctcccggagaggacagcgaagtcatcctctaccctcaagccattttcaaggacccgttcaggaagggtaaccacatccttgtgatgtgtgactgctacacgccacaaggcgagccaatccccaccaacaagaggtacagcgccgccaaggttttcagccaccccgacgtcgcagctgaggtgccgtggtacggtattgagcaggagtacaccctccttcagaaggacgtgagctggcccctcggctggcccgttggtggataccctggtccccagggaccatactactgcgccgccggtgccgacaaggcctttgggcgcgacgtggttgacgcccactacaaggcctgcctctacgccggcatcaacatcagcggcatcaacggcgaagtcatgcctggacagtgggagttccaagtggggccgtccgttgggatctctgccggcgacgagatatgggtcgcccgctacattctcgagaggatcaccgagatggccggaatcgtcctctccctcgacccgaagccgatcaagggcgactggaacggcgccggcgcccacaccaactacagcaccaagtcgatgagggaggccgggggatacgaggtcatcaaggcggcgatcgacaagctggggaagaggcacaaggagcacatcgccgcgtacggcgagggcaacgagcgccgcctcacgggccgccacgagaccgccgacatcaacaccttcaaatggggcgtggcgaaccgcggcgcgtccatccgcgtcggccgcgacaccgagagggagggcaagggctacttcgaggaccgcaggccggcgtccaacatggacccctacgtcgtcaccggcatgatcgccgagaccaccatcctgtggaatggaaactgatcaagcatgtgcattctcgagggagcccactgtttttcttctgcacaacgcatccgccgtggtgtcgctttggttttgaaatttagattccgttgtcctaaaatttatcactacggtctccagtgtattgctcgggaacgaatgaataacgactgcgatgtttgtttttttttttgctggcgtagtagatgtacgtttggctgtgcttccagtttattgggtaaatgaaaaaatgtaatggtctaccggtcttaaaatagtagtcattttagctct

SEQ ID NO: 21122 - protein, 357 aa, Zea mays (maize)
MASLTDLVNLDLSDCTDRIIAEYIWIGGTGIDLRSKARTVKGPITDPIQLPKWNYDGSSTGQAPGEDSEVILYPQAIFKDPFRKGNHILVMCDCYTPQGEPIPTNKRYSAAKVFSHPDVAAEVPWYGIEQEYTLLQKDVSWPLGWPVGGYPGPQGPYYCAAGADKAFGRDVVDAHYKACLYAGINISGINGEVMPGQWEFQVGPSVGISAGDEIWVARYILERITEMAGIVLSLDPKPIKGDWNGAGAHTNYSTKSMREAGGYEVIKAAIDKLGKRHKEHIAAYGEGNERRLTGRHETADINTFKWGVANRGASIRVGRDTEREGKGYFEDRRPASNMDPYVVTGMIAETTILWNGN

SEQ ID NO: 21123 - DNA, 1369 bp, Zea mays (maize)
  CDS (103)..(1209)
cgaaagcacacacggatcaatcacactcactcgcggccattgtcctgcccgtgcgtgctctgccttttcaggcgatcgaccaaccaacttctcgtcactgccatggctctgctctccgacctcatcaacctcgacctctcgggccgcaccgggaagatcatcgccgagtacatctgggttggcggttccgggatggacgtcaggagcaaagccaggacgctgtccggacctgttgatgaccccagcaagcttccgaagtggaacttcgacggctccagcaccggccaagctccgggcgacgacagcgaagtcatcctttgccctcgggccatcttcagggacccgttcaggaaggggcagaacatactggtcatgtgcgactgctacgagccgaacggggagccgatcccgagcaacaagcggcatggggccgcgaagatctttagccaccctgacgtcaaggctgaggaaccatggttcgggattgagcaggagtacacccttctccagaaggacaccaagtggcctctcggttggccgctggcgtaccctggccctcagggaccttactactgcgccgccggagcggacaagtcctacgggcgggacatcgtggactgcgcatacaaggcctgcctctacgccggcatcgacatcagtggcatcaacggggaggtcatgccggggcagtgggagttccaggtggcccctgccgtcggcgtctcggccggcgaccagctctgggtggctcgctacattcttgagaggatcaccgagatcgccggcgtggttgtctccttcgaccccaagccaattccgggggactggaatggcgctggtgcacacaccaactacagcaccaagtcgatgaggagcgacggcgggtacgaggtgatcaagaaggcgatcggcaagctgggcctccggcaccgggagcacatcgccgcgtacggggacggcaacgagcgcccgctcaccggccgccacgagaccgccgacatcaacaccttcgtctggggcgtgccgaaccgcggggcgtcggtgcgggtgggccgagacaccgagaaggaaggcaaaggctacttcgaggaccggaggccggcgtccaacatggacccgtacgtggtgacctgcctgatcgcggagacaaccatgctgtgggagcccagccactccaacggcgacggcaagggcgccgcggctccttgatttgattctgcggagactgagctctgtgtgtgagccggcctgcgtagatggcaaatgggactgaccctgtcagaaacttgagatgaccataataatagctgcagtgtgctcgttctggggttggataagacccaagaactttttttagctttcttcgaac

SEQ ID NO: 21124 - protein, 368 aa, Zea mays (maize)
MALLSDLINLDLSGRTGKIIAEYIWVGGSGMDVRSKARTLSGPVDDPSKLPKWNFDGSSTGQAPGDDSEVILCPRAIFRDPFRKGQNILVMCDCYEPNGEPIPSNKRHGAAKIFSHPDVKAEEPWFGIEQEYTLLQKDTKWPLGWPLAYPGPQGPYYCAAGADKSYGRDIVDCAYKACLYAGIDISGINGEVMPGQWEFQVAPAVGVSAGDQLWVARYILERITEIAGVVVSFDPKPIPGDWNGAGAHTNYSTKSMRSDGGYEVIKKAIGKLGLRHREHIAAYGDGNERPLTGRHETADINTFVWGVPNRGASVRVGRDTEKEGKGYFEDRRPASNMDPYVVTCLIAETTMLWEPSHSNGDGKGAAAP

SEQ ID NO: 21125 - DNA, 1317 bp, Zea mays (maize)
  CDS (63)..(1133)
caatcccacaccaccaccacctcctccggtccccaacccctgtcgcaccgcagccgccggccatggcctgcctcaccgacctcgtcaacctcaacctctcggacaccaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagcgaggtcatcctgtacccgcaggccatcttcaaggacccattcaggaggggcaacaacatccttgtgatgtgcgattgctacaccccagccggcgagccaatccccaccaacaagaggtacaacgccgccaagatcttcagcagccctgaggtcgccgccgaggagccgtggtatggtattgagcaggagtacaccctcctccagaaggacaccaactggccccttgggtggcccatcggtggcttccccggccctcagggtccttactactgtggaatcggcgccgaaaagtcgttcggccgcgacatcgtggacgcccactacaaggcctgcttgtatgcgggcatcaacatcagtggcatcaacggggaggtgatgccagggcagtgggagttccaagtcgggccttccgtgggtatttcttcaggcgaccaggtctgggtcgctcgctacattcttgagaggatcacggagatcgccggtgtggtggtgacgttcgacccgaagccgatcccgggcgactggaacggcgccggcgcgcacaccaactacagcacggagtcgatgaggaaggagggcgggtacgaggtgatcaaggcggccatcgagaagctgaagctgcggcacagggagcacatcgcggcctacggcgagggcaacgacggccggctcaccggcaggcacgagaccgccgacatcaacacgttcagctggggcgtggccaaccgcggcgcgtcggtgcgcgtgggccgggagacggagcagaacggcaagggctacttcgaggaccgccgcccggcgtccaacatggacccctacgtggtcacctccatgatcgccgagaccaccatcatctggaagccctgagcgccgcggccgttgcgttgcagggtccccgaagcgattgcaaagccactgttccttccgttctgtttgcttattattgttattatctagctagatcatccggggtcaggtcgtcgtggtgtgccaaaacagaacacagaaagaggaagaagaaaaaaaaaacaagacgtgtggcgtttatgtt

SEQ ID NO: 21126 - protein, 356 aa, Zea mays (maize)
MACLTDLVNLNLSDTTEKIIAEYIWIGGSGMDLRSKARTLSGPVTDPSKLPKWNYDGSSTGQAPGEDSEVILYPQAIFKDPFRRGNNILVMCDCYTPAGEPIPTNKRYNAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHREHIAAYGEGNDGRLTGRHETADINTFSWGVANRGASVRVGRETEQNGKGYFEDRRPASNMDPYVVTSMIAETTIIWKP

SEQ ID NO: 21127 - DNA, 1490 bp, Zea mays (maize)
  CDS (85)..(1152)
ccacatcctcccctcattcctccttgggttcccagcccgtgcgccccgcctgtcgcagtgccagtcgcgccgcagccgccggccatggcctgcctcaccgacctcgtcaacctcaacctctcggacaccacagagaagatcatcgccgagtacatatggatcggtggatctggcatggatctcaggagcaaagccaggaccctcccgggcccggtgaccgatcccagcaagctgcccaagtggaactacgacggctccagcaccggccaggcccccggcgaggacagcgaggtcatcctgtacccgcaggccatcttcaaggacccattcaggaggggcaacaacatccttgtcatgtgcgattgctacaccccagctggcgagccaattcccaccaacaagaggtacagcgccgccaagatcttcagcagccctgaggtcgctgccgaggagccctggtatggtatcgagcaggagtacaccctccttcagaaggacaccaactggcccctcgggtggcctattggcggcttccctggccctcagggtccttactactgtggaatcggcgcggagaaatcgttcgggcgtgacatagtcgacgcccactacaaggcctgcctgtacgcaggcatcaacatcagtggcatcaacggggaggtcatgccggggcagtgggagttccaggtcggaccgtccgtcggcatctcttcgggcgatcaggtgtgggttgctcgctacattcttgagaggatcaccgagatcgccggcgtggtggtgacgttcgacccgaagccgatcccgggcgactggaacggcgcgggcgcccacaccaactacagcaccgagtccatgaggaaggagggcgggtacgaggtgatcaaggcggccatcgagaagctgaagctgcggcacaaggagcacatcgcggcctacggcgagggcaacgagcgccggctcaccggcaggcacgagaccgccgacatcaacaccttcagctggggagtcgccaaccgtggcgcgtcggtggccgtgggccagacggagcagaacggcaagggctacttcgaggaccgccggccggcgtccaacatggatccctacgtggtcacctccatgatcgccgagaccaccatcgtctggaagccctgaggcatcccgtggccgtgtcgtgtcggtttgctccgcgtacggcgctggccgttgcatcgcagggcccagcggttgcgcaactattttcccttccccgttccgtttgcttgtactactactctaccgctagtcctgcatagcattttagctagaacacaacaacagccaaaaaaaaacattgttgcttgcttcgacttcgacgcttcccaccactagttccattccatgccgtccgtccacttccttcctgtgtaatcctcctccaataatagacgtgtcatgctgcatcctctgcattgtataaaagaaagtggtgtaatccttttgctggcgcctcc

SEQ ID NO: 21128 - protein, 355 aa, Zea mays (maize)
MACLTDLVNLNLSDTTEKIIAEYIWIGGSGMDLRSKARTLPGPVTDPSKLPKWNYDGSSTGQAPGEDSEVILYPQAIFKDPFRRGNNILVMCDCYTPAGEPIPTNKRYSAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHKEHIAAYGEGNERRLTGRHETADINTFSWGVANRGASVAVGQTEQNGKGYFEDRRPASNMDPYVVTSMIAETTIVWKP

SEQ ID NO: 21129 - DNA, 1483 bp, Zea mays (maize)
  CDS (48)..(1319)
gggcggcggccggtccgtgtccgtgtccgtcgacggttggttcgggaatggcgcaggcggtggtgccggcgatgcagtgccgggtcggagtgaaggcggcggcggggagggtgtggagcgccggcaggactaggaccggccgcggcggcgcctcgccggggttcaaggtcatggccgtcagcacgggcagcaccggggtggtgccgcgcctcgagcagctgctcaacatggacaccacgccctacaccgacaaggtcatcgccgagtacatctgggtcggaggatctggaatcgacatcagaagcaaatcaaggacgatttcgaaacccgtggaggatccctcagaactaccaaaatggaactacgatggatctagcacaggacaagccccgggagaagacagtgaagtcattctatacccccaggctatcttcaaggacccattccgaggtggcaacaacgttttggttatctgtgacacctacacgccacagggggaaccccttccaactaacaaacgccacagggctgcgcaaattttcagcgacccaaaggtcggtgaacaagtgccatggtttggcatagagcaagagtacactttgctccagaaagatgtaaattggcctcttggttggcctgttggaggcttccctggtccccagggtccatactactgtgccgtaggagccgacaaatcatttggccgtgacatatcagatgctcactacaaggcatgcctctacgctggaatcaacattagtggaacaaacggggaggtcatgcctggtcagtgggagtaccaagttggacctagtgttggtattgaagcaggagatcacatatggatttcgagatacattctcgagagaatcacagagcaagctggggttgtccttacccttgatccaaaaccaattcagggtgactggaacggagctggctgccacacaaattacagcacaaagaccatgcgcgaagacggcgggtttgaagagatcaagagagcaatcctgaacctttctctgcgccatgatctgcatattagtgcatacggagaaggaaatgaaagaagattgactgggaaacatgagactgcgagcatcggaaccttctcatggggtgtggcaaaccgcggctgctctatccgtgtggggcgggataccgaggcaaaagggaaaggttacctggaagaccgtcggccggcatcaaacatggacccgtacattgtgacggggctactggccgagaccacgatcctctggcagccatccctcgaggcggaggctcttgccgccaagaagctggcgctgaaggtgtgaagcagctgaaggatggttcaggcaccaatataaaccggtccgcgacaagattgatctttgtgtccatggccgttgggtcttgcgactctctgctcggcggtgccactctgtacaaaatcacggctgtctttgattcatcggatattcggatacgtttgtttgtt

SEQ ID NO: 21130 - protein, 423 aa, Zea mays (maize)
MAQAVVPAMQCRVGVKAAAGRVWSAGRTRTGRGGASPGFKVMAVSTGSTGVVPRLEQLLNMDTTPYTDKVIAEYIWVGGSGIDIRSKSRTISKPVEDPSELPKWNYDGSSTGQAPGEDSEVILYPQAIFKDPFRGGNNVLVICDTYTPQGEPLPTNKRHRAAQIFSDPKVGEQVPWFGIEQEYTLLQKDVNWPLGWPVGGFPGPQGPYYCAVGADKSFGRDISDAHYKACLYAGINISGTNGEVMPGQWEYQVGPSVGIEAGDHIWISRYILERITEQAGVVLTLDPKPIQGDWNGAGCHTNYSTKTMREDGGFEEIKRAILNLSLRHDLHISAYGEGNERRLTGKHETASIGTFSWGVANRGCSIRVGRDTEAKGKGYLEDRRPASNMDPYIVTGLLAETTILWQPSLEAEALAAKKLALKV

SEQ ID NO: 21131 - DNA, 1400 bp, Brassica napus (rape)
  CDS (68)..(1138)
caaaaaccacattatccgagatttgagtatatttcattgcaaccttcttgtcattttctctgtaaccatgagtcttctgaccgatctcgttaaccttgacctctcagacaacactgagaaaatcatcgctgaatacatatgggttggtggttcaggaatggatatgagaagcaaagccaggactctccctggacctgtgaccgatccatcaaagctcccaaaatggaattatgatggttcaagcactggccaagctcctggtgaagacagcgaagtgatcttataccctcaagcgattttcaaagatccgttccgtagaggcaacaacattcttgtcatgtgtgatacttacacccctgcgggtgaaccaatccctacgaacaagagacatgctgcagctcagatctttagcaaccctgatgttgttgctgaagtgccatggtatggaatcgaacaagaatacactctgttgcagaaagatgtgaattggcctgtcggatggcccattggtggattccccggccctcagggaccatactactgcagtgttggagctgacaaatcttttggaagagacattgttgatgctcactacaaggcttgtttgtatgctggaattaacatcagtggaatcaatggagaagtcatgcctggtcagtgggagttccaagtcggaccgtcggttggtatctcagctgctgatgaagtgtggattgctcgttttattttggagaggatcacagagattgctggtgtggttgtatcttttgacccaaaaccaattccgggtgactggaacggagctggtgctcacaccaattacagtactaaatcgatgagggaggaaggaggatacgagataatcaagaaggcaattgataagctcggactgagacacaaggagcacatttctgcttacggtgaaggcaacgagcgtcgtctcactggacaccatgaaactgctgatatcaacactttcaaatggggtgttgcaaaccgtggagcatcaatccgtgtaggacgtgacacggagaaggaagggaaaggatactttgaggataggaggccagcttccaacatggacccttacactgtaacttccatgattgcagagactacacttctttggaatccttgaagaaatatgacaataatataacttgaatctggtttcaagtttgtgtttctacagtttattaagcaattaccgggttgatactgccggagtttgtggtttgaggcctttcttttaatctctttgtgttttggggtttgtgattggagcaaaagccctgatttgctctgtttctttgaccttttatttgaaccctttgtatttgtattaataaggcgatctgaaaaggccttttcatgtttctatcaaaaaaaaaaaaaaaaaa

SEQ ID NO: 21132 - protein, 356 aa, Brassica napus (rape)
MSLLTDLVNLDLSDNTEKIIAEYIWVGGSGMDMRSKARTLPGPVTDPSKLPKWNYDGSSTGQAPGEDSEVILYPQAIFKDPFRRGNNILVMCDTYTPAGEPIPTNKRHAAAQIFSNPDVVAEVPWYGIEQEYTLLQKDVNWPVGWPIGGFPGPQGPYYCSVGADKSFGRDIVDAHYKACLYAGINISGINGEVMPGQWEFQVGPSVGISAADEVWIARFILERITEIAGVVVSFDPKPIPGDWNGAGAHTNYSTKSMREEGGYEIIKKAIDKLGLRHKEHISAYGEGNERRLTGHHETADINTFKWGVANRGASIRVGRDTEKEGKGYFEDRRPASNMDPYTVTSMIAETTLLWNP

SEQ ID NO: 21133 - DNA, 1370 bp, Sus scrofa domestica (domestic pig)
  CDS (118)..(1239)
aattccggagcggatggtttaaggagcaccctcggcctcctcgcctctccgctccgattctcgctctcgcggcctgcccgccctgcctcctgctcgccgcccagaacaccgtccaccatggccacctcagcgagctcccacttgaacaaaggcatcaagcaggtgtacatgtccctgccccagggcgagaaagtccaagctatgtacatctggattgacggtacgggagagggactgcgctgcaagacccggaccctggattctgagcccaagtgtatagaagagttgcccgagtggaatttcgatggctctagtacttttcagtctgaaggctccaacagtgacatgtatcttgtccctgctgccatgtttcgggaccctttccgcaaggaccccaacaagctggtgttctgtgaggtcttcaagtacaaccgaaagcctgcagagaccaacttaaggcacacctgtaaacggataatggacatggtgagcaaccagcacccctggtttggaatggagcaggaatatactctcatgggcacagatggacacccctttggttggccttccaatggcttccctgggccccaaggtccgtactattgtggtgttggagcagacaaagcctatggcagggacattgtggaggctcactaccgggcctgcttgtatgccggcatcaagattgggggcaccaatgccgaggtcatgcccgcccagtgggaattccagatcggaccctgtgaaggaatcgacatgggagatcacctctgggtggcccgattcatcttgcatcgtgtgtgcgaagacttcggagtgatcgccacctttgatcctaagcccattcctgggaactggaatggtgccggctgccacaccaactttagcaccaaggccatgcgagaggagaatggtctgaagtacatcgaggaggccatcgagaagctaagcaagcggcaccagtaccacatccgagcctacgatcccaaggggggcctggacaacacacggcgcctaactggattccatgaaacctccaacatcaacgacttttctgccggcgtggccaaccgtggcgctagcatccgcattccccggactgggggccaggagaagaagggttacttcgaagaccgtcgcccttctgccaactgtgacccctttgcggtgacagaagctctcatccgcacgtgtctcctcaacgaaactggcgacgagcccttccagtacaaaaactaagtggactagacgggcagccatcaaaacccctccaattctacaccgcccccccccccctcgccctctcaactgtcgtaatagctgtaactcaaagggcggaatagcaaggtcttttttattcctcaaaaaaa

SEQ ID NO: 21134 - protein, 373 aa, Sus scrofa domestica (domestic pig)
MATSASSHLNKGIKQVYMSLPQGEKVQAMYIWIDGTGEGLRCKTRTLDSEPKCIEELPEWNFDGSSTFQSEGSNSDMYLVPAAMFRDPFRKDPNKLVFCEVFKYNRKPAETNLRHTCKRIMDMVSNQHPWFGMEQEYTLMGTDGHPFGWPSNGFPGPQGPYYCGVGADKAYGRDIVEAHYRACLYAGIKIGGTNAEVMPAQWEFQIGPCEGIDMGDHLWVARFILHRVCEDFGVIATFDPKPIPGNWNGAGCHTNFSTKAMREENGLKYIEEAIEKLSKRHQYHIRAYDPKGGLDNTRRLTGFHETSNINDFSAGVANRGASIRIPRTGGQEKKGYFEDRRPSANCDPFAVTEALIRTCLLNETGDEPFQYKN

SEQ ID NO: 21135 - DNA, 1433 bp, Glycine max (soybean)
  CDS (70)..(1137)
tcgatccgggaagagaaagaaatttgttctctctaaagagtctccgctgaactttttggtttcttgaagatgtcgttactctccgatcttatcaaccttaacctctccgacatcaccgataaagtgatcgcagagtacatatgggttggtggatctggcatggatatgaggagcaaagcaaggacactctcaggactggttaatgacccttcagcacttcccaagtggaactatgatggttccagcacaggtcaagctcctggagaagatagtgaagtgatctatatccacaagcaatttcgggatccattcagaaggggtaacaatatcctggttatgtgtgatgcttacactcctgctggggaacccattcccaccaacaagagaaataaagctgcaaagatattcatacatccggatgttgctgctgaagaaccctggtatggtcttgagcaggaatatacattattgcagaaagatgtccaatggcctcttggatggcctcttggtggtttcctgggcccccagggaccatactattgtggaactggtgctaacaaggcttttgggcgtgatattgttgactcacattacaaagcatgtatttatgcgggatttaacataagtggaatcaatggagaagtgatgccaggtcagtggggattccaagttggtccatcggttggcatctcagctgctgacgagttgtgggttgctcgttacattttggagaggatcaccgagattgctggactggtgctttcctttgaccctaagccaattcagggtgattggaatggtcctggtgctcacacaaattacagtaccaagttgatgagagacgatggtggctatgaaatcatcaaaaaagcaattgctaagttggaaaagaggcacaaagagcacattgctgcttacggagaaggcaatgaacgtcgtttgaccggacccgacgagacggctgacatgaacacctttttatggggagttgcaaaccgtggtgcttctgttagggtagggagacagactctaaaggcagggaagggatactttgaggagaggaggcctgcctctaacatggacccttatgtggtcacttccatgattgctgacacaactattctttggaaaccataagcaacgtcaaagaatcacatggtgccttccgcatagcattgttgtttagatggtcaatttgtttttctatgtttttgtgtgcattctagttgtgactacctcgcctgttgttaggatattgtttgttggtggtactcatgattaccaagcgaggaattgttgtttcattttcttaatgtacgttttaagtgttccaataatgtgtaatggccctcaagtattgttatttgctgcgaatttatattgtgaagcatctcatgatttctctttgagcaatcaagttcttattaactgta

SEQ ID NO: 21136 - protein, 355 aa, Glycine max (soybean)
MSLLSDLINLNLSDITDKVIAEYIWVGGSGMDMRSKARTLSGLVNDPSALPKWNYDGSSTGQAPGEDSEVIYIHKQFRDPFRRGNNILVMCDAYTPAGEPIPTNKRNKAAKIFIHPDVAAEEPWYGLEQEYTLLQKDVQWPLGWPLGGFLGPQGPYYCGTGANKAFGRDIVDSHYKACIYAGFNISGINGEVMPGQWGFQVGPSVGISAADELWVARYILERITEIAGLVLSFDPKPIQGDWNGPGAHTNYSTKLMRDDGGYEIIKKAIAKLEKRHKEHIAAYGEGNERRLTGPDETADMNTFLWGVANRGASVRVGRQTLKAGKGYFEERRPASNMDPYVVTSMIADTTILWKP

SEQ ID NO: 21137 - DNA, 1354 bp, Brassica napus (rape)
  CDS (62)..(1132)
ttcgattttatctgtcatttgcttcaactgttactatcgaccaatctcggtgttcgtagccatgagtcttcttacagatctcgttaaccttaacctctcagagaccactgacaaaatcattgcggaatacatatgggttggaggttcaggaatggatatgagaagcaaagccaggactcttcctggaccagtgagtgacccttcggagctaccaaagtggaactatgatggctcaagcacaggccaagctcctggtgaagacagtgaagtcatcttataccctcaagccatcttcaaagatcctttccgtagaggcaataacattcttgtcatgtgcgatgcttacactccagcgggcgaaccaatcccaacaaacaaaagacacgctgcggctaaggtctttagccaccctgatgttgtagctgaagtgccatggtatggtattgagcaagagtatactttacttcagaaagatgtgaactggcctcttggttggcctattggcggcttccctggccctcagggaccatactattgtagtgttggagcagataaatcttttggtagagacatcgttgatgctcactacaaggcctgcttatacgctggcatcaatattagtggcatcaacggagaagtcatgcctggtcagtgggagttccaagttggtccagctgttggtatctcggccggtgatgaaatttgggtcgcacgtttcattttggagaggatcacagagattgctggtgtggtggtatcttttgacccaaaaccgattcccggtgactggaatggtgctggtgctcactgcaactatagtaccaagtcaatgagggaagatggtggttacgagattatcaagaaggcaattgataaactgggactgagacacaaggaacacattgctgcttatggtgaaggcaatgagcgtcgtctcacgggtcaccacgagactgctgacatcaacactttcctctggggtgttgcgaaccgtggagcatcaatccgtgtaggacgtgacacagagaaagaagggaaaggatactttgaggataggaggccagcttcgaacatggatccttacattgtgacttccatgattgcagagaccacaatcctctggaaaccttgatcagatcaaagaagcttgttgaagaatgttcactccgtttgggtttcttgcatggttcaacgtttgtgtgtttctctatcaagcattgtctcagagcaagtcaagagatttgctttgttcttatggcttttattgtttcacatccattgaaaacatctctttgtatcaatttatgaataaagtgtggtttggttaaaaaaaaaaaaaaaaaaaaaaaaaaaa

SEQ ID NO: 21138 - protein, 356 aa, Brassica napus (rape)
MSLLTDLVNLNLSETTDKIIAEYIWVGGSGMDMRSKARTLPGPVSDPSELPKWNYDGSSTGQAPGEDSEVILYPQAIFKDPFRRGNNILVMCDAYTPAGEPIPTNKRHAAAKVFSHPDVVAEVPWYGIEQEYTLLQKDVNWPLGWPIGGFPGPQGPYYCSVGADKSFGRDIVDAHYKACLYAGINISGINGEVMPGQWEFQVGPAVGISAGDEIWVARFILERITEIAGVVVSFDPKPIPGDWNGAGAHCNYSTKSMREDGGYEIIKKAIDKLGLRHKEHIAAYGEGNERRLTGHHETADINTFLWGVANRGASIRVGRDTEKEGKGYFEDRRPASNMDPYIVTSMIAETTILWKP

SEQ ID NO: 21139 - DNA, 1333 bp, Raphanus sativus (radish)
  CDS (37)..(1101)
ttcacctaaacaaacactgattctcgtaacgccgccatgtctctcctctcagatctcgtcaacctcaacctctctgactccaccgagaaaatcatcgctgaatacatatggatcggtggatctggaatggacatcagaagcaaagccagaacgctcccaggaccagtgagcgatccatcaaagcttcccaagtggaactacgacggatccagcaccggtcaggccgctggagatgatagtgaagtcattatataccctcaggcgatcttccgtgatccgttcaggagaggcaacaacattctggtgatgtgtgatgcttacacaccggccgggaatccaattcctaccaacaagagacacaacgctgctaagatctttagcacctccaaagttgcctccgaggagccttggtatgggattgagcaagagtacacattgatgcagaagggtgtgaactggcctattggttggcctgttggtggcttccctggcccacagggaccatactactgtggtgtgggagctgacaaagccattggtcgtgacattgtcgatgcacactacaaggcctgtctctacgcaggtatcagcatctctggtgtcaatggagaagtcatgcctggccagtgggagttccaagtcggtccagttgaaggtattagcgctggtgatcaagtctgggtcgctagattccttctcgagaggatcactgagatctctggtgtaaatgtcagcttcgacccaaaaccagtcccgggtgactggaacggggctggagctcactgcaactacagtacgaagtcgatgaggaacgacggaggattagcggtgatcaagaaagccatagagaagcttcaggtgaagcacaaggagcacattgctgcttacggtgaaggcaacgagcgtcgtctcacggggaagcacgagacggcagacatcaacacgttctcttggggagtggcgaaccgtggagcttcggttagagtgggacgtgacactgagaaagaaggcaaaggttacttcgaggacagaaggccggcttctaacatggatccttatgtcgttacgtccatgattgctgaaaccaccatcctcggttaaaagtcatcacattttagtaatgtttggttttctccggtttggttttatgatttgaagacttttctgcttgtgatgacattttgtgtttttttcttcttttagtttcgaataattaaaataaagtattcttgtggtgaaaatttgatcagcgacttttgtgttgtgttgctgttgttgaaatgataataataacaaggaagtacggcctggcatgttacaggttgaactaatt

SEQ ID NO: 21140 - protein, 354 aa, Raphanus sativus (radish)
MSLLSDLVNLNLSDSTEKIIAEYIWIGGSGMDIRSKARTLPGPVSDPSKLPKWNYDGSSTGQAAGDDSEVIIYPQAIFRDPFRRGNNILVMCDAYTPAGNPIPTNKRHNAAKIFSTSKVASEEPWYGIEQEYTLMQKGVNWPIGWPVGGFPGPQGPYYCGVGADKAIGRDIVDAHYKACLYAGISISGVNGEVMPGQWEFQVGPVEGISAGDQVWVARFLLERITEISGVNVSFDPKPVPGDWNGAGAHCNYSTKSMRNDGGLAVIKKAIEKLQVKHKEHIAAYGEGNERRLTGKHETADINTFSWGVANRGASVRVGRDTEKEGKGYFEDRRPASNMDPYVVTSMIAETTILG

SEQ ID NO: 21141 - DNA, 1484 bp, Raphanus sativus (radish)
  CDS (170)..(1240)
gaaaacagaggctctctctccctatctctgtagtatgtaccctcgttgctccctataagtactcccacaaccacgaacaccaaaacatcatctcataaacgaaaaaccacattgtccgagatttaattgtttctcactacaaccttcttgtcagtttttttctgtaaccatgagtcttctgaccgatctcattaaccttgacctctcagacaacactgagaaaatcatcgctgaatacatatgggttggtggttcaggaatggacatgagaagcaaagctaggactctctctggacctgtgaccgatccatcacaactcccaaagtggaactatgatggttcaagcactggccaagctcctggtgaagacagtgaagtgatcttataccctcaagcgattttcaaggatccgttccgtagaggcaaccacattcttgtcatgtgtgatacttacacccctgcgggtgaaccaattcctacgaacaagagacatgctgcagctcagatctttagccaccctgatgttgtagctgaagtgccatggtacggaattgaacaggagtacactctgttgcagaaggatgtgaagtggcctgttggatggcccattggtggcttccctggccctcagggaccatactattgcagtgttggagctgacaaatcttttggaagagacattgttgatgctcactacaaggcttgtttgtatgccggaattaacatcagtgggatcaatggagaagtcatgcctggtcagtgggagttccaagtcggaccatcggttggtatctcagccgctgatgaagtgtggatcgctcgttacattttggagaggatcacagagattgctggtgtggttgtatcttttgacccaaaaccaattcctggtgactggaacggagctggtgctcacacgaactacagtactaagtcgatgagggaggaaggaggatacgagataatcaagaaggcaatcgataagctaggactgagacacaaggagcacatttctgcttatggtgaaggcaacgagcgccgtctcaccgggcaccatgaaactgctgacatcaacactttcaaatggggtgttgcaaaccgtggagcatcaatccgagtaggacgtgacacggagaaggaagggaaaggatactttgaggataggaggccagcttccaacatggacccttacattgttacttccatggttgcagagactactatcctttggaatccttgaagaaatatgacaataatataacttgaatcttttggggtttcaagtttgtgttttctataattatttaagcaattaccgggttgatgttaccggggtttgtggtttggggcctttcttttaatctctttgtgttttgggatttgtgattggagcaaaacctgatttgctctgtttccttgaccttttatttgaccccttaaaatttgtattaataagacgatctgaaaaggccttttcatgtttc

SEQ ID NO: 21142 - protein, 356 aa, Raphanus sativus (radish)
MSLLTDLINLDLSDNTEKIIAEYIWVGGSGMDMRSKARTLSGPVTDPSQLPKWNYDGSSTGQAPGEDSEVILYPQAIFKDPFRRGNHILVMCDTYTPAGEPIPTNKRHAAAQIFSHPDVVAEVPWYGIEQEYTLLQKDVKWPVGWPIGGFPGPQGPYYCSVGADKSFGRDIVDAHYKACLYAGINISGINGEVMPGQWEFQVGPSVGISAADEVWIARYILERITEIAGVVVSFDPKPIPGDWNGAGAHTNYSTKSMREEGGYEIIKKAIDKLGLRHKEHISAYGEGNERRLTGHHETADINTFKWGVANRGASIRVGRDTEKEGKGYFEDRRPASNMDPYIVTSMVAETTILWNP

SEQ ID NO: 21143 - DNA, 1326 bp, Raphanus sativus (radish)
  CDS (65)..(1135)
attcgattttatctgtcatttgcgtcaactgttactatcgcgaccaatctcggtgttcgtagccatgagtcttcttacagatctcattaaccttaacctctcggagaccactgacaaaatcattgcggaatacatatgggttggaggttctggaatggatatgagaagcaaagccaggactcttcctggaccagtgagtgacccttcggagctaccaaagtggaactatgatggttcaagcacaggccaagctcctggtgaagatagtgaagtcatcttatacccacaagcgatattcaaagatcctttccgtagagccaataacattcttgtcatgtgcgacgcttacactccagcgggtgaaccaatcccaacaaacaaaagacacgctgcggctaaggtctttagccagcctgatgtggtagctgaagtgccatggtatggtattgagcaagagtatactttacttcagaaagatgtgaagtggcctgttggttggcctattggcggcttccccggtcctcagggaccatactattgtggtgttggagcagataaatcttttggcagagacgttgttgatgctcactacaaggcctgcttatacgctggtatcaacattagtggcatcaatggagaagtcatgccgggtcagtgggagttccaagttggttcagctgttggtatttcggccggtgatgaaatatgggtcgcacgttatattttggagaggatcacggagattgctggcgtggtggtatcttttgacccaaaaccgattccaggtgactggaatggtgctggtgctcactgcaactatagtaccaagtcaatgagggaagatggtggttacgagattatcaagaaggctatcgataaactgggactgagacacaaagaacacattgctgcttacggtgaaggcaatgagcgccgtctcacgggtcaccacgagactgctgacatcaacactttcctctggggtgttgcgaaccgtggagcatcaatccgtgtaggacgtgacacagagaaagaagggaaaggatactttgaggataggaggccggcttcgaacatggaaccttacatcgtgacttccatgattgcagagaccacaatcctctggaacccttgatcagatcgaagaagattgttgaattttcactccatttgggtttcttgcatgattcaacgtttgtatgttctctatcaagcattgtctcagaacaagtcgagagatttgctctgttcttatggcttttattgtttcacatccattgaaaacatctctctgtatcattttatgagtaaagtttggtttggttc

SEQ ID NO: 21144 - protein, 356 aa, Raphanus sativus (radish)
MSLLTDLINLNLSETTDKIIAEYIWVGGSGMDMRSKARTLPGPVSDPSELPKWNYDGSSTGQAPGEDSEVILYPQAIFKDPFRRANNILVMCDAYTPAGEPIPTNKRHAAAKVFSQPDVVAEVPWYGIEQEYTLLQKDVKWPVGWPIGGFPGPQGPYYCGVGADKSFGRDVVDAHYKACLYAGINISGINGEVMPGQWEFQVGSAVGISAGDEIWVARYILERITEIAGVVVSFDPKPIPGDWNGAGAHCNYSTKSMREDGGYEIIKKAIDKLGLRHKEHIAAYGEGNERRLTGHHETADINTFLWGVANRGASIRVGRDTEKEGKGYFEDRRPASNMEPYIVTSMIAETTILWNP

SEQ ID NO: 21145 - DNA, 1416 bp, Vitis vinifera (grape)
  CDS (88)..(1158)
gagaaagagaggaagaggccaagtcaagctttgaagttttttttttatatttatttttctcatttcatccgttttcctgtgttcgtcatggcactgctctccgatctcatcaacttgaacctctctgagaccactgagaaggtgattgtagagtacatatgggttggtggatctggtatggaccttagaagcaaagccaggaccctttctggaccagttagcgatcctgcaaagcttcccaaatggaactatgatggttctagcactggccaagctccgggggaagacagtgaagttattctatatcctcaagcaattttcaaggacccattcaggagaggcaacaacattcttgtgatgtgtgatacttatacccctgccggagagccaattccgaccaataagaggtgtaatgctgcaaagattttcagccaccctgatgttgcagctgaagtgccttggtatggtattgagcaggagtatactttgttgcagaaagaggtaaaatggccaattggctggcctgtgggcggttttcctggacctcagggaccatactattgtggtattggtgctgacaaagcttggggccgtgacattgttgatgcacattacaaagcgtgcctttatgctggcatcaacatcagtggaatcaatggagaagtgatgccaggccagtgggaataccaagttggcccttctgttggcatctctgcaggagatgaattatgggtgtctcgttatattcttgagaggatcacagagattgctggggtggtgctttcttttgacccgaaacccatccagggtgattggaatggagcgggtgcgcacacaaattacagcaccaagtcgatgagaaatgatggagggtttgaagtcatcaaaaaagccattgaaaagcttgggctgaggcacaaggaacacattgcagcttatggagaaggcaatgaacgccgtctcactggacgacatgaaactgctgacatcaacacattcttatggggagtggcaaaccgaggagcctccattagagttggaagagacacagagaaagctgggaaaggatattttgaggacagaaggcctgcttcaaacatggatccttatgtggtcacctccatgattgcagaaactaccatcctctggaagccataagacacccatctcctccgtcccaacaggcttgtgggattgtcttgttggaatttcctgtgaaaattgtctccttagaactgcttgtcctggtttaatagcttccatgtgtttggattacgataaagatcagtctcataaaataagaggctattggggttgctccaatttcgatcattttatgctgtcttatgtattatgctacggaaatatcatcatatgatttaatgtcgtattggttaggccacctctatttactat

SEQ ID NO: 21146 - protein, 356 aa, Vitis vinifera (grape)
MALLSDLINLNLSETTEKVIVEYIWVGGSGMDLRSKARTLSGPVSDPAKLPKWNYDGSSTGQAPGEDSEVILYPQAIFKDPFRRGNNILVMCDTYTPAGEPIPTNKRCNAAKIFSHPDVAAEVPWYGIEQEYTLLQKEVKWPIGWPVGGFPGPQGPYYCGIGADKAWGRDIVDAHYKACLYAGINISGINGEVMPGQWEYQVGPSVGISAGDELWVSRYILERITEIAGVVLSFDPKPIQGDWNGAGAHTNYSTKSMRNDGGFEVIKKAIEKLGLRHKEHIAAYGEGNERRLTGRHETADINTFLWGVANRGASIRVGRDTEKAGKGYFEDRRPASNMDPYVVTSMIAETTILWKP

SEQ ID NO: 21147 - DNA, 1305 bp, Vitis vinifera (grape)
  CDS (24)..(1094)
gtttttttttttttttcgccaccatggctctgctttcagatctcatcaacttgaacctctctgatgtcactgagaaaattattgccgagtacatatggatcggcggatccggaatggacctcagaagtaaagcgagaacgctatcagggcccgtcagcgacccccacaagctacccaaatggaattatgacggatccagcacaggccaagcccctggagaggacagtgaagtgatcctataccctcaagcaattttcaaggacccattcaggagaggcaacaatattcttgtcatgtgtgatacttacactcctgctggggagcccattccaaccaacaagaggcataacgcagctaaaatatttagccatcctgaagtccttgctgaagaaacttggtatggtattgagcaggagtacaccttgttgcaaaactcggttaaatggcccattggctggcctgtgggaggttatcccggcccccagggaccatactactgcggtattggtgctgacaaagcctttgggcgggacattgttgattctcattacaaggcatgcctttatgctggaatcaacattagtggcatcaatggtgaagttatgccaggacagtgggagtttcaagtaggccctgcagtcggcatctctgctggggatgaattgtgggttgctcggtacattctagagaggattacagagattgctggagtggtggtttcctttgatcccaaacccattcagggtgactggaatggtgccggcgctcacacaaattacagcactaagtccatgagaaatgatggaggttatgagatcatcaagaaagcaatcgaaaaacttgggctgaggcacaaagaacacattgccgcatacggagaaggcaatgagcgcagactcacaggacgacatgaaactgctgacattaacacattcttatggggcgtcgcaaaccgaggggcatccatccgagtaggcagagacacagagaaggaagggaaagggtattttgaggacagaaggcctgcttccaacatggatccatatgtggtgacttccatgatcgcggagagcaccatcctgtggaagccataagtgtttccagatgttgccgttgttccaggggataaaatttgagtcagtcagttgtgttattttggtgctgtgtctcattgtttgcccttgtatttgaggtagcaaggggggtgggtttatggcccccttgcctgatcatttcgcctcttgttaaaataaccattaccttagcattaataacaacatttgaaggcctggcttctattgttgc

SEQ ID NO: 21148 - protein, 356 aa, Vitis vinifera (grape)
MALLSDLINLNLSDVTEKIIAEYIWIGGSGMDLRSKARTLSGPVSDPHKLPKWNYDGSSTGQAPGEDSEVILYPQAIFKDPFRRGNNILVMCDTYTPAGEPIPTNKRHNAAKIFSHPEVLAEETWYGIEQEYTLLQNSVKWPIGWPVGGYPGPQGPYYCGIGADKAFGRDIVDSHYKACLYAGINISGINGEVMPGQWEFQVGPAVGISAGDELWVARYILERITEIAGVVVSFDPKPIQGDWNGAGAHTNYSTKSMRNDGGYEIIKKAIEKLGLRHKEHIAAYGEGNERRLTGRHETADINTFLWGVANRGASIRVGRDTEKEGKGYFEDRRPASNMDPYVVTSMIAESTILWKP

SEQ ID NO: 21149 - DNA, 1346 bp, Nicotiana tabacum (common tobacco)
  CDS (21)..(1091)
ttaagacttctattttcattatgtctccgctttcagatcttatcagcctcaatctctctgattctacccagaaaatcatcgctgaatacatatggataggtggatcaggcatggacttaaggagcaaggccaggactctttctggtcctgttactgatccttcagaactacccaaatggaactatgatggatctagcacaggtcaagctcctggagaagatagtgaagtgatcttataccctcaagtatactttaaggatccattcagaagaggcaacaatatcttggtcatgtgtgatgcctatactcctgctggcgagcctatcccgacaaacaagaggcatgctgctgccaagatcttcagcaaccctgatgttgttgctgaggaaccctggtatggtattgagcaagaatacaccttgttgcaaagggatattaactggcctctagcgtggcctattggaggcttccctggacctcagggaccatactactgtggaaccggagctgataaggcctttggacgtgatattgtggactcccattacaaggcttgtctttatgctgggtttaacatcagtggtatcaacggagaagtgatgcccggacagtgggaattccaagtcggaccttctgttggcatctcagccggtgatgaagtgtgggtagctcgttacattcttgagaggattgcggagattgctggagtggttgtgtcatttgaccccaagcctattccgggcgattggaacggtgcaggtgctcacacaaactacagcaccaagtcgatgagggaagatggaggctatgaagtcattttgaaggctattgagaagcttggcctgaagcacaaagtgcacattgctgcatatggtgaaggcaatgagcgtcgtctcactggaaagcacgaaacagccaacatcagcaccttcaaatggggggttgcgaaccgcggtgcatctgtccgtgtaggaagggacacatataaggctgggaagggatattttgaggacagaaggacggcttcaaatatggatccatacgccgttactgccatgatcgcggacaccaaccatatctgcaaatcttgaagcttttagtatgaattgcttgtttctggtttgctcaatttgggatagaaaaggattgatttatgaaacagccctttcgctttgcctgtgtctttagttaggatagtctggccttttcttatttattattttattccagttgaagttgtattttcatacagcaatgctgatttcattcgcctttgatttggcagtggtgttacaaacaaaacaatgttattcttattaataacaaattataaaagggctggttct

SEQ ID NO: 21150 - protein, 356 aa, Nicotiana tabacum (common tobacco)
MSPLSDLISLNLSDSTQKIIAEYIWIGGSGMDLRSKARTLSGPVTDPSELPKWNYDGSSTGQAPGEDSEVILYPQVYFKDPFRRGNNILVMCDAYTPAGEPIPTNKRHAAAKIFSNPDVVAEEPWYGIEQEYTLLQRDINWPLAWPIGGFPGPQGPYYCGTGADKAFGRDIVDSHYKACLYAGFNISGINGEVMPGQWEFQVGPSVGISAGDEVWVARYILERIAEIAGVVVSFDPKPIPGDWNGAGAHTNYSTKSMREDGGYEVILKAIEKLGLKHKVHIAAYGEGNERRLTGKHETANISTFKWGVANRGASVRVGRDTYKAGKGYFEDRRTASNMDPYAVTAMIADTNHICKS

SEQ ID NO: 21151 - DNA, 1381 bp, Nicotiana tabacum (common tobacco)
  CDS (54)..(1124)
ttttattctctcatatacgaactcagccaatttcacaactcttattttccaatatggctcatctttcagatctcgttaatctcaatctctctgactccactcagaaaattattgctgaatacatatggattggtggatcaggaatggacgtcaggagcaaagccagaacactttctggacctgttgatgatccttcaaagcttcccaaatggaattatgatggttctagcacaggacaagctcctggagaagacagtgaagagatcctatatcctcaagcaattttcaaggatccattcagaaggggcaacaatatcttggtcatttgtgattgttacaccccagctggtgaacccattccaacaaacaaaaggcacagtgctgccaagattttcagccaccctgatgttgttgttgaggaaccctggtatggtcttgagcaagaatacaccttgttgcaaaaagatatcaattggcctcttggatggcctcttggtggttttcctggaccacagggaccatactattgcggaattggagctggaaaggtctttggacgcgatatcgttgactctcattataaggcatgtctctatgctgggattaacatcagtggtatcaatggagaagtgatgcccggacagtgggaatttcaagttggaccttcagttggcatttcagcagctgatgaattgtgggcagctcgttacattcttgagaggattactgagattgctggagttgtggtctcatttgaccccaaacctattccgggtgactggaatggtgctggagctcacacaaactacagcacaaagtctatgaggaatgaaggaggctatgaagtcattaagaaggcaattgagaaccttggactgaggcacaaggagcatattgcagcatatggtgaaggcaacgagcgtcgtctcactggaagacacgaaacagctgacatcaacacattcaaatggggagttgcgaaccgtggtgcatctattcgtgtgggaagagacacggagagagaagggaagggatacttcgaggataggaggcctgcttcgaatatggatccattcgtcgtgacttccatgattgctgagaccactatcctatccgagccttgagtgtgtagtcgtcttttgaggattcaatgagtattaattcttgggtgtaatatttggagaaagaattgaatttcggaacaaccctttcctcacaatgtccttatacagttagctatcttgttatattctgctgttttcctggtttgtatttgtattgtactcacgcaaagctcaggtcattgcctgtgatttggcaatggtgtaaaataacagtgttaatcttattgattaataacaatagggaagggtttaactgt

SEQ ID NO: 21152 - protein, 356 aa, Nicotiana tabacum (common tobacco)
MAHLSDLVNLNLSDSTQKIIAEYIWIGGSGMDVRSKARTLSGPVDDPSKLPKWNYDGSSTGQAPGEDSEEILYPQAIFKDPFRRGNNILVICDCYTPAGEPIPTNKRHSAAKIFSHPDVVVEEPWYGLEQEYTLLQKDINWPLGWPLGGFPGPQGPYYCGIGAGKVFGRDIVDSHYKACLYAGINISGINGEVMPGQWEFQVGPSVGISAADELWAARYILERITEIAGVVVSFDPKPIPGDWNGAGAHTNYSTKSMRNEGGYEVIKKAIENLGLRHKEHIAAYGEGNERRLTGRHETADINTFKWGVANRGASIRVGRDTEREGKGYFEDRRPASNMDPFVVTSMIAETTILSEP

SEQ ID NO: 21153 - DNA, 1310 bp, Glycine max (soybean)
  CDS (62)..(1129)
gaaaggaaaagagaaaaaatttctcagaagagtctccgctgaaagttttggtttcttgaagatgtcgttgctctccgatcttatcaaccttaacctctccgacatcaccgataaagtgatcgcagagtacatatgggtaggtggatctggcatggatatgaggagcaaagcaaggacactcccaggaccagttagagacccttcaggacttcccaagtggaactatgatggttccagcacaggtcaagctcctggtgaagatagtgaagtgatttatatccataagccatttcaggatccattcagaaggggtagcaatatcctggttatgtgtgatgcttacactcctgctggggaacccattcccacaaacaagagaaataatgctgcaaagatattcggccatcctgatgttgctgctgaagaaccctggtatggcattaagcaagaatacaccttgttgcaaaaagatgtccaatggcctctagggtggcctcttggtggtttcctgggccacaagggaccatattattgtggtactggtgctaacaaggctttcgggcgtgatattgttgactcacattacaaagcatgtatttatgcgggattcaacatcagtggaatgaatccagaagtgatgccaggtcagtgggaattccaagttggtccttcaattggcatctcagctgctgatgaattgtgggaagctcgttatattttggagaggatctccgagattgcaggagtggtgctttcctttgaccctaagccaattccgggtgattggaatggtgctggtgctcacacaaattacagtaccaagtccatgagagacgatggtggctatgaagtcatcaaagcagcaattgctaagttggaaaagagacacaaggagcacattgcagcttacggagaaggcaacgaacgtcgtttgactggacacgacgagacagctgacatgaactccttgttatggggtgttgcaaaccgtggtgcttctgttagagtagggagggacactgagaaagcagggaaggggtattttgaggataggaggcctgcctctaatatggacccttatgtggtcacttccatgattgctgacacaaccattctttggaaaccataagcagcctcaaaaataatcacacatgccttgttttttcatgttttgtgtgcactcttgttgtgactacctcgccttttcttaggcattgtttgttggtagtactgaagtgaagaattgtcgtgtcattccattaatgtacgtttttcaaaggaattgtttgtgtgcacccttgttgtgatta

SEQ ID NO: 21154 - protein, 355 aa, Glycine max (soybean)
MSLLSDLINLNLSDITDKVIAEYIWVGGSGMDMRSKARTLPGPVRDPSGLPKWNYDGSSTGQAPGEDSEVIYIHKPFQDPFRRGSNILVMCDAYTPAGEPIPTNKRNNAAKIFGHPDVAAEEPWYGIKQEYTLLQKDVQWPLGWPLGGFLGHKGPYYCGTGANKAFGRDIVDSHYKACIYAGFNISGMNPEVMPGQWEFQVGPSIGISAADELWEARYILERISEIAGVVLSFDPKPIPGDWNGAGAHTNYSTKSMRDDGGYEVIKAAIAKLEKRHKEHIAAYGEGNERRLTGHDETADMNSLLWGVANRGASVRVGRDTEKAGKGYFEDRRPASNMDPYVVTSMIADTTILWKP

SEQ ID NO: 21155 - DNA, 2030 bp, Chlamydomonas reinhardtii
  CDS (84)..(1232)
aagccaattctttactctgctgcctgtccactcgcctgtccaactactaccagtcggggatttcttctcctgaaggtctaaccatggccgcgggatctgttggcgtcttcgccaccgatgagaagattggcagcctgctggaccagtccatcacgcgccactttctgtcgactgtgaccgaccagcagggcaagatctgtgccgagtatgtgtggatcggcggctccatgcacgacgtgcgctccaagtcgcgcaccctgtccaccatccccacgaagcccgaggacctgccccactggaactacgacggctcctccaccggccaggcccccggccacgactcagaggtctatctcattccccgctccatcttcaaggaccccttccgcggcggcgacaacatcctggtcatgtgcgactgctacgagccgcccaaggtcaaccccgacggcaccctggccgcgcccaagccgatccccacgaacacccgctttgcctgcgccgaggtgatggagaaggccaagaaggaggagccctggttcggcattgagcaggagtacacgctgctcaacgccatcaccaagtggccgctgggctggcccaagggcggctaccccgccccccagggcccctactactgctcggccggcgccggcgtggccatcggccgcgacgtggcggaggtgcactaccgcctgtgcctggccgcgggcgttaacatcagcggcgtgaacgccgaggtgctgcccagccagtgggagtaccaggtgggcccgtgcgagggcatcaccatgggcgaccacatgtggatgagccgctatatcatgtaccgcgtgtgcgagatgttcaacgtggaggtctcgttcgaccccaagcccatccccggcgactggaacggctccggcggccacaccaactactccactaaggccacccgcaccgcgcccgacggctggaaggtcatccaggagcactgcgccaagctggaggcgcgccacgccgtgcacatcgccgcctacggcgagggcaacgagcgccgcctgaccggcaagcacgagaccagcagcatgagcgacttcagctggggcgtggccaaccgcggctgctccatccgcgtgggccgcatggtgccggtggagaagtcgggctactatgaggaccgccggcctgcctccaacctggacgcctacgtcgtcacccgcctcatcgtggagaccaccatccttctgtaagcgcaggagcagcggcacgcaggagcagcagtgggcgatggtggtggtggcgtttgtgctggcctgagcgaggggggggccacggaagggcgatcgtggccaaggcggagggaagcggcggtcgagccgcgtggtgatcaaggtgaggcgtggtgcgcgtgtttgcattgacatgcgggctcgtttggcgccgtggcttgaagctggagcaattccaactgcatttggtttgccgggacgtgtagcggttcaggaaagatggggtgacggcagcgaggacccgctgtgtgttctggtccagtctgccaaagggacttcggacgcaggatgctgcatcatctgtggcgcagtcaactgatctctacgaagagccgcagtgccataccatttgtcgtgtgcgtttcgagcctggctgtgtggacgccggcgcagaggtcgcctggttgtgtgcaagtgtatgccgtcggcgacggaagggagcgtacacgtgcggccaagcgacacggcgctctgtacgtgcccgtcgtcaagtgcatgagcggaggaccccgcgcagcgcggggtgcgtggcatgacgtgagctcttattggctgtgcgcgacgcatgtgttccctcatgtaggggaggcgttgcatacaggaacggtcgcggccgtgtttggtgttcaaactgtgttttgtcttggtattgtgtcctggttccaacagtggttgggtgattgtgcacttgaaacattctttgtgtgggtcggacccactctgtcgttctgtaacacgggaaagcataaaaaaaaaaaa

SEQ ID NO: 21156 - protein, 382 aa, Chlamydomonas reinhardtii
MAAGSVGVFATDEKIGSLLDQSITRHFLSTVTDQQGKICAEYVWIGGSMHDVRSKSRTLSTIPTKPEDLPHWNYDGSSTGQAPGHDSEVYLIPRSIFKDPFRGGDNILVMCDCYEPPKVNPDGTLAAPKPIPTNTRFACAEVMEKAKKEEPWFGIEQEYTLLNAITKWPLGWPKGGYPAPQGPYYCSAGAGVAIGRDVAEVHYRLCLAAGVNISGVNAEVLPSQWEYQVGPCEGITMGDHMWMSRYIMYRVCEMFNVEVSFDPKPIPGDWNGSGGHTNYSTKATRTAPDGWKVIQEHCAKLEARHAVHIAAYGEGNERRLTGKHETSSMSDFSWGVANRGCSIRVGRMVPVEKSGYYEDRRPASNLDAYVVTRLIVETTILL

SEQ ID NO: 21157 - DNA, 1604 bp, Chlamydomonas reinhardtii
  CDS (12)..(1154)
aagctgcaaagatggcgttcgctctgcgtggtgttaccgctaaggcctcgggccgcactgctggcgcccgctcgtcgggccgcaccctgacggtgcgcgtccaggcctatggcatggcggctgagtacatctgggcggatggcaacgagggcaagcctgagaagggcatgatcttcaacgagatgcgctcgaagaccaagtgcttcgaggcccccctgggcctggacgcctcggagtaccccgactggtcgttcgatggctcgtccaccggccaggctgagggcaacaactcggactgcatcctgcgccccgtgcgcgtggtgaccgaccccatccgcggtgccccccacgtgctggtgatgtgcgaggtgttcgcccccgatggcaagccccactccaccaacacccgcgccaagctccgcgagatcattgacgacaaggtcactgccgaggactgctggtacggcttcgagcaggagtacaccatgctggccaagacctctggccacatctacggctggcccgctggcggcttccctgctccccagggccccttctactgcggtgtgggcgctgagtccgccttcggccgccccctggctgaggcccacatggaggcctgcatgaaggccggtctggtcatctccggcatcaacgccgaggtgatgcccggccagtgggagtaccagatcggccccgtcggccctctggccctgggcgacgaggtgatgctgtcccgctggctgctgcaccgcctgggcgaggacttcggcattgtgtcgaccttcaaccccaagcccgtgcgcaccggtgactggaacggcactggcgcccacactaacttctcgaccaagggcatgcgcgtgcccggcggcatgaaggtgatcgaggaggccgtggagaagctgtccaagacccacatcgagcacatcacccagtacggcattggcaacgaggcgcgcctgaccggcaagcacgagacctgcgacatcaacaccttcaagcacggtgtggctgaccgcggctcttccatccgcattcccctgcccgtcatgctcaagggctacggctacctggaggaccgccgccccgctgccaacgtcgacccctacaccgtggcgcgcctgctgatcaagaccgtgctcaagggctaaatgcccagcatgcgccagctaataagggcagcgatgaggcggaggggtgcgtgactcggatgtgagctgtgatgagggggttgcttctatcggctaagggtgtgtgtgtgtgtgtgtctgtctatgctgggccgggtatgtggaccggcgacctgacgtttggaatgcgtgcgtgtgcacactgcccggttgcagtgtctgcgcatgtatttcctggcaactccaaagcctacggttgagcaagtgacctgtctttggttggacgattgttctgacacgtcgattgctgctaggttaacgggaggttgcggcgtgagccctgcgacgagctgcgtaatactatttccttgtacttcttcctcgcgcgccctcctgggtgctgacgcattgtcaggtttgctcaggtcgccacatgtaatcgaacacgtcaaaaaaaaaaaaaaaaaaaaa

SEQ ID NO: 21158 - protein, 380 aa, Chlamydomonas reinhardtii
MAFALRGVTAKASGRTAGARSSGRTLTVRVQAYGMAAEYIWADGNEGKPEKGMIFNEMRSKTKCFEAPLGLDASEYPDWSFDGSSTGQAEGNNSDCILRPVRVVTDPIRGAPHVLVMCEVFAPDGKPHSTNTRAKLREIIDDKVTAEDCWYGFEQEYTMLAKTSGHIYGWPAGGFPAPQGPFYCGVGAESAFGRPLAEAHMEACMKAGLVISGINAEVMPGQWEYQIGPVGPLALGDEVMLSRWLLHRLGEDFGIVSTFNPKPVRTGDWNGTGAHTNFSTKGMRVPGGMKVIEEAVEKLSKTHIEHITQYGIGNEARLTGKHETCDINTFKHGVADRGSSIRIPLPVMLKGYGYLEDRRPAANVDPYTVARLLIKTVLKG

SEQ ID NO: 21159 - DNA, 1376 bp, Daucus carota (carrot)
  CDS (84)..(1142)
ggtctctgcattccacaccatctatcatcaaacatcactccatataatcttcttcactacccttctctgtttcaccaataaccatggcttcacttacagatctcatcaatcttgacctttctgacaccactgacaagttcattgctgagtacatctggattgatgctgttggtggcctcaggagcaaagctagaaccctttctggtccggttgatgatcccaccaagctcccaaaatggaattttgatggatcaagtactggtcaaggaccaggggatgatagtgaagtgatcatatatccccaagcaatatttaaggatccattcagaaggggtaaccacatattggtcatgtgtgatacctacacaccagctggtgagccaattcctacaaacaagagatgtaatgcggctaagattttcagccaccctgatgttgcagctgaagttccttggttcggtattgagcaagaatacaccctattgaagaaagaggtcaactgccctattgggtgtcccactggaggatatccaggaccacaggggccttactactgtggtattggtgctgataaagcctttggacgggacattgttgatgctcattacaaagcatgtctgtatgctggtattaacataagtggcataaatggggaggttatgcctggacaatgggaattccaagtgggaccagctgttggtatctcagcaggtgatgaactgtgggtggcccgttacattcttgagaggataactgaaattgctggggtggttgtttcattggatcctaagcctatccctggtgattggaatggtgcaggtgcccacacgaattacagcaccaagtccatgagaaatgagggaggatttgagatcatcaagaaggctattgccaaacttgagactaagcatgcacaacacattgctgcatatggtgaaggcaacgaacgtcgtctcactggaaagcacgagactgccagtattcacaagttctcatggggtgttgcaaaccgtggagcatcagtccgggtgggtagagacactgaaaaagaaggcaagggttactttgaggaccgtaggcctgcttccaacatggaaccatatgtcgtcacttccatgatcgcagaaacaacaattctgtgaagccttgagggagaatttgctgcagatactttgcggtgaaagagtaccatgattgtgttccataccaacccttctagatttctattagaattagctcgtctggtcatcatttgttgttactggatttgcctttatattcctggtatttacggcatgagcaatgctcagttactttattttcaaaaactagttgcaatatgaaagggtttggtatctattaagcatttctcatgt

SEQ ID NO: 21160 - protein, 352 aa, Daucus carota (carrot)
MASLTDLINLDLSDTTDKFIAEYIWIDAVGGLRSKARTLSGPVDDPTKLPKWNFDGSSTGQGPGDDSEVIIYPQAIFKDPFRRGNHILVMCDTYTPAGEPIPTNKRCNAAKIFSHPDVAAEVPWFGIEQEYTLLKKEVNCPIGCPTGGYPGPQGPYYCGIGADKAFGRDIVDAHYKACLYAGINISGINGEVMPGQWEFQVGPAVGISAGDELWVARYILERITEIAGVVVSLDPKPIPGDWNGAGAHTNYSTKSMRNEGGFEIIKKAIAKLETKHAQHIAAYGEGNERRLTGKHETASIHKFSWGVANRGASVRVGRDTEKEGKGYFEDRRPASNMEPYVVTSMIAETTIL

SEQ ID NO: 21161 - DNA, 1537 bp, Daucus carota (carrot)
  CDS (17)..(1315)
ccattctaaggtgaggatggctcagatcttagctccgtcagtgcaatggcaaatgagattcacaaaaaattctaccgaagtaagttcaatgacatcaaagatgtggggttctctattcctgaaacaaaacaagaaagcaccagctagaagttctaccaaatatagagcattagcagtgaagtctgaggatggcaccataaataggatggaagatctactaaatttggatgtaactccatacaccgataagatcatagccgagtatatatggataggaggaactggcattgatgtccgaagcaaatcaaggacaatctcaaagccagttgagcacccgtctgagctaccaaaatggaactatgatggatcaagtactgggcaagcacctggagatgatagtgaagtaattttataccctcaagcaattttcaaggaccctttccgtggtggtaacaacatcctcgtcatatgcgatacctacacgccacaaggagagcctattcctacaaataaacgccacaaggctgctcaaatatttagtgatgcgaaggttttaggtgaagttccatggtttggaatagagcaagagtacaccttgatgcaacaggatgtaaactggcctttgggatggaatgttggaggctatcctggtcctcagggtccatattactgtgctgctggagcggataagtcatttggcagagacatatctgacgctcattataaggcttgcttatatgccggaattaatattagtggcacaaatggagaagttatgcctggccagtgggaatttcaagtgggtcccagtgtcggtattgaagctggcgatcacatctggtgtgccagatacctcctggagagaattactgagcaagctggggtcgttctcacacttgacccgaaaccaattgatggtgactggaatggagcaggctgccacaccaactacagtacaaaaagtatgagagaggagggaggctttgaagtaattaagaaagcaatcttaaacctttcacttcgccacaaagagcacatcagtgcatatggagaaggaaatgaaagaagattgacaggaaagcatgaaactgcgagcattgacagcttttcttggggagttgctgaccgtggttgctcaatccgtgtggggcgtgatactgagaaggaaggcaaaggttacttggaggatcggcgccctgcttcaaacatggacccatatgttgtgactggtttacttgctgaaactacattactgtgggagccaacacttgaagctgaagctcttgctgcacagaaactatctttgaatgtctagattcagttcaagataaatttacattttccacaaaattcattgtcgtcagttgaaccgcctcctgctttctttggatcattagttgataatttctgtaaataaagggagccccagtggttaacctttccttctattatgaaagacattcttggaggtcattaggtgttcaaaagaataattatgatgattttgagaatactctacccggaagcaattgtcatc

SEQ ID NO: 21162 - protein, 432 aa, Daucus carota (carrot)
MAQILAPSVQWQMRFTKNSTEVSSMTSKMWGSLFLKQNKKAPARSSTKYRALAVKSEDGTINRMEDLLNLDVTPYTDKIIAEYIWIGGTGIDVRSKSRTISKPVEHPSELPKWNYDGSSTGQAPGDDSEVILYPQAIFKDPFRGGNNILVICDTYTPQGEPIPTNKRHKAAQIFSDAKVLGEVPWFGIEQEYTLMQQDVNWPLGWNVGGYPGPQGPYYCAAGADKSFGRDISDAHYKACLYAGINISGTNGEVMPGQWEFQVGPSVGIEAGDHIWCARYLLERITEQAGVVLTLDPKPIDGDWNGAGCHTNYSTKSMREEGGFEVIKKAILNLSLRHKEHISAYGEGNERRLTGKHETASIDSFSWGVADRGCSIRVGRDTEKEGKGYLEDRRPASNMDPYVVTGLLAETTLLWEPTLEAEALAAQKLSLNV

SEQ ID NO: 21163 - DNA, 1167 bp, Caenorhabditis elegans
  CDS (10)..(1167)
atgtcgcaaatggctcaatcactccgcagtcaattcgccaccgacaagcaggtcctgcaaaagttcctgaacttggaccaaaagggcatgtaccaggccctctacatttggattgacggatccggcgagaacattcgtgccaagaccagaaccttcgattttgagccaactgacccagagaagctcccaatttggaactttgacggatcatccaccggtcaagccgagggagccgactccgacgtctacctgaagccagtcgccatctacccagacccatttaggcagggaaagaacaagttggtgatgtgcgagacctatgacaacaagaagaagccaaccgccaccaactaccgccagcgatgcaaggaggtgatggagaaggccgccgaccagcacccatggttcggaatggagcaggagtacacccttctcgacattgacggacatccattcggatggccaaagaacggattcccaggaccacaaggaccatactactgtggcgtcggcgccaacaaggtctacggtcgcgacatcgtcgaggctcactaccgcgcatgcctctacgccggaatccagatctcgggaaccaacgccgaagtgatgcccggacaatgggagttccaggtcgggccatgcgaaggaatccagatgggagatcagttgtgggtggctcgctacttgctgcaacgtgtcgccgaggagtttggcgtgatcgcctcgttcgattgtaagccgatcaagggagactggaacggagccggatgtcacaccaacttctccactgataagatgagaaatccaggaggaattgacgagatcatgtccgccatcaacaagctctcccttgtccacccacaacacattgcctactacgatccacacggtggaaaagacaacgagcgtcgtttgaccggactccacgagaccgcatcgatcgacaagttctcctacggagtcgcatcccgtgcctcatccattcgtattccacgctccaccgacgatgatggatacggatacttcgaagatcgccgtccatcatccaactgtgacccgtacaccgtcaccggagccctcgtcagaactgtgtgtcttgagggagccgagcgtaaactgtcgatgatgtatgttccaagccaggcaccaaatattaccaagcattag

SEQ ID NO: 21164 - protein, 385 aa, Caenorhabditis elegans
MAQSLRSQFATDKQVLQKFLNLDQKGMYQALYIWIDGSGENIRAKTRTFDFEPTDPEKLPIWNFDGSSTGQAEGADSDVYLKPVAIYPDPFRQGKNKLVMCETYDNKKKPTATNYRQRCKEVMEKAADQHPWFGMEQEYTLLDIDGHPFGWPKNGFPGPQGPYYCGVGANKVYGRDIVEAHYRACLYAGIQISGTNAEVMPGQWEFQVGPCEGIQMGDQLWVARYLLQRVAEEFGVIASFDCKPIKGDWNGAGCHTNFSTDKMRNPGGIDEIMSAINKLSLVHPQHIAYYDPHGGKDNERRLTGLHETASIDKFSYGVASRASSIRIPRSTDDDGYGYFEDRRPSSNCDPYTVTGALVRTVCLEGAERKLSMMYVPSQAPNITKH

SEQ ID NO: 21165 - DNA, 1080 bp, Schizosaccharomyces pombe
  CDS (1)..(1080)
atgtctcaatacgacgttgaacctcttctctccaaggctgctattttaaacaagtatgccgatcttcctcaaaatggtaaggttatggctgagtacatctggatcgatggtttcaaccatcttcgtagcaagaccatgactctcgatgccaagccttcctctattgaccaattgcgcgtttggaactttgacggctcttccaccggtcaggcccccggcaacaattctgacactcttttgaagcctgttgccatgtacaatgatcccttccgtcgcggtgacaacattctcgttctcgctgcttgctacaccgctgatggctctcccaacggcttcaaccatcgtgacgcttgcgccaagttgttggagaagcacgctgacaaagaaacttggtttggtattgaacaagaatataccatgttggactactatgaccgtccctttggctggcctaagggtggtttccctggtcctcaaggtcctttctactgcggtgttggtactggccgcgtctttgctcgtgacatcgttgaggcccattacaaggcttgtctttacgctggtatcaacatttccggtatcaatgctgaggttatgccttcccaatgggaataccaagtcggcccttgcgctggtattgaaatgggtgaccaactctggatgtctcgtttccttcttcaccgcattgccgaagattttggtgtcaaaatctccttccaccccaagccaattttgggtgactggaatggtgctggttgccacactaacgtttctactaaggacactcgtgctgaaggtggtataaaagctattgagtcttatctcgagaagtttgccaaacgccataaggagcacattgctgtttatggtgacgacaacgacttgcgtcttaccggtcgtcatgaaactggttcaatcgataagttcacttatggtgttgccgatcgtggtgcatccgttcgtatcccccgttctgtcgccatgaatggttgcggctactttgaggatcgtcgtcctgcttcttccatcgatccttacctcgtcactggtatcatcactgagaccatgtttgagcattag

SEQ ID NO: 21166 - protein, 359 aa, Schizosaccharomyces pombe
MSQYDVEPLLSKAAILNKYADLPQNGKVMAEYIWIDGFNHLRSKTMTLDAKPSSIDQLRVWNFDGSSTGQAPGNNSDTLLKPVAMYNDPFRRGDNILVLAACYTADGSPNGFNHRDACAKLLEKHADKETWFGIEQEYTMLDYYDRPFGWPKGGFPGPQGPFYCGVGTGRVFARDIVEAHYKACLYAGINISGINAEVMPSQWEYQVGPCAGIEMGDQLWMSRFLLHRIAEDFGVKISFHPKPILGDWNGAGCHTNVSTKDTRAEGGIKAIESYLEKFAKRHKEHIAVYGDDNDLRLTGRHETGSIDKFTYGVADRGASVRIPRSVAMNGCGYFEDRRPASSIDPYLVTGIITETMFEH

SEQ ID NO: 21167 - DNA, 1597 bp, Brassica napus
  CDS (97)..(1383)
gtcaactctttctttgccatttgttgcaaacactcaagtctcttgaatcagagttaagtcttctttaagttcccagggatccaagctttaaacaaaatggcgcaaatcttggcagcttctccaacatgtcaaatgaaattgactaaaccgagccccattgcatcttcaaagttatggagctcggttatgttgaaacagaagaaacagaacagcagcaaactcagaagctttaaagcgatggctctccaatctgataacagtacaatcaatagagttgagagtcttctcaatttagacaccaaacctttcactgaccgcatcatcgctgagtacatttggattggaggatcaggaattgaccttaggagcaagtcaaggactcttgaaaagcctgtggaagatccttctgagcttcccaagtggaattatgatggttctagcaccggacaagcacctggtgaagatagtgaagtgattttatatccgcaagctatcttcagagatcctttccgtggaggcaataacatattggttatttgtgatacctacacaccagctggtgagccaattccaacaaacaaacgtgcccgagctgctgagattttcagcaacaagaaggtcaatgaagagattccatggtttggcattgaacaagagtacactttacttcagccaaacgtaaactggcctttgggttggcccgttggagcgtatcctggtcctcagggtccttactactgtggagttggagctgaaaagtcatggggacgtgacatttcagatgctcattacaaagcttgtttatatgcgggaattaacatcagtggtactaatggcgaagttatgccaggacagtgggaattccaagttggcccgagtgtaggaatcgaagcaggtgatcatgtttggtgtgcaagataccttcttgagagaatcacagaacaagctggtgttgtcttaacacttgatcccaaacccatagagggtgactggaacggtgctggttgccataccaattacagtactaaaagcatgagagaggaaggaggatttgatgtgattaaaaaggacatcttgaacctctcgcttcgtcacatggagcacatcagtgcatacggtgaaggcaatgagagaaggttgaccggaaagcacgagacagctagtatcgaccaattctcatggggcgtggctaaccgtggatgctcaattcgtgtgggacgtgataccgagaagaaaggaaaaggttacttggaagatcgacgtccagcatcaaacatggacccatacattgtgacttcactcttggcagagaccacacttctctgggagccgacccttgaggctgaagcacttgcagctcaaaagctttctttgaaggtttaagttaattaaaccaaagctatcataaatctttgaagttaatgtttatctaagtagtcttgccgggataataaatgttatttaaaatgttggttcggataagacattcttgttgtaaacttaaggattacaatccgtaacttcttatcattaattaaaacatatggtgtcttaggaactaattaaaaaaaaaaaaaaaaaaaaaaaaaaaaaaaaa

SEQ ID NO: 21168 - protein, 428 aa, Brassica napus
MAQILAASPTCQMKLTKPSPIASSKLWSSVMLKQKKQNSSKLRSFKAMALQSDNSTINRVESLLNLDTKPFTDRIIAEYIWIGGSGIDLRSKSRTLEKPVEDPSELPKWNYDGSSTGQAPGEDSEVILYPQAIFRDPFRGGNNILVICDTYTPAGEPIPTNKRARAAEIFSNKKVNEEIPWFGIEQEYTLLQPNVNWPLGWPVGAYPGPQGPYYCGVGAEKSWGRDISDAHYKACLYAGINISGTNGEVMPGQWEFQVGPSVGIEAGDHVWCARYLLERITEQAGVVLTLDPKPIEGDWNGAGCHTNYSTKSMREEGGFDVIKKDILNLSLRHMEHISAYGEGNERRLTGKHETASIDQFSWGVANRGCSIRVGRDTEKKGKGYLEDRRPASNMDPYIVTSLLAETTLLWEPTLEAEALAAQKLSLKV

SEQ ID NO: 21169 - DNA, 1425 bp, Medicago truncatula
  CDS (73)..(1143)
cctctatagctatttgtctattacttgcttttcacacactgtgttcttcttcttccttcactattcatcatcatgtctttgctttcagatctcatcaacctcaatctctcagaatcctctgaaaagattattgctgaatacatatgggttggtggatctggtatggaccttagaagcaaagccaggactctacctggtccagtgagtgacccttcaaaacttcctaaatggaactatgatggatcaagcacaaatcaagctccaggacaagatagtgaagttatcttatatccacaagctattttcaaggatccatttagacaaggcaacaatattcttgtgatttgtgatgtttacaccccagctggtgagccactcccaacaaacaagaggtacaatgctgccaaaattttcagccaccctgatgttgctgctgaggtaccatggtatggaattgagcaagaatatacattattgcagaaagatactaattggccactaggatggcctattggtggctatccaggaccacaaggcccatattattgtgggattggtgctgataaagcctatggtcgtgacattgttgatgcacattacaaagcttgtctttatgctggcattaacattagtggcatcaatggagaggttatgcctggtcagtgggagttccaagttggcccttctgttggtatttctgctggagatgagatatgggctgctcgttacattctagagaggatcacagagatagctggagtggttgtttcatttgaccctaagccaattccgggtgattggaatggagctggtgctcacacaaactatagcaccaagtcaatgagagagaatggaggctatgaaatcatcaagaaggccattgaaaagcttggattgaggcataaggaacacattgctgcctatggagaaggaaatgagagacgtctcactggaaaacatgaaacagcagacatcaacaccttttcttggggtgtggcaaaccgtggtgcatctgttagggttggaagagacacagaaaaagatggcaaaggttactttgaggatagaaggccttcttctaatatggatccctatgtggttacttccatgattgctgaaactacccttctatggaaaccatgaagtcacaaccacttgtctttggatttggaccacatcacattatgtgttcaataaatagactagtttatatctattatcattatcattatgcaaagtgttgcttcattagtagtaattgtccaagtggtctttaagcacaaagcatttagtccatgtatttggatgaaaataattttatcattaataacatggttgcttcttgattttactctaataatttcatggatcaataatgcaatgtttgttgctctttcttggattcaaaaaaaaaaaaaaaaaaaa

SEQ ID NO: 21170 - protein, 356 aa, Medicago truncatula
MSLLSDLINLNLSESSEKIIAEYIWVGGSGMDLRSKARTLPGPVSDPSKLPKWNYDGSSTNQAPGQDSEVILYPQAIFKDPFRQGNNILVICDVYTPAGEPLPTNKRYNAAKIFSHPDVAAEVPWYGIEQEYTLLQKDTNWPLGWPIGGYPGPQGPYYCGIGADKAYGRDIVDAHYKACLYAGINISGINGEVMPGQWEFQVGPSVGISAGDEIWAARYILERITEIAGVVVSFDPKPIPGDWNGAGAHTNYSTKSMRENGGYEIIKKAIEKLGLRHKEHIAAYGEGNERRLTGKHETADINTFSWGVANRGASVRVGRDTEKDGKGYFEDRRPSSNMDPYVVTSMIAETTLLWKP

SEQ ID NO: 21171 - DNA, 1488 bp, Medicago truncatula
  CDS (145)..(1215)
aaataaagacccaactctgcctcatttctctctctattcacaatatttccgttttgattttcatttgattcattcattgaatcaaatcgaatctttaggattcaatacagattccttcgattttactaagtttgaaaccaaaacatgtctctcctttcagatctcatcaaccttgacctctccgaaaccaccgagaaaatcatcgccgaatacatatggattggtggatctggtttggacttgaggagcaaagcaaggactctaccaggaccagttactgacccttcacagcttcccaagtggaactatgatggttccagcacaggtcaagctcctggagaagatagtgaagttattatatacccacaagccattttcaaggatccattcagaaggggtaacaatatctttgttatgtgtgatgcatacactccagctggagaacccattcccaccaacaagagacacgcagctgccaaggttttcagccatcctgatgttgttgctgaagtaccatggtatggtattgaacaagaatacaccttgttgcagaaagacatcaactggcctcttggttggccagttggtggttttcctggacctcagggaccatactattgtggtgctggtgctgacaaggcatttggccgtgacattgttgactcacattacaaagcctgtctttatgccggcatcaacatcagtggaatcaatggtgaagtgatgcctggtcaatgggaattccaagttggtccctcagttggcatctctgctggtgatgaaatttgggttgctcgttacattttggagaggatcactgagattgctgatgtggtgctttcctttgacccaaaaccaattaagggtgattggaatggtgctggtgctcacacaaattacagcaccaagtctatgagagaagatggtggctatgaagtcatcttgaaagcaattgagaagcttgggaagaagcacaaggagcacattgctgcttatggagaaggcaacgagcgtaggttgacagggcgacatgagacggctgacattaacaccttcttatggggtgttgcaaaccgtggtgcgtcgattagagttggaagggacacagagaaagcaggaaaaggttatttcgaggacaggaggccatcatctaacatggatccatatgttgttacttccatgattgcagacaccaccattctctggaaaccataagccaccacgctacttctgctataaaacacacacatgcattgtagtctttcaaagtcattgttgattccgcattagaatttggtcattggtttttctaggatttgatttgtgttattgttatggttcacactttgtttgtttggatctgagtccttgttatggtttcatatttctttttcttgttctaagtaaatgtctgaataataatgtaatgattatcggtaaaataattattgttgattatgattattgataaaaaaaaaaaaaaaaaaa

SEQ ID NO: 21172 - protein, 356 aa, Medicago truncatula
MSLLSDLINLDLSETTEKIIAEYIWIGGSGLDLRSKARTLPGPVTDPSQLPKWNYDGSSTGQAPGEDSEVIIYPQAIFKDPFRRGNNIFVMCDAYTPAGEPIPTNKRHAAAKVFSHPDVVAEVPWYGIEQEYTLLQKDINWPLGWPVGGFPGPQGPYYCGAGADKAFGRDIVDSHYKACLYAGINISGINGEVMPGQWEFQVGPSVGISAGDEIWVARYILERITEIADVVLSFDPKPIKGDWNGAGAHTNYSTKSMREDGGYEVILKAIEKLGKKHKEHIAAYGEGNERRLTGRHETADINTFLWGVANRGASIRVGRDTEKAGKGYFEDRRPSSNMDPYVVTSMIADTTILWKP

SEQ ID NO: 21173 - DNA, 1495 bp, Hevea brasiliensis
  CDS (114)..(1184)
actcggtactccaaaaagctttcacgccctccccccagctagacacctctgcatacagaggcaggaagaagaggaagaagaagagaagagttgccaattattactgtgtggacatgtcgcttctctcagatctcatcaaccttaacctctcagacaccactgacaagatcattgccgagtacatatggatcggcggatctggcatggacatgaggagcaaagcaaggactctttctggtcctgttagtgatccttcaaagctccccaagtggaactatgatggttccagcacaggacaggctcctggagaagacagcgaagtcatcctatatccccaggctattttcaaggatccatttaggaggggcaacaatatacttgtgatgtgtgatgcttacacccctgctggtgagccaattccaacaaacaagagacacgctgctgctaagatcttcagccatccagatgttgttgctgaagagccctggtacggcattgagcaagaatacaccttgctgcagagagatgttaaatggcctattgggtggcctcttggtggttaccctggtcctcaggggccatactactgtagtattggtgctgacaaatcctttgggcgagacgttgttgattcacactacaagtcctgtctatatgctggcatcaacattagtggtattaatggagaagtcatgccaggccagtgggaatttcaagtgggacctgcagttggaatctctgctggagatgaattatgggttgcgcgctacattttggagaggattacagagattgctggagttgtcctttcttttgatcccaagccaattcagggtgactggaatggtgctggagctcacacaaactatagtacaaagtcaatgaggcatgatgggggctatgaggtcatcaagaaagcaattgagaagttggggctgaggcacaaagaacacattgctgcatatggtgaaggcaatgaacgcagactgactggacgacatgaaacggctgacatcaacactttcttatggggcgttgctaaccgtggagcatcgattcgcgttggccgagacacagagaagcaaggaaagggatatttcgaggacaggaggcctgcatcaaacatggatccatatgttgtgacttctatgattgcagaaaccacaatcctgtggaaaccataagcaagttgatgctcccaaccactaaaaatttgaaacattgttgtttttagcctgtgtctgtgggagtgtagaaagaactgtgtttcagtgggaacttgttctccatgtggtttcaacttcctctttgattccaaattttcctgctgtttcgccagttcgcccttgtgtgggaggtgtggcaaggttgggttattgcttccttgcatatgcagtcattctctgttatgcattttaataatataaaacgctttaatacaataacattattattgggcagatttttctaaaaaaaaaaaaaaaaaaaaaaaaaa

SEQ ID NO: 21174 - protein, 356 aa, Hevea brasiliensis
MSLLSDLINLNLSDTTDKIIAEYIWIGGSGMDMRSKARTLSGPVSDPSKLPKWNYDGSSTGQAPGEDSEVILYPQAIFKDPFRRGNNILVMCDAYTPAGEPIPTNKRHAAAKIFSHPDVVAEEPWYGIEQEYTLLQRDVKWPIGWPLGGYPGPQGPYYCSIGADKSFGRDVVDSHYKSCLYAGINISGINGEVMPGQWEFQVGPAVGISAGDELWVARYILERITEIAGVVLSFDPKPIQGDWNGAGAHTNYSTKSMRHDGGYEVIKKAIEKLGLRHKEHIAAYGEGNERRLTGRHETADINTFLWGVANRGASIRVGRDTEKQGKGYFEDRRPASNMDPYVVTSMIAETTILWKP

SEQ ID NO: 21175 - DNA, 2160 bp, Helicobacter pylori
  CDS (573)..(2018)
cttgatcaacttgcacccatgtggatgcaagagcggtttcctacctttcattgaaatctaggctaggaaagttaagatttaaagcaggaagaacacttcccaaaatattctctagatgctgtatctttttaccttgttcgcgatttagagaaagtgaataataaagtgcttcattaagtcccttgttttcatctttaagtctttcattctgatctaaggtctgcttaagaccgccattcaaatatgcggcttcagcattatacagagccgcaccttttaaaggttttccgtacctatcgcagaaaactccatttataagtaagaagttttgtttcataatttttccttaaatttaaaataacaccccatttctaggtagagatagggcggcaattatacttataactagcaaacgaataataccacaataaaagaaacaaaatgccaaaattaaaaaaggtgggttttagtctctataaaatttagagcatcaattctactttttttaccccataaaatgctataatcacccctatcaatcaaactcaattcataacaattaaaggtggttaatgatagtaagaactcaaaatagtgaaagcaagatcaaagaattttttgaattttgcaaagaaaatgaagtggaatttgtggattttagattcagcgatattaaaggcacttggaatcacatcgcttattcttttggggctttaacgcatggcatgtttaaagaggggattccttttgatgcgagttgttttaagggctggcaaggcattgaacactccgatatgattttaacccccgatttggtgcgttatttcattgatccttttagcgcagatgtgagcgtggtcgtgttttgcgatgtgtatgatgtgtataaaaaccagccttatgaaaaatgccccagaagtatcgctaaaaaagccttacagcatttaaaagattcaggtttgggcgatgtggcttattttggtgcggagagcgaatttttcatctttgattccattaaaattaaagacgcttccaattcccaatactacgaagtggatagcgaagaaggcgaatggaatcgggataggagctttgaaaatggcgtgaattttgggcatagaccgggcaagcaagggggctatatgcctgtgccgccaacggatacgatgatggatattcgcactgaaattgtgaaagtcttaaaccaagtggggttagaaacttttgtcgcccatcatgaagtcgcgcaagcgcaaggcgaagtgggcgtgaaatttggggatttagtggaagccgctgacaatgtccaaaaactcaaatatgtggttaaaatggtcgctcatttaaacggcaaaaccgccactttcatgccaaaacctttatacggggataacgggagcgggatgcacacccatgtgagcgtttggaaaaacaacgaaaacctttttagcggcgaaacttataagggcttgagtgggttagcgttgcattttttagggggtgtgttgcgtcacgctagagggttagccgctttcactaacgcttccactaattcttacaaacgcctaattccaggctatgaagccccatctattttaacttattcagctaacaacaggagcgctagcgtgcgtatcccttatgggatttctaaaaatagcgcgaggtttgaattcaggtttcctgacagctcatcaaacccctacctggcttttggggctattttaatggcgggcattgatggcattaaaaataaaatggatcccggcgaagcgatggacattaaccttttcaagctaactttagacgaaattatagaacagggtatcatacaaatgccccacactttaaggagatcattagaagaaatgctagccgataagcagtatctaaaacagggtcaggtctttagcgaacaatttatccacgcctatcagtctcttaaattccattctgaagtgttcccatgggagagcaaaccccatccttttgaatttatcaccacttattcatgctaaaacaatgagtgggttcataaatcccactctaaaaatctagaataaggcaaaaataccttatttttaaaaagagtggttgaaagaattgattttctttgtttgttggttttattttaatagggtattgatcataaaatttaaa

SEQ ID NO: 21176 - protein, 481 aa, Helicobacter pylori
MIVRTQNSESKIKEFFEFCKENEVEFVDFRFSDIKGTWNHIAYSFGALTHGMFKEGIPFDASCFKGWQGIEHSDMILTPDLVRYFIDPFSADVSVVVFCDVYDVYKNQPYEKCPRSIAKKALQHLKDSGLGDVAYFGAESEFFIFDSIKIKDASNSQYYEVDSEEGEWNRDRSFENGVNFGHRPGKQGGYMPVPPTDTMMDIRTEIVKVLNQVGLETFVAHHEVAQAQGEVGVKFGDLVEAADNVQKLKYVVKMVAHLNGKTATFMPKPLYGDNGSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIIEQGIIQMPHTLRRSLEEMLADKQYLKQGQVFSEQFIHAYQSLKFHSEVFPWESKPHPFEFITTYSC

SEQ ID NO: 21177 - DNA, 1203 bp, Aedes aegypti
  CDS (1)..(1203)
atggcattcagagtggtgggattattgattcgccaggaactgtcctcccttggcagtgcatcgacaacgcgcatgatcagcaccagtgcgacacgatctgcacgtattctgcaagagtcacccaatgcttacatgaacaaaacgctgttggatcggtatcacaagctcaagtacgatccaaagtacgttcaagcaacctatgtgtggatcgatggcacgggtgaaaacgttcgtttgaaggatcgtgtgctcgattacgtaccgaaaaaaccggaagacgtgccaaactggcagtacgacggcagctcaacctatcaagctctgggtggtaactctgacatcaagttggttccccgtgctttgtacaaggatccattcaagccaggaccaaatgatttgattgtgctgtgcgacacgtaccaaccagacggaaagccaaccgaatctaacaaacgtgctttaatgcaggatgcctacaacaagtccaaagattacgaaccatggttcggaatcgagcaggaatacacgttcctagacatcgatggaaggcctttgggttggccaacggctggattcccaggaccccaggggccatactactgcgctactggtgcacagaacgtcgtcggtcgcgacatcgccgaagctcacgctctggcttgcctctatgctggagttgattttgccggaaccaatgccgaagtcatgccagctcagtgggaattccaagttggaccaaatcttggaatgaagtgcgctgacgatatctggcttgctcgttacctgctgtggcgtatcgctgaggactacggtgttgtcgtcacgttcgaccccaaaccaatggaaggaaactggaatggtgctggaggccattgcaacttctccaccaagcagatgcgagcagaaaatggtatcgaggccatcaaggcagctattgagaaactgtccaagcagcatgccaagcatatcaaggcctacgatccacgaggaggaaaggacaacgaacgtcgcctggttggccgtctcgagacttcgtccatcgacaaattcagttggggtgttgccgaccgtagcaccagtgttcgcattccacgaggcgttgccgatgccaacaagggctacctcgaggacagacgtccaagctcaaactgtgatccgcacagcgtttgccatgctatccttgaaacttgcctcgtcgagtaa

SEQ ID NO: 21178 - protein, 400 aa, Aedes aegypti
MAFRVVGLLIRQELSSLGSASTTRMISTSATRSARILQESPNAYMNKTLLDRYHKLKYDPKYVQATYVWIDGTGENVRLKDRVLDYVPKKPEDVPNWQYDGSSTYQALGGNSDIKLVPRALYKDPFKPGPNDLIVLCDTYQPDGKPTESNKRALMQDAYNKSKDYEPWFGIEQEYTFLDIDGRPLGWPTAGFPGPQGPYYCATGAQNVVGRDIAEAHALACLYAGVDFAGTNAEVMPAQWEFQVGPNLGMKCADDIWLARYLLWRIAEDYGVVVTFDPKPMEGNWNGAGGHCNFSTKQMRAENGIEAIKAAIEKLSKQHAKHIKAYDPRGGKDNERRLVGRLETSSIDKFSWGVADRSTSVRIPRGVADANKGYLEDRRPSSNCDPHSVCHAILETCLVE

SEQ ID NO: 21179 - DNA, 1518 bp, Skeletonema costatum
  CDS (40)..(1272): n means a or g or c or t/u, s means g or c
gtaaatccattttttccttcctctactcaataaacaaccatgaagctcgctgttaccttcctcgctaccatcggtcctaccgggcggttcgcccctgcggccaacactgttgcccgcacctcggccctcaacatggtccaacagcttgacctcaaaaccggtcaatctcaacttgacacctccgttgttgaccgtttcagcgctcttccctaccccgacgacaaggtcctcgccgaatacgtttgggttgatgccaagggagagtgccgttccaagacacgtactcttcccgttgcccgtaccgaggccgtagacaagctcccgaactggaacttcgacggatcatctaccgaccaagctcccggagatgattcggaggttatcttgaggccatgccgtattttcaaggatcccttccgccctcgtgctcatggattagataacaacttggttatgtgtgatacttatactcctgctggagaggctatccctaccaacactcgtgctattgccgccaaggccttcgaaggcaaggaagacgaagaagtctggttcggacttgagcaagaattcacccctcttcaacctcgaccaacgcactcccctcggctggcccaagaaccggtgtcccaaccgcgctcaggaccctactactcgtccgccggtcccgagaacagcttcggacgtgccgtcaccgatgccatgtaccgctgctgcctttacgctggacttgaaatcagtggaaccaacggtgaggtcatgcccggacaacaggaataccagattggaccatgcgtcggaattgatgccggtgatcagcttttcatgagtcgttacatccttcagcgtgtgtgcgaagagttccaggtttactgcactcttcaccccaaacccatcaccgacgaagactggaacggtgctggtatgcacaccaatgattctaccaaatccatgcgtgaggccggtggacttgacattattaagcaggcaatttacaagttgggtgccaagcacaaagagcacattgccatttacggagagggcaatgagcttcgtttgactggaaagttcgagactgctagcatggacgagttctctttcggagttgccaaccgtggtgccagtgtgcgtattggacgtgataccgaggctgaggagatgctgggttacttcgaggacagaaagccccagtttccaaacgctgatccttaccttgttactggaaaaagatcatggctacccatcatcatggaggatattgaagtttcctgagattgctcctcttgtccgcgcgccgaggcttaagcaaaaagaaagtatattgcacctctgaattctgaaggattttctctgagaccancttcccattgaggagagagagagaagatgaaagaggagacagaacactagctaagaggaaatgaaagtctcgtttagttctgagctcttgggtttttcatttatctgagtataccttaacatataaaaagaagttatttgcaaaaaaaaaaaaaaaaa

SEQ ID NO: 21180 - protein, 410 aa, Skeletonema costatum
MKLAVTFLATIGPTGRFAPAANTVARTSALNMVQQLDLKTGQSQLDTSVVDRFSALPYPDDKVLAEYVWVDAKGECRSKTRTLPVARTEAVDKLPNWNFDGSSTDQAPGDDSEVILRPCRIFKDPFRPRAHGLDNNLVMCDTYTPAGEAIPTNTRAIAAKAFEGKEDEEVWFGLEQEFTPLQPRPTHSPRLAQEPVSQPRSGPYYSSAGPENSFGRAVTDAMYRCCLYAGLEISGTNGEVMPGQQEYQIGPCVGIDAGDQLFMSRYILQRVCEEFQVYCTLHPKPITDEDWNGAGMHTNDSTKSMREAGGLDIIKQAIYKLGAKHKEHIAIYGEGNELRLTGKFETASMDEFSFGVANRGASVRIGRDTEAEEMLGYFEDRKPQFPNADPYLVTGKRSWLPIIMEDIEVS

SEQ ID NO: 21181 - DNA, 2193 bp, Drosophila melanogaster
  CDS (184)..(1383)
acaagacttccaaacatcgaattggtcgggtgtccccaacagtcgctccgcagcccctgacagaaacagaaacgaaaaccgaaagtaccgcaatccaaaattaccaaaagacctgtccaaccagcgactgtttaaccaatcatataactgtaaagtggaaaaacgagcagagcacgaaccaagatgcgactacgcgtggcaggactcttcctgaagaaggagctggtggctcccgcaacacagcagctgcgtctgctgcgtactggcaataccacccgctcccagttcttggccaactcccccaacacggctctagacaagagcattctgcagaggtaccgcaacctggaaacgccggccaatcgagtgcaggctacttacttatggatcgacggtaccggcgagaacattcgcctcaaggatcgcgttttggacaaagtacccagctccgtggaggacttgccggattggcagtacgacggcagttccacctaccaggcccatggcgagaactcggacaccacgctcaagccacgcgccatatatcgcgatccctttaagccgggaaagaacgacgtaattgtcctgtgcgacacctacagcgccgacggcaagccgacggcgtccaacaagcgtgccgcgttccaggcagccattgacctaattagcgatcaggagccctggttcggcattgagcaagaatacactttattagacgtggacggacgtcccttcggctggccggagaacggtttcccagccccacaaggtccttactactgcggcgtgggagctgaccgtgtgtacgctcgcgatcttgtggaggcccacgtcgtggcctgcctgtatgctgggatcgacttcgccggcaccaatgccgaggtaatgcccgcgcagtgggagttccaaattggtccagccgggattaaggcatgtgacgatttatgggtgtcgcgatatattttgcagcgcatagctgaggagtatggcgtagtggtcacctttgaccccaaaccgatggagggtcagtggaacggagccggcgcgcataccaacttttccacaaaggagatgcgtgctgatggcggaatcaaggccatcgaggaagctatcgagaagctgagcaagcgccacgagcggcacatcaaggcatacgaccccaaggaaggcaaagacaatgaacggcgcctcgtgggacgtcttgagacttctagcatcgataagttttcttggggcgtggccaaccgggccgtaagtgtgcgagtgccgcgtggcgttgcgacggccggcaaaggatacctcgaagaccggcggccaagctccaactgtgatccctacgccgtgtgcaacgccattgttcgcacctgcctgctcaacgagtaggctgtgagcggtgcaacagatgtttaattttttgtacattatgttttatggaactgtgaagcgtatccgatcatttggttatatttacattgaactgaagcaaaatttagtttgcttgtgcaaaaaagacaggagaccgaggcacgaaaagcgtgcgcttagaatttaagaacgtgggtgggtggcaagaagaactaagctaaagcgaaatttccttaaagcgatggggcctcatgaatactttgccatatatctcacaaactacgtatatctatcattgctttaatctaaataataaaaaacattgtactctacgttaattttttgtaccttttagatcaaacaaacattttgggatccgacgttgaattcggtcaacgccattttttgcccttaacttcttgaacgcacttttttaataactcctaagagtttctaaatgtaaatttaagaaggaaatatcactgaaatcggacgatatgcatattaatcattcatatccatgagcacgaatacacatatatgtgaaatatgtttataaaaaccaattgttgattagaagttgttaaaaataaaatactaagaaattaatttatgtatatatattggtacatatgtatctcactttacggatctgtcgcttcactttgttcggtagcattttacatcattttactatatgctgttataatataaatgtctaaatactagcactagcaaaattaaaaattccattgagatacataaatacattttgagtaaaagcagaactgcgtacaaagcaaaacacaaaaaaaaaaaaaaaaaaaa

SEQ ID NO: 21182 - protein, 399 aa, Drosophila melanogaster
MRLRVAGLFLKKELVAPATQQLRLLRTGNTTRSQFLANSPNTALDKSILQRYRNLETPANRVQATYLWIDGTGENIRLKDRVLDKVPSSVEDLPDWQYDGSSTYQAHGENSDTTLKPRAIYRDPFKPGKNDVIVLCDTYSADGKPTASNKRAAFQAAIDLISDQEPWFGIEQEYTLLDVDGRPFGWPENGFPAPQGPYYCGVGADRVYARDLVEAHVVACLYAGIDFAGTNAEVMPAQWEFQIGPAGIKACDDLWVSRYILQRIAEEYGVVVTFDPKPMEGQWNGAGAHTNFSTKEMRADGGIKAIEEAIEKLSKRHERHIKAYDPKEGKDNERRLVGRLETSSIDKFSWGVANRAVSVRVPRGVATAGKGYLEDRRPSSNCDPYAVCNAIVRTCLLNE

SEQ ID NO: 21183 - DNA, 1410 bp, Rhodospirillum rubrum
  CDS (1)..(1410)
atgtccgacgttaagaccattctcgaaatgattaaggaaaacgacgttaagttcgtcgatttccgcttcaccgatcccaagggcaagtggcagcataccgcccagtacgtgaccaccatcgacgaggaaagcctggtcgaaggcatcatgttcgacggttcgtcgatcgccgggtggaaggacatcaacgagtccgacatgatcctgaagcccgacctgaagtcggccttcatggatccgttctcggctcagccgcagctcgtcttgttctgcgacgtgctcgagccctcgaccgggcagccctatgagcgttgcccgcgctcgatcgccaagaaggccctgtcctatctggcctcgaccggcatcggcgacacctcgtacttcggcccggaagccgagttcttcgtgttcgacgacgtgcgcttcgacgtgtcgatgaaccgcgtcatgtacgaagtcgacagcgaagaaggcccctacgtcaccggcaagatcttcgacgagggcaactacggccaccgtccgccgatcaagggcggctatttcccggttccgccggtggacagcgcccaggacctgcgcgccgaaatgctctcgaccatggccgagatcggcatgcccgtcgaaaagcaccaccacgaagtggcgccgtcgcagcatgaactgggtgttcgcttcaacaccctgatcgaagccgccgacgacatgcagaagtacaagtatgtcgttcacatggtcgcccatgcctatggcaagaccgcgaccttcatgcccaagccgatcgccggcgacaacgggtcgggcatgcacgtccatcagtcgatctggaaggatggcaagccgctgttcgccggttcgggctatgccgacctgtcggaaatggccctttactacatcggcggcatcatcaagcatgccaaggcgctgaacgccttcaccaatccgtcgaccaactcgtacaagcgcctgatccccggcttcgaagccccggttctgctggcctattcggcccgcaaccgctcggcctcctgccgtatcccctatgtggcgagcccgaagggcaagcgcgtcgaggttcgtttccccgatgccgccgccaacccctatctggctttcgccgccatgatgatggccggcatcgacgggatcgagaacaagatccatccgggcgacccgatggacaagaacctctacgacctgccccccgaagaactgatgggcatccccacggtttgcggctctctgcgcgaagcgcttgacagcctgaacgccgaccgtgacttcctgaagaagggtggcgtcttcaccgacgacatgatcgatggctatgtcgccctgaagtgggaagaggtttacaacctcgagcatgctccccacccgatcgaatacaagatgtactactcggtctga

SEQ ID NO: 21184 - protein, 469 aa, Rhodospirillum rubrum
MSDVKTILEMIKENDVKFVDFRFTDPKGKWQHTAQYVTTIDEESLVEGIMFDGSSIAGWKDINESDMILKPDLKSAFMDPFSAQPQLVLFCDVLEPSTGQPYERCPRSIAKKALSYLASTGIGDTSYFGPEAEFFVFDDVRFDVSMNRVMYEVDSEEGPYVTGKIFDEGNYGHRPPIKGGYFPVPPVDSAQDLRAEMLSTMAEIGMPVEKHHHEVAPSQHELGVRFNTLIEAADDMQKYKYVVHMVAHAYGKTATFMPKPIAGDNGSGMHVHQSIWKDGKPLFAGSGYADLSEMALYYIGGIIKHAKALNAFTNPSTNSYKRLIPGFEAPVLLAYSARNRSASCRIPYVASPKGKRVEVRFPDAAANPYLAFAAMMMAGIDGIENKIHPGDPMDKNLYDLPPEELMGIPTVCGSLREALDSLNADRDFLKKGGVFTDDMIDGYVALKWEEVYNLEHAPHPIEYKMYYSV

SEQ ID NO: 21185 - DNA, 1889 bp, Xenopus laevis
  CDS (23)..(1117)
caaaaccagtggtacctaaataatggcgttggcaaccaatagtccggctgatagtaaaacgcttctggccaaatactacaatttgccacaaccagaagacaaaattcaggttatgtatgtgtggattgacggaacaggggaaaatcttcgctgcaaaacgatgaccgtggaccgagaaccactcagaccagaggattgtcgtttgtggaactttgacgggagcagtaccggacaggctgagggttcaaactccgatgtgtatttgaaaccgcgcgccatttttagcgatccattccgaggcgggaaaaacaaactcgttctgtgcgaaacattcacttacgacatgaaaccacatgccacaaaccaccgtttccagtgcacagaagtaatggaaaaagccaaagaacatgagccgtggtttggaattgagcaagagtacacactattcgacacagatggttatccactccagtggccgaaaaacggttttccagctccacaaggtccatactattgttcagtcggtgctggtaaagctttgggtcgagacgttctggaggcgcattaccgtgcctgtctctatgctggcgtggaaatttgtggtaccaatgccgaggttatgccttcccaatgggaattccaaatcggaccgtgcgaaggtgtgagtgccggtgatcacctatggatggctcgcttcctactgcaccgtgtggctgaggatttcggtgttgtggtcagttttgatccgaagccgatgcctggtgattggaacggttccggggcgcacacgaacttctcgactaaggcgatgcgacgacctgacacggggttgaaagcgattgaagacgcagtggaaaaactatctcgaaaacacgcggagcacattctcgtctatgatccgaaacaaggaatggacaatcgacgtcgactgaccggtttgcatgagactagcagtattcacggcttctcatccggagtggctaatcgtggtagcagtattcgaattccgcgccaggtggccgaggacggatttggctacttggaggatcgcagaccttcggccaactgtgacccatatcaagtgattcgaatgttggttcaaaccacttgtctgtgaatggggatgcactaacgatcgctgttgcgatttgccatgctcgctgccatgttcggacaatgatagatagagaagagagccagagagtcagagagagagccatcacattgagcaagccattgctaacccttcattcactctttcattcattcccgcatcatgtgactgactgactgactgactcagtgagtcaagctgtgctgttactattccagctcacacactaccccccccatcttgcgtttgtcttctttgtcttctttgttttgattatcatctgcctaaatgtgatattctcaggctacttacttacttcatctcttatcgtctcatacggaaacacgtataaacgtaaaaccatgaaagacacccaatttgccagcttgtttgagtctattgtatcagtgtacccatccatctaccatctaccgtcactactattactactaccaccattgttgtgacccttccatcccgacaacatctttctggtcgtcatactcatgatggactactaacactgtgctgtgaccttgaggcaagctatttatctaaagggataatacgttttcatggttggtgaccacgtacatgttctgtccacacccactgacccttccaccgttcaccctccaaaccgatttcttatttgtttgttgtttttctttgtgagtagtgttttttgtcggtgtctttaaaatcagatgtgacgaaaaaatatatatttgattgctcttaaaaaaaaaaaaaaaaaaaaaaaaaaaaaaaaaaa

SEQ ID NO: 21186 - protein, 364 aa, Xenopus laevis
MALATNSPADSKTLLAKYYNLPQPEDKIQVMYVWIDGTGENLRCKTMTVDREPLRPEDCRLWNFDGSSTGQAEGSNSDVYLKPRAIFSDPFRGGKNKLVLCETFTYDMKPHATNHRFQCTEVMEKAKEHEPWFGIEQEYTLFDTDGYPLQWPKNGFPAPQGPYYCSVGAGKALGRDVLEAHYRACLYAGVEICGTNAEVMPSQWEFQIGPCEGVSAGDHLWMARFLLHRVAEDFGVVVSFDPKPMPGDWNGSGAHTNFSTKAMRRPDTGLKAIEDAVEKLSRKHAEHILVYDPKQGMDNRRRLTGLHETSSIHGFSSGVANRGSSIRIPRQVAEDGFGYLEDRRPSANCDPYQVIRMLVQTTCL

SEQ ID NO: 21187 - DNA, 1523 bp, Nicotiana attenuata
  CDS (51)..(1349)
caacactatttttccagcatagcattaccaacttagttggttaggtgaagatggctcagatcttggctccatctgcacaatggcagatgagaatgacaaagagctcaacagatgctaatcccttgacttcaaagatgtggagttctgtggtattgaagcagaataaaagacttgctgttaaaagctctgccaaatttagagtctttgctctccaatctgatagtggcactgtgaacagagtggaacagctgctaaacttggacgtaactccatacactgacaagatcattgctgaatatatttggatcggaggatctggaattgacatgcgcagtaaatcaaggactatttcaaagccagtcaagcatgcttctgagctcccaaagtggaactacgatggatcaagtactggacaagcacctggagaagacagtgaagtcattctataccctcaggcaatatttaaagaccctttccgtggtggtaacaacatcttggttatctgtgatgcctacacaccagctggagagccaattccaacgaacaaacgccataaagctgctcagatttttagcgactcaaaagttgtatctgaagttccatggttcggaatagaacaagagtacaccttactccaacaaaatgtgaagtggcctttaggttggcctgttggaggctaccccggacctcagggtccttactactgtggtgctggagcggataagtcatttggccgagatatatcagatgctcactacaaggcttgcctgtatgctggaattaacattagtggtaccaatggagaggttatgccggggcagtgggaatttcaagtaggtcctagtgtgggaattgaagctggagatcacatctggtgtgctagatacatccttgagagaattactgaacaagcaggagttgttctgtcacttgatccaaaaccaattgagggtgactggaatggtgccggatgccacactaactacagtacactaagtatgagagaagagggaggctttgaagtaataaagaaagcaattctgaatctctcccttcgccacaaggagcatataagtgcttatggagaaggaaatgagagaaggttgactggaaagcatgaaactgcaagtattgacaaattttcatggggagttgctaaccgtggtgcctcaatccgtgtggggcgtgacactgagaagcaaggcaaaggttatttggaagaccgtcgcccagcttcaaacatggacccctatgttgtgaccggattacttgccgaaaccactattctgtgggagccaacccttgaggctgaagctcttgctgctcaaaagctcgcattgaatgtttagattatttaagggcagaatgatccataataatcttcttagagttcatgagctgctaagtgaagaaacttgtaccttgtttagattcccttttagggaaaatcttgtaaaggaaccacaattatcagttattcctataaaagaggttccttaagacaaaaaaaaaaaaaaaaaaaa

SEQ ID NO: 21188 - protein, 432 aa, Nicotiana attenuata
MAQILAPSAQWQMRMTKSSTDANPLTSKMWSSVVLKQNKRLAVKSSAKFRVFALQSDSGTVNRVEQLLNLDVTPYTDKIIAEYIWIGGSGIDMRSKSRTISKPVKHASELPKWNYDGSSTGQAPGEDSEVILYPQAIFKDPFRGGNNILVICDAYTPAGEPIPTNKRHKAAQIFSDSKVVSEVPWFGIEQEYTLLQQNVKWPLGWPVGGYPGPQGPYYCGAGADKSFGRDISDAHYKACLYAGINISGTNGEVMPGQWEFQVGPSVGIEAGDHIWCARYILERITEQAGVVLSLDPKPIEGDWNGAGCHTNYSTLSMREEGGFEVIKKAILNLSLRHKEHISAYGEGNERRLTGKHETASIDKFSWGVANRGASIRVGRDTEKQGKGYLEDRRPASNMDPYVVTGLLAETTILWEPTLEAEALAAQKLALNV

SEQ ID NO: 21189 - DNA, 1410 bp, Erwinia carotovora
  CDS (1)..(1410)
atgtccgcagaacatgttttgacgatgctgaatgagcacgaagtgaagtttgttgatttacgcttcacggatactaaaggtaaagagcagcacgtcaccattccggctcatcaagtcaatgccgacttcttcgaagaaggtaaaatgtttgatggttcctcgattggcggctggaaaggtattaacgagtcagacatggttctgatgcctgatgccagcacagcgatgattgatccgttcttcgaagatactacgctgatcattcgttgtgacatccttgagccaggcaccatgcaaggctatgaccgtgacccgcgttctatcgcgaaacgtgcggaagatttcctgcgttcttccggtatcgccgacaccgtcctgttcgggcctgagccagaattcttcctgtttgatgacatccgtttcggcagcagcacttcaggttcccatgttgctatcgacgatgtcgaagcctactggaactccggtaaagcatacgaaggtggtaacaaaggtcaccgtccaggcctgaaaggcggctatttcccagttccacctgtcgattcatcacaggacatccgttctgctatgtgtctgaccatggagcaaatgggtctggttgttgaagctcaccaccatgaagtggctaccgctggtcagaacgaagtggctacccgcttcaataccatgaccaaaaaagctgacgaaattcagatctacaaatatgtcgtgcataacgtggctcacgcctacggtaaaacagcgaccttcatgccaaaacctatgttcggtgataacggttctggtatgcactgccacatgtctctgtctaaagacggcactaacctgttcgctggcgacaaatacggcggcctgtctgaaatggctctgttctacatcggcggtgttatcaagcacgctaaagccatcaacgccctggcgaacccgaccaccaactcctacaagcgtctggttccaggctacgaagcacctgttatgctggcttactctgcccgtaaccgttctgcttcaatacgtatcccagtggttgctagcccgaaagcacgtcgtatcgaagcgcgcttcccagatccagcagctaacccgtacctgtgcttcgctgcactgctgatggctggcctcgacggcatcatcaacaaaatccaccctggcgatgcgatggacaaaaacctgtacgacctgccgccggaagaagaagcagagattccaaaagttgcaggttctctggacgaggccctggctgcactgaacgaagaccgcgagttcctgacccgtggtggcgtgttcaccgacgacgctatcgaagcgtatatcgaactgcgtaaacctgagattgaccgcgttcgtatgacgccacacccagttgagttcgaactgtactacagcgtgtaa

SEQ ID NO: 21190 - protein, 469 aa, Erwinia carotovora
MSAEHVLTMLNEHEVKFVDLRFTDTKGKEQHVTIPAHQVNADFFEEGKMFDGSSIGGWKGINESDMVLMPDASTAMIDPFFEDTTLIIRCDILEPGTMQGYDRDPRSIAKRAEDFLRSSGIADTVLFGPEPEFFLFDDIRFGSSTSGSHVAIDDVEAYWNSGKAYEGGNKGHRPGLKGGYFPVPPVDSSQDIRSAMCLTMEQMGLVVEAHHHEVATAGQNEVATRFNTMTKKADEIQIYKYVVHNVAHAYGKTATFMPKPMFGDNGSGMHCHMSLSKDGTNLFAGDKYGGLSEMALFYIGGVIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEALAALNEDREFLTRGGVFTDDAIEAYIELRKPEIDRVRMTPHPVEFELYYSV

SEQ ID NO: 21191 - DNA, 1122 bp, Xenopus laevis
  CDS (1)..(1122)
atggcaacctccgacagtgctcagttgagtaaggccattaagcagatgtatctggaactgccgcagggagataaggtgcaggcgatgtacatctggattgatgggaccggggagggtcttcgctgcaagactcgcactctggacagtgaacccaagaccatagaagatctgcccgaatggaacttcgatggatctagcacacaccaatctgagggatccaacagtgacatgtacctgattccagtcgcaatgtttagagacccttttcgaagggatcccaacaagctggtactttgcgaggtgctaaaatacaaccgaaaaactgcagaaacaaacctacgtcatacatgtaatcagataatggacatgatgggaaatgagcatccatggtttggaatggaacaggaatatacattgttgggtatggatggacatccttttggctggccttcaaatggcttcccaggaccacaaggcccctattactgtggagtaggtgcaaataaggcatatggtcgggatattgtggaggctcattatcgggcttgtctttatgctggtgtgaaaattgcaggaactaatgcagaagttatgccagcacagtgggaattccaaattggaccatgtgaaggaatagacatgggagatcacctttggattgctcgatttatactgcatagagtatgtgaggattttgggatcattgtgtcatttgacccaaaacccattactggaaactggaatggagctggatgtcacaccaatttcagcacaaagtcaatgcgtgaagaagaaggccttaagcacatagaagaatccattgaacgtctaagcaaacgtcatgagtatcacattagaatgtatgatccaaggggaggtaaagacaatgcccgtcgtctcacaggtttccatgagacatccagtatccatgagttctcagcaggagttgcaaaccgtggtgcaagtatccgcattccccgccttgtaggtcaggagaagaaaggctattttgaagatcgtcgtccatcggccaactgtgacccctatgctgtgaccgaggctatcatcaggacctgcctgctgaatgaaactggagacgaacctcttgaatacaagaactaa

SEQ ID NO: 21192 - protein, 373 aa, Xenopus laevis
MATSDSAQLSKAIKQMYLELPQGDKVQAMYIWIDGTGEGLRCKTRTLDSEPKTIEDLPEWNFDGSSTHQSEGSNSDMYLIPVAMFRDPFRRDPNKLVLCEVLKYNRKTAETNLRHTCNQIMDMMGNEHPWFGMEQEYTLLGMDGHPFGWPSNGFPGPQGPYYCGVGANKAYGRDIVEAHYRACLYAGVKIAGTNAEVMPAQWEFQIGPCEGIDMGDHLWIARFILHRVCEDFGIIVSFDPKPITGNWNGAGCHTNFSTKSMREEEGLKHIEESIERLSKRHEYHIRMYDPRGGKDNARRLTGFHETSSIHEFSAGVANRGASIRIPRLVGQEKKGYFEDRRPSANCDPYAVTEAIIRTCLLNETGDEPLEYKN

SEQ ID NO: 21193 - DNA, 1359 bp, Elaeagnus umbellata
  CDS (36)..(1103)
ctcctttgaaaaatagcccaaacttttttataactatgtctctcctctctgatctcctcaaccttaacatctcagaatccactgatagaatcatcgctgagtacatatggattggtggatcgggcttagatctcagaagcaaagcaactctgccaaaaaaagtgaagaacccatcagaactcccaaaatggaattatgatggttcaagcacgaatcaagcccctggcgatgacagtgaagtcatcttatatccacaagcaatatttagggatcctttcagaagagggaacaatatcctggttatgtgtgacgcatacactccagctggtgaaccaatccccactaacaaacgtcacaacgctgctaagattttcagtcacccggatgtcgatgccgaggagccatggtatgggattgagcaagaatatactcttcttcagaaggaggtcaactggcctctaggatggcctcttgggggcttccctggacctcagggaccttactattgtggtgttggggcagacaaggcttttggacgcgatattgtggattcacactacaaagcctgcctatatgctggtgttaacatcagtggaatcaatggtgaagttatgcctggccagtgggagtttcaagttggcccaactgttggtattgctgctggtgatcaagtatgggttgctagatatattcttgagagaattgctgaaattgctggagtagttgtttcatttgatccaaaaccaatcaagggtcactggaatggtgctggtgctcacaccaactacagcaccaaatccatgagaattgatggaggtattaatgtgattaagaaggccattgaaaaattgggtctccgccacaaggagcacattgctgcttatggtgaaggcaatgagaggaggttgactggtcgccatgagactgcagacattaacaccttctcctggggtgttgctaacagaggagcctctgtccgtgttggccgtgatactgaaaaggacggaaaaggttactttgaggacagaaggccagcatcaaacatggatccatatgttgtgacttccatgattgctgaaaccaccatcctgtggaagccttgagaagagaacaaaaaaccaagttgtttggttgatttgagttatattggttgattggggagaagaatcaaagctatgaggaatttgaataactttatctccctttcttgtgggtgtgtgtgcttgtactttgtctacttgtttacttattattaaatcatggttgttcacacaacatgaaatgtttttaattgctcgtgttttagaagaccttagtaataaaaaagttaatgttcaatcaaaaaaaaaaaaaaaaaaa

SEQ ID NO: 21194 - protein, 355 aa, Elaeagnus umbellata
MSLLSDLLNLNISESTDRIIAEYIWIGGSGLDLRSKATLPKKVKNPSELPKWNYDGSSTNQAPGDDSEVILYPQAIFRDPFRRGNNILVMCDAYTPAGEPIPTNKRHNAAKIFSHPDVDAEEPWYGIEQEYTLLQKEVNWPLGWPLGGFPGPQGPYYCGVGADKAFGRDIVDSHYKACLYAGVNISGINGEVMPGQWEFQVGPTVGIAAGDQVWVARYILERIAEIAGVVVSFDPKPIKGHWNGAGAHTNYSTKSMRIDGGINVIKKAIEKLGLRHKEHIAAYGEGNERRLTGRHETADINTFSWGVANRGASVRVGRDTEKDGKGYFEDRRPASNMDPYVVTSMIAETTILWKP

SEQ ID NO: 21195 - DNA, 1410 bp, Photobacterium profundum
  CDS (1)..(1410)
atgtcagtagaaaatgtactagcgctgatccaggaaaatgaagttaagtttattgacctacgttttaccgataccaaaggtaaagagcagcacatcactattccttctcatcaaatcgatagcgatttttttgaagatggcaaaatgtttgacggttcatcggttgctggttggaaaggtatcaatgaatcagacatggtgatgatgccagacgcttcaagcgcagtacttgacccattcacggaagattcaacactcaacattcgttgtgacattcttgagcctgcaaccatgcaaggctacgatcgcgacccacgttctatcgcaaaacgtgctgaagagtttatgcgttcgacgggtctagcagacacagtacttgtcggtcctgagcctgaatttttcctatttgacgatgttaagttcaacactgacatgtcaggttctttcttcaaaattgatgatatagaagcagcttggaactcgggttctgatttcgaaggcggtaacaaaggtcaccgtcctggcgttaaaggcggttacttcccagtagcacctgttgattcatctcaagacatccgttctgctatgtgtctaatcatggaagaaatgggccttgttgttgaagcacaccaccacgaagtagcgacagcgggtcagaatgagatcgcgactcgcttcaatacgctaacaacgaaagccgatgaaatccaaatctataagtacgttgtacacaacgttgctcatgcatttggtaaaacagcaaccttcatgccgaagccactcgttggtgataacggttcaggtatgcacgttcacatgtctctaaataaagacggacagaaccttttcgccggtgataagtacggcggcctttcagaaatggctatctactacatcggcggtatcattaagcacgcacgtgcaatcaatgcttttgctaacccagcaacgaactcgtacaagcgccttataccgggttacgaagcacctgtaatgcttgcatactctgcacgtaaccgttctgcttctattcgtatccctgtggtaccaagcccgaaagcacgtcgtatcgaagtacgtttcggcgatccagcagctaacccatacctagcattcgcagcaatgctaatggctggtcttgacggtattcaaaacaagatccacccaggcgaagcaatggataaagatctatacgatcttcctgctgaagaagcagctgaaattccacaagtagcagaatcgctagaaatcgcacttaagaacctagatgaagatcgtgagttcctaaccgctggtggtgtattctctgatgactttattgattcttacatcaagctgaagtctgaagacgtagagaaagtaaatatgacaactcacccacttgagtttgaactttactactctgtataa

SEQ ID NO: 21196 - protein, 469 aa, Photobacterium profundum
MSVENVLALIQENEVKFIDLRFTDTKGKEQHITIPSHQIDSDFFEDGKMFDGSSVAGWKGINESDMVMMPDASSAVLDPFTEDSTLNIRCDILEPATMQGYDRDPRSIAKRAEEFMRSTGLADTVLVGPEPEFFLFDDVKFNTDMSGSFFKIDDIEAAWNSGSDFEGGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHMSLNKDGQNLFAGDKYGGLSEMAIYYIGGIIKHARAINAFANPATNSYKRLIPGYEAPVMLAYSARNRSASIRIPVVPSPKARRIEVRFGDPAANPYLAFAAMLMAGLDGIQNKIHPGEAMDKDLYDLPAEEAAEIPQVAESLEIALKNLDEDREFLTAGGVFSDDFIDSYIKLKSEDVEKVNMTTHPLEFELYYSV

SEQ ID NO: 21197 - DNA, 1038 bp, Rhodopseudomonas palustris
  CDS (1)..(1038)
atgaccaagtacaagctcgagtacatctggctcgacggctacaagccgacgccgaacctccgcggcaagacgaccatcaaggaattcgagatctatccgacgctcgagcagcttccgctttggggattcgacggctcgtcgacgatgcaggccgagggccacagctccgactgcgtgctgaagccggttgcgatgtaccccgacgctgcgcggaagaacggcattctggttctgtgcgaagtgatgatgccggacggcgtcaccccgcatccgaccaacacccgcgccaccattctggacgacgaaggcgcctggttcggctttgaacaggaatacttcttctacaagaatggccgcccgcttggcttccccgaggccggctatcccgcgccgcagggcccgtactacaccggcgtcggctacaagcacgtcggtgacatcgcccgtcagatcgtcgaagagcacctcgacctctgcctcgcagccggcatcaaccacgaaggcatcaacgccgaggtggcgaagggccagtgggaattccaggtgttcggcaaggggtcgaggaccgctgccgaccagatgtggatggcgcgctatctgatgcttcgtctcaccgagaagtacggcatcgacatcgaattccactgcaagccgctcggcgacaccgattggaacggctcgggcatgcactgcaacttctccaccgcctacatgcgcgaagtcggcggcaaggagtatttcgaagcgatgatgaaggcgttcgaggccaacctcgacgaccacatcgcggtgtatggtcctgacaaccacatgcggctcaccggcaagcacgagaccgcgccgtggaacaagttttcctacggcatcgccgatcgcggcgcgtcgatccgggtgccgcactccttcgtcaacaacggctacaagggctatctggaagatcgccgcccgaactcgcagggcgacccctaccagatcgcgtcccaggttctgaagacgatttcgtcggtccccacctcgaagtcggcagccgccgcctga

SEQ ID NO: 21198 - protein, 345 aa, Rhodopseudomonas palustris
MTKYKLEYIWLDGYKPTPNLRGKTTIKEFEIYPTLEQLPLWGFDGSSTMQAEGHSSDCVLKPVAMYPDAARKNGILVLCEVMMPDGVTPHPTNTRATILDDEGAWFGFEQEYFFYKNGRPLGFPEAGYPAPQGPYYTGVGYKHVGDIARQIVEEHLDLCLAAGINHEGINAEVAKGQWEFQVFGKGSRTAADQMWMARYLMLRLTEKYGIDIEFHCKPLGDTDWNGSGMHCNFSTAYMREVGGKEYFEAMMKAFEANLDDHIAVYGPDNHMRLTGKHETAPWNKFSYGIADRGASIRVPHSFVNNGYKGYLEDRRPNSQGDPYQIASQVLKTISSVPTSKSAAAA

SEQ ID NO: 21199 - DNA, 1410 bp, Rhodopseudomonas palustris
  CDS (1)..(1410)
atgacgaccgctaaagaagtcctgaaatccatcaaggacaacgacgtgaaatacgtcgatctgcgtttcaccgatccgcgcggcaagtggcagcatgtcaccttcgacgtgtcgatgatcgacgaggagatcttctccgaaggcaccatgttcgacggctcctcgatcgccggttggaaggcgatcaacgagtccgacatgacgctgatgcccgatccggcgaccgccacgatcgatccgttcttcgcagagaccaccatggtgatcacctgcgacatcctcgagccgtcgaccggcgagccctacaaccgcgacccgcgcggcatcgccaagaaggcggaagcccaggtcaaggcgctcggcatcggtgacagcgtgttcgtcggccccgaagccgagttcttcgtgttcgacgacgtgcgctattcggcgagcccgtacaacaccggcttcaagctggactcgtcggaactgccgaccaactcggacaccgagtacgaaggcggcaacctcggccaccgcatccgcaccaaggccggttacttcccggtgccgccgcaggactccgtgcaggacatgcgctcggagatgctcggcgcgatggccaagatgggcgtcaaggtcgagaagcatcaccacgaagtcgcttcggcccagcacgagctcggcatgaagttcgacaccctgacccacatggccgaccagatgcagatctacaagtactgcatccatcaggtcgcccacatctacggcaagaccgcgaccttcatgccgaagccggtgttcggcgacaacggctcgggcatgcacgtccaccagtcgatctggaaggacggcaagccgaccttcgccggcaacaagtacgccgacctgtcggaaacctgcctccactacatcggcggcatcatcaagcacgccaaggcgatcaacgccttcaccaacccgtcgaccaactcctacaagcgtctggtcccgggctatgaagcgccggtgctgctggcctactcggcccgcaaccgctcggcctcgtgccgtatcccctacaccacctcgccgaaggccaagcgcgtcgaagtccgcttcccggacccgatggccaatccgtatctcgccttcgcggcgatgctgatggccggcctcgacggcatcaagaacaagatcgatccgggtccggcgatggacaaggacctgtacgatctgccgaaggaagagctgaagcagatcccgaccgtttgcggcagcttgcgcgaagcgctcgagaacctcgacaaggaccgcgccttcctcaaggccggcggcgtgttcgatgacgacttcatcgacgccttcatcgagctgaagatgaccgaagtggcgcggttcgaaatgaccccgcacccggtcgagttcgagatgtactactcgtactaa

SEQ ID NO: 21200 - protein, 469 aa, Rhodopseudomonas palustris
MTTAKEVLKSIKDNDVKYVDLRFTDPRGKWQHVTFDVSMIDEEIFSEGTMFDGSSIAGWKAINESDMTLMPDPATATIDPFFAETTMVITCDILEPSTGEPYNRDPRGIAKKAEAQVKALGIGDSVFVGPEAEFFVFDDVRYSASPYNTGFKLDSSELPTNSDTEYEGGNLGHRIRTKAGYFPVPPQDSVQDMRSEMLGAMAKMGVKVEKHHHEVASAQHELGMKFDTLTHMADQMQIYKYCIHQVAHIYGKTATFMPKPVFGDNGSGMHVHQSIWKDGKPTFAGNKYADLSETCLHYIGGIIKHAKAINAFTNPSTNSYKRLVPGYEAPVLLAYSARNRSASCRIPYTTSPKAKRVEVRFPDPMANPYLAFAAMLMAGLDGIKNKIDPGPAMDKDLYDLPKEELKQIPTVCGSLREALENLDKDRAFLKAGGVFDDDFIDAFIELKMTEVARFEMTPHPVEFEMYYSY

SEQ ID NO: 21201 - DNA, 1122 bp, Rattus norvegicus
  CDS (1)..(1122)
atggccacctcagcaagttcccacttgaacaaaggcatcaagcagatgtacatgaacctgccccagggcgagaagatccaactcatgtatatctgggttgatggtaccggggaagggctacgctgcaagacccgtactctggactgtgaccccaagtgtgtagaagagttacccgagtggaactttgatggttctagtacgtttcagtctgaaggctccgacagcgacatgtacctccatcctgtggccatgtttcgagaccccttccgcagagaccccaacaagctggtgttctgcgaagtattcaagtataaccggaagcccgcagagaccaacctgaggcacagctgtaagcgtataatggacatggtgagcagccagcacccctggtttggaatggaacaggagtatactctcatgggaacagacggccaccctttcggctggccttctaatggcttccctggaccccaaggaccctattactgcggtgtgggagctgacaaggcttatggccgagatatcgtggaggctcactaccgggcctgcttgtatgctggaatcaagatcacagggacaaatgccgaggttatgcctgcccagtgggaattccagataggaccctgcgaagggatccgcatgggagatcatctctgggtagcccgttttatcttgcatcgggtatgcgaagactttggggtgatagcaacctttgaccccaagcccattccagggaactggaatggggcaggctgccacaccaactttagcaccaaggccatgcgggaggagaatggtctgaggtgcattgaggaggccattgataaactgagcaagaggcaccagtaccacatccgtgcctacgaccccaaggggggcctggacaacgcccgccgtctgactggattccacgaaacctccaacatcaacgacttttccgctggcgttgccaaccgcagcgccagtatccgcattccccggattgtcggccaggagaagaagggttactttgaagaccgtcggccttctgccaattgcgacccctatgcggtgacggaagccatcgtccgcacgtgtctcctcaacgaaactggcgacgagcccttccaatacaagaactaa

SEQ ID NO: 21202 - protein, 373 aa, Rattus norvegicus
MATSASSHLNKGIKQMYMNLPQGEKIQLMYIWVDGTGEGLRCKTRTLDCDPKCVEELPEWNFDGSSTFQSEGSDSDMYLHPVAMFRDPFRRDPNKLVFCEVFKYNRKPAETNLRHSCKRIMDMVSSQHPWFGMEQEYTLMGTDGHPFGWPSNGFPGPQGPYYCGVGADKAYGRDIVEAHYRACLYAGIKITGTNAEVMPAQWEFQIGPCEGIRMGDHLWVARFILHRVCEDFGVIATFDPKPIPGNWNGAGCHTNFSTKAMREENGLRCIEEAIDKLSKRHQYHIRAYDPKGGLDNARRLTGFHETSNINDFSAGVANRSASIRIPRIVGQEKKGYFEDRRPSANCDPYAVTEAIVRTCLLNETGDEPFQYKN

SEQ ID NO: 21203 - DNA, 1278 bp, Triticum aestivum
  CDS (116)..(1204)
cccgcatttcccagagagctaccatttgccactacaacacctctccctctccctctccctctccatctccggtaggctccgggggaagaagaagaacagcacgccggcatccgccatgtctccgctcgccgaccttctcagcctcgacctgtccggctgcaccggcaagatcatcgccgagtacatatgggtcggcggcacgggcatggacgtcaggagcaaagccaggacgctgcccgggcccgttgatgaccccagcaagctcccaaaatggaatttcgacggctccagcaccggccaggccacgggcgacgacagcgaggtcatcctctgccctcaagccatcttcagggacccattcaggaaggggaacaacatcctggtcatctgtgactgctatgcgcctaacggagagccgattccgagcaacaagcggtacaacgcggcgaggatattcggccatcccgaggtcaaggctgaagaaccatggtatgggattgagcaagagtacacccttcttcagaaggacaccaactggcccattggctggccactagggggttaccctggccctcagggaccttactactgcgccgcgggtgcggagaaatcttacgggcgcgacatcgtcgatgcacactacaaggcctgcctctacgccggcatcaacatcggcggcatcaatgcagaagtcatgccaggacagtgggagttccaagtcggcccttccgtcggcatctcggccggcgacgagctctgggcggctcgctacatcctggagaggatcactgagattgctggcgtcgtcgtctccttcgaccccaagccgatcccgggagaatggaatggtgctggtgcccacacaaactacagcaccaagtcgatgaggagcgagggcgggtacgaggtgatcaagaaggcgatcaagaagctcgaggcgcggcacatggagcacatcgccgcctacggtgagggcaacgagcgccggctcaccggccgccatgagaccgccgacatcaacaccttcgtatggggcgtggcgaaccgcggcgcgtcggtgcgggtgggccgcgacaccgagaaggaaggcaagggctacttcgaggaccggaggccggggtccaacatggatccctacgtcgtcacctccctgatcgccgagaccaccatcctctgcaaggccggcctctccaatggcaagtagatgtcatctttgatgggttctgtcttctgtgtgaatgcccgtggttgtgtgtgtgtgtgtgtgtgtgtgtgtcc

SEQ ID NO: 21204 - protein, 362 aa, Triticum aestivum
MSPLADLLSLDLSGCTGKIIAEYIWVGGTGMDVRSKARTLPGPVDDPSKLPKWNFDGSSTGQATGDDSEVILCPQAIFRDPFRKGNNILVICDCYAPNGEPIPSNKRYNAARIFGHPEVKAEEPWYGIEQEYTLLQKDTNWPIGWPLGGYPGPQGPYYCAAGAEKSYGRDIVDAHYKACLYAGINIGGINAEVMPGQWEFQVGPSVGISAGDELWAARYILERITEIAGVVVSFDPKPIPGEWNGAGAHTNYSTKSMRSEGGYEVIKKAIKKLEARHMEHIAAYGEGNERRLTGRHETADINTFVWGVANRGASVRVGRDTEKEGKGYFEDRRPGSNMDPYVVTSLIAETTILCKAGLSNGK

SEQ ID NO: 21205 - DNA, 1299 bp, Triticum aestivum
  CDS (82)..(1170)
ttccaagaacacctctcccttcccttgctctgccctctccatctccatctccggctccgggaagaagaagaagaggtagccatgtctccgctcgccgaccttctcagcctcgacctgtccggctgcaccggcaagatcatcgccgagtacatatgggtcggcggcacagggatggacgtcaggagcaaagccaggacgctgcccgggcccgtggaggaccccagcaagcttccaaaatggaattttgacggctccagcaccggccaagccacgggtgacgacagcgaagtcatcctctgccctcaagccatcttcaaggacccattcaggagggggaacaacatcctggtcatctgtgactgctatgcgcctaacggagagccgattccgagcaacaagcggtacaacgcggcgaggatattcggccatcctgatgtcaaggctgaagaaccatggtatgggattgagcaagagtacacccttcttcagaaggacaccaactggcccattggctggccactagggggttaccctggtcctcagggaccttactactgcgccgcgggtgcggagaaatcttacgggcgcgacatcgtcgacgcgcactacaaggcctgcctctacgccggcatcaacatcggcggcatcaatgcagaagtcatgccaggacagtgggagttccaagtcggcccttccgtcggcatctcggccggcgacgagctctgggcggctcgctacatcctggagaggatcactgagattgccggtgtcgtcgtctccttcgaccccaaaccgatcccgggagagtggaatggtgctggtgcccacacaaactacagcaccaagtcgatgaggagcgagggtgggtacgaggtgatcaagaaggcgatccagaagctggaggcgcggcacatggagcacatcgccgcctacggggagggcaacgagcgccggctcaccggccgccacgagaccgccgacatcaacaccttcgtatggggcgtggcgaaccgcggcgcgtcggtgcgggtgggccgcgacaccgagaaggaaggcaagggctacttcgaggaccggaggccggcatccaacatggatccctacgtcgtcacctccatgatcgccgagaccaccatcctcagcaaggccggtctctccaatggcaagtagagtggctttgatgggttctgttatctgtgtgagtgcccgtggttgcgcatgtgtgtgtgtgtgtgtgtctgtgtgatctgcattgcagtgacaagactggcagggttgtgatatgatgataagcataac

SEQ ID NO: 21206 - protein, 362 aa, Triticum aestivum
MSPLADLLSLDLSGCTGKIIAEYIWVGGTGMDVRSKARTLPGPVEDPSKLPKWNFDGSSTGQATGDDSEVILCPQAIFKDPFRRGNNILVICDCYAPNGEPIPSNKRYNAARIFGHPDVKAEEPWYGIEQEYTLLQKDTNWPIGWPLGGYPGPQGPYYCAAGAEKSYGRDIVDAHYKACLYAGINIGGINAEVMPGQWEFQVGPSVGISAGDELWAARYILERITEIAGVVVSFDPKPIPGEWNGAGAHTNYSTKSMRSEGGYEVIKKAIQKLEARHMEHIAAYGEGNERRLTGRHETADINTFVWGVANRGASVRVGRDTEKEGKGYFEDRRPASNMDPYVVTSMIAETTILSKAGLSNGK

SEQ ID NO: 21207 - DNA, 1341 bp, Triticum aestivum
  CDS (28)..(1092)
ccctccttgcgagtagtagcagcagcaatggccagcctcgccgacctcgtcaacctcgacctcagcgactgcaccgacaagatcatcgtcgagtacctctgggttggaggatccggtatcgacatcaggagcaaagcaaggacggtgaacggccccatcaccgacgcgagccagctgcccaagtggaactacgacggctccagcaccggccaggctcccggagaggacagcgaagtcatcctctacccccaggccattttcaaggacccgttcaggaggggtgacaacctccttgttatgtgcgactgctacacaccacaaggtgttccaatccccactaacaagaggcacaatgctgccaagatcttcaacaccccgaatgttgcagctgaggagacatggtatggtatcgagcaggagtacactctcctccagaaggacgtgaactggccccttggctggcccattggtggctaccctggtcctcagggaccctactactgcgcggccggcgcggacaaggcgttcgggcgtgacatcgttgacgcgcactacaaggcgtgcctctacgccgggatcaacatcagcggcatcaacggggaggtcatgcccggccagtgggagttccaagtcgggccgtccgtggggatcgccgcgtccgaccagctgtgggtggcgcgctacatcctcgagaggatcacggaggttgccggggtggtgctgtccctggacccgaagccgatcccgggcgactggaacggcgccggcgcgcacaccaactacagcaccaagtcgatgcgggaggccggcgggtacggggtgatcaagacggccatcgagaagctgggcaagcggcacgcgcagcacatcgccgcctacggcgagggcaacgagcgccgcctcacgggccaccacgagaccgccgacatcaacaccttcaagtggggcgtggctgaccgcggcgcgtccatccgcgtggggcgcgacacggagaaggacggcaagggctacttcgaggaccgcaggccggcctccaacatggacccctacgtcgtcacctccatgatcgccgagaccaccctcctcctctgagccagcagcagatgacacacgcacacgctttcttcctctacctcggagtgagagagggcgacgatgaatttctttctgcaaaacgtctcctgtttccatttcttttgcaaggtctagtctgtttttggggcgtgcctttcgtgtctttcactttactcgttcagataagagtcttccgtgtactctgaaaataatgttcttctttccgcattccgataaatgaaatcatggaaccggttgtgattccgt

SEQ ID NO: 21208 - protein, 354 aa, Triticum aestivum
MASLADLVNLDLSDCTDKIIVEYLWVGGSGIDIRSKARTVNGPITDASQLPKWNYDGSSTGQAPGEDSEVILYPQAIFKDPFRRGDNLLVMCDCYTPQGVPIPTNKRHNAAKIFNTPNVAAEETWYGIEQEYTLLQKDVNWPLGWPIGGYPGPQGPYYCAAGADKAFGRDIVDAHYKACLYAGINISGINGEVMPGQWEFQVGPSVGIAASDQLWVARYILERITEVAGVVLSLDPKPIPGDWNGAGAHTNYSTKSMREAGGYGVIKTAIEKLGKRHAQHIAAYGEGNERRLTGHHETADINTFKWGVADRGASIRVGRDTEKDGKGYFEDRRPASNMDPYVVTSMIAETTLLL

SEQ ID NO: 21209 - DNA, 1634 bp, Aiptasia pallida
  CDS (77)..(1186)
attcctctatttattcagacttgatatttgtagtattccccgtcgttattagtaagctaaatttaaggacagagccatgagtcttcacgataaaagaactgtctctgacaagacatgtgttttggagaggtattcgaaacttgaccaaggaaccagcgttcaagccttgtacatttggattgacggtacaggcgaaggtatccgttgtaaaaccaagactttagagaaaaggccagattccattgaagaccttccaatctggaacttcgatggatcgagtaccgcacaagccgagggccataacagcgatgtctatcttcatcctgtagctattttcaaggacccattccgtggcggagaaaacatcttggttctctgcgagacctacacacacgaccataagccaacacacaccaacaacagaaagacctgtatgaacataatgaacgaccctgaagttaaatcttcacatccatggtttggcattgaacaagaatacaccctgcttgacattgatgggcacccacttggatggccaaagggaggctttccaggaccacaaggaccttactactgtggtgttggtaccaacaaagtgtttggtcgagaagtagtagaagcacattacagagcatgtttgtatgctggtgtgaagattgctggtactaatgccgaggttatgcctgctcagtgggaataccaagttggaccatgtgaaggcattgagatgggtgatcatctatggatctcaagatatatccttcatcgagttgctgaagacttccatgttgttgtatcatttgatcctaaacccatgcctggtgactggaatggtgctggtgctcactgcaattacagcaccgttggaatgagagaagaaaatggaatgaggttgatctatgaagccattgacaagcttgaaaagaaccatgactaccacatcaagaaatatgaccccaagcaaggacaagacaatgcgcgtcggttgactggaaggcatgagacctcaagtatttatcaattctctcatggtgtagccaacagaggtgccagtgtaagaatcccacgtcaatgtgctgaggatggcaagggctatcttgaagatagacgaccatcatcaaactgtgatccatacagtgttacagaggcaattgtcaggacaactataaagaactacacatgttgataagatggactagtaataattagtagagattattacatataatactgggttcaacatatttattttaacaccttcaaaaattattgaatgcaattttaattgacaaggtacctctacaaatagaatccaacgacattgtagttttctctttttaatagacatttaatgattctatgagaatcatcatccattgaattcatttaaattcaggggagtactgctgtttctgttcaaattattaatgggaattgcacgctatttagatttcaaaaattctacaaagcgttttttgagattaatgattacaagagttgtttagttgtatttgatgtttagtctagtactcgtttttatgtgatgtttttgtgacttattttgttgtttttagtacttatgtatatagatgacttttaataaagatattttagagattaaaaaaaaaaaaaaa

SEQ ID NO: 21210 - protein, 369 aa, Aiptasia pallida
MSLHDKRTVSDKTCVLERYSKLDQGTSVQALYIWIDGTGEGIRCKTKTLEKRPDSIEDLPIWNFDGSSTAQAEGHNSDVYLHPVAIFKDPFRGGENILVLCETYTHDHKPTHTNNRKTCMNIMNDPEVKSSHPWFGIEQEYTLLDIDGHPLGWPKGGFPGPQGPYYCGVGTNKVFGREVVEAHYRACLYAGVKIAGTNAEVMPAQWEYQVGPCEGIEMGDHLWISRYILHRVAEDFHVVVSFDPKPMPGDWNGAGAHCNYSTVGMREENGMRLIYEAIDKLEKNHDYHIKKYDPKQGQDNARRLTGRHETSSIYQFSHGVANRGASVRIPRQCAEDGKGYLEDRRPSSNCDPYSVTEAIVRTTIKNYTC

SEQ ID NO: 21211 - DNA, 1445 bp, Datisca glomerata
  CDS (77)..(1147)
gaattcggcacgagaaacaagagtgagagaaagaggtttactattcattttgaagcttttgttttgtattccgagtatgtctttgctatcagatctcgtcaacctcaacctctcagattctactgagaaggtcatcgcagagtacatatggatcggtggatctggtctggatatcagaagcaaagcaaggaccctcccagggcctgtcagtgatccttcaaagctccccaagtggaattatgatggttctagcacaggtcaagctcctggaaaagacagtgaagtgatcttataccctcaagcaattttcagggacccattcaggagaggcaacaacattcttgtaatgtgtgacgcttacacaccggccggagagccaattccgaccaacaagagatgtgctgcagcaaagatattcagtcatcctaatgttgttgctgaagtgccatggtatggaattgagcaggagtacacgttgttgcagaaagacgtcaagtggccaatcgggtggcctgtcggtggtttccctgggcctcagggaccatactactgtggtgttggtgctgacaaggcatttgcccgtgacgttgtcgatgctcattataaggcttgtttatatgctggcgtcaacattagcggcatcaatggggaagtcatgccggggcagtgggaatttcaagtcggtccttccgttggcatttcggccggagatgaattatgggttgctcgttacattttggagaggatcacagaaattgctggagttgttctttcttttgatcccaaaccaattcagggtgactggaatggtgctggagctcacacaaattacagtactaagtcaatgagagaaaaaggcggatacgaggttattaagaaagcgattgaaaagttagggctgaggcacaaagaacacattgctgcttacggtgaaggaaacgagcgtcgtctcaccggacgacacgagacagcagacatcaacacttccttatggggtgtggctaaccgtggagcgtccattcgtgttgggagagacaccgagaaggaaggcaaagggtactttgaggatcggagaccagcttctaacatggatccgtacgtggttacttcgatgattgcagagaccactcttctgtggaagccataagtggtctgctcagtttatcaaatgtattatcttggagaccgatgatatacaagtgtctcccattgaaattgtggaaatatgtgttttttagtaggctgcatcagaatgaatggttttccttcccattagtttttattatttgtaatttctgttgttgctgtttggccctttcggaggtggcgaagtgagattgataatctcgcgatgaataatgatcatttatgaataatgtttttttttggctgaaagggcttattttcattgttgcaatataattaattttatgatattttccctt

SEQ ID NO: 21212 - protein, 356 aa, Datisca glomerata
MSLLSDLVNLNLSDSTEKVIAEYIWIGGSGLDIRSKARTLPGPVSDPSKLPKWNYDGSSTGQAPGKDSEVILYPQAIFRDPFRRGNNILVMCDAYTPAGEPIPTNKRCAAAKIFSHPNVVAEVPWYGIEQEYTLLQKDVKWPIGWPVGGFPGPQGPYYCGVGADKAFARDVVDAHYKACLYAGVNISGINGEVMPGQWEFQVGPSVGISAGDELWVARYILERITEIAGVVLSFDPKPIQGDWNGAGAHTNYSTKSMREKGGYEVIKKAIEKLGLRHKEHIAAYGEGNERRLTGRHETADINTSLWGVANRGASIRVGRDTEKEGKGYFEDRRPASNMDPYVVTSMIAETTLLWKP

SEQ ID NO: 21213 - DNA, 1065 bp, Glomus mosseae
  CDS (1)..(1065)
atggctgttgctaacaaatccaacactcaaactctcgctaaatacctttctctcgatcaaggtggtaaaatccaagccgaatacatctggattgacggcgatggtggacttcgtgggaaaaccactactcttgattttaaaccaactgatgtttccgaattaaaagaatggaattttgatggttcttcaactaatcaagctccaggagataattctgatattttacttcgcccttgtgcaatctttaaggatcctttccgtggtggtgataacatcttggtcctcgccgaatgttataataatgatggaacaccaaaccgaacaaattatcgtcattcctgtactaaacttatgtcggctcattctgaagccaaaccttggtttggtattgaacaagaatataccttgttcgatatggacggtcaagtgcttggwtggccaaaaggtggtttcccaggtcctcaaggtccttattattgttccgttggtgctaatgtagcttttggacgcgacgtcgttgaagctcattaccgcgcttgcctttactccggtgtaaatatttcgggtgttaatggtgaagttatgcctggtcaatgggaataccaagttggtccatgtgaaggaattgatatgggagatcatctttgggtatctcgatatctccttcaacgtgtagcagaagatttcggtatagttgtttccttccatcccaaaccaatcaagggagattggaacggtgcaggatgccacacaaattattcaacagaagcaatgagaatagaaggcggaataaaagcaattcatgatgcaattgatagaatgagtaaacgtcacgcagaacacatcgccgtatatggcgaggataatgacaaacgtcttaccggtcgtcacgaaactggtcatatttcagaattctcatttggtgtagcgaatcgtggtgcttcaattagaattccaagacatgttgccgctcaaggttatggttatttcgaagatcgtagaccagcttccaatattgatccttatcgtgttactgaagtcatagttgaatctactctcggttaa

SEQ ID NO: 21214 - protein, 354 aa, Glomus mosseae
MAVANKSNTQTLAKYLSLDQGGKIQAEYIWIDGDGGLRGKTTTLDFKPTDVSELKEWNFDGSSTNQAPGDNSDILLRPCAIFKDPFRGGDNILVLAECYNNDGTPNRTNYRHSCTKLMSAHSEAKPWFGIEQEYTLFDMDGQVLGWPKGGFPGPQGPYYCSVGANVAFGRDVVEAHYRACLYSGVNISGVNGEVMPGQWEYQVGPCEGIDMGDHLWVSRYLLQRVAEDFGIVVSFHPKPIKGDWNGAGCHTNYSTEAMRIEGGIKAIHDAIDRMSKRHAEHIAVYGEDNDKRLTGRHETGHISEFSFGVANRGASIRIPRHVAAQGYGYFEDRRPASNIDPYRVTEVIVESTLG

SEQ ID NO: 21215 - DNA, 1341 bp, Thermus thermophilus
  CDS (1)..(1341)
atgggttacacgaaggccgagattttaaaagcgcttaagggggaaaacgtcaagttcttgcgcctgcagatcacggacatcctgggcgtggtcaagaacgtggaggtgcccgagtcccagtttgagaaggccctggacggggagatcatgtttgacggctcctccattgagggcttcacccggattgaggagtcggacatgctcctaaggcccgactacaacaccttcgtcatcctccccgacctggtggaagacccaaagcggggccgggtggcgcggctcatctgcgacgtctactaccccgacggccgcccctttgaaggggacccccgctacgtcctcaagcggcagattgaaaggctcaagaagctcgggtttgacaacctgtacgccggccccgagcccgagttcttcctcttcctcaggaccccggagggcctgcccaccaccgagacccacgaccgggcgggctactttgacctggcccccatagacaagggggaggaggcgcgccgcgacatggtgaacgccctggtggccatgggctttgagattgaggcggcccaccacgaggtggccccggggcagcacgagattgacttcaagtacgccgacgccctcaccaccgccgacaacatcgccaccttcaagtgggtggtgaagcggatcgccctgaaccacggcctccacgccaccttcctgcccaagcccatccggggcatcaacggcagcggcatgcacacccacctctccctcttcaaggacggggagaacgccttctatgaccccaacgccgagtaccagctctcccagaccgccctccacttcatcgctgggctcctggagcacgccgccgggatggtggccgtcaccaaccccttggtgaactcctacaagcgcctcacccccgggtacgaggcccccaccaacatcgcctggtccgcctccaaccgctccgccatgatccggatcccggcgcgccggggcgtgggcacccgggcggagctcaggatgcccgacccctcctgcaacccctacctggccctggcggtgatggcggccgcgggcgcggacgggattgagcggaagctcctcccgcccccgcccatccagcggaacatctaccagatgaccgtgcgggagcggcgcaagcacaagatccgggagctccccgggaccctccgggaggccctcgaggccctgaggaaggaccccgtgatccgggaggccctgggcgagcacgtctacacccacttcctccaggccaagcagatggagtgggacgactaccgggtcacggtccaccagtgggagctggaccggtacctggccacctactag

SEQ ID NO: 21216 - protein, 446 aa, Thermus thermophilus
MGYTKAEILKALKGENVKFLRLQITDILGVVKNVEVPESQFEKALDGEIMFDGSSIEGFTRIEESDMLLRPDYNTFVILPDLVEDPKRGRVARLICDVYYPDGRPFEGDPRYVLKRQIERLKKLGFDNLYAGPEPEFFLFLRTPEGLPTTETHDRAGYFDLAPIDKGEEARRDMVNALVAMGFEIEAAHHEVAPGQHEIDFKYADALTTADNIATFKWVVKRIALNHGLHATFLPKPIRGINGSGMHTHLSLFKDGENAFYDPNAEYQLSQTALHFIAGLLEHAAGMVAVTNPLVNSYKRLTPGYEAPTNIAWSASNRSAMIRIPARRGVGTRAELRMPDPSCNPYLALAVMAAAGADGIERKLLPPPPIQRNIYQMTVRERRKHKIRELPGTLREALEALRKDPVIREALGEHVYTHFLQAKQMEWDDYRVTVHQWELDRYLATY

SEQ ID NO: 21217 - DNA, 1413 bp, Geobacter sulfurreducens
  CDS (1)..(1413)
atgacaccacaagaggtagtaagcttcgccaaagagaacggcgcgctgatggtcgattacaagttcatggacttcgtcggcatctggcagcatgtttccgtgcccatttcggagttcggtgaagatacctttgaggaaggccagggtttcgacggctcctccatccgcggctggcagcccatccatgcgtccgacatgatcctcctgccggaccccgcaacggccaagatggatccgttcatcgcggtgccgaccctttcactcatctgcaatgtcttcgatccgatcaccaaggaagactacactcgcgatccgcgcaacattgcccgtaaggccgaggcgtacctgaagtcgaccggcctcggcgataccgctttcttcggtcccgaggccgagttcttcatttttgacgacgtccggtacgattcgacctccaaccagtcgttctacatggttgattcggtggagggtgcctggaacaccggccgcgaagagttcccgaacctgggctacaagccgcgccacaaggaaggttatttccccgtttccccgaccgactcccagaacgatctccgcaacgagatggtcatggagctccagaaggtcggcatccgggtcgagtgtcagcatcacgaagttgcctccggcggccaggccgaaatcgacatgcggttctcctccctcgtcgacatggccgaccagctccagtggttcaagtatgtcatcaagaacgttgcctaccgtaacggcaagaccgttaccttcatgcccaagccgctctatggcgacaacggctccggcatgcactgccacatgtccatctggaaggacggccagaacctctttgccggcgacaagtacggcggactttcccagatggcactctggtacattggtggtatcatcaagcacgccaaggctctctgtgccctgaccaacccgaccaccaactcgtacaagcgtctggtgccgggtttcgaggcaccggtgaacatggcttactccagccgtaaccgttccgcctccatccggatacccatgatgtccaccaacccgaaggccaagcggatcgagtaccggactccggacccctcctgcaacggctatcttgccttcgccgccatgctgatggccggcctcgacggcatcgagaacaagatcgatccggggcaaccgctggataaggacatctacgggctttcccccgaggagctcaagaacatcccgtccgctccgggaagccttgaagaagccctcaaggccctggaggccgaccacgagttccttctcaagggcgacgtcttcacccccgacgttgtcgagaagtggatcgagtacaagatggaagccgaggtcaacccggtccgcatgcgtccggtccccctcgagttcgccctctactacgacatctag

SEQ ID NO: 21218 - protein, 470 aa, Geobacter sulfurreducens
MTPQEVVSFAKENGALMVDYKFMDFVGIWQHVSVPISEFGEDTFEEGQGFDGSSIRGWQPIHASDMILLPDPATAKMDPFIAVPTLSLICNVFDPITKEDYTRDPRNIARKAEAYLKSTGLGDTAFFGPEAEFFIFDDVRYDSTSNQSFYMVDSVEGAWNTGREEFPNLGYKPRHKEGYFPVSPTDSQNDLRNEMVMELQKVGIRVECQHHEVASGGQAEIDMRFSSLVDMADQLQWFKYVIKNVAYRNGKTVTFMPKPLYGDNGSGMHCHMSIWKDGQNLFAGDKYGGLSQMALWYIGGIIKHAKALCALTNPTTNSYKRLVPGFEAPVNMAYSSRNRSASIRIPMMSTNPKAKRIEYRTPDPSCNGYLAFAAMLMAGLDGIENKIDPGQPLDKDIYGLSPEELKNIPSAPGSLEEALKALEADHEFLLKGDVFTPDVVEKWIEYKMEAEVNPVRMRPVPLEFALYYDI

SEQ ID NO: 21219 - DNA, 1290 bp, Phragmites australis
  CDS (1)..(1290)
atggcgcaggcggtggtgccggctatgcagtgccaggtgggagtgaaggcggcagtccgtgcgaggcctgcggccgcgggggctggcggtagggtgtggggcgtcaggaggagcggccgcggcacgtcggggttcaaggtgatggccatgggcatgtcgacctccggcgtggtgccgcgcctcgagcagctgctcaacatggacaccaagccctacaccgacaatatcatcgctgagtacatctgggttggaggatctggaattgacgtcagaagcaaatcgaggacaatatcgaaaccagttgaggatccctcggagctaccgaaatggaactatgatggatcaagcacagggcaagctccaggagaagacagtgaagtcatcctatatccccaggctatcttcaaggatccatttcgaggtggcaacaacatattggttatctgtgatacatacacgccagctggggaacccattcctactaacaaacgccacagggctgcacaaatattcagcgacccaaaggtcgttagccaagtgccatggtttggcattgagcaggagtacactttgctccagacagatgtgaattggcctcttggctggcctgttggaggctaccctggtccccagggtccatactactgcgcggtaggagcagacaaatcatttggccgtgacatatcagacgctcactacaaaccatgtctttacgctggaatcaacattagtggaacaaacggggaggtcatgcctggtcagtgggagtatcaagttggacctagcgttggaattgaagcaggagaccacatatggatttcaagatacattctcgagagaatcacggagcaagctggtgtggtgcttacccttgatccaaaaccaattcagggtgactggaatggagctggctgccacacaaactacagcacaaagagcatgcgtgaagatggaggatttgaagtgatcaagaaagcaatccttaacctttctcttcgccatgatttgcatattagtgcatatggagaagggaatgaaaggaggttgacagggttacatgagacagcgagcattgacaacttctcatggggtgtggcaaaccgtggctgctctattcgggtggggcgagatactgaggcaaaagggaaaggctacctggaagaccgtcgcccggcatcaaacatggacccatatgttgtgacatcgctactggctgaaaccacaattctttgggagccaaccctcgaagtagaggctcttgccgctaagaagttggcgctgaaggtatga

SEQ ID NO: 21220 - protein, 429 aa, Phragmites australis
MAQAVVPAMQCQVGVKAAVRARPAAAGAGGRVWGVRRSGRGTSGFKVMAMGMSTSGVVPRLEQLLNMDTKPYTDNIIAEYIWVGGSGIDVRSKSRTISKPVEDPSELPKWNYDGSSTGQAPGEDSEVILYPQAIFKDPFRGGNNILVICDTYTPAGEPIPTNKRHRAAQIFSDPKVVSQVPWFGIEQEYTLLQTDVNWPLGWPVGGYPGPQGPYYCAVGADKSFGRDISDAHYKPCLYAGINISGTNGEVMPGQWEYQVGPSVGIEAGDHIWISRYILERITEQAGVVLTLDPKPIQGDWNGAGCHTNYSTKSMREDGGFEVIKKAILNLSLRHDLHISAYGEGNERRLTGLHETASIDNFSWGVANRGCSIRVGRDTEAKGKGYLEDRRPASNMDPYVVTSLLAETTILWEPTLEVEALAAKKLALKV

SEQ ID NO: 21221 - DNA, 1290 bp, Phragmites australis
  CDS (1)..(1290)
atggcgcagccggtggtgccggcgatgcagtgtcaggtcggggcgcggggcaaggcggccgtccgggcgaggccggcgggtgcgggaggaagggtgtggggcgtgaagaggagcgggcgcggcacgtccgggttcaaggtgatggccgtgagcacggagagcaccggggtggtgccgcgcctcgagcagctgctcaacatggacaccaagcccttcaccgacaagatcattgccgagtacatctgggttggaggatctggaattgacctcagaagcaaatcaaggacattatcaaaaccagtggaggatccctctgagctaccgaaatggaactacgacggatcaagcacagggcaagctccaggagaagacagtgaagtcatcctatacccccaggctatcttcaaggacccatttcgaggtggcaacaacatattggttatctgtgatacttacacaccagctggggaacccattcctactaacaaacgccacagggctgcacaaatattcagtgacccgaaggtcgtggaccaagtgccatggtttggcattgaacaggagtacactttgctccagacagatgtgaattggcctcttggctggcctgttggaggctaccctggtccccagggtccatactactgcgctgtaggagcagacaaatcatttggccgtgacatatcagatgctcactacaaggcatgtctttacgctggaattaacattagtggaacaaatggggaggtcatgcctggtcagtgggagtatcaggttggacctagcgttggtattgaagcaggagatcacatatggatttcaagatacattctcgagaggatcacggagcaagctggcatagtgcttactcttgatccgaaaccaattcagggtgactggaacggagctggttgccacacaaattacagcacaaagagcatgcgtgaggatggaggttttgaagtgatcaagaaagcaatcctgaacctttctcttcgccatgatctgcatattagtgcatatggagaaggaaatgaaaggaggttgacaggattacatgagacagctagcatagacaacttctcatggggtgtggcaaaccgtggctgctctattcgggtggggcgagatactgaggcaaaaggaaaaggctacctggaagaccgtcgcccggcatcaaacatggacccatatgttgtgacatcgctactggctgaaaccacaattctttgggagccaacccttgaggcggaagctcttgccactaagaagttagcactgaaggtatga

SEQ ID NO: 21222 - protein, 429 aa, Phragmites australis
MAQPVVPAMQCQVGARGKAAVRARPAGAGGRVWGVKRSGRGTSGFKVMAVSTESTGVVPRLEQLLNMDTKPFTDKIIAEYIWVGGSGIDLRSKSRTLSKPVEDPSELPKWNYDGSSTGQAPGEDSEVILYPQAIFKDPFRGGNNILVICDTYTPAGEPIPTNKRHRAAQIFSDPKVVDQVPWFGIEQEYTLLQTDVNWPLGWPVGGYPGPQGPYYCAVGADKSFGRDISDAHYKACLYAGINISGTNGEVMPGQWEYQVGPSVGIEAGDHIWISRYILERITEQAGIVLTLDPKPIQGDWNGAGCHTNYSTKSMREDGGFEVIKKAILNLSLRHDLHISAYGEGNERRLTGLHETASIDNFSWGVANRGCSIRVGRDTEAKGKGYLEDRRPASNMDPYVVTSLLAETTILWEPTLEAEALATKKLALKV

SEQ ID NO: 21223 - DNA, 1409 bp, Camellia sinensis
  CDS (126)..(1196)
agctcattactcctcgccacagactccaacacaaaccacgtatagtacggagagaaagaggagagagggagagtcaaagcatcgtgtggtttgtttggagtgggtgtttttgatcgatcgtcactatgtctcttctttccgatctttgcaacttgaatctatctgagtccaccgagaagatcattgcagagtacatatggatcggtggatctggtatggacctcagaagcaaagccaggaccctgaatgcaccagtctctgatccttcaaagttaccacaatggaactacgatggttccagcactggccaagcccctggcgaggacagtgaagtgattttatatccccaggcaatttataaagacccattcaggagaggcaacaacattcttgtaatgtgtgatgcttacacgccgggtggagagccaatcccaacaaataagaggtttgatgctgccaagatattcagccaccctgatgttgttgctgaggaaccttggtatggtatagagcaggagtacactttgttgcagaaagaagtgaagtggccgattggttggcctgtgggaggttatcctggaccacagggaccatactactgtggtattggtgcggataaagcttttgggcgagacattgtcgatgcccattataaggcatgtctttatgctggtattaacattagtggcatcaatggagaggtgatgccgggtcagtgggaattccaagttgggccttctgttggcatcagttctggagatcagttgtggatggctcgttacattctagaaaggatcactgaaattgctggagtcgttgtttcgttcgaccctaaacctattgagggtgactggaatggagccggtgctcacaccaactacagtaccaagtccatgcgaagtgatgggggctttgaagtcattaagaaggccatcgaaaagcttggattgaagcacaaggaacacattgctgcttatggagaaggcaatgagcgtcggcttacaggaaagcacgaaacagctgacataaacacattcttatggggagtggcaaaccgtggagcctccattagggttggccgggacacagagaaggcaggcaaaggttattttgaggacaggaggcctgcatcaaacatggatccgtacgttgtcacttccatgatcgcaaacaccaccatcctctggaaaccgtaagaacggaagcaagaatttctattgttttttggatgtgcacattttgttttagttgtttccaaaatgtatttgcagttgtgggttttggacatttgcatcttcatttgccgtgaattgacaataagttaattgacattaaaaaaaaaagaagcaggcttttgccttattagtaaattcatcatggtatgtttggctgttaaaaaaaaaaaaaaa

SEQ ID NO: 21224 - protein, 356 aa, Camellia sinensis
MSLLSDLCNLNLSESTEKIIAEYIWIGGSGMDLRSKARTLNAPVSDPSKLPQWNYDGSSTGQAPGEDSEVILYPQAIYKDPFRRGNNILVMCDAYTPGGEPIPTNKRFDAAKIFSHPDVVAEEPWYGIEQEYTLLQKEVKWPIGWPVGGYPGPQGPYYCGIGADKAFGRDIVDAHYKACLYAGINISGINGEVMPGQWEFQVGPSVGISSGDQLWMARYILERITEIAGVVVSFDPKPIEGDWNGAGAHTNYSTKSMRSDGGFEVIKKAIEKLGLKHKEHIAAYGEGNERRLTGKHETADINTFLWGVANRGASIRVGRDTEKAGKGYFEDRRPASNMDPYVVTSMIANTTILWKP

SEQ ID NO: 21225 - DNA, 1525 bp, Xenopus laevis
  CDS (30)..(1145)
tttccttgctcataagatcagctgccaccatgtccgtctcccacagttcgagactcaacaagggggtgagggaacagtacatgaaactgccccaaggtgggatggcccaggtcacctacgtctggatcgatggcaccggggaaggagtaaggtgcaaaaccaggactctggatcaggaaccaaaaaccatagatgaaatcccagaatggaactttgatggatccagtacttaccaagcagaaggctcaaacagtgacatgtatcttgtcccagtccagatgttcagagacccattctgcctggaccccaataagctggttatgtgtgaagtcttgaaatacaaccgcaagtctgcagagaccaacctgcggcacacatgcaagaagatcatggagatggtgggtgatcaccgcccatggttcggaatggagcaagaatacaccttgctgggcattaacgggcacccgtatggctggccagaaaatggcttccctgggccacaaggtccctattactgcggtgttggggcagataaggtttacgggcgggatattgtggaggctcattacaaggcctgtctgtatgctggcatcaagatctgtggcaccaatgcagaagtcatgccctctcagtgggagttccaggtgggtccatgtgaaggtatcgatatgggggatcatttgtggatggccaggttcatccttcatcgggtctgtgaagacttcggggtggtggcaacgctagacccgaaaccaatgactggaaactggaacggtgccgggtgccacaccaactacagcacagagagcatgagggtcgaaggaggcctcaaacacattgaagatgccattgagaagctggggaagaggcacgactatcacatctgcgtgtacgacccccgaggagggaaagacaactcccggagactcaccgggcagcacgagacatctagtattcacgagttctcagctggcgtggccaaccggggcgccagcatccgtatcccgcgtcaggtgggccaggaaggctacggctactttgaagaccggcggccagcagccaactgcgacccctacgccgttacagaggcgctggtcagaaccaccatcctgaacgaaaccggcagcgagactaaagactattaaaaactgagctgggagctggtttctcctgggcaatcagtatggcgtctcccgatactacttgaattaaattcctttggttggaaaggcatttctagaaccagagaccttgcatggtgtctcccatattgtctgtaaaaatagggggtcttaccttgggggtggggggttgcacagatctatgtgctggttttatagtataagaacaaagcacgtgaccctgctgacatttaattggccagtgccaagtgattccttcagtttatccctttggggagggttttatgaattggctcctctgaagtcttatacccacagtgtgttttaatgcctaataataaagtttgttttttattaaaaaaaaaaaaaaaaaaaaaaaaaaa

SEQ ID NO: 21226 - protein, 371 aa, Xenopus laevis
MSVSHSSRLNKGVREQYMKLPQGGMAQVTYVWIDGTGEGVRCKTRTLDQEPKTIDEIPEWNFDGSSTYQAEGSNSDMYLVPVQMFRDPFCLDPNKLVMCEVLKYNRKSAETNLRHTCKKIMEMVGDHRPWFGMEQEYTLLGINGHPYGWPENGFPGPQGPYYCGVGADKVYGRDIVEAHYKACLYAGIKICGTNAEVMPSQWEFQVGPCEGIDMGDHLWMARFILHRVCEDFGVVATLDPKPMTGNWNGAGCHTNYSTESMRVEGGLKHIEDAIEKLGKRHDYHICVYDPRGGKDNSRRLTGQHETSSIHEFSAGVANRGASIRIPRQVGQEGYGYFEDRRPAANCDPYAVTEALVRTTILNETGSETKDY

SEQ ID NO: 21227 - DNA, 1050 bp, Neurospora crassa
  CDS (1)..(1050)
atggccgagtacatctggattgactctgagggcaacacccgctcaaaatctcgcactctcgatgagaagccagagggctacaagcccgaggagctccccatctggaactttgacggtagctcaacaggccaggctcctggtgacaactcggatgtttacctaaagccggtcgccgtctaccccgatcctttccgccctcccaacaacattcttgtcctcgccgaatgctgggatgccgacggcacccccaacaagtacaaccaccgccacgagtgcgccaagctcatggagcttcacgccaagcatgagccttggttcggcctcgagcaagaatacacccttctcgatctgaatgatcgtccctacggctggcctcagaatggctaccccgccccgcaaggtccttactactgcggtgtcggtgccggaaaggttgtcatgcgcgacattgtcgaagcgcactaccgcgcctgcctgtactcgggcatcaagatctcgggaaccaacgccgaagttatgcccgcccagtgggagttccaagtcggcccctgcgtcggcatcgagatgggcgaccagctttggctcgcccgtttcttgctgcaccgcgtagctgaggagttcgccgtcaaggtgtcgctcgatcccaagcccatccctggcgactggaacggtgccggtctacacagcaacttttcgacggtcgagatgaggaaggagggcggcatgaagcagatcgaggcggccatcaagaagctggagggaaggcataaggagcatattgctggtgagtttgtccgatcagaggaagaatggagtggggttgggacggaggctaatgcggggaaaacagtctacggcgaaggcaacgagaagcgtctcaccggccgtcacgagacgggtgccatcgacaccttcacctacggcgtggccaaccgtggcgcgtccattcgtatccctcgcgagtgcgccgccaagggctacggctactttgaggatcgtcgtcctgcttccaacgcggatccctatctcattactggcatcatcacgtag

SEQ ID NO: 21228 - protein, 349 aa, Neurospora crassa
MAEYIWIDSEGNTRSKSRTLDEKPEGYKPEELPIWNFDGSSTGQAPGDNSDVYLKPVAVYPDPFRPPNNILVLAECWDADGTPNKYNHRHECAKLMELHAKHEPWFGLEQEYTLLDLNDRPYGWPQNGYPAPQGPYYCGVGAGKVVMRDIVEAHYRACLYSGIKISGTNAEVMPAQWEFQVGPCVGIEMGDQLWLARFLLHRVAEEFAVKVSLDPKPIPGDWNGAGLHSNFSTVEMRKEGGMKQIEAAIKKLEGRHKEHIAGEFVRSEEEWSGVGTEANAGKTVYGEGNEKRLTGRHETGAIDTFTYGVANRGASIRIPRECAAKGYGYFEDRRPASNADPYLITGIIT

SEQ ID NO: 21229 - DNA, 1101 bp, Rhodopirellula baltica
  CDS (1)..(1101)
atgtctgacagtttcattctttgctctggcaagaccgccacgggcaccaaaaaagtctttaggagactcgcatccatgaccaagtgtaagttggaatacatctggctcgacggctatcaaccgacccagagcatgcgcagcaaaaccaaaatcgtcgaagacttcagcggcaaagtggaagatgccgaaatgtggtcgttcgacggttcgtcaaccgaacaagcgcccggtggagccagtgactgcttgctgaagcccgtcttctgccttcccgatccggatcgtttgggcaccggcttcttggtgatgtgcgaagtgatgaatgccgatggcacgcctcaccgcagcaacggccgtgcaacgatcaaagacgatgacaatgacttctggttcggtttcgaacaggagtacacgatcttcgatccagaaaccaagaaaccaatcggcttccctgctgaaggtttcccaggacctcaaggtccttactactgctcggtcggtgctggcaaagcagtcggtcgtgaaatcgtcgaagagcacctcgaactgtgcttgcaagctggcttgaacgtcgaaggcatcaacgccgaagtcatgatgggccagtgggaattccaaatcttcgccaagggcgcagcccaagctggtgacgaaatttggctcgcacgctacttgctggatcgcaccggcgagaagtacggcatggaaattaactaccactgcaaaccagtcaaaggtgactggaacggcagcggcatgcacgccaacttcagcaacacgaccctgcgtacgtgcggcagcaaagaagtttacgaagcgatttgccaagccttcgagcctcgtatcaccgagcacatcgatgtttacggtgctgacaacgatcagcgtttgaccggtttgcacgaaacgcaatcgatcgacaagttcagctacggcatctcggaccgcggtgcatcgatccgcattccaatcgccacggttgaaaagggctggaagggctggttggaagatcgtcgcccagcttcgaacgctgacccatacatggttgccagtgcaatcatcgcaacggtcaagacagccaacgtcccagccggcgtttga

SEQ ID NO: 21230 - protein, 366 aa, Rhodopirellula baltica
MSDSFILCSGKTATGTKKVFRRLASMTKCKLEYIWLDGYQPTQSMRSKTKIVEDFSGKVEDAEMWSFDGSSTEQAPGGASDCLLKPVFCLPDPDRLGTGFLVMCEVMNADGTPHRSNGRATIKDDDNDFWFGFEQEYTIFDPETKKPIGFPAEGFPGPQGPYYCSVGAGKAVGREIVEEHLELCLQAGLNVEGINAEVMMGQWEFQIFAKGAAQAGDEIWLARYLLDRTGEKYGMEINYHCKPVKGDWNGSGMHANFSNTTLRTCGSKEVYEAICQAFEPRITEHIDVYGADNDQRLTGLHETQSIDKFSYGISDRGASIRIPIATVEKGWKGWLEDRRPASNADPYMVASAIIATVKTANVPAGV

SEQ ID NO: 21231 - DNA, 1440 bp, Helicobacter hepaticus
  CDS (1)..(1440)
atgagtagagtaagcatagataaacaagcggtagcagagttttttagattctgtgatgaaaatgaagtagaatttattgatttccgttttagtgacattaaaggcgtatggcatcatttgagcttttctcgcaatgcaattaacgaagaaagctttgagggcataccttttgatggtagctctatccctgcttggcagcccgtagataaatccgatatgatgcttatccctgaacctgtgcggtatttcattgacccatttactgctgataccactgcggtagtcttttgcgatatttgggacatttacaacaataagccttatgagaaatgtccgcgctccattgttaaacgtgcaatgaaatatctcaaagaaagcggtattggcgatatcgcctactatggaccagagaatgagttttttgtatttgattctattaagattaaagattctgtgaattgtcaatattatgagatagattccgaagagggcgaatggaatcgtgcgcgtgagtttgaaggcggtgtaaatatggggcatcgtcccggcacaaaaggtgggtattttcctgtgccacctgtagattctatggtggatttacgcgctgaaatcgtcaaagtgcttaatcaagtaggattagaaactttcgtgcttcaccacgaagtcgcacaagggcaaaatgaaattggtgtgaaatttggcgatatgcttgaagcagcagataatgtacaaaaactcaaatatgttgtcaaaatggttgctcatctcaatggcaaaaccgcgacttttatgccaaagccactttatggagataatggcagtggtatgcacgtgcatattagtatttggaaagatgggcataatctctttgcaggagaagcataccaaggcttaagcgaaatggctctacatttcttaggcggtgtgcttaaacacgcacgcgcattagccgcctttacaaatcctagcacaaactcatataaacgccttataccgggatttgaagcaccaagtatcctcacttattccgcacaaaaccgctctgcaagtatcagaatcccatataatagcggcgagaaagcaaaacgaatggaatttagattcccagatagctctgcaaatccttatcttgcatttgcaagcctcttactcgcaggaattgatgggataaaaaacaaaattgacccgggcgcgcctatggaaatcaatctttttgaacttactttagatgaaattcgcgaaaaaggcattaaacaactaccacacactttgcgccacgctattgaggaaatgcttgttgataaagcatatcttaaagaaggcggtgtatttagtgaagaatttatccaaacttataaagcatataagtttgaaacagagatttggccttgggaggcacgccctcacccatttgagttccttactacttatagttgctag

SEQ ID NO: 21232 - protein, 479 aa, Helicobacter hepaticus
MSRVSIDKQAVAEFFRFCDENEVEFIDFRFSDIKGVWHHLSFSRNAINEESFEGIPFDGSSIPAWQPVDKSDMMLIPEPVRYFIDPFTADTTAVVFCDIWDIYNNKPYEKCPRSIVKRAMKYLKESGIGDIAYYGPENEFFVFDSIKIKDSVNCQYYEIDSEEGEWNRAREFEGGVNMGHRPGTKGGYFPVPPVDSMVDLRAEIVKVLNQVGLETFVLHHEVAQGQNEIGVKFGDMLEAADNVQKLKYVVKMVAHLNGKTATFMPKPLYGDNGSGMHVHISIWKDGHNLFAGEAYQGLSEMALHFLGGVLKHARALAAFTNPSTNSYKRLIPGFEAPSILTYSAQNRSASIRIPYNSGEKAKRMEFRFPDSSANPYLAFASLLLAGIDGIKNKIDPGAPMEINLFELTLDEIREKGIKQLPHTLRHAIEEMLVDKAYLKEGGVFSEEFIQTYKAYKFETEIWPWEARPHPFEFLTTYSC

SEQ ID NO: 21233 - DNA, 1811 bp, Brachydanio rerio
  CDS (122)..(1240)
gttatgaggatgagagacaaacagccaggactaccctataaaaccctctggaaatacagccactcttatagtgactatttgtactttttgataggtttgatatagcaccactagcaccaccatggccacttcagccagttccaaattaagcaaagctatgaaacagcagtacatggatctccctcagggagaaaaagttcaggtcatgtacatctggattgatggaaccggagagggattgagatgcaaaaccaggactctagactctgaacctaaatctgttgaagaacttcctgagtggaactttgatggttccagcacatatcaggctgaggggtccaacagtgacatgtatttgttccctcaagccatgttcagagaccctttcaggaaagaccccaacaaactggttctgtgcgatgttctcaaatacaaccataaacctgcagaaaccaatcttcgtcagtcctgtaagaagattatggatatggtccagaaccagcatccttggtttggaatggaacaggagtacactcttctcggcacagatggtcatccttttggttggccctccaatggcttccctggacctcaaggtccatattactgtggtgttggagctgataaggcctatggacgagatgttgtagaggcacattatagagcctgtctgtatgctggggtaaaaatctgtggcaccaatgctgaagtcatgcctgcacagtgggagttccaagttggcccttgtgaggggatcgagatgggagaccatctgtgggtcgcccgcttcctcctacacagggtttgtgaggactttggtgttgtggcctcttttgaccccaagcctattccaggcaactggaatggagccggctgccacaccaacttcagcaccaaggagatgcgcgaggaaggaggtttgaagcatattgaggagtcgattgagaagcttggcaagagacaccagtaccatatccgtgcctacgatcctaaaggagggctggacaatgccagacgtctgactggccatcacgagacctctaacattaacgagttttcggctggagtggccaaccgtggtgctagcatacgaattccacgatctgtgggtcaggaaaagaagggctatttcgaagaccgccgtccttcagccaactgtgatccatacgcagtcactgaagctcttatacgcacatgtctgctcaacgaagagggtgaagtgccagagaaatacatgtgaaagactggactgaagcgttattttaataacaaaatctatctacagactccttgtattttgaattcattagctgtctaaaatgaggtatgacactagatggatctttactccttttgttggttgtagaaacgcacattgggtcagtttatcctacaattttagctttttcactgtcggtttctttttgtgataagcttcgtaatgataccagatccggtcaaatgtctgatagagatgaacatttgcacccatcattactactacttggcctttatacctgaagctgttcagtgtattgacttgtttttaatgtcatttaattttagcttcttttttatatatatatataaactaattgtagatattttaatgcatatcatagtcagttttagacttttcacgggctataaattatggcactatttctcacaaggaccaaaatacattgtacttgtatggcgctgactgttgctcaaagggttatttcatttttgcagttccaggtttcagaaaacactattaacttgtcttattaaaagaattttattaaaatgtaaaaaaaaaaaaaaaa

SEQ ID NO: 21234 - protein, 372 aa, Brachydanio rerio
MATSASSKLSKAMKQQYMDLPQGEKVQVMYIWIDGTGEGLRCKTRTLDSEPKSVEELPEWNFDGSSTYQAEGSNSDMYLFPQAMFRDPFRKDPNKLVLCDVLKYNHKPAETNLRQSCKKIMDMVQNQHPWFGMEQEYTLLGTDGHPFGWPSNGFPGPQGPYYCGVGADKAYGRDVVEAHYRACLYAGVKICGTNAEVMPAQWEFQVGPCEGIEMGDHLWVARFLLHRVCEDFGVVASFDPKPIPGNWNGAGCHTNFSTKEMREEGGLKHIEESIEKLGKRHQYHIRAYDPKGGLDNARRLTGHHETSNINEFSAGVANRGASIRIPRSVGQEKKGYFEDRRPSANCDPYAVTEALIRTCLLNEEGEVPEKYM

SEQ ID NO: 21235 - DNA, 1029 bp, Streptomyces avermitilis
  CDS (1)..(1029)
atgaccttcaaggctgagtacatctggatcgacggcaccgagccgacggccaagctccgttcgaagacgaagatcctggcggacgatgccaagggtgccgagctgccgatctggggcttcgacgggtcctccacgaaccaggccgaggggcacgcctccgaccgcgtactcaagccggtcgccacctacccggacccgatccgcggcggcgacgacgtcctcgtcatgtgcgaggtcctgaacatcgacatgacgccgcacgagtccaacacgcgtgccacgctggccgaggtcgaggagaagttcggcgcccaggagccgatcttcggcatcgagcaggagtacaccttcttcaagggctcgcgcccgctgggcttccccgagggcggcttcccggccgcgcagggcggctactactgcggtgtcggctcggacgagatcttcggccgtgacgtcgtcgaggcgcacctggagaactgcctcaaggcgggtctgggcatctccggcatcaacgccgaggtcatgcccggccagtgggagttccaggtcggcccgctggcgccgctcgaggtctccgaccagctgtgggtggcccgctggctgctctaccgcaccgccgaggacttcggcgtctccgcgacgctggacccgaagccggtgaagggcgactggaacggcgcgggcgcgcacaccaacttctccacgaaggcgatgcgcgagggctacgacgcgatcatcaccgcgtgcgagtcgctgggcgagggctccaagccgctcgaccacgtcaagaactacggcgcgggcatcgacgaccgcctgacgggcctgcacgagaccgccccgtggaacgagtactcgtacggcgtctcgaaccgtggcgcctcggtccgtatcccgtggcaggtcgagaaggacggcaagggctacatcgaggaccgccgtccgaacgccaacgtcgacccgtacgtcgtgacgcgtctgctcgtcgacacctgctgctccgccctggagaaggccggccaggtctga

SEQ ID NO: 21236 - protein, 342 aa, Streptomyces avermitilis
MTFKAEYIWIDGTEPTAKLRSKTKILADDAKGAELPIWGFDGSSTNQAEGHASDRVLKPVATYPDPIRGGDDVLVMCEVLNIDMTPHESNTRATLAEVEEKFGAQEPIFGIEQEYTFFKGSRPLGFPEGGFPAAQGGYYCGVGSDEIFGRDVVEAHLENCLKAGLGISGINAEVMPGQWEFQVGPLAPLEVSDQLWVARWLLYRTAEDFGVSATLDPKPVKGDWNGAGAHTNFSTKAMREGYDAIITACESLGEGSKPLDHVKNYGAGIDDRLTGLHETAPWNEYSYGVSNRGASVRIPWQVEKDGKGYIEDRRPNANVDPYVVTRLLVDTCCSALEKAGQV

SEQ ID NO: 21237 - DNA, 1080 bp, Coxiella burnetii
  CDS (1)..(1080)
atgtttgctcaagttacctatatttggatggacggcgcgcagccaacccaaaagttacgatcaaaagttcggatcgtcaaacatcctgagcgagatattacgctggccgactttccagaatgggggttcgacggctcttcaacctaccaagcgacgggaaaggattccgatttgattttacaaccggtccattttgttaaagatccaatcttaggcgatggaaattacttggtgttatgtgaagtgatgaatcccgatggatctccacatgcttcaaacacccgtgcccgcttgcgccaaatcatggccaatggcgctgctgagcatgagccctggattggttttgagcaagaatacactctctttcaaggcgtccaacctctcggatggcccgatcgaggatatcccgcgcctcaaggccctttttattgcggcatcggtgcggatgaagtgtttggtcgcccgctggtggaagaacatgccaccgcttgtattgaggctgagctcatgatttttggaacgaacgccgaagtcatgccaggacaatgggagttccaaattggctatcgaggcgctgacgacgagacgcctgatcctttgacggtttctgatcatctttggttggctcgatggttgctctatcgtattggagaagattacgggatcacagcaaccctccagcctaaaccggttaaaggggattggaacggtgctggaaaacacacgaacttttctactaagttgatgcgcgaccccgccacaggccgggaagccatcgaacaggccatcgagcgattatcaaaacgtcatgacgctcatattgcggtgtacggtcatggtttagaagagcggctcacgggtaaacacgaaacggctcctattacgcaattttcttcaggcgtaggcaatcgcggcgcttccgttcgcatacctagcgcggtagcctctcggggttgtggttacttagaagatcgtcggcccggtgctaacgccgatccttaccaagtcgcggctattttgttagaaacgatttgtgggattcaattgccgaaaaacagtgggatcgaaacaaccgtttga

SEQ ID NO: 21238 - protein, 359 aa, Coxiella burnetii
MFAQVTYIWMDGAQPTQKLRSKVRIVKHPERDITLADFPEWGFDGSSTYQATGKDSDLILQPVHFVKDPILGDGNYLVLCEVMNPDGSPHASNTRARLRQIMANGAAEHEPWIGFEQEYTLFQGVQPLGWPDRGYPAPQGPFYCGIGADEVFGRPLVEEHATACIEAELMIFGTNAEVMPGQWEFQIGYRGADDETPDPLTVSDHLWLARWLLYRIGEDYGITATLQPKPVKGDWNGAGKHTNFSTKLMRDPATGREAIEQAIERLSKRHDAHIAVYGHGLEERLTGKHETAPITQFSSGVGNRGASVRIPSAVASRGCGYLEDRRPGANADPYQVAAILLETICGIQLPKNSGIETTV

SEQ ID NO: 21239 - DNA, 1659 bp, Pantoea agglomerans
  CDS (223)..(1632)
gcgctgaagatttcctgcgctcttccggcatcgctgataccgtactgtttggaccagaaccagaattcgctttatctaaatcaagcgtaaacgccagacagatgtcggttgaagagcgtgccggaagaggttggtcagggagttgttttcccgcaacgtattccggaaacgacgtttcctcgccatgtagataatgaaagaccatttccaggagagttgagtatgtccgctgaacacgttctctcgatgatgaacgagcatgaagttaagtttgttgacctgcgttttaccgataccaaaggtaaagaacagcacgttacgatccctgctcaccaggttaacgctgacttcttcgaagaaggcaaaatgttcgatggttcgtctattggcggctggaaaggcattaacgaatcagacatggtgctgatgcctgacgccaccacggcggtcatggatcctttcttcgaagattctacgctgatcatccgttgtgacatcctcgagccaggcaccatgcagggctacgaccgcgatccacgctctatcgctaagcgcgctgaagatttcctgcgctcttccggcatcgctgataccgtactgtttggaccagaaccagaattcttcctgttcgatgacatccgtttcggctcatcgacgtccggttcacacgttgctatcgacgatatcgaagcggcatggaacaccggtaaagagtacgaaggcggtaacaaaggtcaccgtccaggtctgaaaggcggctacttcccggttccaccggttgactcatcacaggacatccgttctgccatgtgtctgaccatggagcagatgggcctggttgttgaagcgcatcaccacgaagtggcgaccgcgggtcagaacgaagtggcaacccgcttcaataccatgaccaaaaaagcggacgaaattcagatttacaaatatgtggttcacaacgttgcgcatgcttacggcaaaaccgcgacctttatgccgaagcctatgtttggcgacaacggttcaggcatgcactgccatatgtcactctccaaaggtggccagaacctgtttgccggcgataagtacggcggcctgtctgaaatggcgctgttctacatcggcggtatcatcaagcacgctaaagcgatcaacgccctggcgaacccgaccaccaactcttacaagcgtctggtcccgggttacgaagcaccggttatgctggcttactctgcccgtaaccgttcagcctcaatccgtattccggttgttgccagcccgaaagcgcgtcgtatcgaagcgcgcttcccggatccagcggctaacccatacctggcgttcaccgcactgctgatggctggcctggatggcatcatcaacaaaatccatcctggcgatgcgatggacaaaaacctgtatgacctgccaccggaagaagaagctgagattccaaaagttgcaggctctctggaagaagcgctgaatgcactgaacgaagaccgcgagttcctgacccgcggcggagtattcactgacgaatcgatcgatgcttacatcgaactgcgtaaagcagagatggatcgcgttcgcatgacgccacacccggttgagttcgagctctactacagcgtttaactggtcagacgttttttgttgccgtgg

SEQ ID NO: 21240 - protein, 469 aa, Pantoea agglomerans
MSAEHVLSMMNEHEVKFVDLRFTDTKGKEQHVTIPAHQVNADFFEEGKMFDGSSIGGWKGINESDMVLMPDATTAVMDPFFEDSTLIIRCDILEPGTMQGYDRDPRSIAKRAEDFLRSSGIADTVLFGPEPEFFLFDDIRFGSSTSGSHVAIDDIEAAWNTGKEYEGGNKGHRPGLKGGYFPVPPVDSSQDIRSAMCLTMEQMGLVVEAHHHEVATAGQNEVATRFNTMTKKADEIQIYKYVVHNVAHAYGKTATFMPKPMFGDNGSGMHCHMSLSKGGQNLFAGDKYGGLSEMALFYIGGIIKHAKAINALANPTTNSYKRLVPGYEAPVMLAYSARNRSASIRIPVVASPKARRIEARFPDPAANPYLAFTALLMAGLDGIINKIHPGDAMDKNLYDLPPEEEAEIPKVAGSLEEALNALNEDREFLTRGGVFTDESIDAYIELRKAEMDRVRMTPHPVEFELYYSV

SEQ ID NO: 21241 - DNA, 1401 bp, Securigera parviflora
  CDS (99)..(1169)
gaaaacccccctatcaaaagctagaagctttcactagtgattagctaccatttgccatcctctcactgttctgctttctgcacaacaactagtttaccatgtctttgcttacagatctcgtcaacctcaacctctcggaatccacggaaaagattattgctgagtacatatgggttggtggatctggattggatatcagaagcaaagccaggactcttcctggaccggttagtgaccctgcaaaacttcccaagtggaactatgatggttctagcacagatcaagctcctggggaggatagtgaagtcatcctatatccacaagctattttcagggacccctttagaagaggcagcaacattcttgtgatttgtgatgtttacaccccagctggagagccacttccatcaagctataggtacaatgctgccaaaattttcagccacccagaggtagctgctgaggaaccttggtatggtattgagcaagagtataccttgttgcagaaagatataaattggccactaggttggccagttggtggatttcctggacaacagggcccatactactgtggtattggtgctgataaagcctatggccgtgacattgtagatgcacattacaaagcttgtctttatgctggcattaacattagtggtatcaatggagaggttatgcctggccagtgggaattccaagttggtccttccgttggtatctcagctggtgatgagatatgggctgcaagatacattcttgagagaattacagagattgctggagcagttgtttcatttgatcccaagcctattccaggagactggaatggtgctggtgctcacacaaactacagcaccaagtccatgagagaagatggaggctttgagatcatcaaaaaggccattgaaaagcttggattgaagcacaaggagcacattgcagcttatggaaaaggcaatgagagacgtctcactggcaaacatgaaacagcagacatcaacaccttctcttggggtgtggcaaaccgtggagcctcagttagagttggaagagagacagaaaaagaagggaaaggctactttgaggacaggaggcctgcttctaacatggatccatacattgtcacctccatgattgcagagactaccatcctctggaagccatgaagatgaaaatattcacagccatcgattaatttctctctagaaatttataccactacataatatatcttgtgttgttgttgttgttcctggctgttagtaattagtaatttgctatgtggtcttttgatcattagcatatggtccatgggccctgtgttctgtttcacaataatttcatcattaataacaaggactacctctgcttcttgatttcaaaaaaaaaaaaaaaaaa

SEQ ID NO: 21242 - protein, 356 aa, Securigera parviflora
MSLLTDLVNLNLSESTEKIIAEYIWVGGSGLDIRSKARTLPGPVSDPAKLPKWNYDGSSTDQAPGEDSEVILYPQAIFRDPFRRGSNILVICDVYTPAGEPLPSSYRYNAAKIFSHPEVAAEEPWYGIEQEYTLLQKDINWPLGWPVGGFPGQQGPYYCGIGADKAYGRDIVDAHYKACLYAGINISGINGEVMPGQWEFQVGPSVGISAGDEIWAARYILERITEIAGAVVSFDPKPIPGDWNGAGAHTNYSTKSMREDGGFEIIKKAIEKLGLKHKEHIAAYGKGNERRLTGKHETADINTFSWGVANRGASVRVGRETEKEGKGYFEDRRPASNMDPYIVTSMIAETTILWKP

SEQ ID NO: 21243 - DNA, 1508 bp, Securigera parviflora
  CDS (105)..(1175)
gaaaaaaagagagaagcaaaagagagagaaagaggtcattgctggttgctgtgagcgacgacgacgacgactgtgaagtcttgctgctgctgctgcttttgaagatgtcgctgctctcagatctcatcaacctcaacctctctgaaaccaccgacaagatcatcgccgagtacatatggatcggtggatcaggcctggacttgaggagcaaagcaaggaccctgccaggaccagtcagcgacccttcagaactgcccaagtggaattatgatggttccagcacaggtcgagctcctggggaagacagtgaagtgattttatacccacaggccattttcaaagatccattcagaaggggaagcaatatcttggttatctgtgatgcatacactcctgctggagaacccattcccaccaacaagagacatgctgctgccaaggtcttcagccatcctgatgttgtagctgaagtaccatggtatggtattgagcaggaatataccttgttgcagaaagaggttaactggcctcttggttggcctcttggtggtttcccaggaccacagggaccatactactgtggtactggagctgataaggctcttggccgtgatattgtggacgcacactacaaagcatgcctatatgctggtgtgagcatcagtggaattaatggagaagtgatgcctggtcagtgggaattccaagttggaccttcagtaggtatctctgctggtgatgaggtgtgggttgctcgttacgttttggagaggatcactgagattgctggtgtggtgctttcctttgaccctaagccaattaagggtgattggaatggtgctggtgcgcacacaaattacagcacaaagaccatgagagaggatggtggctatgaaatcatcaagaaggcaattgagaagttgggcttgagacacaaggagcacattgctgcttatggagaaggcaacgagcgtcgtttgacaggaagacacgagacagctgacataaacactttcttatggggagttgcaaaccgtggtgcttctattagagttggaagggacacagagaaagcagggaagggttactttgaggacagaaggcctgcatctaacatggacccatatgtggttacttccatgattgcagacacaaccattctctggaaaccatgagccacagttacaggaacatttgcttgcatgtcttcgaaagtcattgttatttctcctttggatggatcaagggagcagtttctttttcctgattaggatttggccattgctttttatttcgtctgattttattgtgttcttgttatggctggcatatggtctgaggcctgtgtgtttgcacaaactaccaaggctcattgcttgctacttctctccctcattttctttttaagtttcacaataataatgtaatggttatcagtgaaaaagatgattgtcgagtatattaataatatatatgaagttgatatgttgatgaaaaaaaaaaaaaaa

SEQ ID NO: 21244 - protein, 356 aa, Securigera parviflora
MSLLSDLINLNLSETTDKIIAEYIWIGGSGLDLRSKARTLPGPVSDPSELPKWNYDGSSTGRAPGEDSEVILYPQAIFKDPFRRGSNILVICDAYTPAGEPIPTNKRHAAAKVFSHPDVVAEVPWYGIEQEYTLLQKEVNWPLGWPLGGFPGPQGPYYCGTGADKALGRDIVDAHYKACLYAGVSISGINGEVMPGQWEFQVGPSVGISAGDEVWVARYVLERITEIAGVVLSFDPKPIKGDWNGAGAHTNYSTKTMREDGGYEIIKKAIEKLGLRHKEHIAAYGEGNERRLTGRHETADINTFLWGVANRGASIRVGRDTEKAGKGYFEDRRPASNMDPYVVTSMIADTTILWKP

SEQ ID NO: 21245 - DNA, 1313 bp, Arabidopsis thaliana
  CDS (53)..(1117)
gatcgtcttctctttccctaaacacactgattattttctctccgacgccgccatgtctctgctctcagatctcgttaacctcaacctcaccgatgccaccgggaaaatcatcgccgaatacatatggatcggtggatctggaatggatatcagaagcaaagccaggacactaccaggaccagtgactgatccatcaaagcttcccaagtggaactacgacggatccagcaccggtcaggctgctggagaagacagtgaagtcattctataccctcaggcaatattcaaggatcccttcaggaaagacaacaacatcctggtgatgtgtgatgcttacacaccagctggtgatcctattccaaccaacaagaggcacaacgctgctaagatcttcagccaccccgacgttgccaaggaggagccttggtatgggattgagcaagaatacactttgatgcaaaaggatgtgaactggccaattggttggcctgttggtggctaccctggccctcagggaccttactactgtggtgtgggagctgacaaagccattggtcgtgacattgtggatgctcactacaaggcctgtctttacgccggtattggtatttctggtatcaatggagaagtcatgccaggccagtgggagttccaagtcggccctgttgagggtattagttctggtgatcaagtctgggttgctcgataccttctcgagaggatcactgagatctctggtgtaattgtcagcttcgacccgaaaccagtcccgggtgactggaatggagctggagctcactgcaactacagcactaagacaatgagaaacgatggaggattagaagtgatcaagaaagcgatagggaagcttcagctgaaacacaaagaacacattgctgcttacggtgaaggaaacgagcgtcgtctcactggaaagcacgaaaccgcagacatcaacacattctcttggggagtcgcgaaccgtggagcgtcagtgagagtgggacgtgacacagagaaggaaggtaaagggtacttcgaagacagaaggccagcttctaacatggatccttacgttgtcacctccatgatcgctgagacgaccatactcggttgatgacacatttcatgatttgatttctctccaatttggttttttttttttcccttttgattgcacttttcgataataaaaaaataattcttattatgggcgtattgttgtgacattttgtgttttgtttcgaataattaaataagcgcttcttaaggtgaaaataaaaaaaaaaaaaaaaaagaaaaaaaaaaaaaaa

SEQ ID NO: 21246 - protein, 354 aa, Arabidopsis thaliana
MSLLSDLVNLNLTDATGKIIAEYIWIGGSGMDIRSKARTLPGPVTDPSKLPKWNYDGSSTGQAAGEDSEVILYPQAIFKDPFRKDNNILVMCDAYTPAGDPIPTNKRHNAAKIFSHPDVAKEEPWYGIEQEYTLMQKDVNWPIGWPVGGYPGPQGPYYCGVGADKAIGRDIVDAHYKACLYAGIGISGINGEVMPGQWEFQVGPVEGISSGDQVWVARYLLERITEISGVIVSFDPKPVPGDWNGAGAHCNYSTKTMRNDGGLEVIKKAIGKLQLKHKEHIAAYGEGNERRLTGKHETADINTFSWGVANRGASVRVGRDTEKEGKGYFEDRRPASNMDPYVVTSMIAETTILG

SEQ ID NO: 21247 - DNA, 1263 bp, Opsanus beta
  CDS (33)..(1154)
cggcttcagacagaaaccttcacacagagacgatggcctcttcggtgtctgtcagctctcgcctcaacaaggcggtgctgcagcggtacctgagcctgccgcagcaaggaaaaacccaggtcacctacatctggatcgacggcaccggagagggacttcgaagcaagacacgaactctggatagcgagccaaaaagtgtagaagacattcctgagtggaactttgacggttccagtacgtaccaggccgaaggctccaacagtgatatgtacctcatcccagtgtgcatgttcaaagatccgtttacacttgaccccaacaaactggtcctctgcgaagtcctcaaatacaaccgcttacctgcagaaactaaccatcgcaacagctgcaacaaagtgatggaggcagtgaaggagcagcatttgtggtttggcatggagcaggagtacacgctgtttggtacagatggacatccctatgggtggcccgccaatggattcccggcaccacaaggcccctactactgtagcgtgggtgccaacaatgcttacgggcgtgacgtagtggagtgccactacaaggcgtgcctgtatgcaggaatcaaaatctacggcacaaatgctgaggtcatgccagctcagtgggagttccagatcggcccctgtgagggcatcgagatgggcgaccacctgtgggtggcgcgtttcttgttgcatcgagtgtgtgaagattttggcatcatcgccaccatggaccccaaaccaatgaaggggaactggaacggtgctggctgtcacacaaatgtgagcaccaaagagatgagggaggagggaggactgcaatacatcgagcaggccatcgagaagttgagtaaaaatcatgccgagcacatctgcatgtatgacccccataagggccaggataacatcagaaggctcacggggatccacgagacctccagcatccatgacttctctgctggcgtggccaaccgaggtgccagtatccgcatccctcggcatgtggggcaggagaaacgaggttactttgaggaccgccgccctgctgcaaactgtgacccgtacgccgtcaccaaggtcatcgcaagcacctgtattctcagcactgacaataatacacagtcccagcaataaaaaatgaaggtcaaaccatggtctgtagcaaacttgttttcggtgtttgataaagtataaagagagctgtttgggaaaaaaaaaaaaaaaaaaaaaaaaaaaaaaaaaa

SEQ ID NO: 21248 - protein, 373 aa, Opsanus beta
MASSVSVSSRLNKAVLQRYLSLPQQGKTQVTYIWIDGTGEGLRSKTRTLDSEPKSVEDIPEWNFDGSSTYQAEGSNSDMYLIPVCMFKDPFTLDPNKLVLCEVLKYNRLPAETNHRNSCNKVMEAVKEQHLWFGMEQEYTLFGTDGHPYGWPANGFPAPQGPYYCSVGANNAYGRDVVECHYKACLYAGIKIYGTNAEVMPAQWEFQIGPCEGIEMGDHLWVARFLLHRVCEDFGIIATMDPKPMKGNWNGAGCHTNVSTKEMREEGGLQYIEQAIEKLSKNHAEHICMYDPHKGQDNIRRLTGIHETSSIHDFSAGVANRGASIRIPRHVGQEKRGYFEDRRPAANCDPYAVTKVIASTCILSTDNNTQSQQ

SEQ ID NO: 21249 - DNA, 1434 bp, Yersinia pestis
  CDS (1)..(1434)
atgacaaatccgggagatataagtatgtccgctgaacatgttttgacgatgctgaatgagcacgaagtgaaatttgttgatttacgtttcactgataccaaagggaaagagcagcacatcacgatccctgctcatcaagtcaacgctgacttcttcgaagaaggcaaaatgtttgatggctcctcgattggtggctggaaaggcattaacgaatccgacatggtactgatgccagacgccagcactgccgttatggacccgttcttcgcagattcaacactgattatccgttgtgacattcttgagccaggcaccatgcagggctatgaccgcgatccacgttctatctccaaacgtgctgaagacttcctgaaatcttcaggtatcgctgataccgtgttgttcgggccagaaccagaattcttcctgtttgacgatatccgttttggtagcagcatcaatgggtcacacgtatccatcgatgacgtcgaaggcgcatggaactccagcaccaaatacgaaggcggcaacaaaggccaccgtcctgcagtaaaaggcggttacttccctgttcctccggtcgactctgcacaagacctccgttctgccatgtgtctgacgatggaagagatgggcttggtggtagaagcacaccaccacgaagtggctaccgcgggtcaaaacgaagtggctacccgcttcaataccatgaccaagaaagcagatgagatccagatttacaaatacgtcgtacacaacgtggcgcacgcatttggtaaaacagcgacctttatgccaaaaccgatgttcggcgataacggctcaggtatgcactgccatatgtctttgtccaagaacggtaataacctgttcgctggcgacaaatacggcggcctgtctgaaatcgccctgttctacatcggcggtatcatcaaacatgcgaaagccattaatgccttggctaacccgaccaccaactcctacaagcgtctggtcccaggttatgaagcaccggtcatgctggcatattcagcccgtaaccgttcagcttctatccgtattcctgttgttgccagcccgaaagctcgtcgtattgaagcgcgtttccccgatcctgcggctaacccgtacctgtgcttcgccgcgctgttgatggctggccttgatggcatcatcaacaaaattcacccaggtgatgcgatggacaaaaacctgtatgacttgccgccggaagaagaagctgagattccaaaagttgccggttcactggacgaagccatggccgcattgaacgaagatcgcgagttcctgactcgtggtggcgtgttcaccgatgatgctatcgatgcgtatatcgagctacgtagagaagaaatggatcgcgtgcgtatgactccgcatcctgttgagttcgaactgtattacagcgtttaa

SEQ ID NO: 21250 - protein, 477 aa, Yersinia pestis
MTNPGDISMSAEHVLTMLNEHEVKFVDLRFTDTKGKEQHITIPAHQVNADFFEEGKMFDGSSIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHAFGKTATFMPKPMFGDNGSGMHCHMSLSKNGNNLFAGDKYGGLSEIALFYIGGIIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEAMAALNEDREFLTRGGVFTDDAIDAYIELRREEMDRVRMTPHPVEFELYYSV

SEQ ID NO: 21251 - DNA, 1338 bp, Bifidobacterium longum
  CDS (1)..(1338)
atggataaacagcaggagtttgcgctgcgcacggtcgaagaacgcgacgtgcgctttattcgtctgtggttcacggacgtgttgggaacactgaagtccgtggcgattgctccggccgaactggaagccgcgtttgaggagggtctcggcttcgacggttccgccatcgagggcatgacccgcgtgtccgaagacgatatgatcgttcaacccgatccctcgacgttccagatcctgccgtggcgcggtggcccgcaaggtaccgcccgcatgttctgcgacattctgaccccggacggcgagccttcgctcggcgatccacgtcacgtgttgaagcgcacgctcgccaaagccaaggacaagggcttcacgttctacgtgcatccggaaatcgagttctacctgttcgaaagccaggacgactggtccaaggccccgaccccgatcgacgagggcggctacttcgaccacgtgccgcgcagcccaggcatggacttccgccgtgccaccgtgaacatgctcgagcaaatgggcatctcggtggaatactcgcaccatgaggcggggccaggccagaacgagatcgatctgcgatacgcggacgcgctcaccatggccgacaacatcatgacattccgtacggtggtcaaggagatttccttggagcgtggcattcacgccagcttcatgcccaagcccctggccgacgcgcccggttccggcatgcacacgcacctgagcctgttcgaaggcgattccaacgccttctacgaggccggtcaggagttcaacatgtccctgaccgcccgccagttcgccgccggcatcctgtaccatgcggccgaaatctgcgcggtcaccgaccagtacgtcaactcgtacaagcgcctgtggggcggtaacgaggcaccaagctacatctgctggggccacaacaaccgttccgcgctgctgcgtatcccgcagtacaagccgggcaagggcaactccgcgcgcatggagttccgtgcgctcgacccggtggccaacccataccttgcctactcggtgctgctggccgccggtctcgacggtatcgataagcagatgcagttgggcgagcctaccagtgatgacgtgtgggagctcaccgacggcgaacgtcaggctatgggcattcagccgctgccgcgctcgctggacgaggcgctgaagatcatggagaaatccgacttcgtggccgacgtgctcggcgaacacgccttcggctacttcctggacaacaagcaccaggaatgggaggagtacaaccagcaggtcacgccttacgagctgaagaagtatctgccgaagctgtaa

SEQ ID NO: 21252 - protein, 445 aa, Bifidobacterium longum
MDKQQEFALRTVEERDVRFIRLWFTDVLGTLKSVAIAPAELEAAFEEGLGFDGSAIEGMTRVSEDDMIVQPDPSTFQILPWRGGPQGTARMFCDILTPDGEPSLGDPRHVLKRTLAKAKDKGFTFYVHPEIEFYLFESQDDWSKAPTPIDEGGYFDHVPRSPGMDFRRATVNMLEQMGISVEYSHHEAGPGQNEIDLRYADALTMADNIMTFRTVVKEISLERGIHASFMPKPLADAPGSGMHTHLSLFEGDSNAFYEAGQEFNMSLTARQFAAGILYHAAEICAVTDQYVNSYKRLWGGNEAPSYICWGHNNRSALLRIPQYKPGKGNSARMEFRALDPVANPYLAYSVLLAAGLDGIDKQMQLGEPTSDDVWELTDGERQAMGIQPLPRSLDEALKIMEKSDFVADVLGEHAFGYFLDNKHQEWEEYNQQVTPYELKKYLPKL

SEQ ID NO: 21253 - DNA, 2681 bp, Acetobacter diazotrophicus
  CDS (832)..(2292)
gcgccgacatgacggtgaagatcgtcgtcggcaggccggacagcatgctgttcagcgatttcatgaacatccttccttcggacccgtcctgtgggcccttccctgctgcgatccgtgctgcaatccgccggccatgcgcagatgtgcgtaaaatgccggccttttgcaatccgatccgattgcccgaaagcgcaacccgtgcaacggtgtcaggtacgggcggcccgcggcgcccacgggatcgggcgggcggcccgggcgtgtgcacatcgctgccccgggatttcggggctgcccggggacatgacgacgcggcatgaaaaagatcgaggccatcatcaagcccttcaagctggacgaggtgaaggacgcccttcacgagatcggcctgatgggcatcacggtgaccgaggccaagggattcggccgccagaaaggccacaccgaactgtatcgcggcgccgaatacatcgtcgatttcctgccgaaggtgaagctggagatcgtctgcgccgacaacttggtggaccgcgccgtcgagacgatcatggccgccgcgcgcaccgggcgcatcggtgacggcaagatcttcatcctgccggtggaagacgtcatccgcatccgcaccggagagcacggcgaggaggccatctgacccgccgcgccaccatccccttcccggccgacggagaccggtgcccccgtggacaccggcatgcttccgatagccggtgccggggtccgtatgtcctatcgacaacggcgccccagtctcgtaaccgtttcaccgccgtgtcgttcggcatcccaagttaaggcaggtaatcagcaatggcgaaaaaagccccgagttcagctccgaccacgactccgtccccatcggcggaggctgttgccaaggtattcagcctgatccaggaacattccgtggaactggtggacctgcgcttcacggacccgcgcggcaagtggcaccacaccacgcagcatatctcgacgatcgagcaggacacgttccgcgacggcttcatgttcgacggatcgtccatcgtcggctggaaggccatcaacgagagcgacatggtgctgctgcccgacccgacgacggcggtcatggacccgttctcggcgaagccgcagctgatcctgatctgcgacatcatcgagccctcgaccgggcagttctacaaccgcgacccccgcgccaccgccaagctggccgaggcctacctgaagtccaccggcctgggcgacacggcgtttttcggtccggaagccgaattcttcgtcttcgacagcgtcaagttcggcacgggcccgaatttcggcatctaccagcttgacagcatcgaggggcccggcgcctcgctgaaggactatcccgagggcaacatgggccatcgcccgacggtgaagggcggctatttccccgtcccgccggtcgacagcgaaaacgacctgcgcgccgagatgctgtccacgatgggcgagatgggcctgccgatcgaaaagcatcaccacgaggtcgcgcagtcgcagcacgagttgggcaccaagttcgcgacgctggtgaagtccgccgacttcatgcagatctacaaatactgcgtgcacaacgtcgcccattcctacggcaagtccgcgacgttcatgccgaagccgatctatggcgacaacggatcgggcatgcacgtccaccagtcgatctggaagagcggcaagccggtcttcgccggcaacggctatgccgacctgtcggaccaggcgctgtattacatcggcggcatcatcaagcacgccaaggcgctgaacgccttcaccaacccgtcgaccaattcctacaagcgcctgatcccgggcttcgaggcgccggtgctgctggcctattcggcgcgcaaccgctcggcgtcctgccgcatcccgtatgcgaccagcccgaaggccaagcgcgtcgaggtccgcttccccgacccgaccgccaacccctacctggcgttcgcggccatgctgatggccggcctggacggcatcaagaacaagatccatccgggcgacgccatggacaaggatctgtacgacctgccgcccgacgagctgaagcagatcccgaccgtctgcggatcgctgcgcgaggcgctggaggccctgacggccgatcatgagttcctgctggccggcggcgtgttcaccaaggaccagatcgagagctatatcgacatcaagtggcaggaagtgttcaagttcgaacacaccccgcacccggccgagttcgagatgtactactccgtctgatcccggcgggattgacgaaaaaagggggcgccggaccgattgggtccggcgcccctttttcgttcggcacgccctcagacgcgggcgtggagacgaccctcacccgccagttcgcggcgagtacggtccagttcctcgctatagcggcgcagggcgtgctgttcggtcagcagtcccagcaccatgcgggattccatgccatcgaccaccaccagcgcgtcgctttccgcctgttcgaaacgggcgatcgcgtcgcgcaggttcatctgcggcatcagcatcacgtcgcgatactgggcgaagcgggtcaggtcctcggtcgcacgcgccgtttcggcatacaggtcgggcacctgcaccaatccgacatagcggcccgcgccgtcgac

SEQ ID NO: 21254 - protein, 486 aa, Acetobacter diazotrophicus
MAKKAPSSAPTTTPSPSAEAVAKVFSLIQEHSVELVDLRFTDPRGKWHHTTQHISTIEQDTFRDGFMFDGSSIVGWKAINESDMVLLPDPTTAVMDPFSAKPQLILICDIIEPSTGQFYNRDPRATAKLAEAYLKSTGLGDTAFFGPEAEFFVFDSVKFGTGPNFGIYQLDSIEGPGASLKDYPEGNMGHRPTVKGGYFPVPPVDSENDLRAEMLSTMGEMGLPIEKHHHEVAQSQHELGTKFATLVKSADFMQIYKYCVHNVAHSYGKSATFMPKPIYGDNGSGMHVHQSIWKSGKPVFAGNGYADLSDQALYYIGGIIKHAKALNAFTNPSTNSYKRLIPGFEAPVLLAYSARNRSASCRIPYATSPKAKRVEVRFPDPTANPYLAFAAMLMAGLDGIKNKIHPGDAMDKDLYDLPPDELKQIPTVCGSLREALEALTADHEFLLAGGVFTKDQIESYIDIKWQEVFKFEHTPHPAEFEMYYSV

SEQ ID NO: 21255 - DNA, 1640 bp, Crataegus crus
  CDS (85)..(1383)
atctctctctctcactctcataagctctgagtggttccagccaagttgcagcgctcttctgtcttcagtgaggagtaggccgaaatggcgcagattttggcacccacttcacaatggcggatgaaagttacaaggagctcagcaactgccagtcctatgacagcaaagatgtggggttctcttgtgttgaaacagaacaagaaaggaccagctcggagctctactaaatttagagtgctcgccaccaagtccgaaggttataccataaacaggctagagggtttactaaacctggacctcactccattcactgacaagattattgccgagtacatttggattggagggtcaggcgttgatgtccgtagcaagtcaaggacaatttcaaagcctgttgaggatccttctgagcttcccaagtggaattatgatggatcaagtaccggacaagcgcccggtgaagacagtgaagtaatcttataccctcaggcaatatttaaggaccctttccgtggtggcaacaatattttggtaatttgcgatgcatacacaccgcaaggcgagcctatcccaacaaacaagcgcgccagggctgctgagattttcaagaacaagaaggttatagacgaagtcccatggtatgggattgagcaagagtacacattactccaaaccgatgtgaaatggcctttgggatggccaattggaggttatcctggtcctcagggtccctactactgtggtgctggtgcagacaagtcattcggccgtgacatatcagatgctcactacaaggcttgcctatatgccggaatcaacatcagtggcaccaatggggaggttatgcctggccagtgggagtatcaagttggtccgagtgtgggaattgaagctggagatcatatctgggcttcaagatacattcttgagagaatcactgaacaagctggtgttgttctcacacttgatccaaaaccgatagagggtgactggaacggtgcagggtgccacaccaattacagtacaaagagcatgagggaagatggaggctttgaagttattaagaaggcaattttgaacctgtcacttcgccatgttgagcacattagtgcctacggagaaggaaatgagagaaggttgacaggaaagcatgaaacagccagcattaacacattttcttggggagtggctaatcgtggttgctcaatccgtgttggtcgtgaaactgagaagcaaggaaaaggttatctggaggatcgtcgtccagcttcaaacatggacccttacattgtgacctcgctgctggcagaaactacattgttgtgggagccaacccttgaggctgaagctcttgcagctcaaaagcttgcattgaacgtctgaaaccaattcgtcgaagataatccactggggcttcaaatgctgtcaattgggacaaaacagccaaatgtgggaagcattttccctcaccttttaaatccttttgagaagatcctttgtaaataaaggtcctatcgtcagtgattgttcatgattcatcccatgctcaactttgtagaatatttgctcgtatcgaagaaattaatcgtgtagatcggagagccttaattgaatcaaaaaaaaaaaaaaaaaaaaaaaaa

SEQ ID NO: 21256 - protein, 432 aa, Crataegus crus
MAQILAPTSQWRMKVTRSSATASPMTAKMWGSLVLKQNKKGPARSSTKFRVLATKSEGYTINRLEGLLNLDLTPFTDKIIAEYIWIGGSGVDVRSKSRTISKPVEDPSELPKWNYDGSSTGQAPGEDSEVILYPQAIFKDPFRGGNNILVICDAYTPQGEPIPTNKRARAAEIFKNKKVIDEVPWYGIEQEYTLLQTDVKWPLGWPIGGYPGPQGPYYCGAGADKSFGRDISDAHYKACLYAGINISGTNGEVMPGQWEYQVGPSVGIEAGDHIWASRYILERITEQAGVVLTLDPKPIEGDWNGAGCHTNYSTKSMREDGGFEVIKKAILNLSLRHVEHISAYGEGNERRLTGKHETASINTFSWGVANRGCSIRVGRETEKQGKGYLEDRRPASNMDPYIVTSLLAETTLLWEPTLEAEALAAQKLALNV

SEQ ID NO: 21257 - DNA, 1340 bp, Phytophthora infestans
  CDS (56)..(1129)
agtggacgtcccagttccagcctcttcaagcttcaactccattctaccaaacatcatgagccagcttgaccgcgccgtttacgaccagtacatgtccctcgacgtgtctgagagcgtcacgctcgccgagtacgtctggatcggcggttcgggccaggacctgcgctgcaagaccaagacgctgaccaagcccgtcaagtcggtggccgacctgcccatctggaacttcgatggctccagcacgggccaggctcccggcgaggactcggaggtgctgctgcgtcccgtggccatcttcaaggatccgttccgtcgcggccagcacatcttggtgctgtgcgactgcctgaagcccgacatgacgcccatcgccaacaacacgcgtgctgacgctgctcgtgtcatgaaggctgctgagggcgaggagccgtggttcggtattgagcaggagtacactctgttcgagaaggacggcgtgaccccgtacggctggccgaagggaggtttccctggtccgcagggtccgtactactgcggtgccggtgcgcactcggtgttcggccgtatcattgtggacgctcactaccgcgcatcgctgtacgctggcatcaacatctctggcatcaacgccgaggtgatgcctggccagtgggagtaccaggtgggtccgtgcacgggcattgagtctggcgaccacctgtggatgtctcgctacattctgctgcgtgtgtgcgaggactttggcgtgaacgtgtcgtgggacccgaagccgatccctggcgactggaacggcgctggctgccacaccaactactcgaccaaggcgatgcgtgaggagggcggcatggccaagatcatcgaggccatcgagaagatgaagctgaagcacaaggagcacattgcggcgtacggcacgggcaacgagcgtcgtctgacgggccgccacgagacggccagcatggacacgttctcgtacggcgtggccaaccgtggtgcgtcgatccgcattccgcgtgtggcggaggccgagggcaagggctacttcgaggaccgtcgcccagcgtccaacatggacccgtacgtggtgactggccgcatcatcaagacgacgatcttgaacgaggcataagtctcaaggttaaagtggtagatttcgactggtagcgggttgcagctgctgcttccagagcagagctgcccgtagctattgtgaccgcgatcgcttctctttgttttgtcgtggaggagtgagtagcggtgtttcctatatatgcttagtgagagaagaaaaatacagaacttcctatgatagcttaaaaaaaaaaaaaaaaaaaaaaaaa

SEQ ID NO: 21258 - protein, 357 aa, Phytophthora infestans
MSQLDRAVYDQYMSLDVSESVTLAEYVWIGGSGQDLRCKTKTLTKPVKSVADLPIWNFDGSSTGQAPGEDSEVLLRPVAIFKDPFRRGQHILVLCDCLKPDMTPIANNTRADAARVMKAAEGEEPWFGIEQEYTLFEKDGVTPYGWPKGGFPGPQGPYYCGAGAHSVFGRIIVDAHYRASLYAGINISGINAEVMPGQWEYQVGPCTGIESGDHLWMSRYILLRVCEDFGVNVSWDPKPIPGDWNGAGCHTNYSTKAMREEGGMAKIIEAIEKMKLKHKEHIAAYGTGNERRLTGRHETASMDTFSYGVANRGASIRIPRVAEAEGKGYFEDRRPASNMDPYVVTGRIIKTTILNEA

SEQ ID NO: 21259 - DNA, 1369 bp, Canis familiaris
  CDS (248)..(1369)
agagccgagaatgggagcggaggggagcttctgagcagcgccccggcctcctctcctcgccgcacctcgctctcgcggcccgcccgcccgccctgctgcctgcgacccgcccagaaagctccggtgtatggaccagcgggagcccgagagcctggagaggcgcgaacgcgactccaaacggagaagggccagggaaggcaatcccaacgacccgattgaccttctgtggctgggaacaacttccaccatggccacctctgcgagttcccacttgaacaaaggcatcaagcaggtgtacatgtccctgcctcagggcgagaaagtgcaagctatgtatatttggattgacgggactggagaaggattacgttgcaagacccggaccttggacagtgagcccaagggtgttgaagagttgcctgaatggaattttgatggctctagcacctttcagtctgaaggctccaacagtgacatgtatcttgtccctgctgccatgtttcgcgaccctttccgcaaggaccccaacaagctggtattctgtgaagtcttcaaatacaacagaaagcctgcagaaaccaatttaaggcatacctgtaaacggataatggacatggtgagcaaccaacacccctggtttggaatggagcaggaatatactctcatgggcacagatggtcacccttttggttggccttccaatggcttccctgggccccaaggtccgtactactgtggtgtaggagcagacaaagcctatggcagggatatcgtggaggctcactaccgggcctgcttgtatgctggcatcaagattgctgggacaaacgctgaggtcatgcctgcccagtgggaattccagataggaccctgtgaaggaatcgacatgggagatcatctctgggtggcccgtttcatcttgcatcgtgtatgtgaagacttcggagtgatagcaacctttgatcctaagcccattcccggaaactggaatggtgcaggctgccacaccaacttcagcaccaaggccatgcgagaggagaatggtctaaagtacattgaggagtccattgaaaaactgagcaagcggcaccagtaccacatccgagcctacgatcccaagggaggcctggataatgcccggcgcctaactggattccatgagacatccaacatcaacgacttttctgccggcgtggccaaccgtggtgctagcatccgcattccccggactgtcggccaggagaagaagggttactttgaagaccgtcgcccctctgccaactgcgaccccttttcggtgacagaagccctcatccgcacatgtcttctcaacgaaactggcgatgaacccttccagtacaaaaactaa

SEQ ID NO: 21260 - protein, 373 aa, Canis familiaris
MATSASSHLNKGIKQVYMSLPQGEKVQAMYIWIDGTGEGLRCKTRTLDSEPKGVEELPEWNFDGSSTFQSEGSNSDMYLVPAAMFRDPFRKDPNKLVFCEVFKYNRKPAETNLRHTCKRIMDMVSNQHPWFGMEQEYTLMGTDGHPFGWPSNGFPGPQGPYYCGVGADKAYGRDIVEAHYRACLYAGIKIAGTNAEVMPAQWEFQIGPCEGIDMGDHLWVARFILHRVCEDFGVIATFDPKPIPGNWNGAGCHTNFSTKAMREENGLKYIEESIEKLSKRHQYHIRAYDPKGGLDNARRLTGFHETSNINDFSAGVANRGASIRIPRTVGQEKKGYFEDRRPSANCDPFSVTEALIRTCLLNETGDEPFQYKN

SEQ ID NO: 21261 - DNA, 1905 bp, Homo sapiens
  CDS (644)..(1765)
ggcttccaatgtgaccgaacaatggagagcccgggcctcggcgcagtcagtggagaagccggtccgggcggaggcagcagcagcgcgcagtccctacggcctgcgcccccaccctcccccggaccccccaacccctcggcggcagggtatggccacctccgtgaggccctgagattcggacgggggcccgaggggcagggcgcccactttagggacatttcagtgggaaggggctgctctcaaagtggataattataactccctcgggggcgggaagcggggatcctcccccagccgcaagtccacgaagaaagcaacgaatgaaaattatgaagacgagaagtcagcctcctccgggtcgcgctccagctgcttcggcttcgtcgcctactctgtgaactccggggagagatctcgagtcaagattaagaccttaacccaccaacctgcctgttcggacaccccccgggccggccgctgtctgtccccttctccatcgccctctcccaggaagctccggtgcttggaccagctagagtctgagaaagaggagaggcgcgaacgccactccaaaaagagaagggttaaagagggcaaccctaacgatacgcttgactttctgtggctgggaacaccttccaccatgaccacctcagcaagttaccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcacagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatccgaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccaaaaaaaaaaaaaaaa

SEQ ID NO: 21262 - protein, 373 aa, Homo sapiens [sequence omitted]

SEQ ID NO: 21263 - DNA, 1520 bp, Oncorhynchus mykiss
  CDS (7)..(1122)
aataatatggctacgtcctccagcgcagaactgagtaaggctgtcaaacagcagtacatggacctccctcagggagacaaagtccaaatcatgtatgtctggatcgatggaaccggagagggactccgctgtaagaccagaacgctggattcggagcccaagtgcattgaagaactgcctgaatggaactttgatggctctagcacctaccagtctgagggctcaaacagtgatatgtatttgattccttctgcaatgttcagagatcctttccgcaaagaccccaacaaactggtcctgtgtgaagtgctgaagtacaaccgcaaacctgcagaaaccaaccttcgtttgacgtgtaataaagttatggacatggttgagaaccaggtcccttggtttggcatggagcaagagtacaccattttgggcacggatggacacccatttggctggcccaacaacggcttccctggcccacaaggtccctattactgtggagtgggatctgacaaggcctacggtagagatattgtggaagcccactacaaagcctgcctgtatgctggggtcatgatctgtggaaccaatgctgaagtcatgcctgcacagtgggagttccaggttggcccttgtgaaggcatcagcatgggtgatcacctttgggcagctaggttcattctccaccgggtgtgtgaggactttggtgtggtggcctcatttgaccccaagcccatccctggaaactggaacggcgctggatgccacaccaatttcagcacaaaagagatgagggaagagggtgggttgaaggccattgaggagtccattgaaaggctggggaagaggcatagctaccacatccgtgcctatgaccctaaagggggacttgacaatgcccgtcgccttaccggccaccatgaaacctccaacatccacgagttctctgccggtgtggccaaccgcggtgccagcatccgcatccctcgcactgtgggccaggagaagaagggctacttcgaggaccgccgcccatctgccaactgtgacccgtacgccgtgactgaggctataatccgcacctgtttgcttagcgaggaaggagatgaacctgtgaactactagatctaactagagccacacctctggactgaatccccttcgccaccacccttctccattctcattttctaaatggctgaaaagttgaactagtactgtatttgttgtaatttttcactgaaattattctaaccttctaaatggcttaaagttggctggtcaacttaacatggaattaaatctgtttaacataaaaacaaacatttaatgaaagatggtggctgacagggcattgtcttccccttttgagtcttctagtggggagtataactgtttttaaatccccatttgatctcgcgtttcctgcagtctgtcgaactgaaataaactaaagcacatgtggacactgacgactatggctgggcggcatgtgtaattgtcttaataaaacctattttgct

SEQ ID NO: 21264 - protein, 371 aa, Oncorhynchus mykiss
MATSSSAELSKAVKQQYMDLPQGDKVQIMYVWIDGTGEGLRCKTRTLDSEPKCIEELPEWNFDGSSTYQSEGSNSDMYLIPSAMFRDPFRKDPNKLVLCEVLKYNRKPAETNLRLTCNKVMDMVENQVPWFGMEQEYTILGTDGHPFGWPNNGFPGPQGPYYCGVGSDKAYGRDIVEAHYKACLYAGVMICGTNAEVMPAQWEFQVGPCEGISMGDHLWAARFILHRVCEDFGVVASFDPKPIPGNWNGAGCHTNFSTKEMREEGGLKAIEESIERLGKRHSYHIRAYDPKGGLDNARRLTGHHETSNIHEFSAGVANRGASIRIPRTVGQEKKGYFEDRRPSANCDPYAVTEAIIRTCLLSEEGDEPVNY

SEQ ID NO: 21265 - DNA, 1840 bp, Oncorhynchus mykiss
  CDS (76)..(1191)
attatattggacttgccagtcctttaaattttatttaaaatttctcgtatttccaggtgttttataacaaacaagatggctatgtccgccagcgccgaactaagtaaggctgttaaacagcagtacatggaactccctcagggagacaaagtccaagtcatgtatgtctggatcgatggaaccggagagggactccgctgcaaaaccagaacgctggattcggagcccaagagcatcgaagaactgccggaatggaactttgatggctccagcacctaccagtctgagggctcaaacagtgatatgtatttgattccttctgcaatgttcagagatcccttccgcaaagaccccaacaaattggtattgtgtgaagtgctgaagtacaaccacaagcctgcagaaaccaaccttcgtttgacttgtaagaaagtcatggacctggttgagaaccagatcccttggtttggcatggagcaagagtacacaatcctaggcactgatggacacccatttggctggcccaacaacggcttccctggcccacaaggtccctattattgtggagtgggatctgacaaggcctatggtagagatattgtggaagcccactatagagcctgtctgtatgctggggtcatgatctgtggcaccaatgctgaagtaatgcctgcacagtgggagttccaggttggtccttgtgaaggcatcaccatgggtgatcacctctgggtggctcgcttcatcctccaccgggtgtgtgaggactttggcgtggtggcctcatttgaccccaagcctatccctgggaactggaacggtgctggctgccacaccaatttcagcaccaaagagatgcgggaagaaggcgggttaaaggccattgaggagtccattgagaggctggggaggaggcatagctaccacatccgtgcctacgaccctaaaggggggcttgacaacgcccgtcgcctcaccggccaccatgaaacctccaatatccacgagttctctgctggcgtagccaaccgtggcgccagtatccgcatccctcgcaccgtgggccaggagaagaagggctactttgaggaccgccgcccgtcggccaactgcgacccgtatgccgtgacggaggctctgatccgcacctgtttgctcagcgaggagggagatgaacctgtggactattagacccaacgagatccactgctctctggacttagtccccttccccctcaccctcatttttttttttaatggctgaaaagtcaaactagtactgtatttgtcattttttttattttccactgaaatgattctaaccttgcatttttatgtagcttaaagttggctggtcaacttaacatggaattaaatctggtgttaacatatgggggggagggaaagagtgtctgacagggtattgtctttcccctctcgtgttggttgttttctagtggggagtatttgtaatgtaactgtttaagtcctcatttggtctctttccctgcagtctgttgaactgaaatgctctaaagaacatattgacactgaagactagggctgggtggcatgtgtcactttcttaataaaacctatggctagtttgtgtactttgtatgttgacctgccttttaaactatgtactgtttcaatgttaactaactaggcagtgtctttaaatggcaacatttctgtctccagatttgacacattcctggatcatgttgtctggtacattctttagatgtctggctctaaacactgtcttttacatttggctcagtcttgccaattgtagcgttcctgtaagactcatgaaggagttttatcccttttt

SEQ ID NO: 21266 - protein, 371 aa, Oncorhynchus mykiss
MAMSASAELSKAVKQQYMELPQGDKVQVMYVWIDGTGEGLRCKTRTLDSEPKSIEELPEWNFDGSSTYQSEGSNSDMYLIPSAMFRDPFRKDPNKLVLCEVLKYNHKPAETNLRLTCKKVMDLVENQIPWFGMEQEYTILGTDGHPFGWPNNGFPGPQGPYYCGVGSDKAYGRDIVEAHYRACLYAGVMICGTNAEVMPAQWEFQVGPCEGITMGDHLWVARFILHRVCEDFGVVASFDPKPIPGNWNGAGCHTNFSTKEMREEGGLKAIEESIERLGRRHSYHIRAYDPKGGLDNARRLTGHHETSNIHEFSAGVANRGASIRIPRTVGQEKKGYFEDRRPSANCDPYAVTEALIRTCLLSEEGDEPVDY

SEQ ID NO: 21267 - DNA, 1681 bp, Oncorhynchus mykiss
  CDS (160)..(1281)
tcatatctctcttttataaatggaaccgttaggacaaattttgcggtagagaatgaaacaaaaacatttggaattacacagaacatttacagaaggctgtaccaggcttttgatcctaattccttacttgatataaggttttccagggctcattgaaaaatggccacgtcagagagtgccagtttgagtaaaactgtgaagcagcattatatggacctttctcagggagacaaggtccaggccatgtacatctggatagatgggactggagaggggctccgctgcaagaccagaactctggattctgaacccaagaacattgatgatctcccagagtggaactttgatggttccagtacgtaccagtcggagggctccaacagcgatatgtaccttatccctgctgccatgttcagggaccccttcaggaaagaccccaacaaactggtcctgtgtgaagtgctcaaatacaaccgcaagcctacagaaactaacctcaggctgatgtgtaagaagatcatggagatggtagagaaccaggtgccgtggtttggcatggaacaggagtacaccatcctgggaacagacggacatccgtttggctggccttccaacggcttccctggtccacaaggcccctactactgtggtgtgggagcagacaaggcgtatggtagagacatcgtagaagcccactatagagcttgtctttatgctggggttaagatatgtggcaccaatgctgaagtcatgccagctcagtgggagttccaggttgggccatgtgaaggtatcaacatgggtgaccacctctgggctgctcggttcatcctccaccgggtgtgtgaagactttggcgtggtggcctcattcgaccccaagcccatccctgggaattggaacggcgctggctgccatacaaacttcagcaccaaggagatgagagaagatggcggattgaggggcatcgaagattcgattgagaagttgggaaggagacaccgctaccacatccgtgcctacgaccccaaaggggggctggacaacgcccggcgcttgaccggtcaccacgaaacatccaacatccacgagttctctgccggcgtggcaaaccgcggcgccagcatccgcataccccgctcggtgggtcaggacaagaagggctacttcgaggaccgccgtccatctgctaactgcgacccatatgcagtcacggaagcgctgatacgcacatgtttgctcagtgaagagggggaggagcctaaagaatacagcaaatgaactagatactcttttggtctgaaataatccccctcctgtcctattgcgctacatctcaagtgtcattccaagtactgttttgtctgtggctttgtaaaccccttgcatattgcaagtcttgaccatccatgtatggcttgctttttaacccttttcatgggagaatcttcggtatattctgcagtctgtgttcagggtagagtagatccctaccttttgatcactgccaacattgccctttttaattgatgctatggacttaacaattccagacagatgtctgttggagggatacatgttttctatatataggtctacttctagttgtgtatcaatttgctactcataatattgtttaacatgatttactaaccaagatgctgtagatttttgattgggg

SEQ ID NO: 21268 - protein, 373 aa, Oncorhynchus mykiss
MATSESASLSKTVKQHYMDLSQGDKVQAMYIWIDGTGEGLRCKTRTLDSEPKNIDDLPEWNFDGSSTYQSEGSNSDMYLIPAAMFRDPFRKDPNKLVLCEVLKYNRKPTETNLRLMCKKIMEMVENQVPWFGMEQEYTILGTDGHPFGWPSNGFPGPQGPYYCGVGADKAYGRDIVEAHYRACLYAGVKICGTNAEVMPAQWEFQVGPCEGINMGDHLWAARFILHRVCEDFGVVASFDPKPIPGNWNGAGCHTNFSTKEMREDGGLRGIEDSIEKLGRRHRYHIRAYDPKGGLDNARRLTGHHETSNIHEFSAGVANRGASIRIPRSVGQDKKGYFEDRRPSANCDPYAVTEALIRTCLLSEEGEEPKEYSK

SEQ ID NO: 21269 - DNA, 1926 bp, Oreochromis niloticus
  CDS (94)..(1209)
gagacatcattcagcaacacattggacctgccagtcctttagtttttatttcaattttctcgtttctccaggtgtattatagtagcaaataagatggctacatccgccagcgccagcttgagtaaagctgtcaagcagcagtacatggagctccctcagggggacaaagtccaggccatgtacatctggatcgacggaaccggagaggggctccgatgcaaaaccaggacgcttgattctgagcccaaaagcatcgaagatcttcctgaatggaactttgacggatccagtacctaccagtccgaaggctccaacagcgacatgtatctgatcccctcagccatgttccgcgatccattccgcaaagaccccaacaagctggtgctgtgtgaagtcctgaagtacaaccgtaaacctacagaaaccaaccttcggctcacctgtaagaaagtgatggatatggtggcggatcagcatccttggtttggcatggagcaggagtacaccatccttggaacggacgggcatccatttggctggccatctaatggtttccccggaccacaggggccgtactactgtggtgttggagctgacaaagcctatggcagggacgtagtcgaggcccattacaaagcttgtttgtacgctggagtccagatttgtggcacaaatgctgaagtaatgcctgctcagtgggagttccaggtcggaccttgcgaaggcattgacatgggcgatcatttgtgggtagcgcgcttcatcctgcaccgtgtctgtgaggattttggcgtcgtcgcctcatttgatcccaagccaatccctggaaactggaacggtgctggctgccatacaaacttcagcacgaaagagatgagggaagacggtggattgaaagctattgaggattccattgagaagcttggaaagaggcacagctaccacattcgtgcctacgaccccaaaggggggctcgacaacgcccgccgtctcactggccgccatgaaacctcaaacatcaacgaattctctgctggtgtggccaaccgtggtgccagcattcgcattcctcgtaatgttggtcaggagaagaaaggctacttcgaagaccgtcgcccttcagccaactgtgacccgtacagtgtgaccgaggccctgatccgcacctgtctgctgaacgaggaaggagatgaacccgcggattactaaatccacaactgactcccactgtcctccctaatttcttttaaactagtatttttttttttttttttttttccttttctccctctgagatgattttaacccacatttttaatggcttaaagttgactggtcaactgaaaacatgacaaaggtgttacatccttggtagttgtgagctggtcatggcagggtatgcctttcccctcatctttagcagggatcggcttttgtaacactgttttgtaacccatgtcatatcattcccttttttgtcagtgactaaaacgaactaaagcacatggacactgcagagtagcgctgctaagactggacagcatttgtaattgaataaatctgactagttcgtgtactgttaatatgttgaactgcctttcaactatccagtcttcaatgttactaattctgtcgttttatcaagtgtctacttttaaatggcaacatttgtcttcagagttttgacacactgggtcatctttgtattgtacacttcgtagaggtctgtacccagatgtaagttgtgcaaatgtggtggatctgtccgtaatgccatttgtagatttcctcaaggagttttatccttttgttaactgcaatattgtaatgcacctgatttggtaaaacattacatttactgaacatggtgatttttattgaaacatttaaaacttttatttttatcaaaaaaaaaaaaaaaaaaaa

SEQ ID NO: 21270 - protein, 371 aa, Oreochromis niloticus
MATSASASLSKAVKQQYMELPQGDKVQAMYIWIDGTGEGLRCKTRTLDSEPKSIEDLPEWNFDGSSTYQSEGSNSDMYLIPSAMFRDPFRKDPNKLVLCEVLKYNRKPTETNLRLTCKKVMDMVADQHPWFGMEQEYTILGTDGHPFGWPSNGFPGPQGPYYCGVGADKAYGRDVVEAHYKACLYAGVQICGTNAEVMPAQWEFQVGPCEGIDMGDHLWVARFILHRVCEDFGVVASFDPKPIPGNWNGAGCHTNFSTKEMREDGGLKAIEDSIEKLGKRHSYHIRAYDPKGGLDNARRLTGRHETSNINEFSAGVANRGASIRIPRNVGQEKKGYFEDRRPSANCDPYSVTEALIRTCLLNEEGDEPADY

SEQ ID NO: 21271 - DNA, 1429 bp, Arabidopsis thaliana
  CDS (91)..(1161)
atcatctcattaacaaaaataaaacacacaatctcaagattttctacttcttattacaaagattcaatcttcttgtttcttcttgcaaccatgagtcttcttgcagatcttgttaaccttgacatctcagacaacagtgaaaagatcatcgctgaatacatatgggttggtggttctggtatggacatgagaagcaaagccaggactctccctggacctgtgaccgatccatcaaaacttccaaagtggaactatgatggttcaagcactggtcaagctcctggtcaagacagtgaagtgatcttataccctcaagcaattttcaaagatccattccgtagaggcaacaacatccttgttatgtgtgatgcttacactccagcgggagagccaatccctactaacaagcgacatgctgcggctgagatctttgctaaccctgatgttattgctgaagtgccatggtatggaatcgaacaagaatacactttgttgcagaaggatgtgaactggcctcttggatggcccattggtggcttccctggccctcagggaccatactactgcagtattggagctgacaaatcttttggaagagacattgttgatgctcactacaaagcctctttgtatgctggaatcaacatcagtgggatcaatggagaagtcatgccgggacaatgggagttccaagtcggcccatcggtcggtatctcagctgctgatgaaatatggatcgctcgttacattttggagaggatcacagagattgctggtgtggttgtatcttttgacccaaaacctattcctggtgactggaatggagctggtgctcacaccaattacagtactaaatcaatgagggaagaaggaggatacgagataatcaagaaggcgatcgagaagcttggcttgagacacaaggaacacatttccgcttacggtgaaggaaacgagcttcgtctcacgggacaccatgaaactgctgacatcaacactttcctttggggtgttgcgaaccgtggtgcatcgatccgagtaggacgtgacaccgagaaagaagggaagggatactttgaggataggaggccagcttcaaacatggacccttacgttgttacttccatgattgcagagactacactcctctggaacccttgaaaggatgatccgtaactcttgaagctgcttctgattgggttttttggaagttccaagcttgtcttttctctacagtgtgtattaagcaattgtaccggttgacactgccggagtttgtgatttggggcctttctttctttttcttctttttataatcttttgggttctgtggttagagcaaattcggtttgctctgtttgtttgacctttattgaaacctttggtatttgtactaataatacaatctgaaaaggcctcttcatgttcc

SEQ ID NO: 21272 - protein, 356 aa, Arabidopsis thaliana
MSLLADLVNLDISDNSEKIIAEYIWVGGSGMDMRSKARTLPGPVTDPSKLPKWNYDGSSTGQAPGQDSEVILYPQAIFKDPFRRGNNILVMCDAYTPAGEPIPTNKRHAAAEIFANPDVIAEVPWYGIEQEYTLLQKDVNWPLGWPIGGFPGPQGPYYCSIGADKSFGRDIVDAHYKASLYAGINISGINGEVMPGQWEFQVGPSVGISAADEIWIARYILERITEIAGVVVSFDPKPIPGDWNGAGAHTNYSTKSMREEGGYEIIKKAIEKLGLRHKEHISAYGEGNELRLTGHHETADINTFLWGVANRGASIRVGRDTEKEGKGYFEDRRPASNMDPYVVTSMIAETTLLWNP

SEQ ID NO: 21273 - DNA, 1356 bp, Oryza sativa
  CDS (1)..(1356)
atggcgcaggcggtggtgccggcgatgcagtgccaggtcggggccgtgcgggcgaggccggcggcggctgcggcggcggcgggggggagggtgtggggagtcaggaggaccgggcgcggcacgtcggggttcagggtgatggccgtgagcacggagaccaccggggtggtgacgcggatggagcagctgctcaacatggacaccacccccttcaccgacaagatcatcgccgagtacatctgggttggaggaactggaattgacctcagaagcaaatcaaggacaatatcaaaaccagtggaggacccctcggagctaccaaaatggaactacgatggatcaagcacagggcaagctccaggagaagatagtgaagtcatcttatacccacaggctatattcaaggacccatttcgaggtggcaacaacatattggttatgtgtgatacctacacaccagctggggaacccatccctactaacaaacgtaacagggctgcacaagtattcagtgatccaaaggttgtcagccaagtgccatggtttggaatagaacaggagtacactttgctccagagagacgtaaactggcctcttggctggcccgttggaggctaccctgggccccagggtccatactactgcgctgtaggatcggacaaatcgtttggccgtgacatatcagatgctcactacaaggcatgtctttatgctggaattaacattagtggaacaaatggagaggtcatgcctggtcagtgggagtaccaggttggacctagtgtcggtattgaagctggagaccacatatggatttcaagatatattcttgagagaataacggagcaggctggtgtagtgcttacccttgaccccaaaccaattcaggcggattctgtaatttgttttgttattagactacgtttaatacttcaaatcaccaagagtatgcgtgaagatggaggatttgaggtgatcaagaaggcaatcctaaacctatcacttcgccatgacttgcatataagtgcatatggtgaaggaaatgaaaggaggttgacaggtttacacgagacagctagcattgacaatttctcatggggtgtggcaaaccgtggatgctctattcgggtggggcgagacaccgaggcgaagggaaaaggctacttggaagaccgtcgcccggcatcaaacatggacccgtacgtcgtgacagcgctattggctgaaaccacaattctttgggagccaaccctcgaagcggaggttcttgctgctaagaagttggccctgaagtttctagaaaaccacgccaccttccattcgccagttaacattttggttgaacaccacacttga

SEQ ID NO: 21274 - protein, 451 aa, Oryza sativa
MAQAVVPAMQCQVGAVRARPAAAAAAAGGRVWGVRRTGRGTSGFRVMAVSTETTGVVTRMEQLLNMDTTPFTDKIIAEYIWVGGTGIDLRSKSRTISKPVEDPSELPKWNYDGSSTGQAPGEDSEVILYPQAIFKDPFRGGNNILVMCDTYTPAGEPIPTNKRNRAAQVFSDPKVVSQVPWFGIEQEYTLLQRDVNWPLGWPVGGYPGPQGPYYCAVGSDKSFGRDISDAHYKACLYAGINISGTNGEVMPGQWEYQVGPSVGIEAGDHIWISRYILERITEQAGVVLTLDPKPIQADSVICFVIRLRLILQITKSMREDGGFEVIKKAILNLSLRHDLHISAYGEGNERRLTGLHETASIDNFSWGVANRGCSIRVGRDTEAKGKGYLEDRRPASNMDPYVVTALLAETTILWEPTLEAEVLAAKKLALKFLENHATFHSPVNILVEHHT

SEQ ID NO: 21275 - DNA, 1544 bp, Bostrychus sinensis
  CDS (90)..(1205)
catcacaacacaagacattggacctgtcagtcctttagtttttatttgtatttccttgtacatccaggtgtgttatagtagcggtgaagatggccacatccgccagctccagtttgagtaaagctgtgaagcagcagtacatggagctgccccagggggataaggtgcaggccatgtacatctggatagacggcactggagaggggctccgctgcaaaacgaggacactagacagtgagcctaaaagcattgaagatctgcctgagtggaacttcgatggctcaagcacatatcaagcagaagactccaacagtgacatgtacctgattcctgctgctatgttccgtgacccttttcgcaaagaccccaacaaactggtcctgtgtgaagtgctgaagtataaccgaaaacctgcagaaaccaacctcagaattacatgtaaaaagctgatggatatggtggcagaccagcacccctggtttggcatggaacaagagtacactattttggggactgatggacacccctttggatggccatctaatggattccctggaccacaaggtccatactactgtggtgtgggagcagacaaggcttatggcagagacattgtggaggcacattacagagcctgcctctatgctggagtgcagatttgtggcacaaatgcagaagtgatgccagctcagtgggagttccaggtggggccttgcgagggcattaacatgggtgatcatctctgggcggcccgcttcatcctgcaccgtgtgtgtgaagactttggagttgttgcctcatttgaccccaagcccatccctggaaactggaatggtgctggctgccatacaaacttcagcacaaaagagatgagggaagaaggcggcctaaaagccattgaggagtctattgaaagacttggaaagaggcaccgctaccacatccgtgcctatgatcccaaaggcgggctcgacaacgcccgccgcctcacgggccaccacgaaacctcaaacatcaatgaattctccgcaggcgtggccaatcgtggtgccagcatccgcattcctcgcagtgttggtcaggagaagaagggctactttgaagaccgccgtccctctgtcaactgtgacccatatggtgtcactgaggccctgatccgtacctgtttgctgggtgaggagggggatgaacccacggattactaaactataactcatggactgactcctaatgcccttctggcttctcttaaaaaaaaataatagtactgtatttctcccactgagattattttaacctgcattttaatggctaaagttggctggtcaacttaaacatgtcaaggtagtcacatctttagtagttgtgagctggtaatggcagggtatgtctttcccttcatctttagatgggattggcctttgtaacggttttctagcttgtgttctttccttttttgtttgactaaaatgaactaaaagcacatggacactgaaaagtagagctgctacagctggaaagcatgtgtaacaaaataaatgatt

SEQ ID NO: 21276 - protein, 371 aa, Bostrychus sinensis
MATSASSSLSKAVKQQYMELPQGDKVQAMYIWIDGTGEGLRCKTRTLDSEPKSIEDLPEWNFDGSSTYQAEDSNSDMYLIPAAMFRDPFRKDPNKLVLCEVLKYNRKPAETNLRITCKKLMDMVADQHPWFGMEQEYTILGTDGHPFGWPSNGFPGPQGPYYCGVGADKAYGRDIVEAHYRACLYAGVQICGTNAEVMPAQWEFQVGPCEGINMGDHLWAARFILHRVCEDFGVVASFDPKPIPGNWNGAGCHTNFSTKEMREEGGLKAIEESIERLGKRHRYHIRAYDPKGGLDNARRLTGHHETSNINEFSAGVANRGASIRIPRSVGQEKKGYFEDRRPSVNCDPYGVTEALIRTCLLGEEGDEPTDY

SEQ ID NO: 21277 - DNA, 1696 bp, Lotus japonicus
  CDS (147)..(1439): n means a or g or c or t/u, s means g or c
gcgtccgatatctatctcacacgagtctctcctactactattcttcacactctgcctcagggtctctgactcatacacggggcgcattttcacttgaacttagttcaagtttgcatctttagccatttttccactctctactgaacatggcacagattttggcaccctcgacgcaatggcagacgagaatcaccaaaacctctcccaatgcaagtcccattacatcaaacatgtggagttctttattgtggaaacaaaacaagaaagttgcacgtgcttctaagtttagagtactggcaatcaagtctgatggtagcaccatcaacaggctagagggtctgcttaatttggatgtcactccatacactgataagttcattgctgagtacatctggattggggggactggtgtcgatgttcgcagtaaatcaagaactatatcgaagcctgtttcacatccctctgagctccctaaatggaactatgatggatctagcactgggcaggcaccgggcgatgatagtgaagtaattctatatcctcaagcaattttcagagatcctttccgtggtggtaacaatattttggttatttgcgatgcttacacaccacaaggtgagcctatccctacaaacaagcggcacagagctgctgaaatcttcagtaacccaaaggttcaagctgaaattccatggtatggaatagaacaagagtacaccctacttcaaacggatgtgaagtggcctttgggatggcctgttggcggctatcctggtcctcagggtccctattactgtgctgccggggctgataagtcattcggacgtgatatatctgatgctcattacaaggcttgcttgtatgctggaatcaacatcagtggcaccaatggggaggttatgcctgggcagtgggagtatcaagttggtcctantgtaggtattgaagctggtgatcatatctgggcttcaaggtacctccttgagagaatcactgnacaagctggtgttgtcctcactcttgatccaaaaccaattgagggtgactggaacggtgccggagcccacaccaattacagcacaaagagcatgagggaagagggaggctttgaggtaatcaagaaggcaattttgaatctatcccttcgccaccaggaccatattcgtgcttatggagaaggaaatgagagacgattgacgggaaagcatgaaacagccgacattaacacattttcttggggagtggctaaccggggttgctcaatccgtgtgggaagagacacagagaaggaaggaaaaggttacttggaagacaggcgccctgcttcaaacatggatccatatgttgtgacagcattgctggcagagactaccttgttgtgggaaccaactctagaggctgaagctcttgcagctcagaagatacaattgaaggtctaaatctattgattgatggcattcttgatggagagcacgtacactttccttttagattatctacattctgaagatcttgtttggacaaaagaggctcctatgcccagttattgattgtcaaatgaaatgtgcactgtatatcataaattctgttggttatgtttgcatctggacaaacattgatgcttggttatatttcagtgttccttcggatttgaaaaaaaaaaaaaaaaaaaaaaaaaaaaaaaaaaaaaaaaaaa

SEQ ID NO: 21278 - protein, 430 aa, Lotus japonicus
  Xaa in position 263 and 284 is unknown
MAQILAPSTQWQTRITKTSPNASPITSNMWSSLLWKQNKKVARASKFRVLAIKSDGSTINRLEGLLNLDVTPYTDKFIAEYIWIGGTGVDVRSKSRTISKPVSHPSELPKWNYDGSSTGQAPGDDSEVILYPQAIFRDPFRGGNNILVICDAYTPQGEPIPTNKRHRAAEIFSNPKVQAEIPWYGIEQEYTLLQTDVKWPLGWPVGGYPGPQGPYYCAAGADKSFGRDISDAHYKACLYAGINISGTNGEVMPGQWEYQVGPXVGIEAGDHIWASRYLLERITXQAGVVLTLDPKPIEGDWNGAGAHTNYSTKSMREEGGFEVIKKAILNLSLRHQDHIRAYGEGNERRLTGKHETADINTFSWGVANRGCSIRVGRDTEKEGKGYLEDRRPASNMDPYVVTALLAETTLLWEPTLEAEALAAQKIQLKV

SEQ ID NO: 21279 - DNA, 1233 bp, Gelidium crinale
  CDS (66)..(1121): n means a or g or c or t/u, s means g or c
tcgtctctatctctttatcacttttcttttcagattcgtacatccacttttgatcttatttcaatatggaaaaatctttcgatcaacttttaagtctcaacgtagatgaaggatgtattgttgaatacgtctggattgatggatatgatgctgttcgttctaaaggtcgttatcttaagaatattccatcaaaagcttccgatttacctgattggaattatgatggtagttcaactaatcaagcaagtggtgaagattcagaagtaattattaaacctcaacgtatttttccagatccatttcgtggaaaaccaaatcttcttgttatgtgtgatacttatactccaaatggtgaacctttaaaaacaaatactcgttttgaatgtgaacgtattatgaatcaagcaaaagatttaaaaccttggtttggtttagaacaagaatattttctaattaatcctaatactggtaaacctttaggatttcctaatgataaagatcctgaaccacaaggtccatattattgtggtgtatctggatctaaaatgtttggtagagatattgctgatgcacattttaaagcttgtgtatatgcaggtattaaaatttcaggtattaatgcagaagttgcacctggacaatgggaatttcaagtaggtccatgtgttggtattgaagaaggtgatgaattatggatgggaagatatttattacaaagaattgctgaaatgaaaggtttggatgttaattatgatcctaaacctgttaaaggtgattggaatggttctggttgtcattctaatttttctactaaacctatgcgtgaaaaagatggttatcaaaatgctattatacctgcattagaaaaattgagtaagaaacataaagaacatattgcagcttatggtattggtaatgaagatcgacttactggaaaacatgaaactgctagtattgaacaatttaaatggggtgtagctgatcgtggtgcttcatgtcgtgttggtcatgatgtagaaaagaaaggttatggatattttgaagatagacgtcctgctggtaattgtgatccttatgttgttactatgatgcttgttaagacttgttgtcttgaagattagataagaaaatgctttcttgaaagaattgatagccttaagaaaacttgaggattcttctctaccatatcttcctttgtaatacgtttaataaacaaattgaatttattaccnt

SEQ ID NO: 21280 - protein, 351 aa, Gelidium crinale
MEKSFDQLLSLNVDEGCIVEYVWIDGYDAVRSKGRYLKNIPSKASDLPDWNYDGSSTNQASGEDSEVIIKPQRIFPDPFRGKPNLLVMCDTYTPNGEPLKTNTRFECERIMNQAKDLKPWFGLEQEYFLINPNTGKPLGFPNDKDPEPQGPYYCGVSGSKMFGRDIADAHFKACVYAGIKISGINAEVAPGQWEFQVGPCVGIEEGDELWMGRYLLQRIAEMKGLDVNYDPKPVKGDWNGSGCHSNFSTKPMREKDGYQNAIIPALEKLSKKHKEHIAAYGIGNEDRLTGKHETASIEQFKWGVADRGASCRVGHDVEKKGYGYFEDRRPAGNCDPYVVTMMLVKTCCLED

SEQ ID NO: 21281 - DNA, 1338 bp, Vitis vinifera
  CDS (27)..(1097)
ctgtgtcttattctttctattccaccatgtctctcctcgctgatctccaaaacatcaacctcagtgactccacggagaagattatcgccgaatacatatggatcggcggatccggaaatgatttgaggagtaaagcaaggaccctctccggtccggtcactggcccagcgcaactgccgaagtggaactacgatggatccagcaccggccaggctcccggcgaagacagtgaagtcattttataccctcaggcgatctttaaggatcccttcagaggaggagacaatattctggtcatgtgcgatgcctacactccagggggcgaaccaatcccgacaaacaagagattcaatgctgccaagatttttagccatcctgaagtgaccgccgaggagccttggtatggcattgagcaagaatatactcttcttcagaaggacgtcaactggccgcttggatggccagtcggcggcttccctggccctcagggcattatctactgtggaattggggctgacaaggcctttggtcgtgacatagtagattctcactacaaggcatgcctgtatgctggaatcaacatttctggaatcaatggagaggtcatgcctgggcagtgggaattccaagttgggcctgcagttgggatctctgctggtgatgaattatgggttgcccggtacattctggagaggattaccgaaattgctggagttgtcgtttcattcgacccaaaacctatcaagggagactggaatggtgctggagctcacaccaactatagcacgaaatccatgaggaatactggtggatatgatgtgattaaaaaggcaattgaaaagttgggtttgcgccacaaggagcatatttcagcttatggagagggtaatgagagaagattgacaggtcgccatgaaacagctgacatcaacactttctgttggggagttgccaacagaggtgcctctatccgtgttggccgtgacactgaaaaagaaggaaaaggttactttgaagacagaagacctgcttccaacatggatccaatcgttgtcacttccatgatcgccgagaccaccatcctctggaagccttaacaaggaaagtggaatatagaaattgattgaaggaaaaccagtatggtcagatttcaataaataattgtgttaattcctatttctgctgctttgaattgatgggttgcttgtcaaacttgggtttccttttggctttggtggaaagttctcatctgttgaactctctgtttaaagtactgctatattctgccttcgaatgttgacgttatgaagtggtatgtatgccttctcaattcaaaaa

SEQ ID NO: 21282 - protein, 356 aa, Vitis vinifera
MSLLADLQNINLSDSTEKIIAEYIWIGGSGNDLRSKARTLSGPVTGPAQLPKWNYDGSSTGQAPGEDSEVILYPQAIFKDPFRGGDNILVMCDAYTPGGEPIPTNKRFNAAKIFSHPEVTAEEPWYGIEQEYTLLQKDVNWPLGWPVGGFPGPQGIIYCGIGADKAFGRDIVDSHYKACLYAGINISGINGEVMPGQWEFQVGPAVGISAGDELWVARYILERITEIAGVVVSFDPKPIKGDWNGAGAHTNYSTKSMRNTGGYDVIKKAIEKLGLRHKEHISAYGEGNERRLTGRHETADINTFCWGVANRGASIRVGRDTEKEGKGYFEDRRPASNMDPIVVTSMIAETTILWKP

SEQ ID NO: 21283 - DNA, 1557 bp, Populus alba x Populus tremula
  CDS (114)..(1184)
acactgtactccttaaagctttcaggccctggccccagctagacaccactgctaacacaggcaggttgaagagctagaagaagagaagagttgcctattattactgtgtggacatgtcacttctcacggacctaattaaccttaagctctctgacattactgacaagataattgcggaatatatctggattggaggctcaggtatggatatgagaagtaaagccagaacgctctcaggcccagttacggatccagcacaactacctaagtggaattacgacggctctagtaccggccaagcaccaggcgaggatagcgaggtaatactttatcctcaagcgatctttaaagacccgttcagaagaggtaataacattctcgttatgtgcgacgcgtatactccgcaaggcgaacctatcccgaccaataagaggtatgccgctgcgaagatatttagctcaccagaggttgctgctgaggaaccatggtatggaatcgaacaggagtatacattacttcaaagggacgtcaactggccgataggttggcctgtcggaggctatccaggaccgcaaggtccttattactgcggtatcggcgccgataaggcgtatgggcgagacattgttgatgctcactataaagcttgcctatacgcaggtattaatatcagtggcatcaacggtgaggttatgcctggacaatgggagttccaggtgggcccgtcagtaggcatctctgctggtgatcatatttgggctgcacgatatatattggaaagaatcactgaacaagctggcgtggtactctccttcgacccgaagcctatcaaaggcgattggaacggagcaggtgcgcatactaattacagcacgaagtcgatgagagaggacggtggatacgaagttattaagaaggcgatcgaaaagttaggtctcagacataaggagcatatcagtgcgtacggagagggtaacgagcgtcggcttacaggtagacacgagacagccgatattaatacgttctcatggggagtagcgaatcgaggtgcgtctatccgagtcggtcgtgatacagagaaggagggtaaaggctactttgaagatagaagaccagcgtcgaatatggacccgtacgtggtcacgtcgatgatcgctgagactacgattctatggaagccgtaagcaagttcatgctggcaataactaaaaatttgaaacacctttgtttttacgctgtgtctgtcccagtgtacaaagaactgtgaatcagtcccaacttgaactccatgtccaatcaacttgctctttgatatgaaattttactattgtttgctcagttcgagtttgtatgcatcattgtccgaggtgtagcttggttgatttattgcatcagatcgattctttgcatatgacttcattctcctagatgcaggttaatataataaaacgccctaatacaatatcattagaatcatgcgttacctgacagatccctctagttagtacgctcgaatactactaggtatggtaaaaaaaaaaaaaaaaaaaaaaaaaa

SEQ ID NO: 21284 - protein, 356 aa, Populus alba x Populus tremula
MSLLTDLINLKLSDITDKIIAEYIWIGGSGMDMRSKARTLSGPVTDPAQLPKWNYDGSSTGQAPGEDSEVILYPQAIFKDPFRRGNNILVMCDAYTPQGEPIPTNKRYAAAKIFSSPEVAAEEPWYGIEQEYTLLQRDVNWPIGWPVGGYPGPQGPYYCGIGADKAYGRDIVDAHYKACLYAGINISGINGEVMPGQWEFQVGPSVGISAGDHIWAARYILERITEQAGVVLSFDPKPIKGDWNGAGAHTNYSTKSMREDGGYEVIKKAIEKLGLRHKEHISAYGEGNERRLTGRHETADINTFSWGVANRGASIRVGRDTEKEGKGYFEDRRPASNMDPYVVTSMIAETTILWKP

SEQ ID NO: 21285 - DNA, 1541 bp, Glycine max
  CDS (30)..(1328)
ccactgtttattgagaacaactgcagaacatggcacagattttggctccctctacgcaatggcagatgagaatctcaaaatcctctcccaatgcaagtcccattacatcaaacatgtggagttctttattgtggaaacaaaataagaaagtttcacccacaagttctgctaaatttagagtgatggcaattaagtctgacaatagcatcatcaacaggctagagggtctacttaatttggatatcactccattcacggacaagataattgctgagtacatttggattggggggacaggaattgatgtgcgcagtaaatcaagaacaatatcaaagcctgttgaacatccctctgagctccctaaatggaactatgatggatctagcactggacaggcaccgggtgatgatagtgaagtaatcctatatcctcaagcaattttcaaagatccgttccgtggtggtaacaatattttggtcatttgcgattcttacaccccacaaggtgagcctatccctacaaacaagagacacagagctgctgaaattttcagtaacccaaaggtccaagcagaagttccatggtatggaatagaacaagagtacaccttacttcaaacaaatgtgaaatggccattaggttggcccgttggtggctatcctggtcctcagggtccttattattgcagcgctggggcagacaagtcatttggacgtgacatatctgatgctcattacaaggcttgcttatatgctggaattaacatcagtggtacgattggagaggtgatgcctggtcagtgggagtaccaagttggtcctagtgtaggtattgaggctggtgatcatatctgggcttcaaggtacatcctcgagagaattactgagcaagctggtgttgtgctctctcttgatccaaaaccaatagagggtgactggaatggagcaggatgccacaccaattacagtacaaagagcatgagggaagatggaggctttgaggtaataaagaaggcaattttgaatctatcgctacgccacaaggatcacatcagtgcatatggagaaggaaatgagagaaggttgacaggaaagcatgagacagcaagcattaacacattttcttggggagtggctaaccgtggttgctcaatccgtgtgggaagagacacagagaagaatggcaaaggttacttggaagacaggcgaccgacttcaaacatggatccatatgttgcgacatcattacttgcagagactacactattgtgggagccaactctggaggctgaagctcttgcagctcagaagttagcattgaaggtctaaacctattgaatgatggcattctggatgcaaaatcactttccttttagattatctatatgtattctaatgatcttgtttggactaaagaggttgccatgcccagttattggttatcatatgaaatgcacattgtatatcagaagtttggttggtactacttgcttcaggacaaattttctttgatgcttggttaaaaaaaaaaaaaaaaaaaaa

SEQ ID NO: 21286 - protein, 432 aa, Glycine max
MAQILAPSTQWQMRISKSSPNASPITSNMWSSLLWKQNKKVSPTSSAKFRVMAIKSDNSIINRLEGLLNLDITPFTDKIIAEYIWIGGTGIDVRSKSRTISKPVEHPSELPKWNYDGSSTGQAPGDDSEVILYPQAIFKDPFRGGNNILVICDSYTPQGEPIPTNKRHRAAEIFSNPKVQAEVPWYGIEQEYTLLQTNVKWPLGWPVGGYPGPQGPYYCSAGADKSFGRDISDAHYKACLYAGINISGTIGEVMPGQWEYQVGPSVGIEAGDHIWASRYILERITEQAGVVLSLDPKPIEGDWNGAGCHTNYSTKSMREDGGFEVIKKAILNLSLRHKDHISAYGEGNERRLTGKHETASINTFSWGVANRGCSIRVGRDTEKNGKGYLEDRRPTSNMDPYVATSLLAETTLLWEPTLEAEALAAQKLALKV

SEQ ID NO: 21287 - DNA, 1410 bp, Rhizobium loti
  CDS (1)..(1410)
atgacgacagccaaagacatcatgaagcagatcaaggacaacgacgtgaaattcgtcgacctgcgcttcaccgacccgaagggcaagctgcagcacgtaacgatggatgtcgtcgaggtcgaggaagacatgttcgccgatggtgtcatgttcgacggctcctcgattgccggctggaaggccatcaacgagtccgacatggtgctcatgcccgatccggacacggtccacatggatccgttcttcgcgcagtcgaccatggtcatcctgtgcgacatcctcgatccggtctcgggcgaatcctacaaccgcgacccgcgcggcacggccaagaaggccgaagcctacatgaagtcggaaggcatcggcgaccagatcttcgtcggcccggaagccgaattcttcgtcttcgatgacgtcaagtacaaggccgacccgtacaacaccggcttcaagctcgactccaccgaactgccgtcaaacgacgacaccgactacgagaccggcaatctcggccatcgcccgcgcatcaagggcggctatttcccggtgccgccgatcgacagcgcgcaggacatgcgctccgagatgctgaccgtgctcgcggaaatgggcgtgcgcgtcgaaaagcatcaccacgaagtcgccgccgcgcagcacgaactcggcatcaagttcgacacgctggtccgcaacgccgacaagatgctgatctacaagtatgtcgtgcaccaggtcgccaacgcctatggcaagacggccaccttcatgccgaagcccatcttcggcgacaatggctcgggcatgcacgtccaccagtcgatctggaagggcggcaagccgaccttcgccggcaatgaatatgccggcctgtcggaaagctgcctgttctacatcggcggcatcatcaagcacgccaaggcgatcaacgcgttcaccaacccgctgacgaactcctacaagcgcctggtgcccggctatgaagcgccggtgctgctcgcctattccgcgcgcaaccgttcggcctcctgccgcatcccgttcggctcgtcgccgaaggccaagcgcgtcgaggtccgcttccccgatccgggcgcgaacccgtacctcgccttcgcagccatgctgatggccggcctcgacggcatcaagaacaagatccaccccggccagccgatggacaaggatctctacgacctgccgccgaaggagttgaagaagatcccgaccgtctgcggctcgctgcgtgaagctctccagagcctcgataaggatcgcggcttcctgaaggccggcggcgtcttcgacgacgaccagatcgacagctacatcgaactgaagatggccgaggtgatgcgctttgaaatgaccccgcatccggtggaatacgacatgtactattcggtgtaa

SEQ ID NO: 21288 - protein, 469 aa, Rhizobium loti
MTTAKDIMKQIKDNDVKFVDLRFTDPKGKLQHVTMDVVEVEEDMFADGVMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPDPGANPYLAFAAMLMAGLDGIKNKIHPGQPMDKDLYDLPPKELKKIPTVCGSLREALQSLDKDRGFLKAGGVFDDDQIDSYIELKMAEVMRFEMTPHPVEYDMYYSV

SEQ ID NO: 21289 - DNA, 1041 bp, Rhizobium loti
  CDS (1)..(1041)
atgacgaaatacaagctcgagtacatttggctcgatggttacaccccggtccccaaccttcgcggcaagacgcagatcaaggaattcgccgaattcccgacgctcgaacagctgccgctgtggggcttcgacggttcctcgaccatgcaggccgaaggccgcagctccgattgcgtgttgaagccggtggcgctttacccggatccggcccgcaccaacggcattctcgtcatgtgcgaggtcatgatgcccgacggcgtcaccccgcatgaatcgaacagccgcgcgaccatcctcgacgacgaggacgcctggtttggtttcgagcaagagtacttcttctacaaggacggccgcccgctcggcttcccggagagcggttatcccgcgccgcagggcccttactacaccggcgtcggctacaagaacgtcggcgacgtcgcgcgcaagatcgtcgaagagcatctcgaccagtgcctcgcggccggcatcaaccatgaaggcatcaacgccgaagtggccaagggccagtgggaattccagattttcggcaagggctccaagaaggccgccgaccagatctggatggcgcgctacctgctcctgcgtctgaccgagacttacggcatcgacatcgagttccactgcaagccgctcggcgacaccgactggaacggctcgggcatgcactgcaatttctcgaccaagttcatgcgcgaagtcggcggcaaggcctatttcgaagccctgatggcgcagttcgacaaaaacctgatggaccacatcgccgtctacgggccggacaacgacaagcgcctgaccggcaagcacgagaccgcgccgtggaacaagtttagctatggcgtcgccgaccgtggcgcatcgatccgcgtgccgcactccttcgtcaagaatgactacaagggctatctggaagaccgtcgtccgaactcccagggcgacccctaccagatcgcttcgcaggtgctgaagacgatctcgcaggttgcgaccgacgcgaaggtctcggccgccgcctga

SEQ ID NO: 21290 - protein, 346 aa, Rhizobium loti
MTKYKLEYIWLDGYTPVPNLRGKTQIKEFAEFPTLEQLPLWGFDGSSTMQAEGRSSDCVLKPVALYPDPARTNGILVMCEVMMPDGVTPHESNSRATILDDEDAWFGFEQEYFFYKDGRPLGFPESGYPAPQGPYYTGVGYKNVGDVARKIVEEHLDQCLAAGINHEGINAEVAKGQWEFQIFGKGSKKAADQIWMARYLLLRLTETYGIDIEFHCKPLGDTDWNGSGMHCNFSTKFMREVGGKAYFEALMAQFDKNLMDHIAVYGPDNDKRLTGKHETAPWNKFSYGVADRGASIRVPHSFVKNDYKGYLEDRRPNSQGDPYQIASQVLKTISQVATDAKVSAAA

SEQ ID NO: 21291 - DNA, 1494 bp, Oryza sativa
  CDS (122)..(1234)
aattgatagcctgtgcgtctccaagaagaggcttgccgctgccgccattggagccctctcgtttctgctcgagctctgcatttcttcagtaggaggaggaggaggaagagttggagtcgccatgtcgtcgtccctgctcactgacctcgttaacctcgacctgtcggagagcacggacaaggtcatcgccgagtacatatgggttggtggtactgggatggatgtgaggagcaaagccagaacgttgtctggacctgttgatgacccaagcaagcttccaaagtggaactttgatggctccagcaccggtcaggctaccggtgacgacagtgaagtcatcctccaccctcaagccatcttcagagacccattcaggaaggggaagaacatcctggtcatgtgtgactgttatgcgccgaatggcgagccgattccgacgaacaaccggtacaatgcagcaaggatcttcagtcatcctgatgtcaaggctgaagagccatggtatgggattgagcaggagtacacccttcttcagaagcacatcaactggcctcttggctggccactaggtggctatccaggccctcagggtccgtactactgtgcggcgggagccgataaatcgtacgggcgcgacatcgttgatgcccactacaaggcctgcctgtttgccggcatcaacatcagcgggatcaacgcagaagtcatgccggggcagtgggagttccagattggccctgtcgttggcgtctccgcaggggatcatgtctgggtggcacgctacattcttgagaggatcactgagattgctggcgtcgtcgtgtccttcgaccccaagcccattccgggagactggaatggcgccggtgctcacaccaactacagcaccaagtcgatgaggagcaatggcggctacgaggtgatcaagaaagcgatcaagaagcttggcatgcgccaccgtgagcacatcgccgcctacggcgacggcaacgagcgccgcctcaccggccgccacgagaccgccgacatcaacaacttcgtctggggcgtagcgaaccgcggcgcgtcggtgcgtgtcggccgggacaccgagaaggacggcaaaggttacttcgaggacaggaggccggcgtccaacatggacccgtacctggtgaccgccatgatcgccgagaccaccatcctctgggagcccagccacggccacggccacggccaatccaacggcaagtgaggaggagtcgcctcgcccgggttgatgaactgctttctcgcgttctgggtttcatggaaatctgtgtgtgtgttctctgacgctggtgctgttagaaacttccaataattcagaaataactgcgatgtgctctcaaatttctcatgaggccatcacctgcagcatctcatgaaatagatctattgcaatgacaataccaatggcaacgcaaaattttatggtacctccagataccatctactctcctcaataatgacaat

SEQ ID NO: 21292 - protein, 370 aa, Oryza sativa
MSSSLLTDLVNLDLSESTDKVIAEYIWVGGTGMDVRSKARTLSGPVDDPSKLPKWNFDGSSTGQATGDDSEVILHPQAIFRDPFRKGKNILVMCDCYAPNGEPIPTNNRYNAARIFSHPDVKAEEPWYGIEQEYTLLQKHINWPLGWPLGGYPGPQGPYYCAAGADKSYGRDIVDAHYKACLFAGINISGINAEVMPGQWEFQIGPVVGVSAGDHVWVARYILERITEIAGVVVSFDPKPIPGDWNGAGAHTNYSTKSMRSNGGYEVIKKAIKKLGMRHREHIAAYGDGNERRLTGRHETADINNFVWGVANRGASVRVGRDTEKDGKGYFEDRRPASNMDPYLVTAMIAETTILWEPSHGHGHGQSNGK

SEQ ID NO: 21293 - DNA, 1296 bp, Beta vulgaris subsp
  CDS (1)..(1296)
atggctcaaatacttgcacctaacatgcaatgtcagatgaaactatcaaagagcttgacaaactcaatgataccaaactcttggacctccatattactgaaaggaagtcaaaagggatcaattaagtgctctacgaagtttaaagtatgtgccgctctcaagactgaacatggcactgtgaacaggatggagcaattactcaatttggatgtcactccatttactgacaagattattgcagaatacatttggattggaggatctgggattgatcttcgtagcaaatcgaggacactatcacgacctgttgaggacccatctgagcttcccaagtggaactatgatgggtcaagcacaggacaagcacctggagaagacagtgaagtaatcttatacccccaagcaatttttaaggatccattccgtggtggtaacaatattttggtaatatgtgacgcatacacaccagcaggtgagccgatcccaacgaataaacgacacaaagctgccgagatcttcagcaacccaaaggttgcttctgaggttccatggtttggaatagagcaagaatacacgctgcttcaaccaaatgttcaatggcccttgggatggcctgtcggagcctatcctggtccccagggaccatattactgtggtgttggtgctgataaatcgtttggacgtgacatatctgatgctcattataaagcttgcctgtatgctggaataaacataagtggcaccaacggggaggtcatgcctggccagtgggaatttcaggttggtcctagtgttgggattgaagctggagatcatatctggtgtgccagatatcttcttgagagaatcactgagcaagctggtgtagttttgacacttgatccgaagccaattgagggtgattggaacggcgcaggttgccataccaattacagtacaaagacaatgagagaagacggtggttttgaagtaataaagaaggccattttgaatctatcattacgccataaagaacatatcagtgcatatggagaagggaatgaaagaagactgacagggaagcatgagactgccgacatcgacacattctcttggggtgtcgccaatcgtggttgttcaatccgtgtgggtcgtgatacggagaaggaaggcaaaggttacatggaagacaggcgacctgcttcaaacatggacccttacgtggtaacaggtttgctagcagagtcaacactactttgggaacccacactcgaagctgaggcacttgcagctcaaagactctctctcaatgtgtaa

SEQ ID NO: 21294 - protein, 431 aa, Beta vulgaris subsp
MAQILAPNMQCQMKLSKSLTNSMIPNSWTSILLKGSQKGSIKCSTKFKVCAALKTEHGTVNRMEQLLNLDVTPFTDKIIAEYIWIGGSGIDLRSKSRTLSRPVEDPSELPKWNYDGSSTGQAPGEDSEVILYPQAIFKDPFRGGNNILVICDAYTPAGEPIPTNKRHKAAEIFSNPKVASEVPWFGIEQEYTLLQPNVQWPLGWPVGAYPGPQGPYYCGVGADKSFGRDISDAHYKACLYAGINISGTNGEVMPGQWEFQVGPSVGIEAGDHIWCARYLLERITEQAGVVLTLDPKPIEGDWNGAGCHTNYSTKTMREDGGFEVIKKAILNLSLRHKEHISAYGEGNERRLTGKHETADIDTFSWGVANRGCSIRVGRDTEKEGKGYMEDRRPASNMDPYVVTGLLAESTLLWEPTLEAEALAAQRLSLNV

SEQ ID NO: 21295 - DNA, 1071 bp, Beta vulgaris subsp
  CDS (1)..(1071)
atggctcttcttaacgatctaattaaccttaatctctcagaaacatctgacaagattattgctgagtatatatggatcggaggatctgggttggatatgagaagcaaagcaaggacattaacagggccaataagtgatcctgcaaaattaccaaaatggaattacgatggatcaagtactaatcaagctcctggtgaagatagtgaagtcattttataccctcaggctattttcaaggatccattcagaagaggagacaatatcctagttatgtgtgatgcatacaccccagctggagaaccaattccaacaaacaagaggtacaatgctgagaaaatcttcagccacccagacgttgtcgctgaggagccatggtatggaattgaacaagaatacacacttcttcagaaggatatcaactggcctcttggatggccaactggtggcttccctggtcctcagggaccatactattgtggtgtaggggctgataaatctttcgggcgagacattgtagatgctcactataaggcttgcatctatgctggtgtcaatatcagtggaattaatggtgaagtcatgccaggacagtgggaattccaagttggtcctactgttggaatttcatctggtgatcaagtctgggttgctagatacattcttgagagaattgctgagattgccggagttgttgtgtcttttgaccccaaaccagtgaagggtgattggaatggtgctggtgctcacaccaactacagcactaagtcgatgagggaagatggtgggatcaatgttataaaggctgccatcgagaagttgagtctccgtcacaaggagcacattgctgcctacggggagggcaacgagaggaggctcactggtcgtcatgagacagccgatatcaccactttctcctggggtgttgcaaataggggtgcctctgttcgtgttggccgtgacacagagaaagatggcaaaggttactttgaagacagaaggccagcatcaaacatggatccatatgtggttacctccatgattgctgaaacaactatcctcggaaagccttga

SEQ ID NO: 21296 - protein, 356 aa, Beta vulgaris subsp
MALLNDLINLNLSETSDKIIAEYIWIGGSGLDMRSKARTLTGPISDPAKLPKWNYDGSSTNQAPGEDSEVILYPQAIFKDPFRRGDNILVMCDAYTPAGEPIPTNKRYNAEKIFSHPDVVAEEPWYGIEQEYTLLQKDINWPLGWPTGGFPGPQGPYYCGVGADKSFGRDIVDAHYKACIYAGVNISGINGEVMPGQWEFQVGPTVGISSGDQVWVARYILERIAEIAGVVVSFDPKPVKGDWNGAGAHTNYSTKSMREDGGINVIKAAIEKLSLRHKEHIAAYGEGNERRLTGRHETADITTFSWGVANRGASVRVGRDTEKDGKGYFEDRRPASNMDPYVVTSMIAETTILGKP

SEQ ID NO: 21297 - DNA, 1374 bp, Avicennia marina
  CDS (65)..(1135)
gcccacgcgtccggccgaacacgggaaacacaaggagtgaaagagcagttgaaagttttccataatgtctctgctttcagatctcctcaacctcgacctctctgagaccactgagaagatcattgctgaatatgtttgggttggtggctccggtatggaccttaggagtaaagccaggactatttctggacccgttagcgatccttcaaagctgccaaaatggaactatgatggatctagcacaggccaagcccccggcgaagacagtgaagtgatcctatatccccaagcaattttcagagatcctttcaggaggggaaagaacatcctggtcatgtgtgatacttacaccccagctggcgaaccaattccaaccaacaagaggcacgctgcagccaaaattttcagccatcctgatgttgctgctgaagagccttggtatggaattgagcaagaatacactttgctgcaaaagaatgtcaagtggcccatgggatggcctactggaggttaccctggaccccagggcccatactactgtggagtcggagcagacaaagcttttggacgcgatattgtggatgcacattacaagtcttgcctttatgctggaatcaacatcagcggtattaatggggaagtgatgcctggacagtgggaattccaagttggacctgctgttggcatctcagctggtgatgagttgtggatggctcgttacattttggagaggatcacagaaattgctggggttgtgctgtcctttgatcccaagcctatccagggtgactggaatggggccggcgcccacactaattacagcaccaaatccatgaggaaggagggaggctttgaagttatcaagaaggcaattgagaagctcggacacaggcacaaagaacacattgctgcctatggcgagggcaacgagcgccgtctcactgggagacatgaaactgctgacatcaactccttcaaatggggggttgcgaaccgtggtgcatccgtccgtgttggtcgggacactgagagagaaggcaaggggtactttgaggacaggaggcctgcctcgaacatggacccttacattgtcacttccatgatagccgagaccaccatcttagggaagcactgagcttgtttggtgtcaactggtcttctgtgaagggagaaatggattgttatttagtataagatgaaggttgattgtttgctttagggaagcactgcatttgtttactatttgctggtttacttgttatgctatgacaacctctgcatttctggctgcaaggtttgagcttgtctcaaccttcttgattgagcctgcctaataatattgagatcataaataaaaaaaaaaaaaaaaaaaaa

SEQ ID NO: 21298 - protein, 356 aa, Avicennia marina
MSLLSDLLNLDLSETTEKIIAEYVWVGGSGMDLRSKARTISGPVSDPSKLPKWNYDGSSTGQAPGEDSEVILYPQAIFRDPFRRGKNILVMCDTYTPAGEPIPTNKRHAAAKIFSHPDVAAEEPWYGIEQEYTLLQKNVKWPMGWPTGGYPGPQGPYYCGVGADKAFGRDIVDAHYKSCLYAGINISGINGEVMPGQWEFQVGPAVGISAGDELWMARYILERITEIAGVVLSFDPKPIQGDWNGAGAHTNYSTKSMRKEGGFEVIKKAIEKLGHRHKEHIAAYGEGNERRLTGRHETADINSFKWGVANRGASVRVGRDTEREGKGYFEDRRPASNMDPYIVTSMIAETTILGKH

SEQ ID NO: 21299 - DNA, 1122 bp, Cricetulus griseus
  CDS (1)..(1122)
atggccacctcagcaagttcccacttgaacaaaggcatcaagcaaatgtacatgtccctgccccagggtgagaaagtccaagccatgtatatctgggttgatggtaccggagaaggactgcgctgcaaaacccgcaccctggactgtgagcccaagtgtgtagaagagttacctgagtggaattttgatggctctagtacctttcagtctgagagctccaacagtgacatgtatctcagccctgttgccatgtttcgggaccccttccgcaaagagcccaacaagctggtgttctgtgaagtcttcaagtacaaccagaagcctgcagagaccaatttaagacacacgtgtaaacggataatggacatggtgagcaaccagcacccctggtttggaatggaacaggagtatactctcttgggaacagatgggcacccttttggttggccttccgatggcttccctgggccccaaggtctgtattactgtggtgtgggcgcagacaaagcctatcgcagggatatcatggaggctcactaccgtgcctgcttgtatgctggggtcaagattacaggaacatatgctgaggtcaagcatgcccagtgggaattccaaataggaccctgtgaaggaatccgcatgggagatcatctctgggtggcccgtttcatcttgcatcgagtatgtaaagactttggagtaatagcaacctttgactccaagcccattcctgggaactggaatggtgcaggctgccataccaactttagtaccaagaccatgcgggaggagaatggtctgaagcacatcaaggaggccattgagaaactaagcaagcggcaccggtaccatattcgagcctacgatcccaagggggggctggacaatgcccgtcgtctgactgggttccacaaaacgtccaacatcaacgacttttcagctggcgtcgccgatcgcagtgccagcatccgcattccccggactgtcggccaggagaagaaaggttactttgaagcccgctgcccctctgccaattgtgacccctttgcagtgacagaagccatcgtccgcacatgccttctcaatgagactggcgaccagcccttccaatacaaaaactaa

SEQ ID NO: 21300 - protein, 373 aa, Cricetulus griseus
MATSASSHLNKGIKQMYMSLPQGEKVQAMYIWVDGTGEGLRCKTRTLDCEPKCVEELPEWNFDGSSTFQSESSNSDMYLSPVAMFRDPFRKEPNKLVFCEVFKYNQKPAETNLRHTCKRIMDMVSNQHPWFGMEQEYTLLGTDGHPFGWPSDGFPGPQGLYYCGVGADKAYRRDIMEAHYRACLYAGVKITGTYAEVKHAQWEFQIGPCEGIRMGDHLWVARFILHRVCKDFGVIATFDSKPIPGNWNGAGCHTNFSTKTMREENGLKHIKEAIEKLSKRHRYHIRAYDPKGGLDNARRLTGFHKTSNINDFSAGVADRSASIRIPRTVGQEKKGYFEARCPSANCDPFAVTEAIVRTCLLNETGDQPFQYKN

SEQ ID NO: 21301 - DNA, 1410 bp, Shewanella violacea
  CDS (1)..(1410)
atgtcagctgaatcagttttacaacaactcaaagaattagaagttaagtttgttgatctacgctttaccgatacccgtggtaaagaacagcacgtctcaatcccttcacatcaggtcgatgaagacttttttgaagacggcaagatgtttgatggttcatctattaatggttggaagggaatcaacgaatcagacatggtcttgatgccagatcctgcaagcttcgtactggatcctttcactgcagagacaacggccaacattcgttgtgacatccttaaccctggtactatgacaggttataaccgtgacccacgctctatcgccaagaaagccgaagagtacctacgttctaccggcatagcagatacagttttgctcggccctgaacctgagttcttcctgtttgatgacgttaaatatggcgccgatatgtcaggttgtttctacaaggtcgatgccgaagaagctgcctggaactcaggtaccagctatgaaggcggtaacaagggtcaccgtccaagcgttaaaggtggttacttccctgtagcaccggtcgactcttcacaagacatacgttcagccatgtgtctggttctagaagagatgggtcaggtcgttgaagcacatcaccacgaagtggcaactgccggtcaaaacgagatcgcgactcgcttcaacacactaacactcaaggccgatgaagttcaggtgcttaaatatgtcgttcataacgtagctcacgcttatggtaagacagctacctttatgcctaagcctatcgttggcgacaatggtagcggcatgcacgttcatatttcgctggccaaagatggcaccaacctattcgctggtgacaagtacggcggattgagcgagatggcaatctattttatcggtggagttatcaagcatgctcgcgccatcaacgccttctctaacccagccacaaactcgtacaagcgtctgatcccacatttcgaaacgcctgtaatgttggcatactctgcagctaaccgcagtgcttcgattcgtatacctttggttccaagccctaagggacgtcgtatcgaactaagattcggtgacccaatggctaacccatatttggcattctcggctatgctgatggctggcctagacggtatccagaacaagatccatccgggtgaagccatggacaaagatctatatgacctgcctcctgaagaggctgctgaaatcccaacagtggctacttcacttgagaatgcactggaatgtctggatgcagatcgtgaattcctgactcgcggcgaagtattcagcaacgatttcatcgattcatatatcacgctgaaatctgaagatgttgagcgtgttaatcagactactcaccctgtcgagttcgagctttattacagcttgtaa

SEQ ID NO: 21302 - protein, 469 aa, Shewanella violacea
MSAESVLQQLKELEVKFVDLRFTDTRGKEQHVSIPSHQVDEDFFEDGKMFDGSSINGWKGINESDMVLMPDPASFVLDPFTAETTANIRCDILNPGTMTGYNRDPRSIAKKAEEYLRSTGIADTVLLGPEPEFFLFDDVKYGADMSGCFYKVDAEEAAWNSGTSYEGGNKGHRPSVKGGYFPVAPVDSSQDIRSAMCLVLEEMGQVVEAHHHEVATAGQNEIATRFNTLTLKADEVQVLKYVVHNVAHAYGKTATFMPKPIVGDNGSGMHVHISLAKDGTNLFAGDKYGGLSEMAIYFIGGVIKHARAINAFSNPATNSYKRLIPHFETPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSNDFIDSYITLKSEDVERVNQTTHPVEFELYYSL

SEQ ID NO: 21303 - DNA, 1387 bp, Arabidopsis thaliana
  CDS (79)..(1149)
aaaatatcaaaacacgagacagatttgattccatttttattactgttactatcatccaaacccttggtatttgtagccatgagtcttgtttcagatctcatcaaccttaacctctcagactccactgacaaaatcattgctgaatacatatgggttggtggttctggaatggacatgagaagcaaagccaggactctacctggaccagtgactgacccttcgcagctaccaaagtggaactatgatggttcaagcacaggccaagctcctggtgaagacagtgaagtcatcttataccctcaagccatattcaaggatcctttccgtagaggaaacaacattcttgtcatgtgcgatgcgtacactcccgcgggtgaaccaatcccgactaacaaaagacacgctgcggctaaggtctttagcaaccctgatgttgcagctgaagtgccatggtatggtattgagcaagaatacactttactccagaaagatgtgaagtggcctgttggttggcctattggtggttatcccggccctcagggaccgtactattgcggtattggagcagacaaatcttttggcagagatgttgttgattctcactacaaggcctgcttatacgctgggatcaacattagtggcatcaatggagaagtcatgccgggtcagtgggagttccaggtcggtccagctgttggtatctcggctgctgatgaaatttgggtcgctcgttacattttggagaggatcacagagattgctggtgtagtggtatcttttgacccgaaaccgattcccggtgactggaacggtgctggtgctcactgcaactacagtaccaagtcaatgagggaagaaggcggttacgagatcatcaagaaagcaatcgataaattgggactgagacacaaagaacacattgctgcttacggtgaaggcaatgagcgtcgtctcacaggacaccacgagactgctgacatcaacactttcctttggggtgttgcgaaccgtggagcatcgatccgagtaggacgtgatacggagaaagaagggaaaggatactttgaggacaggaggccagcttcgaacatggatccttacattgtcacttccatgattgcagagactacaatcctctggaatccttgatgatcatcagatcaagaaaaaatcttgaatgtcactcaaatttgtgtttcttgcaagattcaaagtttgtgttctctatcaagcaatgtcttaggataagtcaaagatttgctctgcttattctgctttttatttacttcacatcctattgaaaacatttctgtgtattatttatgaataaacattatcttaaaagggctgatttatttactaatgcatgcattcaccacttaagatc

SEQ ID NO: 21304 - protein, 356 aa, Arabidopsis thaliana
MSLVSDLINLNLSDSTDKIIAEYIWVGGSGMDMRSKARTLPGPVTDPSQLPKWNYDGSSTGQAPGEDSEVILYPQAIFKDPFRRGNNILVMCDAYTPAGEPIPTNKRHAAAKVFSNPDVAAEVPWYGIEQEYTLLQKDVKWPVGWPIGGYPGPQGPYYCGIGADKSFGRDVVDSHYKACLYAGINISGINGEVMPGQWEFQVGPAVGISAADEIWVARYILERITEIAGVVVSFDPKPIPGDWNGAGAHCNYSTKSMREEGGYEIIKKAIDKLGLRHKEHIAAYGEGNERRLTGHHETADINTFLWGVANRGASIRVGRDTEKEGKGYFEDRRPASNMDPYIVTSMIAETTILWNP

SEQ ID NO: 21305 - DNA, 1269 bp, Arabidopsis thaliana
  CDS (44)..(1114)
accaaaaaaaaaaaggtttattattctttgagattcctaagatatgtcttcacttgcagatttaatcaatctcgatctctccgattccactgaccagatcatcgccgagtacatatggattggtggatcgggcttggatatgagaagcaaagcaaggactttgcctggaccagtgacggatccatcgcagttaccgaaatggaactacgacggttcaagcaccggccaagctccgggcgatgacagtgaagtcatcatctaccctcaagctatcttcaaagaccccttcagaagaggcaacaacatccttgtgatgtgtgacgcatatacaccggcaggagagccgattccgacgaacaaaaggcatgcggcggctaagatctttgaagaccctagtgttgtcgccgaagaaacatggtacggaattgaacaagagtataccttgttgcaaaaggatattaagtggccggtaggttggccggtcggcggtttcccaggtcctcagggaccgtactactgtggagttggagcagacaaagcctttggaagagacatcgttgattctcattacaaagcttgtctttacgccggaatcaatgtcagtgggactaacggcgaagttatgcctggccagtgggagttccaagtcggtcccaccgttggaatcgctgccgccgatcaggtctgggttgctcgttacattcttgagaggatcacagaattggctggagttgttctgtctctagaccctaaaccaattccgggagattggaatggtgcaggggcacacacaaattacagtacgaagtcgatgagagaagatggagggtacgaggtgataaagaaagcaatagagaagcttggattgcgtcacaaggaacacattgctgcttatggtgaaggcaacgagcgtcgtctcaccggaaaacatgaaaccgccgatatcaacactttcttatggggtgtggcaaaccgtggggcatcgattagggttgggcgtgacactgagcaggctggaaaaggatactttgaagatcgtaggccagcttcgaacatggatccttacactgtgacctccatgattgctgaatccacaatcctttggaaaccatgaaagaagaaaccttgagcctcaaggaatctctataatatcagttcatgttcattcttctatggtctctttctcattctgaaacagttctcatgtgttctttgtttattatgtttgatttgaagtcttcaatttgtttctgagaacgatagttcctc

SEQ ID NO: 21306 - protein, 356 aa, Arabidopsis thaliana
MSSLADLINLDLSDSTDQIIAEYIWIGGSGLDMRSKARTLPGPVTDPSQLPKWNYDGSSTGQAPGDDSEVIIYPQAIFKDPFRRGNNILVMCDAYTPAGEPIPTNKRHAAAKIFEDPSVVAEETWYGIEQEYTLLQKDIKWPVGWPVGGFPGPQGPYYCGVGADKAFGRDIVDSHYKACLYAGINVSGTNGEVMPGQWEFQVGPTVGIAAADQVWVARYILERITELAGVVLSLDPKPIPGDWNGAGAHTNYSTKSMREDGGYEVIKKAIEKLGLRHKEHIAAYGEGNERRLTGKHETADINTFLWGVANRGASIRVGRDTEQAGKGYFEDRRPASNMDPYTVTSMIAESTILWKP

SEQ ID NO: 21307 - DNA, 1403 bp, Glycine max
  CDS (60)..(1130)
tctaaaagagatctttttctgctctttgaagaaagaagggtctttgcttgattttggagatgtctctgctctcagatctcatcaaccttaacctctccgataccaccgagaaggtgatcgcagagtacatatggatcggtggatcaggaatggacctgaggagcaaagcaaggactctcccaggaccagttagcgacccttcagagcttcccaagtggaactatgatggttccagcacaggtcaagctcctggtgaagacagtgaagtgattttatacccacaagccattttcagggatccattcagaaggggtaacaatatcttggttatctgtgatgcctacactcctgctggagaacctattcccactaacaagaggcacgctgctgccaaggttttcagccatcctgatgttgttgctgaagtgccatggtacggtattgaacaagaatacaccttgttgcagaaagatatccaatggcctcttgggtggcctgttggtggtttccctggacctcagggtccatactactgtggtgttggcgctgacaaggcttttggccgtgacattgttgacgcacactacaaagcctgtatttatgctggcatcaacatcagtggaattaatggagaagtgatgcccggtcagtgggaattccaagttggaccttcagttggaatctcagctggtgatgagatttgggcagctcgttacatcttggagaggatcactgagattgctggtgtggtggtttcctttgaccccaagccaattaagggtgattggaatggtgctggtgctcacacaaactacagcaccaagtccatgagagaagatggtggctatgaagtgatcaaagcagcaattgacaagttggggaagaagcacaaggagcacattgctgcttatggagaaggcaacgaacgtcgtttgacaggacgccacgaaaccgctgacatcaacaccttcttatggggagttgcaaaccgtggagcttctgttagggttgggagagacacagagaaagcagggaagggatattttgaggacagaaggccagcttccaacatggacccatacgtggttacttccatgattgcagacacaaccattctgtggaagccatgagcaaaacctgcatgttttctccctttggatggaaaggaacagttatgcttttcttagtaggatttggtctctctctctttttaccttttgattggtactatggttggtgccttgttggttggtgcaactaactggcaagggttgttcattgttttcttctattcctttccctcgttttccgattgttacaatgacaataatttaatggttattatcagtcttgaacaaagaaatgctgattgtgaagtataataataatatatgaaattgccg

SEQ ID NO: 21308 - protein, 356 aa, Glycine max
MSLLSDLINLNLSDTTEKVIAEYIWIGGSGMDLRSKARTLPGPVSDPSELPKWNYDGSSTGQAPGEDSEVILYPQAIFRDPFRRGNNILVICDAYTPAGEPIPTNKRHAAAKVFSHPDVVAEVPWYGIEQEYTLLQKDIQWPLGWPVGGFPGPQGPYYCGVGADKAFGRDIVDAHYKACIYAGINISGINGEVMPGQWEFQVGPSVGISAGDEIWAARYILERITEIAGVVVSFDPKPIKGDWNGAGAHTNYSTKSMREDGGYEVIKAAIDKLGKKHKEHIAAYGEGNERRLTGRHETADINTFLWGVANRGASVRVGRDTEKAGKGYFEDRRPASNMDPYVVTSMIADTTILWKP

SEQ ID NO: 21309 - DNA, 1044 bp, Arabidopsis thaliana
  CDS (1)..(1044)
atgacgtctcctctctcagatctcctaaaccttgatctatcagacaccaagaaaatcatcgctgaatacatatggatcggtggctctggaatggatattagaagcaaagccaggacattaccaggaccagtaagtaatccaacaaagcttccaaaatggaactacgatggatctagcaccgatcaagctgccggagatgatagtgaagcaatatttaaggacccattcaggaaggggaacaacattctggtgatgtgtgatgcttacagaccggccggagatccaattccgaccaacaataggcacaaggccgtaaaaatcttcgatcatcccaatgtgaaggctgaagagccttggtttgggatagagcaagaatacacattacttaaaaaagatgtgaagtggccactaggttggcctcttggtggctttcctggtcctcagggaccgtactattgtgcagtaggtgcagacaaagcttttggtcgtgacattgtcgatgctcactataaagcttgtctatactccggtttgagtattggtggtgccaatggtgaagtcatgcctggacaatgggagtttcaaatcagtcctactgttggtattggtgcaggtgatcaattatgggttgctcgttacattcttgagaggattactgagatatgcggtgtgattgtctcattcgatccaaaaccaatccagggtgattggaatggagcagccgctcatacgaacttcagtacaaaatcgatgaggaaagatggaggactggatttgattaaggaagcaataaagaagcttgaagtgaaacacaaacaacacattgctgcttatggtgaaggcaacgagaggcgtctcactgggaagcatgaaactgcagacatcaacactttctcttggggagtggcggatcgtggagcatcggtgagagtaggaagagatacggagaaagaaggtaaagggtattttgaagatcgaaggccttcgtctaatatggatccttacctagttacctccatgattgctgaaaccaccatcctctaa

SEQ ID NO: 21310 - protein, 347 aa, Arabidopsis thaliana
MTSPLSDLLNLDLSDTKKIIAEYIWIGGSGMDIRSKARTLPGPVSNPTKLPKWNYDGSSTDQAAGDDSEAIFKDPFRKGNNILVMCDAYRPAGDPIPTNNRHKAVKIFDHPNVKAEEPWFGIEQEYTLLKKDVKWPLGWPLGGFPGPQGPYYCAVGADKAFGRDIVDAHYKACLYSGLSIGGANGEVMPGQWEFQISPTVGIGAGDQLWVARYILERITEICGVIVSFDPKPIQGDWNGAAAHTNFSTKSMRKDGGLDLIKEAIKKLEVKHKQHIAAYGEGNERRLTGKHETADINTFSWGVADRGASVRVGRDTEKEGKGYFEDRRPSSNMDPYLVTSMIAETTIL

SEQ ID NO: 21311 - DNA, 1122 bp, Acomys cahirinus
  CDS (1)..(1122)
atggccacctcagcaagttcccacttgaacaaaggcatcaagcaaatgtacatgtccctgcctcagggtgagaaagtccaagccatgtatatctgggttgatggtaccggagaaggactgcgctgcaagacccgcacgctggactgtgagcccaagtgtgtagaggagttacctgagtggaattttgacggctcgagcacctttcagtctgaaggatccaacagtgacatgtatctcagccctgtcgccatgtttcgggaccccttccgcaaagaacccaacaagctggtgttctgtgaagttttcaagtataaccggaagcctgcagagaccaatctaaggcacagctgtaagcggataatggacatggtgagcaaccagcacccctggtttggaatggaacaggaatatactctcatgggaacagatgggcacccttttggctggccttccaatggcttccctgggccccaaggtccatattactgtggagtaggagcagacaaagcctatggcagagacatcgtggaggctcactaccgagcctgcttgtatgcaggagtcaagatcacagggacaaacgctgaggtcatgccagcccagtgggagttccaaataggaccctgtgaaggaatccgcatgggagaccatctctgggtggcccgcttcatcttgcatcgtgtgtgtgaagacttcggggtgatagcaacctttgaccccaaacccattcctggcaactggaacggtgctggctgtcataccaacttcagcaccaaggccatgcgtgaggagaacggtctcaagtatattgaggaagccattgacaaactaagcaagaggcaccagtaccacattcgcgcctacgatcccaaggggggcctggacaacgcccggcgtctgactggattccatgaaacctccaacatcaacgacttttctgctggcgttgccaaccgcggtgccagcatccgcattccccggactgtcggccaggagaagaggggttactttgaagaccggcgcccttctgccaattgtgacccctatgcggtgacagaagccatcgtgcgcacgtgtcttctcaacgagaccggcaacgagcccttccagtacaaaaactaa

SEQ ID NO: 21312 - protein, 373 aa, Acomys cahirinus
MATSASSHLNKGIKQMYMSLPQGEKVQAMYIWVDGTGEGLRCKTRTLDCEPKCVEELPEWNFDGSSTFQSEGSNSDMYLSPVAMFRDPFRKEPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWVARFILHRVCEDFGVIATFDPKPIPGNWNGAGCHTNFSTKAMREENGLKYIEEAIDKLSKRHQYHIRAYDPKGGLDNARRLTGFHETSNINDFSAGVANRGASIRIPRTVGQEKRGYFEDRRPSANCDPYAVTEAIVRTCLLNETGNEPFQYKN

SEQ ID NO: 21313 - DNA, 1577 bp, Canavalia lineata
  CDS (91)..(1383)
gacacacacagacacaaccgcattttcacttcaacttctctgctttacccatttttctactctctattgtaaagagcagaagtgcagaacatggcacaaattttggcaccctctacgcaatggcagatgagaatcacgaaaacatcacccaatgcaagtcccgtcacatcaaacatgtggagttctttgttgatgaaacaaaataagaaagctacaagttctgctaaatttagagtgctggcaatcaagtctgaaaatggcaccatcaacaggctggaaaatctacttgatttggacatcaccccatacactgacaagataattgctgagtacatttgggttgggggaacaggaattgatgtgcgcagtaaatcaagaacaatagcgaggccagttgaacatccctctgagctccctaaatggaattatgatggatctagcactggacaggcaccgggtgatgatagtgaagtaatcttatatcctcaagcaattttcaaagatcctttccgtggtggtaacaatattttggtcatttgtgatgcttacacgccagcaggtgagcctatccctacaaacaagcgacacagagctgctgaaattttcagtaacccaaaggtccaagccgaagttccatggtatggaattgaacaagagtacaccttacttcaaacaaatgtgaattggcctttaggttggcctgttggtggctatcctggtcctcagggtccttattactgcagtgctggggcagataagtcattcggacgtgatatatctgatgcacattacaaggcttgcttatatgctggaattaacatcagtggcaccaatggggaggttatgcctgggcagtgggagtttcaagttggtcctagtgtaggcattgaagctggtgatcatatctgggctgcgaggtacattcttgagagaattactgaacaagctggcgttgtgctctcactcgatccaaaaccaattcagggtgattggaatggtgcaggatgccacactaattatagtacaaagagcatgagggaagagggaggctttgaggtaataaagaaggccattttgaatctatcactccgtcactcggatcacattagggcatatggtgaaggaaatgagagaaggttgacaggaaagcatgagacagccgacattaacacattttcttggggagtggctaaccgcggttgctcaatccgtgtgggaagagacacagagaagaatggcaaaggttacttggaagacaggcgtccggcttcaaacatggatccatacgttgtgacatcattactggcggagactacactattgtgggaaccaactctagaggctgaagctcttgcagcacagaagatagcgttgaaggtctaaatctattgattggtggcattctggatggaatcggtagtctgtgggagctgttctttcactttccttttagattatttatattctaaagatcttgtttggactaaagaggttgtcatgcccagttattggttaccatatgaaatgcacatttgatatcagaagtttcgatggttaaaaaaaaaaaaaaaaaaaaa

SEQ ID NO: 21314 - protein, 430 aa, Canavalia lineata
MAQILAPSTQWQMRITKTSPNASPVTSNMWSSLLMKQNKKATSSAKFRVLAIKSENGTINRLENLLDLDITPYTDKIIAEYIWVGGTGIDVRSKSRTIARPVEHPSELPKWNYDGSSTGQAPGDDSEVILYPQAIFKDPFRGGNNILVICDAYTPAGEPIPTNKRHRAAEIFSNPKVQAEVPWYGIEQEYTLLQTNVNWPLGWPVGGYPGPQGPYYCSAGADKSFGRDISDAHYKACLYAGINISGTNGEVMPGQWEFQVGPSVGIEAGDHIWAARYILERITEQAGVVLSLDPKPIQGDWNGAGCHTNYSTKSMREEGGFEVIKKAILNLSLRHSDHIRAYGEGNERRLTGKHETADINTFSWGVANRGCSIRVGRDTEKNGKGYLEDRRPASNMDPYVVTSLLAETTLLWEPTLEAEALAAQKIALKV

SEQ ID NO: 21315 - DNA, 1666 bp, Juglans nigra
  CDS (96)..(1394)
aagaagccaactgggtcatcactctccctctgtatatcttcacccaaggtaattccggcaaaacccaccggccatccgccgttcctgagctgaaaatggcacatatcttgacacccactacgcgatggcagatgagaatcacaaagaattctgcaaatgcgagtcctatgacagcaaagatgtggggttctctgttgttgaaacaaaacaagaaagggtcatctaagagctcagctaagtttcgggtttttgccacgaagtcggagaacagcactgtcaacagaatagaaaaactactaaatttggacctcactccatatactgacaaaatcattgctgaatatatttggattggagggtccggaattgatctgcgtagcaagtcaaggacaatttccaagcctgttgaacatccatctgagcttcctaagtggaattatgatggatcaagtactggtcaagctccgggtgaagatagtgaagtaattctataccctcaagcgatctttaaggacccttttcgtggtggtaacaacatcttggtaatttgtgatacatacacaccagcaggtgagcctatcccaacaaacaaacgccacagggctgctgagatcttcactaacaagaaggtcgcagatgaagttccctggtatggaatagagcaagagtacaccttactacaacaaaatgtgaaatggccattaggttggcctgttggaggctatcctggtcctcagggtccttactactgtggtgctggggcagacaaatcatttggccgtgacatttcagacgcccattacaaagcttgcttatatgccggaattaacatcagtggtacaaatggggaggttatgcctggccagtgggagtatcaagttggacctagtgtgggaattgaagctggagatcatatatggtgttccagatacattcttgagagaattactgaacaagctggtgttgttctctcactcgatccaaaaccaatagagggtgatcggaacggtgcaggatgccacacaaattacagtacaaagagcatgagggaggatggaggctttgaagttataaagaaggcaattttgaatctgtcacttcgccataaagatcatatcagtgcctatggagaaggaaatgagagaaggttgacaggaaagcatgaaacagccagcattaacacattttcttggggagtggctaatcgtggatgctccatccgtgttggacgtgaaactgagaagcaaggcaaagggtacttggaagatcggcgtccagcttcaaacatggacccttatattgtgacctcgctactggctgaaactacaatattatgggaaccaacactggaggctgaagctctagctgctcagaagctggcactgaatgtttaaagttgattggttcaacgtaatctgaaggcattcgggagtggattcacagggaattagttaatcctcatgcagtgaacctttttcccttctagattggttagagcagatttattgtaaattagggatcttggagtgaggggtcgtacatgcccaggcatgtagaattgcagatggaatacttcttatgcaccatcataaatagatttgttagattatatatatgcatgttacttgggatgtatgcttctcaaaaaaaaaaaaaaaaaaaaaaa

SEQ ID NO: 21316 - protein, 432 aa, Juglans nigra
MAHILTPTTRWQMRITKNSANASPMTAKMWGSLLLKQNKKGSSKSSAKFRVFATKSENSTVNRIEKLLNLDLTPYTDKIIAEYIWIGGSGIDLRSKSRTISKPVEHPSELPKWNYDGSSTGQAPGEDSEVILYPQAIFKDPFRGGNNILVICDTYTPAGEPIPTNKRHRAAEIFTNKKVADEVPWYGIEQEYTLLQQNVKWPLGWPVGGYPGPQGPYYCGAGADKSFGRDISDAHYKACLYAGINISGTNGEVMPGQWEYQVGPSVGIEAGDHIWCSRYILERITEQAGVVLSLDPKPIEGDRNGAGCHTNYSTKSMREDGGFEVIKKAILNLSLRHKDHISAYGEGNERRLTGKHETASINTFSWGVANRGCSIRVGRETEKQGKGYLEDRRPASNMDPYIVTSLLAETTILWEPTLEAEALAAQKLALNV

SEQ ID NO: 21317 - DNA, 1590 bp, Nicotiana sylvestris
  CDS (67)..(1365)
ttcatattctctctcttcaacatatttttccagcatagcattaccaagttagttggttaggtgaagatggctcagatcttggctccatcaggagaatggcagatgagaatgacaaagagctcaacagatgctaatcccttgacttcaaagatgtggagttctgtggtgttgaagataataaaagaacttgctgttaaaagctctgccaaatttagattctttgctctggaatctgatagtggcactgtgaaccagagtgaacagctgctaaacttggacgtaactccatacactgacaagatcattgctgaatatatttggatcggaggatcaggaattgacatgcgcagtaaatcaaggactatttcaaagccagtcaagcatgcttctgagctcccaaagtggaactacgatggatcaagtactggacaagcacctggagaagacagtgaagtcattctataccctcaggcaatatttaaagaccctttccgtggtggtaacaacatcttggttatctgtgatgcctacacaccagctggagagccaattccatcaaacaaacgccataaagctgctcagatttttagcgactcaaaagttgtatctgaagttccatggttcgaaatagaacaagagtacaccttactccaacaaaatgtgaagtggcctttaggttggcctgttggaggctatcctggtactcagggtccttactacttgtgtgctggagcggataagtcatttggccttgatatatcagatgctcactacaaggcttgtctgtatgctggaattaacattagtggtactaacggagaggttatgccaggacagtgggaatttcaggtaggtcctagtgttgggattgaagctggagatcacatctggtgcgccagatacatccttgagagaattactggacaagcaggagttgttctctcacttgatccaaaaccaattgagggcgactggaatggtgccggatgccacactaactacagtacactaagtatgagagaagatggaggatttgaagtaataaagaaagcaaatctgaatctctcccttcgccacaaggagcatataaatgcatatggagagggaatcctcgagaagttgactggaaaccatgaaactgcaagcattgacaaattttcatggggagttgcattccgtggtgcctcaatccgtgtgggcgctgacactgagaagcaaggcaaaggttatttggaagaccgccgtccagcttcaaacatggacccctatgttgtgactggattacttgccgaaactactattctgtgggagccaaccaatgaggctgaagctcttgctgctcaaaagctcgcactgaaggtatgatgttttaattatttaagggcagattgatccataatcttcttagagttcatgatctgctaagtgaagaaacttgtaccttgtttagattgggttttagggaaaatcttgtaaaggaaccacaatttatcagttattcctataaaagaggttccttaagacaatgagactgtaattgttggaactactttgaacatatttatctttctttctccagatgaaaaaaaa

SEQ ID NO: 21318 - protein, 432 aa, Nicotiana sylvestris
MAQILAPSGEWQMRMTKSSTDANPLTSKMWSSVVLKIIKELAVKSSAKFRFFALESDSGTVNQSEQLLNLDVTPYTDKIIAEYIWIGGSGIDMRSKSRTISKPVKHASELPKWNYDGSSTGQAPGEDSEVILYPQAIFKDPFRGGNNILVICDAYTPAGEPIPSNKRHKAAQIFSDSKVVSEVPWFEIEQEYTLLQQNVKWPLGWPVGGYPGTQGPYYLCAGADKSFGLDISDAHYKACLYAGINISGTNGEVMPGQWEFQVGPSVGIEAGDHIWCARYILERITGQAGVVLSLDPKPIEGDWNGAGCHTNYSTLSMREDGGFEVIKKANLNLSLRHKEHINAYGEGILEKLTGNHETASIDKFSWGVAFRGASIRVGADTEKQGKGYLEDRRPASNMDPYVVTGLLAETTILWEPTNEAEALAAQKLALKV

SEQ ID NO: 21319 - DNA, 1345 bp, Canavalia lineata
  CDS (83)..(1150)
gctaaaccctgcttattactctatactctccatcatcatttgcttctctcaccacagtgttcttcttcagcacaaccagtccatgtctttagtctcagatctcatcaacctcaatctttcagaatctactgagaagattattgctgagtacatatgggttggtggatctggtatggacctaagaagtaaagccaggactcttcctggaccagtgagtgatccttctaaacttccaaagtggaactatgatgggtcaagcacagatcaagctcctggggatgacagtgaagtcattttatatccacaagctattttcaaggacccatttaggagaggcaataatattcttgtgatttgtgatgtttacaccccagctggagaaccacttccaacaaacaagaggcatgatgctgccaaaatcttcactcaccctgatgttgttgctgaggagccatggtatggtattgagcaagagtataccttgttgcagaaagatgtgaattggccacttgggtggccacttggtgggtatcctgggccacagggaccctactactgtggagttggtgctgataaagcctatggtcgtgatattgtagatgcacattacaaagcttgtgtttatgcaggaattaacatcagtggcatcaatggagaggttatgcctggccagtgggaattccaagtgggtccttctgttggaatctctgctggagatgagctatgggctgctcgttacattttggagaggattactgagatagctggagcagttgtttcatttgatcctaaaccaattccgggagattggaatggagctggtgctcacacaaactatagcaccaagtctatgagagatgagggaggttatgaggttattaagaaagccattgaaaaacttggattgaagcacaaagagcacattgcagcatatggaaaaggcaatagacgtctcactggaagacatgaaacagcagacatcaacaccttctcttggggtgtggcaaaccgtggaagctccattagagttggaagagacacagaaaaggagggtaaaggttactttgaggacagaaggcctgcttctaatatggatccctatgtggtaacctccatgattgcagagaccaccatcctctggaagccatgaaatcatagaccaccaccatcaattatgtgtgttccattgcattttaatcaacaacttatatctccaaggtgttattttgctgagtggtcttttcaaccaaagtatttccctatgtcctttgtatggttcaacactaattttctcattaataataataataataataattgcttcttgaaaaaaaaaaaaaaaaaa

SEQ ID NO: 21320 - protein, 355 aa, Canavalia lineata
MSLVSDLINLNLSESTEKIIAEYIWVGGSGMDLRSKARTLPGPVSDPSKLPKWNYDGSSTDQAPGDDSEVILYPQAIFKDPFRRGNNILVICDVYTPAGEPLPTNKRHDAAKIFTHPDVVAEEPWYGIEQEYTLLQKDVNWPLGWPLGGYPGPQGPYYCGVGADKAYGRDIVDAHYKACVYAGINISGINGEVMPGQWEFQVGPSVGISAGDELWAARYILERITEIAGAVVSFDPKPIPGDWNGAGAHTNYSTKSMRDEGGYEVIKKAIEKLGLKHKEHIAAYGKGNRRLTGRHETADINTFSWGVANRGSSIRVGRDTEKEGKGYFEDRRPASNMDPYVVTSMIAETTILWKP

SEQ ID NO: 21321 - DNA, 1668 bp, Opsanus beta
  CDS (1)..(1185)
atgagagtcagggttggaagactctttctacaacttcctcgtttgtccaggtgtgttacagcagcaaaaatggccacatcagccagcgccagcttgagtaaagctgtcaagaagcattacatgggactccctcagggggataaagtccaagctatgtacatttggattgatggaacaggggagggactcagatgtaaaaccagaacgctggattctgaacccaaaagcattgaagatcttccggaatggaactttgacggttccagcacgtaccaggctgagggctccaacagcgacatgtacttggttcccgctgccatgttccgtgatccctttcgcgaagatcccaacaagcttgtcctttgtgaagtgctgaagtacaaccgcaaaccatcagaatccaatcttcggttgaactgtaacaaggtgatgaacatggtcaaggaccagcatccttggtttggcatggagcaagagtacaccattcttggcacagatggacatcctttcggctggccatctaatggatttcccggaccacaaggtccatattactgtggtgtgggagcagacaaggcctacggcagagacatagtggaggcccattacagagcctgtctctatgctggagtccagatttgtggcacaaatgcagaagtaatgcctgcacagtgggagtttcaggtaggaccttgtgagggtatcaacatgggcgatcatttctgggcggcacgtttcatcctgcaccgtgtctgtgaggatttgggcgtggtcgcttcatttgaccctaagcccatccccggaaactggaacggtgctggctgccatacaaacttcagcacgaaagagatgagggaagacggcggattaaaagccattgaagatgcgattgagaagctcgggaagaggcaccactaccacattcgtgcctatgaccccaaaggggggctggacaacgcccgccgtctcaccggccaccacgaaacctcaaacatccacgagttctctgcaggtgtggccaaccgcggcgccagcattcgcattccccgtagtgtcggccaggagaagaagggctactttgaggaccgccgaccgtctgccaactgtgacccgtacggcgtaacggaggccctgatccgcacgtgtttgctgagcgaggaaggagatgaacctttagcttactgaatcccactcccctcctgacattcttttctttaaactagtacattgtttctgttctcctactgagatgatttaacctgcattttaatggtttaaaagttggctggtcaacttaaaacaaggcggtcttgtccttggtagtggtgagctggtaatagcagggtatgttccgcttgccttctgacgggactggccttttgtaacactgtatatagtctgtgtcctggcatttccttttttgttttttttggtctgtcggtgactaaaatgagctgatgcgtagcggtgctaaggctggacagtaactttaaaaacaaacaaaaagaaaatcatgatgtacaggttaatttctaaacttgccttttcatctctccagtcttcagtgttactaattcgttgatcacgactttatgttttttaaatggcaatgtttgtattccgattttgacacactgggtcatcttgtttggtggacatttgtaccca

SEQ ID NO: 21322 - protein, 394 aa, Opsanus beta
MRVRVGRLFLQLPRLSRCVTAAKMATSASASLSKAVKKHYMGLPQGDKVQAMYIWIDGTGEGLRCKTRTLDSEPKSIEDLPEWNFDGSSTYQAEGSNSDMYLVPAAMFRDPFREDPNKLVLCEVLKYNRKPSESNLRLNCNKVMNMVKDQHPWFGMEQEYTILGTDGHPFGWPSNGFPGPQGPYYCGVGADKAYGRDIVEAHYRACLYAGVQICGTNAEVMPAQWEFQVGPCEGINMGDHFWAARFILHRVCEDLGVVASFDPKPIPGNWNGAGCHTNFSTKEMREDGGLKAIEDAIEKLGKRHHYHIRAYDPKGGLDNARRLTGHHETSNIHEFSAGVANRGASIRIPRSVGQEKKGYFEDRRPSANCDPYGVTEALIRTCLLSEEGDEPLAY

SEQ ID NO: 21323 - DNA, 1032 bp, Streptomyces coelicolor
  CDS (1)..(1032)
atgaccttcaaggccgagtacatctggatcgacggcaccgagccgacggccaagctccgttccaagacgaagatcatcacggctgcccccgcgggtctggacgccctgccggtctggggcttcgacggctcctccaccaaccaggccgagggcagctcctcggactgcgtgctcaagccggtcttctcctgccccgacccgatccgcggaggcgaggacatcctggtgctgtgcgaggtcctggacacggacatgacgccgcacccgagcaacacccgtgccgcgctggccgagctgtccgagcgcttcgccgcgcaggagccggtcttcggcatcgagcaggagtacaccttcttcaagggcacccgcccgctcggcttccccgagggcggcttcccggccgcgcagggcggctactactgcggcgtgggctcggacgagatcttcggccgcgacgtcgtcgaggcgcacctggagaactgcctgaaggccggactcggcatctccggcatcaacgccgaggtcatgcccggccagtgggagttccaggtcggcccgctggcgccgctggaggtctccgaccagctgtgggtggcccgctggctgctctaccgcaccgcggaggacttcgaggtctccgccaccctcgaccccaagccggtcaagggcgactggaacggcgcgggcgcgcacaccaacttctccaccaaggcgatgcgcgagggttacgacgcgatcatcacggccgccgagtccctcggtgagggctccaagccgatggaccacgtcaagaactacggcgccggcatcgacgaccgactcaccggcctgcacgagaccgccccgtggaacgagtactcctacggcgtctccgaccgcggcgcctcggtgcgcatcccgtggcaggtcgagaaggacggcaagggctacatcgaggaccgccgtcccaacgccaacgtggacccgtacgtcgtgacgcgcctgctcgtcgacacctgctgcacggcgctggagaaggccggccaggtctga

SEQ ID NO: 21324 - protein, 343 aa, Streptomyces coelicolor
MTFKAEYIWIDGTEPTAKLRSKTKIITAAPAGLDALPVWGFDGSSTNQAEGSSSDCVLKPVFSCPDPIRGGEDILVLCEVLDTDMTPHPSNTRAALAELSERFAAQEPVFGIEQEYTFFKGTRPLGFPEGGFPAAQGGYYCGVGSDEIFGRDVVEAHLENCLKAGLGISGINAEVMPGQWEFQVGPLAPLEVSDQLWVARWLLYRTAEDFEVSATLDPKPVKGDWNGAGAHTNFSTKAMREGYDAIITAAESLGEGSKPMDHVKNYGAGIDDRLTGLHETAPWNEYSYGVSDRGASVRIPWQVEKDGKGYIEDRRPNANVDPYVVTRLLVDTCCTALEKAGQV

SEQ ID NO: 21325 - DNA, 1579 bp, Mesembryanthemum crystallinum
  CDS (88)..(1389): n means a or g or c or t/u, s means g or c
ctctctttctctctcctcctcttcttcagttccgcagctttgtcttcaacggctccgatccggcaacagagaaacaagtagccaaacatggcgcaaatacttgcaccaagcttgcaagtgaagatgagcatcacaaaaagctcaacccctgcaagctcaatgttgccaaacacatggacctctgtagtgttgaagcagagccgaaaaggatcgatcaagaactcgaccaaatttaaagtctgtgcttctattaagccagatgtaagtgttcagaacagggtggagcagctactcaatttggatgtcactcctttcactgacaagatcattgctgaatacatttggatcggaggagctggcattgatctccgtagcaaatcaaggacactctcgaaacctgttgagcacccatctgagcttcccaagtggaattatgatgggtctagcacagggcaggctccaggagaagacagtgaagtcatcttatacccacaagcaatttttaaggacccgttccgtggtggtaacaatatcttggtaatttgtgatgcatacacgccagcaggcgagccaattccgactaacaaaagacacaaggctgccgagatctttagcaatccaaaggtcgtttctgaggttccatggtatgggatagagcaagagtacacgttgatgcaaccgaatgtcaagtggcccttgggttggcctgttggagcctatcctggtcctcagggtccatactactgtggtgttggtgctgataaatcctttgggcgtgacatatccgatgcccattacaaagcatgcttgtatgctggaattaacataagtggcaccaatggggaggttatgcctggccagtgggaattccaagtgggtccaagtgtcggaattgaagctggagatcacgtctggtgtgccagatatattcttgagagaatcactgagcaagttggtgtagttctcacccttgatccaaaaccaattgagggtgattggaacggtgcagggtgtcataccaattacagtacaaagagcatgagagaagaaggtggtttcgaagtaattaagaaggcaattttaaacctttcattgcgccacaaagatcatatcagcgcatatggagaagggaatgaaagaaggttgacagggaagcatgaaactgccagtatcgactctttctcttggggagtcgctaatcgtggttgctcaatccgtgtgggtcgtgatacagagaaggcaggaaaaggatacttggaagataggcgaccggcttcaaacatggacccatacgtggtaacaggcttgctagcagagaccacattactttgggagccaacattagaggctgaggcacttgcagctcagaaaattgcaatgaaagtttaaaaattcttgtagatcnaacctgaaaacattggaaagggcctatatggcacttactgttgacttaacaattttatgttctgtccttagtattatgcatttgggacttgggagtgtggactgcatttttttttttgttttccaattgttggttatgaatattttgaaataaaagaattagttacttcaagcc

SEQ ID NO: 21326 - protein, 433 aa, Mesembryanthemum crystallinum
MAQILAPSLQVKMSITKSSTPASSMLPNTWTSVVLKQSRKGSIKNSTKFKVCASIKPDVSVQNRVEQLLNLDVTPFTDKIIAEYIWIGGAGIDLRSKSRTLSKPVEHPSELPKWNYDGSSTGQAPGEDSEVILYPQAIFKDPFRGGNNILVICDAYTPAGEPIPTNKRHKAAEIFSNPKVVSEVPWYGIEQEYTLMQPNVKWPLGWPVGAYPGPQGPYYCGVGADKSFGRDISDAHYKACLYAGINISGTNGEVMPGQWEFQVGPSVGIEAGDHVWCARYILERITEQVGVVLTLDPKPIEGDWNGAGCHTNYSTKSMREEGGFEVIKKAILNLSLRHKDHISAYGEGNERRLTGKHETASIDSFSWGVANRGCSIRVGRDTEKAGKGYLEDRRPASNMDPYVVTGLLAETTLLWEPTLEAEALAAQKIAMKV

SEQ ID NO: 21327 - DNA, 1410 bp, Enterobacter gergoviae
  CDS (1)..(1410)
atgtccgctgaacacgttttgacgatgctgaacgagcacgaagtgaagtttgtcgatctgcgcttcaccgataccaaaggtaaagaacagcacgtcacgattccgtctcatcaggtaaatgccgaattcttcgaagaaggcaaaatgtttgatggctcctcgatcggtggctggaaaggtatcaacgaatctgacatggtcctgatgccggacgcttccaccgcggtcattgacccgttctacgaagaaccgaccctgatcatccgctgcgatatcctcgagccaggcaccctgcagggctatgaccgtgacccgcgctccatcgcgaaacgcgctgaagagtacctgcgcgccaccggcatcgctgacaccgtcctgttcgggccagaaacagaattcttcctgttcgacgacatccgttttggcgcctctatctccggctcccatgtcgcgatcgatgacatcgaaggtgcgtggaactcctccaccaaatacgaaggcggtaacaaaggtcaccgtccgggcgtgaaagggggttacttcccggttccgccagtagactcttctcaggatatccgttccaccatgtgtatgatcatggaagagatgggcctggttgttgaagctcaccaccacgaagtggctaccgcaggtcagaacgaagtggcaacccgcttcaacaccatgaccaaaaaagcggacgaaattcagatttacaaatacgttgttcacaacgtcgctcaccgcttcggtaaaaccgcgacctttatgccgaaaccaatgttcggcgataacggttccggcatgcactgccatatgtctctggcgaaaaacgggactaacctgttctccggcgacaaatacgcaggtctgtctgagcaggcgctgttctacatcggcggcgtaatcaaacacgctaaagctatcaacgccctggcgaacccgaccaccaactcctacaagcgtctggtcccgggttacgaagcgccggttatgctggcttactctgcgcgtaaccgctctgcctccatccgtattccggtggtgacctctccgaaagcgcgtcgtatcgaagtgcgcttcccggacccggctgccaacccgtacctgtgctttgcggcgctgctgatggctggccttgatggtatcaagaacaaaatccatccgggcgaagcaatggacaaaaacctgtatgacctgccgccggaagaagcgaaagagatcccgcaggttgcaggctctctggaagaagccctgcaggctctggatgctgaccgtgagttcctgacggctggcggcgtgttcaccaatgacgctatcgatgcttatatcgccctgcgtctggaagagaacgaccgcgtacgcatgactccgcatccggttgagttcgaactgtactacagcgtctaa

SEQ ID NO: 21328 - protein, 469 aa, Enterobacter gergoviae
MSAEHVLTMLNEHEVKFVDLRFTDTKGKEQHVTIPSHQVNAEFFEEGKMFDGSSIGGWKGINESDMVLMPDASTAVIDPFYEEPTLIIRCDILEPGTLQGYDRDPRSIAKRAEEYLRATGIADTVLFGPETEFFLFDDIRFGASISGSHVAIDDIEGAWNSSTKYEGGNKGHRPGVKGGYFPVPPVDSSQDIRSTMCMIMEEMGLVVEAHHHEVATAGQNEVATRFNTMTKKADEIQIYKYVVHNVAHRFGKTATFMPKPMFGDNGSGMHCHMSLAKNGTNLFSGDKYAGLSEQALFYIGGVIKHAKAINALANPTTNSYKRLVPGYEAPVMLAYSARNRSASIRIPVVTSPKARRIEVRFPDPAANPYLCFAALLMAGLDGIKNKIHPGEAMDKNLYDLPPEEAKEIPQVAGSLEEALQALDADREFLTAGGVFTNDAIDAYIALRLEENDRVRMTPHPVEFELYYSV

SEQ ID NO: 21329 - DNA, 1451 bp, Pinus sylvestris
  CDS (78)..(1145)
ggaattcggcacgagggccttcactgcttgcgaaattatacttgtgcgggagtctgtgattttgttgtacatccaagatgtctctactgacggatttgatcaacttggacctctctgatatcactgagaagataatcgctgagtacatatggatcggaggctctggcatggatatccgcagcaaggccaggaccttatctcacccagttacggaccccaaagatctacccaagttgaattatgatggatccagtactggacaggctcctggaaaggacagtgaagtcatcctttaccctcaggctatcttcagggatccattccgcagggggaacaacatcttggtgatttgtgatacatataccccagctggagaacctattcctactaacaagagagcaaatgcgcaaaaatatttagccatccagatgttgtttgccgaggaaccatggtatgggattgaacaagaatacactcttctgcaaaaggatgtgaattggcctcttggatggcccgtaggtggttaccctggtcctcagggtccttattattgtggaacgggagcagacaaagcctacggccgtgatatcgtcgatgcccactataaggcttgcctgtatgcaggaatcaacattagtggcatcaatggagaagtcatgcccggtcaatgggaatttcaagttggcccgacggttggtatttcatctggtgatcaagtctgggctgcacgttaccttcttgagagaatcacagaagtggctggtgttgtcctctcatttgaccccaaacccattcagggtgattggaatggtgctggtgctcacactaactacagtacgaaatcaatgagggaagaagggggaattaaagtgataaaaaaggccattgaaaagttagggttgaggcataaggaacacattgctgcctatggagagggcaacgagaggcgtttgactggccgacatgagacagcagacataaacacattttcatggggagttgcaaatcgtggagcttctattcgagttggccgtgacacggaacgtgaaggcaaagggtacttcgaagaccgcaggccagcttccaacatggacccctatattgtaacatctatgattgctgagaccaaccatcctttgaagtgagagtaacattgattactcaatgaataaagatgccgatacgattgaagtgttcttgatgctagtcaaattgcgaggggatccccaattgtttgtgggggatattctcatttgaatctctctgtgcctaaagtatttcccctatttctgttaataagaacattctagaaataggacttgagatttagggtgcattatattcagtgtctagtttgtcattcagatttgcattattccatgactctgatatgattggtgtgcaattgaatttaatgaattcagaagttcttttattgcttgcgaaaaaaa

SEQ ID NO: 21330 - protein, 355 aa, Pinus sylvestris
MSLLTDLINLDLSDITEKIIAEYIWIGGSGMDIRSKARTLSHPVTDPKDLPKLNYDGSSTGQAPGKDSEVILYPQAIFRDPFRRGNNILVICDTYTPAGEPIPTNKRANAQKYLAIQMLFAEEPWYGIEQEYTLLQKDVNWPLGWPVGGYPGPQGPYYCGTGADKAYGRDIVDAHYKACLYAGINISGINGEVMPGQWEFQVGPTVGISSGDQVWAARYLLERITEVAGVVLSFDPKPIQGDWNGAGAHTNYSTKSMREEGGIKVIKKAIEKLGLRHKEHIAAYGEGNERRLTGRHETADINTFSWGVANRGASIRVGRDTEREGKGYFEDRRPASNMDPYIVTSMIAETNHPLK

SEQ ID NO: 21331 - DNA, 1346 bp, Alnus glutinosa
  CDS (50)..(1120)
ccgagattcacttcaaagtctctgctttgtgtttgtgtttcttctcaacatgtcgctgctttcagatctcatcaaccttaacctctcggacgctactgataaagtgattgcagagtacatatggatcggtggatctggtacggacctcagaagcaaagctaggacgcttactggaccagtcaatcatccttcaaagcttcccaagtggaattatgatggttccagtacaggtcaagctcctggtgaagacagtgaagtgatctatatcctcaggcaatttttcaaggatccattcaggagaggcaacaatattctagtcatctgtgatacttacactccggcgggagagccaattccaacaaacaagagacatggtgctgcaaagatattcagccatcctgaagttgttgctgaagtaccctggtacggtattgagcaggagtacaccttgttgcagaaagatgtcaaatggcctcttgggtggcctgttggtggttatcctggtcctcagggaccatactactgtggtattggtgctgacaaagcctggggccgtgatatagttgatgctcattacaaggcttgtctatatgcaggcatcaacattagtggcatcaatggagaagtgatgccaggccagtgggaattccaagttggtccttctgttggcatctctgctggagatgaggtgtgggctgctcgatacattttggagaggattacagagattgctggggtggtgctcagccttgatcccaagccaatccagggtgattggaatggagctggtgctcacacaaactacagtaccaagtccatgagaaacaatggaggctatgagatcatcaagaaagcaattgagaagctagggctgaggcacaaagagcacattgcagcatatggggaaggcaatgagcgccgtctcactggccgacatgaaacagctgacatcaacactttcaaatggggtgttgccaaccgtggggcatctatccgtgttggcagagacacagaaaaagaaggcaaaggctattttgaggacaggaggcctgcttctaacatggatccatatgtggtcacttccatgatcgcggaaaccaccctcctgtggaagccatgagtgccagctacgcccgcctttgggaacattgtcattgtcttttcatgaagataaaagcaacgtgtcatttgtgtaaccattgtgctttccattagagtagctttgtcctgttatttctgtctcatttgccctttttatatgaggtggtagcaattcatgatactgcctcatgtgttaaataatgggttttgtataaactacaaaatgaaagggttggctattttgt

SEQ ID NO: 21332 - protein, 356 aa, Alnus glutinosa
MSLLSDLINLNLSDATDKVIAEYIWIGGSGTDLRSKARTLTGPVNHPSKLPKWNYDGSSTGQAPGEDSEVIYILRQFFKDPFRRGNNILVICDTYTPAGEPIPTNKRHGAAKIFSHPEVVAEVPWYGIEQEYTLLQKDVKWPLGWPVGGYPGPQGPYYCGIGADKAWGRDIVDAHYKACLYAGINISGINGEVMPGQWEFQVGPSVGISAGDEVWAARYILERITEIAGVVLSLDPKPIQGDWNGAGAHTNYSTKSMRNNGGYEIIKKAIEKLGLRHKEHIAAYGEGNERRLTGRHETADINTFKWGVANRGASIRVGRDTEKEGKGYFEDRRPASNMDPYVVTSMIAETTLLWKP

SEQ ID NO: 21333 - DNA, 1821 bp, Drosophila melanogaster
  CDS (148)..(1257)
gcttagtcgtgttccagtaacgcttccgcgcacaccaaatccaattcagtaccaaaatcggaatcagcgccaggacacagcacacagccgtcgtcccgccatcaattacatcgtcagtccaatcagaagtgcattgaaaaaatcagtatgtccgctaggatcctggaggactcgcccaacgcgcgcatcaacaagacgatcctcgatcgctatctttcactgccgctgcaggagaacatcgttcaggccacctacgtgtggatcgatggcaccggcgaggatttgcgctgcaaggatcgcaccctcgacttcattccccagagtcccaaggagctacccgtttggaactacgatggaagctcgtgctaccaggccgagggatccaactcggacacctacctgtatccggtggccatctacaaggacccgttccggcgcggcaacaacatcctggtgatgtgcgacacctacaagttcgacggcacccccacggacaccaacaagcgcaagacctgcctggaggtggccaacaagtgcgccgcagaggagccctggttcggtattgagcaggagtacaccttcctcgactttgatggccatccattgggctggcccaagaacggtttccccggaccccagggaccctactattgcggcgttggtgccaacaaggtctacgcccgcgacattgtggatgcccactatcgcgcctgtctgtacgccggcatcaaggtgtccggcaccaatgccgaggtgatgcccgcccagtgggagttccaggtgggaccctgcgagggcatctccattggtgatgatctctggatggcccgtttcctcttgcatcgcatctccgaggagtttggcattgtgtccactctggatcccaagccgatgcctggcgattggaacggtgctggtgcccacaccaatgtgtcgacgaaggcaatgcgcgaagatggcggcattcgggacattgagaaggcggtggccaagctgtccaagtgccacgagaggcacattcgcgcctacgatcccaagcagggacaggacaatgcccgtcgtctgaccggaaagcacgagacgagctccatcaacgatttcagtgccggcgtggccaatcgcggatgcagcatacgcattcctcgcggcgtcaatgatgatggcaagggctatttcgaggatcgccgccccagctccaactgcgatccctactccgtggtggaggccatcttgcgcaccatctgcctggacgaataggacgggatgggatatgcctatctcccgaattgttgttatcgatttatagcttgttgttaaaccaccttttgatccactgatccaatgacccacgaacaacccgatcaactgaacaccgaacgcgaagttatttgcataacgtaggcttagtttttacctaacgtatttcccataaaccagaactagaaacctaaggcagccccctcctcttgctgatattttcaaagttttttttttcttttttttgtagctgctgttacttaggttttagtatgagttttttttttttgtttgttgaccaatcaaatatatagtaatgtggtcagcgtaatgacgatgaaatgaagaggagcaagaacccaaaaaagacatccccacgaagaagaagaaaaaaaaagataacataaagctctagtatcaaacaattccttgagaccccgcaaaaaaaagaaaacccagccccctacttgttaatgatattaaataattaactttaatcctaaactacatacatatactctctagttaagtaaatgcactaaaaaataaaaaaaaatacacaat

SEQ ID NO: 21334 - protein, 369 aa, Drosophila melanogaster
MSARILEDSPNARINKTILDRYLSLPLQENIVQATYVWIDGTGEDLRCKDRTLDFIPQSPKELPVWNYDGSSCYQAEGSNSDTYLYPVAIYKDPFRRGNNILVMCDTYKFDGTPTDTNKRKTCLEVANKCAAEEPWFGIEQEYTFLDFDGHPLGWPKNGFPGPQGPYYCGVGANKVYARDIVDAHYRACLYAGIKVSGTNAEVMPAQWEFQVGPCEGISIGDDLWMARFLLHRISEEFGIVSTLDPKPMPGDWNGAGAHTNVSTKAMREDGGIRDIEKAVAKLSKCHERHIRAYDPKQGQDNARRLTGKHETSSINDFSAGVANRGCSIRIPRGVNDDGKGYFEDRRPSSNCDPYSVVEAILRTICLDE

SEQ ID NO: 21335 - DNA, 1595 bp, Medicago sativa
  CDS (88)..(1374)
gttcagtgacacaaggctcattttcattcacttgaacccatttccaaagtttgcagctttttgccatttttcaactctgtattgaacatggcacagattttggctccttctatacaatgtcagacaagaatcacaaaaacatctccccttgcaactccgatctcatcaaagatgtggagttctttggttatgaaacaaaacaagaaagttgcacgttctgctaaattcagagtaatggcaatcaactctggcaccatcaacagggttgaggatttacttaatttggacatcactccattcactgacagcataattgctgagtacatctggattggtggaacaggaatcgatgtgcgcagtaaatcaagaaccatatcaaagcctgttgagcatccctctgagcttcctaagtggaactatgacggatctagcactggacaagcccctggtgaagatagtgaagtgatcctctatcctcaagccattttcaaagatcctttccgcggtggtaacaacattttggtcatttgcgatgcttatacaccacaaggtgagcctatccctacaaataagagacataaagctgctgaaatcttcagtaacccaaaggttgaggctgaaattccgtggtatggaatcgaacaagagtacaccttacttcaaacagatgtgaaatggccattaggttggcctgttggtggctatcctggtcctcagggtccttattactgcgccgccggggcagataagtcatttggtcgtgatatatctgatgctcattacaaggcttgcttatatgctggaattaacatcagtggtaccaatggagaggttatgcctggccagtgggagtatcaagttggtcctagtgtaggtattgaagctggtgatcatatctgggcttcaaggtacatccttgagagaattactgaacaagctggtgttgtgctcacccttgatccaaaaccaattgagggtgattggaatggtgcaggatgtcacaccaattacagtacaaagagcatgagggaagatggaggatttgaggtaataaagaaggcaattttgaacctttcccttcgccacaaggttcacattgaagcatatggagaaggaaatgagagaaggttgacaggaaagcatgagactgccagcatcaacacattttcttggggagtggctaaccgtggatgctcaatccgtgtgggaagagacaccgagaagaatggcaaaggttacttggaagacaggcgtccggcttcaaacatggatccatatgtggtgacagccttattggcagagagtacattattgtgggaaccaactctagaggctgaagctcttgcagctcagaagattgcattgaaagtctaaatctattgattaatggaatcagcactgctgcagtttgtgaggtgctgggaagctctttcattttccatttagatttattatattatgaagatattgtttggacaaatgaggctgccatgcctagtcattggttatgagatgaatgcacattgtatatcagatatttcgttggctgtgtttgcatgtggtatggacagagttgcattgatgctttttttgtt

SEQ ID NO: 21336 - protein, 428 aa, Medicago sativa
MAQILAPSIQCQTRITKTSPLATPISSKMWSSLVMKQNKKVARSAKFRVMAINSGTINRVEDLLNLDITPFTDSIIAEYIWIGGTGIDVRSKSRTISKPVEHPSELPKWNYDGSSTGQAPGEDSEVILYPQAIFKDPFRGGNNILVICDAYTPQGEPIPTNKRHKAAEIFSNPKVEAEIPWYGIEQEYTLLQTDVKWPLGWPVGGYPGPQGPYYCAAGADKSFGRDISDAHYKACLYAGINISGTNGEVMPGQWEYQVGPSVGIEAGDHIWASRYILERITEQAGVVLTLDPKPIEGDWNGAGCHTNYSTKSMREDGGFEVIKKAILNLSLRHKVHIEAYGEGNERRLTGKHETASINTFSWGVANRGCSIRVGRDTEKNGKGYLEDRRPASNMDPYVVTALLAESTLLWEPTLEAEALAAQKIALKV

SEQ ID NO: 21337 - DNA, 1071 bp, Glycine max
  CDS (1)..(1071)
atgtcgttgctctccgatcttatcaaccttaacctctccgacatcaccgataaagtgatcgccgagtacatatgggtaggtggatctggcatggatatgaggagcaaagcaaggacactctcaggaccggttaaagacccttcgaagcttcccaagtggaactatgatggttccagcactggtcaagctcctgggcaagatagtgaagtgatcttatatccacaagcaattttcaaggatccattcaggaggggtagcaatatcctggttatgtgtgatgcttacactcctgctggggaacccattcctacaaacaagagaaataatgctgcaaagatattcggccatcctgatgttgctgctgaagaaccctggtatggcctagagcaagaatacaccttgttgcaaaaagatgtccaatggcctctaggatggcctcttggtggttttcctgggccacaaggaccatattattgtggtactggtgctaacaaggctttcgggcgtgatattgttgactcacattacaaagcatgtatttatgcgggcattaacatcagtggaatcaatggagaagtgatgcctggtcagtgggaattccaagttggtccatcaattggcatctctgctgctgacgaattgtgggttgctcgttatattttggagaggatcaccgagattgcaggagtggtgctttcctttgaccctaaaccaattcagggtgattggaatggtgctggtgctcacacaaattacagtaccaagtccatgagaaacgatggtggctatgaagtcatcaaaaaagcaattgctaagttggaaaagagacacaaggagcacattgcagcttacggagagggcaacgaacgccgtttgactggacgacacgagacagctgacatgaacacctttgtatggggtgttgcaaaccgtggtgcttctattagagtagggagggacactgagaaggcagggaaggggtattttgaggataggaggcctgcctctaatatggacccttatgtggtcacttccatgattgctgagacaaccattctttggaaaccataa

SEQ ID NO: 21338 - protein, 356 aa, Glycine max
MSLLSDLINLNLSDITDKVIAEYIWVGGSGMDMRSKARTLSGPVKDPSKLPKWNYDGSSTGQAPGQDSEVILYPQAIFKDPFRRGSNILVMCDAYTPAGEPIPTNKRNNAAKIFGHPDVAAEEPWYGLEQEYTLLQKDVQWPLGWPLGGFPGPQGPYYCGTGANKAFGRDIVDSHYKACIYAGINISGINGEVMPGQWEFQVGPSIGISAADELWVARYILERITEIAGVVLSFDPKPIQGDWNGAGAHTNYSTKSMRNDGGYEVIKKAIAKLEKRHKEHIAAYGEGNERRLTGRHETADMNTFVWGVANRGASIRVGRDTEKAGKGYFEDRRPASNMDPYVVTSMIAETTILWKP

SEQ ID NO: 21339 - DNA, 1372 bp, Medicago sativa
  CDS (92)..(1162)
ggcacgagtagagattcctgtgtagctatttgtctattacttgcttttcacacactgtgtttttcttcttcttccttcactgttcatcgtcatgtctttgctttcagatctcatcaacctcaatctctcagaatcctccgaaaagattattgctgaatacatatgggttggtggatctggtatggaccttagaagcaaagccaggactcttcctggtccagtgagtgaccctgcaaaactgcctaagtggaactatgatggatcaagcacaaatcaagctccaggacaagatagtgaagttatcttatatccacaagctattttcaaggatccatttagacaaggcaacaatattcttgtgatttgtgatgtttacaccccagctggtgaaccactcccaacaaacaagaggcacaatgctgccaaaattttcagtcaccctgatgttgctgctgaggtaccatggtatggtattgagcaagagtatacattattgcagaaagatactaattggccactaggatggcctattggtggctttccaggaccacaaggtccatattattgtgggattggtgctgataaagcatatggtcgtgatattgttgatgcacattacaaagcttgtctttatgctggcattaacattagtggcatcaatggagaggttatgcctggccagtgggagttccaagttggcccttctgttggtatttctgctggagatgaaatatgggctgctcgttacattctagagaggatcacagagatagctggagtggttgtttcatttgaccctaagccaattccgggtgattggaatggagctggtgctcacacaaactatagcaccaagtcaatgagagaggatggaggctatgaaatcatcaagaaggccattgaaaagcttggattgaggcataaggagcacattgctgcttatggggaaggaaatgagagacgtctcactggaaaacatgaaacaacagacatcaacaccttttcttggggtgtggcaaaccgtggtgcctcagttagggttggaagagacacagaaaaagatggcaaaggttactttgaggacagaaggccttcttctaatatggatccctatgtggtcacttccatgattgctgaaaccacccttctatggaaaccatgaagtcacaaccacttgtctttggatttggaccacatcacattatgtgttcaataaatagtctagtttatatctattattatcctgcaaagtgttgcttcattagtagtaattgtccaagtggtctttaagcacaaagcatttagtccatgtatttggatgacaataattttatcattaataacatggttgcttcttgattttactctaata

SEQ ID NO: 21340 - protein, 356 aa, Medicago sativa
MSLLSDLINLNLSESSEKIIAEYIWVGGSGMDLRSKARTLPGPVSDPAKLPKWNYDGSSTNQAPGQDSEVILYPQAIFKDPFRQGNNILVICDVYTPAGEPLPTNKRHNAAKIFSHPDVAAEVPWYGIEQEYTLLQKDTNWPLGWPIGGFPGPQGPYYCGIGADKAYGRDIVDAHYKACLYAGINISGINGEVMPGQWEFQVGPSVGISAGDEIWAARYILERITEIAGVVVSFDPKPIPGDWNGAGAHTNYSTKSMREDGGYEIIKKAIEKLGLRHKEHIAAYGEGNERRLTGKHETTDINTFSWGVANRGASVRVGRDTEKDGKGYFEDRRPSSNMDPYVVTSMIAETTLLWKP

SEQ ID NO: 21341 - DNA, 1065 bp, Agaricus bisporus
  CDS (1)..(1065)
atggccaacacctaccacaacgaccttcttgccccctacctcagcctcgatcaaggcgacaagatccaagcagagtacgtctggatcgacggtgacggtggcctccgctgcaagaccactaccgttagcaagaaggttaccgacatcggccaactccgcatttgggacttcgatggttcttccacaaatcaagcccccggtcacgattccgatgtctacctccgtcccgccgccatcttcaaagaccctttccgtggcggcgacaacatccttgttctcgcagagacctacaacaacgacggcactccaaaccgcaccaaccatcgccatcatgccaagaaggtctttgatgaagccaaggaacacgagccatggtttggtctcgaacaggaatatacccttttcgatgccgacgatcaaccatacggttggccaaaaggcggtttccccggccctcaaggtccctactactgcggtgctggcaccggcaaagtctttgcgcgtgacctcattgaggcacactatcgtgcctgcctctatgctggtatcaacatcagcggtatcaatgctgaagtgatgccttctcaatgggagttccaagtgggaccgtgtgaaggcatttctatgggcgaccacctttggatggcccggtatcttcttgttcgcatcgctgagcagtggggcgtcaaggtttccttccaccccaaacctctcaagggcgaatggaacggtgctggctgccacaccaacttctctaccaaggccatgcgggaagccggaggtatgaagttcatcgaagacgctatcgaaaaactcgccaaacgacatgatgaacatattgctgtttacggggaggacaatgacctccgactcactggtcgccacgagaccggtcacatcagcaatttcagctccggtgtagctaaccgcggtgcttcaattcgtgttccacgacatgttgcctctcagggctatggttatctcgaggatcgtcgccccgcgtccaatattgatccctatcgcgtcacgagcatcatcgccgaaaccaccatcctcgataaataa

SEQ ID NO: 21342 - protein, 354 aa, Agaricus bisporus
MANTYHNDLLAPYLSLDQGDKIQAEYVWIDGDGGLRCKTTTVSKKVTDIGQLRIWDFDGSSTNQAPGHDSDVYLRPAAIFKDPFRGGDNILVLAETYNNDGTPNRTNHRHHAKKVFDEAKEHEPWFGLEQEYTLFDADDQPYGWPKGGFPGPQGPYYCGAGTGKVFARDLIEAHYRACLYAGINISGINAEVMPSQWEFQVGPCEGISMGDHLWMARYLLVRIAEQWGVKVSFHPKPLKGEWNGAGCHTNFSTKAMREAGGMKFIEDAIEKLAKRHDEHIAVYGEDNDLRLTGRHETGHISNFSSGVANRGASIRVPRHVASQGYGYLEDRRPASNIDPYRVTSIIAETTILDK

SEQ ID NO: 21343 - DNA, 1245 bp, Amanita muscaria
  CDS (96)..(1160)
atatttgcgctccttatcgtccaatgagattcgttcaaatagatgtcaacattcttcctttatctattttactcggcgcttccaacttgtccgtcatggctaaccagtaccacaacgatctcctcgctccctacctcgctctcgaccaaggcggcaaattccacgctgaatatgtctggattgacggcgatggtggtctccgttcaaagactactactgtcgaccagaaggtgacagatatcagccaacttcgtgtttgggatttcgatggctcttccacaaaccaagccccttctggtaattccgatgtatatctccgcccgtctgccatctttaaagaccccttccggggcggagaaaacatcctcgttctttccgaaacctacaacaacgacggtactcctaacaggacaaaccaccgccaccacactgccaaggttatggagctggccaaggacgagataccatggtttggtattgagcaggaatatacccttttcgacgcagacggttcaccttacggatggccaaaaggcggtttccctggaccccagggtccctactactgcggtgcaggcaccggtaaagtctttgctcgtgacctcatcgaggctcattatcgcgcatgtctatatgcgggtgtcaacatcagcggcatcaacgcagaggttatgccatcacaatgggagttccaggtcgggccatgtgagggtatttccatgggcgaccatctgtggatggctcgttacttgcttatccgcgtcgcggagcaatggggcgtcaaggtttctttccaccctaaaccccttcaaggagattggaacggtgctggtgctcacaccaactactctacattagctatgcgcgagcctggtggtatgaagtacatcgaggctgcgattgaaaagttggccaagagacacgacgaacacatcgcggtttatggtgaagataacgaaatgcgtctcaccggccgccacgagacaggccacattggcactttctcgtctggcgtagccaaccgtggtgcttccattcgtgtaccaaggcatgttgctaacaaaggatatggatacctcgaagatagacgccctgcttccaacattgacccttaccgtgtaaccggcatcatcatagagacgactatccttgacaaatagattaaatccagtgtgtatctgtagattgatatgtaggcaaaattaaaggacggacttgttgaatcacaaaaaaaaaaaaaaaaaa

SEQ ID NO: 21344 - protein, 354 aa, Amanita muscaria
MANQYHNDLLAPYLALDQGGKFHAEYVWIDGDGGLRSKTTTVDQKVTDISQLRVWDFDGSSTNQAPSGNSDVYLRPSAIFKDPFRGGENILVLSETYNNDGTPNRTNHRHHTAKVMELAKDEIPWFGIEQEYTLFDADGSPYGWPKGGFPGPQGPYYCGAGTGKVFARDLIEAHYRACLYAGVNISGINAEVMPSQWEFQVGPCEGISMGDHLWMARYLLIRVAEQWGVKVSFHPKPLQGDWNGAGAHTNYSTLAMREPGGMKYIEAAIEKLAKRHDEHIAVYGEDNEMRLTGRHETGHIGTFSSGVANRGASIRVPRHVANKGYGYLEDRRPASNIDPYRVTGIIIETTILDK

SEQ ID NO: 21345 - DNA, 1110 bp, Ashbya gossypii
  CDS (1)..(1110)
atgagcgagctagtagagaagacatcgacgttgctgaaatacctcgatttggaccagcgcggggcggtgatcgcggagtacatctgggtcgactcggccgggcacttgcggtcgaaggggcgcacgttgcagcggcgcgtggagagcgtggacgagttgccggagtggaacttcgacgggtcgtcgacggggcaggcgcctgggcacgactcggacgtgtacttgaagccggtggccttctacccggacccgttccggcgcggggacaacatcatcgtgttggcggagtgctggaacaacgacggcacgccgaacaagtacaaccaccggcacgaggcggcgaagctctttgaggcgcacagggcggcggacatctggtttgggctcgagcaggagtacacgttgttcgaccacaacgacaacgtgtacgggtggcccaagggcggcttccccgcgccgcagggcccctactactgcggcgtgggcgcgggcaaggtgtacgcgcgcgacgtggtcgaggcgcactaccgcgcgtgcctctacgcgggccttcgcatctcgggcatcaacgccgaggtgatgccctcgcagtgggagttccaggtcgggccgtgcacgggcatcaccatgggcgacgagctctgggtggggcgctacttgctccaccgcgtcgccgaggagttcggcgtgaaggtctccttccaccccaagcccttgaagggcgattggaacggcgcgggctgccacaccaacgtgtccacgagggagatgcgccagcccggcggcatgcgctacatcgaggaggccatcgacaagttgtccaagcgccacaaggagcacatcaagctctacggctccgacaacgagctccgcctcaccggccgccacgagaccgcctccatggccaccttctcgtccggcgtggccaaccgcggcgcgtccatccgcattccgcgctccgtcagcaaggagggcttcggctacttcgaggatcgccggcccgcctccaacatcgacccttacttggttaccggcataatatgcgagaccatctgcggtgccattgagaatgcagatatgtccaaggagttcgagcgtgaatcttcttga

SEQ ID NO: 21346 - protein, 369 aa, Ashbya gossypii
MSELVEKTSTLLKYLDLDQRGAVIAEYIWVDSAGHLRSKGRTLQRRVESVDELPEWNFDGSSTGQAPGHDSDVYLKPVAFYPDPFRRGDNIIVLAECWNNDGTPNKYNHRHEAAKLFEAHRAADIWFGLEQEYTLFDHNDNVYGWPKGGFPAPQGPYYCGVGAGKVYARDVVEAHYRACLYAGLRISGINAEVMPSQWEFQVGPCTGITMGDELWVGRYLLHRVAEEFGVKVSFHPKPLKGDWNGAGCHTNVSTREMRQPGGMRYIEEAIDKLSKRHKEHIKLYGSDNELRLTGRHETASMATFSSGVANRGASIRIPRSVSKEGFGYFEDRRPASNIDPYLVTGIICETICGAIENADMSKEFERESS

SEQ ID NO: 21347 - DNA, 1119 bp, Candida glabrata
  CDS (1)..(1119)
atgcatgaacacagtgttgaaaagactcaaatcttacaaaaataccttgagttgccccaaaacggtaaggtcatcgccgagtacgtctgggttgacggtactggtaacctacgttccaaggctagaactttgaacaaagtcataacgtctattgagcaactgccggagtggaactttgacggttcttctactaaccaagccccaggctacgactcagacatctacttgaagccagtggcgttctaccctgatccattcagaagaggtgacaacatcactgtcttggctgaatgtttcaacagtgacggtactccaaacaagttcaaccacagacatgaggctaacaagttgttccaagcacacaaggacgaagagatctggttcggtatcgagcaagaatacactttgttcgacatgtacgacaacgtctacgcttggccaaagggtggttacccagccccacaaggtccatactactgtggtgttggtgccggtaaggtctacgccagagatgtgatcgaagcccactacagagcctgtctatacgctggtatcaacatctcaggtatcaacgccgaagtgatgccttcccaatgggaattccaagttggtccatgtgagggtatctccatgggtgaccaattgtggatggccagatacttcttgcacagagtggcagaagaattcggtgtcaagatttccttccatccaaagcctttgaagggtgactggaatggtgctggttgccatactaacgtctctacaaaggacatgagagtgccaggtggtatgaagtacatcgaacaagccatcgaaaaactttcaaagagacacaacgaacacatcaagctatatggtgccgacaacgaacaaagactaacgggtagacacgaaaccgcctccatgacatccttctccagtggtgtcgctaacagaggtgcttccatcagaatacctagaccagtcgccaaggaaggattcggttacttcgaagaccgtagaccagcctccaacatagatccatacttggtcaccggtatcatgtgtgagactgtttgtggtgccatcgaaaacgccaacatgtccaaggaatacgaaagagaaactaacgaacaataa

SEQ ID NO: 21348 - protein, 372 aa, Candida glabrata
MHEHSVEKTQILQKYLELPQNGKVIAEYVWVDGTGNLRSKARTLNKVITSIEQLPEWNFDGSSTNQAPGYDSDIYLKPVAFYPDPFRRGDNITVLAECFNSDGTPNKFNHRHEANKLFQAHKDEEIWFGIEQEYTLFDMYDNVYAWPKGGYPAPQGPYYCGVGAGKVYARDVIEAHYRACLYAGINISGINAEVMPSQWEFQVGPCEGISMGDQLWMARYFLHRVAEEFGVKISFHPKPLKGDWNGAGCHTNVSTKDMRVPGGMKYIEQAIEKLSKRHNEHIKLYGADNEQRLTGRHETASMTSFSSGVANRGASIRIPRPVAKEGFGYFEDRRPASNIDPYLVTGIMCETVCGAIENANMSKEYERETNEQ

SEQ ID NO: 21349 - DNA, 1083 bp, Colletotrichum gloeosporioides
  CDS (1)..(1083)
atggcgacagaagctgccgtggtttccaaccccaacaccctggccaagtacctgaagcttgaccagaagggctcgatcatggccgagtacatctggatcgatgctgatggcgagacccgctccaagtcaaggacactcaaggagaaggagtacactcccgaagaccttcctatgtggaacttcgacggttcctccaccggccaggcccccggtgacaactctgacgtctacctgaagcccgttgccgtcttccccgaccccttccgtggatcccccaacattctcgtcctctccgagtgctggaacgccgacggcacccccaacaagtacaactacagacatgagtgcgctaagctcatggaggctcacgccgcccacgagccctggttcggtctcgagcaggagtacaccctcctcgacctcagcaaccgccccttcggctggcctgctaacggtttccccgcccctcagggcccttactactgcggtgttggtaccggcaaggttgtccagcgtgatatcgttgacgcccactacaaggcctgcttgtactctggcgtcaagatctctggtaccaacgccgaggtcatgcccgcccagtgggagttccaggtcggcccttgcgtcggcattgagatgggtgaccacctgtggctcgctcgcttcctgctcgcccgtattgcggaagagttcggcgccaaggtttccgttgaccctaagcccatccccggtgactggaacggtgccggtctgcacagcaatttctccaccaaggagatgcgtgttgagggtggtatgaagcacattgaggccgccatcaagaagcttgagggccgccacaaggagcacatcgccgtttacggcgagggcaacgagaagcgccttactggccgccacgagacgggagccatcgaccagttctcttacggagttgccaaccgtggtgcttccattcgtatccccagagagtacaccgccaagggctacggttacttcgaggaccgtcgtcccgcttccaacgccgacccctacaggattactggtattctgatggagaccatttacggttccgtcgacaactaa

SEQ ID NO: 21350 - protein, 360 aa, Colletotrichum gloeosporioides
MATEAAVVSNPNTLAKYLKLDQKGSIMAEYIWIDADGETRSKSRTLKEKEYTPEDLPMWNFDGSSTGQAPGDNSDVYLKPVAVFPDPFRGSPNILVLSECWNADGTPNKYNYRHECAKLMEAHAAHEPWFGLEQEYTLLDLSNRPFGWPANGFPAPQGPYYCGVGTGKVVQRDIVDAHYKACLYSGVKISGTNAEVMPAQWEFQVGPCVGIEMGDHLWLARFLLARIAEEFGAKVSVDPKPIPGDWNGAGLHSNFSTKEMRVEGGMKHIEAAIKKLEGRHKEHIAVYGEGNEKRLTGRHETGAIDQFSYGVANRGASIRIPREYTAKGYGYFEDRRPASNADPYRITGILMETIYGSVDN

SEQ ID NO: 21351 - DNA, 1077 bp, Cryptococcus neoformans
  CDS (1)..(1077)
atgtctcaactaattgccaccaagcgagttgatcttcttgccccttacctcgcccttgatcagggttctcgtgttcaggccgagtacatctggattgacgctgagggaggtatccgaagtaagaccatgactctcgataaggctccttcatctgttgccgatctcaaggagtggaatttcgacggttcttctaccaaccaggcccctgctgataactctgatgtcttcctccgtcctgttgccatcttcaaggaccccttccgaggtggcgccaacattctcgttctctgcgaatgttacgacaacgacggtacccctaacaagtccaactaccgagctcactgcaagaaggtgatggacgccgccaaggacactgagccttggttcggtctcgagcaggagtacactctttttgacgccgatggtcaagtctttggctggcccaagaatggtttccccggtcctcagggtccttactactgtggtgtcggtgccggcaaggtgtttgctcgtgatttcatcgaggctcactacagggcttgtctctacgccggtatcaagatttccggtatcaacgccgaggtcatgccatctcagtgggagttccaggttggtccttgtactggtatcgagatgggtgaccatctctggatgccccgattcctccttcttaggattggtgaggagtggggtatcactccttctctccatcctaagcctctgaagggtgattggaacggtgccggttgccactccaactactccaccaaggacatgcgaacacccggtaagggtatggctgctatcgaagatgccatcaagaagctagaaaagaagcacctcgaacacatcgcggtttacggtgaagataatgacttgcggttgaccggcaagcatgagaccgcatcaatgaccaccttctctgctggtgttgccaacaggggtgcctctattcgaattcccaggcatgtcggtgcgcagggttacggttaccttgaagatcgtcgacccgcctctaacgttgacccttatcgagtcacagccatcctcgtcgagaccaccgttcttaacaactaa

SEQ ID NO: 21352 - protein, 358 aa, Cryptococcus neoformans
MSQLIATKRVDLLAPYLALDQGSRVQAEYIWIDAEGGIRSKTMTLDKAPSSVADLKEWNFDGSSTNQAPADNSDVFLRPVAIFKDPFRGGANILVLCECYDNDGTPNKSNYRAHCKKVMDAAKDTEPWFGLEQEYTLFDADGQVFGWPKNGFPGPQGPYYCGVGAGKVFARDFIEAHYRACLYAGIKISGINAEVMPSQWEFQVGPCTGIEMGDHLWMPRFLLLRIGEEWGITPSLHPKPLKGDWNGAGCHSNYSTKDMRTPGKGMAAIEDAIKKLEKKHLEHIAVYGEDNDLRLTGKHETASMTTFSAGVANRGASIRIPRHVGAQGYGYLEDRRPASNVDPYRVTAILVETTVLNN

SEQ ID NO: 21353 - DNA, 1113 bp, Debaryomyces hansenii
  CDS (1)..(1113)
atggtgtcgattacagaacaaactgctattttagccaaatatttggatctttctcaaaacggtaaggtgttagccgaatacgtgtggattgatgctgatggtaactctagatctaagtgtaaaacattagacaagaagccaagctcagttgaagatttaccagaatggaactttgacggttcttctaccggtcaagctcctggtcatgattccgatgtgtatttaagaccagtcgcattctacgcagatcctttcagaaagggtgacaacatcattgttttaaccgaatgttggaacaacgacggtactccaaacaagttcaaccacagacacgaatctgctaagttaatgaaggcccatgctgatgaagaagtctggttcggtttagagcaagaatacaccttattcgaccaatttgaccaaccatacgcatggccaaagggtggtttcccagctccacaaggtccttactactgtggtgtcggaaccggtaaggtttacgccagagacttaattgaagctcactacagagcttgtcttcacgccggtgtcgatatttctggtatcaacgctgaagtcatgccatcacaatgggaattccaagtcggtccttgtgaaggtatccaaatgggtgacgagttatggattgctcgttacttgttacaaagagtcgccgaagaattcggtgttaaggtttctttccatccaaagcctttgaaaggtgaatggaacggtgctggttgtcacactaatgtttctaccaagtctatgagattaccaggtggtatgaagagtatagaagttgctttatctaaattagcaaagagacataaggaacatatgttgttatacggtgctgataatgatcaaagattaacaggtcgtcatgagactgcttctatcgaaggtttctcatctggtgttgctaacagaggtgcttctgttagaatcccaagatctgttgccaaggaaggctatggttatttcgaagatagaagacctgcttccaatatagatccttacttggttactggtattatggttgaaaccatttgtggttccattccagatgctgatatgttcaaagaatatgctagagaatcttctgattaa

SEQ ID NO: 21354 - protein, 370 aa, Debaryomyces hansenii
MVSITEQTAILAKYLDLSQNGKVLAEYVWIDADGNSRSKCKTLDKKPSSVEDLPEWNFDGSSTGQAPGHDSDVYLRPVAFYADPFRKGDNIIVLTECWNNDGTPNKFNHRHESAKLMKAHADEEVWFGLEQEYTLFDQFDQPYAWPKGGFPAPQGPYYCGVGTGKVYARDLIEAHYRACLHAGVDISGINAEVMPSQWEFQVGPCEGIQMGDELWIARYLLQRVAEEFGVKVSFHPKPLKGEWNGAGCHTNVSTKSMRLPGGMKSIEVALSKLAKRHKEHMLLYGADNDQRLTGRHETASIEGFSSGVANRGASVRIPRSVAKEGYGYFEDRRPASNIDPYLVTGIMVETICGSIPDADMFKEYARESSD

SEQ ID NO: 21355 - DNA, 1038 bp, Emericella nidulans
  CDS (1)..(1038)
atgaagtacatgagcctcgaccagcgagggtcggtcatggctgagtacatttggatcgacgcccacggcggtactcgaagtaagacaaagactctttctaaggccccttctagcgttgatgagctccccgaatggaatttcgacggttcatcaacagctcaggcccccggtgacaactcagatgtctaccttcgccctgtcgctatgtaccccgatcctttccgtcgcggcgataacatcctcgttctctgtgagacatgggactctgatggaagccccaacaagttcaactaccgtcacgactgcgcccgtctgatggaaacgcatgccaaggaggagttctggtttggtcttgagcaagagtacacccttctcggccctgacggctggccttacggttggcccaagggcggtttccccggtgcccagggaccgtactactgtggtgtcggtaccggcaaggtctactgccgtgacatcgttgaggcgcactaccgcgcctgtctctacgccggtgttaagatctctggtatcaacgcggaggtcatgccctctcaatgggagtaccaggttggtccttgccatggcatcgaaatgggtgaccacctctggatctctcgtttccttctccaccgcgtcgccgaagagttcggtgtgaagatctccaacgatcctaagcccatcaagggtgactggaacggtgccggtctgcacactaacgtctcaacgacgtcaacacgtgccgagggtggcatcaaggccattgagtcgtacatgaagaaacttgaagcccgccatgtcgagcacattgccgtctacggtgagggtaacgaggagcgtctcactggtcgtcacgagactggtaacatcgacaagttctcatacggtgttgctgaccgtggtggctccatccgaattccccggcaagtcgccaaggatggtaagggttacttcgaagaccgccgccccgcttccaacgcggacccttaccagattactggtatcattgctgaaactgtaagtttttctaatcgatga

SEQ ID NO: 21356 - protein, 345 aa, Emericella nidulans
MKYMSLDQRGSVMAEYIWIDAHGGTRSKTKTLSKAPSSVDELPEWNFDGSSTAQAPGDNSDVYLRPVAMYPDPFRRGDNILVLCETWDSDGSPNKFNYRHDCARLMETHAKEEFWFGLEQEYTLLGPDGWPYGWPKGGFPGAQGPYYCGVGTGKVYCRDIVEAHYRACLYAGVKISGINAEVMPSQWEYQVGPCHGIEMGDHLWISRFLLHRVAEEFGVKISNDPKPIKGDWNGAGLHTNVSTTSTRAEGGIKAIESYMKKLEARHVEHIAVYGEGNEERLTGRHETGNIDKFSYGVADRGGSIRIPRQVAKDGKGYFEDRRPASNADPYQITGIIAETVSFSNR

SEQ ID NO: 21357 - DNA, 1335 bp, Fusarium solani
  CDS (91)..(1161)
gatacgtttagtatcaattcactttctttcttccggatctcgcttggaattaatctctcttcacctcacaaacccaaaaaacctttcacaatggcgacttcagctcccgtcacctcgaggaccgagaccctcgcaaaatatctcaagctcgaccagaagggccagatcatggccgagtacgtctgggttgatgctgctggcgagacccgatcaaagtcccgaactctccctgagaaggactacaaggccgaggacctccccgtctggaacttcgatggttcctctaccaaccaggcccccggcgacaactccgatgtctacctccgcccctgcgccgtctaccccgatcccttccgtggctctcccaacatcatcgttctcgctgagtgctggaacgccggtggcactcccaacaagttcaacttccgacatgactgcgtgaaggtcatggacacctacgccgaagacgagccctggttcggtctcgagcaggagtacaccctgctcggtcctgacaaccgaccctacggctggcccactggcggtttccccgctcctcagggcgagtactactgcggtgttggcaccggcaaggttgtccagcgcgacatcgtcgaggctcactacaaggcctgcttgtacgctggcatccagatttccggcaccaacgctgaggttatgcctgctcagtgggagtaccaagtcggcccttgcctgggtattgagatgggcgaccaactttgggtttcacgattcttcctcgcccgcatcactgaagagttcggcgccaaggtctccctgcaccccaagccaatcgcgggagactggaacggagctggcctgcattccaatttctctacgaaggcgatgcgcgaggagggtggaatgaaggtgatcgaggaggcgctgaagaaactcgagcctcaccacgccgagtgtatcgcggagtatggcgaggacaacgaactccgccttactggccgtcatgagactggctcgatcgactcgttctcctggggcgtcgccaaccgcggaacaagtatccgcgcccctcgtgaaaccgcagccaagggctacggttacttcgaggatcgccgccctgcctctaacgctgacccttaccgggtcaccaaggctctccttcagttctctctggcttaagcgtgtgaaaagatttttgttcagacgagttcgtctttcatggttaccggcgtgagggtttgggacactattacatagatagcatgacaactggtccagcgagatccagtaattacaatgatcactgatgcaaaaaaaaaaaaaaaaaaaaaaaaaaaagcggccgctgaattc

SEQ ID NO: 21358 - protein, 356 aa, Fusarium solani
MATSAPVTSRTETLAKYLKLDQKGQIMAEYVWVDAAGETRSKSRTLPEKDYKAEDLPVWNFDGSSTNQAPGDNSDVYLRPCAVYPDPFRGSPNIIVLAECWNAGGTPNKFNFRHDCVKVMDTYAEDEPWFGLEQEYTLLGPDNRPYGWPTGGFPAPQGEYYCGVGTGKVVQRDIVEAHYKACLYAGIQISGTNAEVMPAQWEYQVGPCLGIEMGDQLWVSRFFLARITEEFGAKVSLHPKPIAGDWNGAGLHSNFSTKAMREEGGMKVIEEALKKLEPHHAECIAEYGEDNELRLTGRHETGSIDSFSWGVANRGTSIRAPRETAAKGYGYFEDRRPASNADPYRVTKALLQFSLA

SEQ ID NO: 21359 - DNA, 1062 bp, Gibberella fujikuroi
  CDS (1)..(1062)
atggctactcctatcacctcacggacggagactctccagaagtatctcaagcttgatcagaagggtatgatcatggctgagtacgtctgggttgatgccgatggtggcactcgttccaagtctcgcacattgcccgagaaagaatacaagcccgaggatcttcccgtttggaacttcgatggttcttccactaaccaggcccctggtgacaactccgatgtctacctccgtccctgcgccgtctaccctgatcccttccgcggctctcccaacatcattgttcttgctgagtgctggaacgccgatggcactcccaacaaatacaacttccgtcacgattgcgtgaaggtcatggacacctacgccgacgacgagccyttgtttggcctcgagcaggagtataccctcctcggctctgacaaccgaccctatggctggcccgccggtggtttccctgctccccaaggcgagtactactgtggtgtgggcactggaaaggttgtccagcgcgatatcgtcgaggcccattataaagcctgtttgtacgccggcatccagatctctggaacgaacgccgaggtcatgcctgctcagtgggaatatcaggtcggcccctgcactggcattgcaatgggcgaccaactctggatttcgcgattctttttacatcgagtcgctgaggaattcggtgcaaaggtttctttgcaccccaagcccattgctggcgattggaacggaggtttgcactccaacttctccacgaaagcaatgcgcgaggagggtggtatgaaggttattgaggaggccctgaagaagcttgaacctcaccacgtcgagtgtatcgcagagtatggtgaggataacgaattgcgtttgaccggccgtcacgagactggatccatcgacagcttttcttggggtgtcgccaaccgtggcacaagcatccgcgtgccacgcgaaacggctgctaagggctatggctactttgaggaccgccgtcctgcttccaacgccgatccctaccgcgttaccaaggttctcctccaattttctatggcttag

SEQ ID NO: 21360 - protein, 353 aa, Gibberella fujikuroi
MATPITSRTETLQKYLKLDQKGMIMAEYVWVDADGGTRSKSRTLPEKEYKPEDLPVWNFDGSSTNQAPGDNSDVYLRPCAVYPDPFRGSPNIIVLAECWNADGTPNKYNFRHDCVKVMDTYADDEPLFGLEQEYTLLGSDNRPYGWPAGGFPAPQGEYYCGVGTGKVVQRDIVEAHYKACLYAGIQISGTNAEVMPAQWEYQVGPCTGIAMGDQLWISRFFLHRVAEEFGAKVSLHPKPIAGDWNGGLHSNFSTKAMREEGGMKVIEEALKKLEPHHVECIAEYGEDNELRLTGRHETGSIDSFSWGVANRGTSIRVPRETAAKGYGYFEDRRPASNADPYRVTKVLLQFSMA

SEQ ID NO: 21361 - DNA, 1119 bp, Kluyveromyces lactis
  CDS (1)..(1119)
atggctgctactagtgatattgtcgaaaagactcacattttacaaaaatatttggaattagaccaaagaggtgctatcatcgccgaatacgtttggattgattccgaaggtggtttgagatccaagggtagaaccttgaacaagaaggtcacatccgttgattctttgccagagtggaactttgatggttcttctaccggccaagctccaggtcatgactccgatatctacttgaagcctgttgccttctacccagatccatttagaagaggtgacaacattgttgttttggctgaatgttggaacaacgatggtactccaaataagttcaaccacagacatgaagctgctaagttgttcgaagctcacaaggatgctgagatgtggttcggtttggaacaagaatacactttgttcgaccaatacgatcaagtatatggctggccaaagggtggtttcccagctccacaaggtccatactactgtggtgttggtgccggtaaggtctttgctcgtgacgtcatcgaagctcattacagagcctgtttgtatgccggtgtgaacatctctggtatcaacgctgaagtcatgccatctcaatgggaattccaagtcggtccatgtgaaggtatcgccatggctgatcaattgtggatcgccagatacttcctgcatagagtagccgaagaattcggtgttaaggtttctctacatccaaagccattgaagggtgactggaacggtgctggttgtcacaccaacgtttctaccaagctaatgagagctccaggtggtatgaagtacatcgaagatgctatcgaaaagttgtccaagagacataacgaacacatcaagctatatggtgctgacaacgaacaaagattgactggtagacatgaaaccgcatccatgtccaccttctcttctggtgtcgccaaccgtggtgcttccattagaatcccaagatctgtcaacaaagagggatacggatatttcgaagacagaagacctgcctccaacattgacccttacttggttactggtatcatgtgtgaaactgtctgtggtgctattgaaaacgccaacatgactaaggaatacgaaagagaatctttataa

SEQ ID NO: 21362 - protein, 372 aa, Kluyveromyces lactis
MAATSDIVEKTHILQKYLELDQRGAIIAEYVWIDSEGGLRSKGRTLNKKVTSVDSLPEWNFDGSSTGQAPGHDSDIYLKPVAFYPDPFRRGDNIVVLAECWNNDGTPNKFNHRHEAAKLFEAHKDAEMWFGLEQEYTLFDQYDQVYGWPKGGFPAPQGPYYCGVGAGKVFARDVIEAHYRACLYAGVNISGINAEVMPSQWEFQVGPCEGIAMADQLWIARYFLHRVAEEFGVKVSLHPKPLKGDWNGAGCHTNVSTKLMRAPGGMKYIEDAIEKLSKRHNEHIKLYGADNEQRLTGRHETASMSTFSSGVANRGASIRIPRSVNKEGYGYFEDRRPASNIDPYLVTGIMCETVCGAIENANMTKEYERESL

SEQ ID NO: 21363 - DNA, 1429 bp, Lactuca sativa
  CDS (16)..(1092)
catcacttcgatctcatggctctgctttcggatctcgtcaacctcgacctctctagtatcaccgataagattatcgccgagtatatatggatcggcggatcgggtatggatcttagaagcaaagcaagaacactttcagggcctgtgtcggatcccagtgagcttccgaagtggaactacgatggctctagcacagggcaagctcccggagaagacagtgaagtcatcatataccctcaagcaatcttcaaagatccattcaggagaggcaaccatatcttggtgatgtgtgatgcttacactcccgccggcgaaccaatccccaccaacaagagggccgccgccgccaaaatcttcagcaacccagaagtcgaaaaggaggttacatggtacggaattgagcaagaatacaccttgttgcagaaggacaccaactggccattgggttggcctctaggtggtttccctggtccacagggcccatactactgtggaattggcgctgataaagcttttggacgtgatattgttgatgcacactacaaagcttgcctttacgctggcgtcaacattagcggcatcaatggcgaagttatgcctggacaatgggaatttcaagtaggaccttccgtaggcatagctgcagctgatcaaatctgggtcgctcgttacattcttgagaggatcactgagatttatggggtggtggtttcatttgaccccaagcctattccgggtgactggaatggagctggtgctcacacaaattacagtacaaaaaccatgagggaagagggaggatatgaggtgatcaagaaagctatcgagaagttgggattgaggcacaaggaacacattgctgcatatggtgaaggcaatgaacgtaggctcactggtcgacatgaaacagctgatatcaacacctttttatggggtgttgcaaaccgtggagcttctattcgtgttggaagagacacagagaaagaagggaaaggttactttgaggacagaaggccagcttcaaacatggatccatatgtcgtgacttccatgattgctgagactaccattctgtgggacaacaaatcttgaaaagagatcgaaaattatgaagcctgattgggagggagatttgaaaaaatgaaattagaattgggaacaaacaaaacaacccttcttgtttattttcttgaaaattagatattgttcttgtttgtttgtgttgcatgttgatcgttatggttattatggtaatggtagttttgtgtttcatgtttcttgtagcaaagcattttgagtccaaaatgcatgtaaagctactacttgatttgagatttctcccatggtgattcatgggaatattgtcgatattgtctatgataataacaaatatgaagggttgatttttatccaaaaaaaaaaaaaaaaa

SEQ ID NO: 21364 - protein, 358 aa, Lactuca sativa
MALLSDLVNLDLSSITDKIIAEYIWIGGSGMDLRSKARTLSGPVSDPSELPKWNYDGSSTGQAPGEDSEVIIYPQAIFKDPFRRGNHILVMCDAYTPAGEPIPTNKRAAAAKIFSNPEVEKEVTWYGIEQEYTLLQKDTNWPLGWPLGGFPGPQGPYYCGIGADKAFGRDIVDAHYKACLYAGVNISGINGEVMPGQWEFQVGPSVGIAAADQIWVARYILERITEIYGVVVSFDPKPIPGDWNGAGAHTNYSTKTMREEGGYEVIKKAIEKLGLRHKEHIAAYGEGNERRLTGRHETADINTFLWGVANRGASIRVGRDTEKEGKGYFEDRRPASNMDPYVVTSMIAETTILWDNKS

SEQ ID NO: 21365 - DNA, 1062 bp, Lupinus luteus
  CDS (1)..(1062)
atgtctgtactctcagatttaataaaccttaacctctctgacaccacagagaagattatcgccgagtacatatgggtgggtggatctggtgtggacctcaggagtaaagcaaggaccctgtcaggacctgttaatgacccttcaaagcttcccaagtggaactatgatggctccagtactggccaagctccaggaaaagatagtgaagtgatcttatggccacaagcaattttcaaggatccatttaggaggggtaacaatatcctggttatgtgtgatacttacactcctgctggagaacctattccaacaaacaagagacatgctgctgcaaagatattcagccaccctgatgttgttgctgaagaaccctggtttggtattgagcaggaatacaccttgttacagaaagatatccattggcctattggatggccacttggtggttttcctggacctcagggaccatactattgtggtaccggtgctgaaaaagctttcggtcgtgatattgttgactcacattacaaagcatgtctttatgctggcatcaacattagtggcattaatgcagaagtgatgcctggccagtgggaattccaagttggtccaagtgttggtatctctgctggtgatgagttgtgggttgctcgttacattttggagaggatcactgagattgctggggtggtcctttccttagaccccaaaccgattccgggtgattggaatggtgctggtgctcacactaattacagtaccaagtccatgagaaatgatggtggctatgaagtcataaaaaaagcaattgagaagttggggaagagacacaatgagcacattgctgcttatggtgaaggtaacgaacgtcgtctgaccggaagacacgaaactgctgacattagtactttcttttggggtgttgcaaaccgtggagcttctattagggtgggcagggacactgagaaagaaggcaagggatattttgaggacagaaggcctgcttctaacatggacccatatgtggtcacttctatgattgcagagacaacccttctctag

SEQ ID NO: 21366 - protein, 353 aa, Lupinus luteus
MSVLSDLINLNLSDTTEKIIAEYIWVGGSGVDLRSKARTLSGPVNDPSKLPKWNYDGSSTGQAPGKDSEVILWPQAIFKDPFRRGNNILVMCDTYTPAGEPIPTNKRHAAAKIFSHPDVVAEEPWFGIEQEYTLLQKDIHWPIGWPLGGFPGPQGPYYCGTGAEKAFGRDIVDSHYKACLYAGINISGINAEVMPGQWEFQVGPSVGISAGDELWVARYILERITEIAGVVLSLDPKPIPGDWNGAGAHTNYSTKSMRNDGGYEVIKKAIEKLGKRHNEHIAAYGEGNERRLTGRHETADISTFFWGVANRGASIRVGRDTEKEGKGYFEDRRPASNMDPYVVTSMIAETTLL

SEQ ID NO: 21367 - DNA, 1813 bp, Neisseria gonorrhoeae
  CDS (123)..(1541)
tcggcttggaatttgacgcaaaaccggtttcagacggcatcggcgtggtaaaatcgtgccgactttgcgtcaagccgccgcgttccgcgtattttgccatttccctttttcaggagctgaagatgtccattaaaaacgccgtaaaattgattgaaaaaagcaaagcccgctttgtcgatttgcgcttcaccgataccaaaggcaagcagcaccactttaccgtgcctgcgcgcatcgtgttggaaggccccgaagagtggttcgaaaacggtcaggcgtttgacggttcgtccatcggcggctggaaaggcattcaggcttccgatatgcagctgcgtcccgatgcgtccacagccttcgtcgatcctttttatgatgatgttaccgtcgtcattacctgcgacgtcatcgaccctgccgacggtcagggttacgaccgcgacccgcgctccatcgcacgccgcgccgaagcctatttgaaatcttccggtatcggcgacaccgcctatttcggtcccgaacccgaattcttcgtcttcgacggcgtagaatttgaaaccgacatgcacaaaacccgttacgaaatcacgtccgaaagcggcgcgtgggcaagcggcctgcatatggacggtcaaaacaccggccaccgccccgccgtcaaaggcggctacgcgcccgtcgcgccgattgactgcggtcaagatttgcgctccgccatggtgaacattttggaaggactcggcatcgaagtcgaagtccaccacagcgaagtcggtaccggcagccaaatggaaatcggcacccgtttcgccactttggtcaaacgcgccgaccaaacccaagatatgaaatacgtcatccaaaacgttgcccacaatttcggcaaaaccgccacctttatgcccaaaccgattatgggcgacaacggcagcggtatgcacgtccaccaatccatttggaaagacggtcaaaacctgttcgcaggcgacggctatgccggtttgtccgataccgcgctctactacatcggcggcatcatcaaacacgccaaagccctgaacgcgattaccaatccgtccaccaactcctacaaacgcctcgtgccgcactttgaagcaccgaccaaattggcctattccgccaaaaaccgttccgcttccatccgtatcccgtctgtgaacagcagcaaggcgcgccgcatcgaagcgcgtttccccgacccgaccgccaacccgtatttggcatttgccgccctgctgatggcgggtttggacggcattcaaaacaaaatccatccgggcgaccctgccgataaaaacctgtacgacctgccgccggaagaagacgcgctcgtcccgaccgtctgcgcttctttggaagaagcacttgccgccctcaaggccgaccacgaattcctgctgcgcggcggcgtgttcagcaaagactggatcgacagctacatcgcctttaaagaggaagatgtccgccgcatccgtatggcgccgcacccgctggaatttgaaatgtattacagcctgtaaaccgtcgggtttcagtagcaatgccgtctgaacacagtttcagacggcattttgcattggaacggcaaaccggcggcgcgtggcggcatttttcagcaggcgggcgatatttgctacaataggcttttgttttttggctgtacgaacgatgactgcatcgaaatcaggttttatcgggcaaatcttttcccgcaatatgcttgtctgtatttttacggggtttgcctcggggctgccgctgtacttctgattaacctgattccggcgtggtt

SEQ ID NO: 21368 - protein, 472 aa, Neisseria gonorrhoeae
MSIKNAVKLIEKSKARFVDLRFTDTKGKQHHFTVPARIVLEGPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 21369 - DNA, 1089 bp, Neurospora crassa
  CDS (1)..(1089)
atggcgtcagaatcaacaatcctctccaatgccgagaacctcaagaagttcttgcgtcttccccagaacggccagctcattgccgagtacatctggatcgacagcgaaggcggcaccaggtcaaagtcgaggactcttcccgagaaggagagccaatatctccctgaggagcttcccatctggaacttcgatggttcctcgactggccaggcccccggcgagaactccgatgtctacctcaagcccgtagccgtcttccctgacccgttccgtggtagccccaacattctcgtcctctccgagtgctggaacgccgatggcacccccaacaagttcaaccacagacatgaagccgccaagttgatggaggctcatgccgaccaggttccctggttcggtctcgagcaggagtacactctcctcgacatcaacgacaggccctatggttggcccagaaacggtttccccgctccccagggcccctactactgcggtgtcggcactggcaaggttgtccagcgtgacattgtcgaggcgcactacaagtgctgcttgtacgccggcgtcaagatctctggcaccaacgccgaggtcatgcctgctcagtgggagttccaggtcggcccttgcgacggcatcgagatgggtgaccacctctggctcgctcgcttcctcctccaccgcgtgtcggaagagttcggcgccaaggtctccttcgaccccaagcccattcccggtgactggaacggcgcgggcctccacaccaacttctctaccgagaacatgcgcaaggagggtggcatgaagtacattgaggatgccatcaagaagctcgaggcccgtcataaggagcacattgccgtctatggcgagggcaatgataagcgtcttaccggccgtcacgagaccggctctatcgactctttcacatacggcgttgccaaccgcggcgcctctatccgtattcctagggaatgcggcgccaagggctacggttacttcgaggaccgtcgccctgcgtccaacgccgacccttaccagattacgggtattatcatggagacttgctttggcgctgtttcggagtaa

SEQ ID NO: 21370 - protein, 362 aa, Neurospora crassa
MASESTILSNAENLKKFLRLPQNGQLIAEYIWIDSEGGTRSKSRTLPEKESQYLPEELPIWNFDGSSTGQAPGENSDVYLKPVAVFPDPFRGSPNILVLSECWNADGTPNKFNHRHEAAKLMEAHADQVPWFGLEQEYTLLDINDRPYGWPRNGFPAPQGPYYCGVGTGKVVQRDIVEAHYKCCLYAGVKISGTNAEVMPAQWEFQVGPCDGIEMGDHLWLARFLLHRVSEEFGAKVSFDPKPIPGDWNGAGLHTNFSTENMRKEGGMKYIEDAIKKLEARHKEHIAVYGEGNDKRLTGRHETGSIDSFTYGVANRGASIRIPRECGAKGYGYFEDRRPASNADPYQITGIIMETCFGAVSE

SEQ ID NO: 21371 - DNA, 1065 bp, Suillus bovinus
  CDS (1)..(1065)
atggcctaccagtaccacaacgacctccttgctccttaccttgcgttgtcccagggtgacaaagtgcaagccgagtacgtttggattgatggcgatggcggccttcgttcaaagaccatgactatgaccaagaagaccactgatattggccagctccgcatctgggatttcgatggttcatccacaaaccaagctccaggcggtgactcagatgtctatctccgtcccgccgctattttcaaagatcctttccgaggcggcgacaacattctcgtccttgccgagaccttcaacaatgacggcacacccaatagaacaaaccaccgtcaccacaccaagaaggtcatggatctcgcaaaggactccgttccttggttcggtcttgagcaagaatatacccttttcgatgcagatggcacgccattcggctggccgaagggtggcttccccggaccccagggcccttactactgcggagcaggaactggcaaagtttttgctcgtgacctcatcgaggctcactaccgtgcctgcctatacgccggcgtgaacatcagcggtatcaacgctgaagtcatgccctcccaatgggagttccaagtcggcccttgcgagggtatttccatgggtgatcacctctggatggctcgttaccttctcgttcgcatcgctgaacagtggggcatcaaggtctccttccaccccaagcctcttgcgggtgactggaacggtgctggttgccacaccaactacagcaccaaggtcatgcgtgagcctggaggtatgaagtacatcgatgaggccatcgagaaactttcaaagagacatgctgaacacatcgctgtttacggagaggacaatgatctccgtctcactggacgtcatgagactggccacatcggagacttcagttctggcgttgctaaccgcggagcttccatccgggtgccaaggcacgttgctgcccagggttacggatacctggaggaccgtcgtccggcttccaacattgacccataccgtgtgactggaataatcgtggagaccactgttcttgacaagtag

SEQ ID NO: 21372 - protein, 354 aa, Suillus bovinus
MAYQYHNDLLAPYLALSQGDKVQAEYVWIDGDGGLRSKTMTMTKKTTDIGQLRIWDFDGSSTNQAPGGDSDVYLRPAAIFKDPFRGGDNILVLAETFNNDGTPNRTNHRHHTKKVMDLAKDSVPWFGLEQEYTLFDADGTPFGWPKGGFPGPQGPYYCGAGTGKVFARDLIEAHYRACLYAGVNISGINAEVMPSQWEFQVGPCEGISMGDHLWMARYLLVRIAEQWGIKVSFHPKPLAGDWNGAGCHTNYSTKVMREPGGMKYIDEAIEKLSKRHAEHIAVYGEDNDLRLTGRHETGHIGDFSSGVANRGASIRVPRHVAAQGYGYLEDRRPASNIDPYRVTGIIVETTVLDK

SEQ ID NO: 21373 - DNA, 1300 bp, Tuber borchii
  CDS (45)..(1121)
tttactcaacacaacttgttttttagaccaaatagtcaatcacgatgagcgaaaactctactatcgtctccaatacggcgaatctcgtcaaatttctcaacctagatcagaaagggtcgattttggcggagtatatctggattgacggtgcgaacggcgtcagatctaagaccaagactctcttcaagaagccatcctctgtcgaagacttgcctgaatggaactttgacggttcctccactggtcaagctcctggtgaggattcggacatctatctccgtcctgtcgccatatttccagatccgttcagaatgggtgacaacattcttgtgttggctgagtgctggaatgcggacgggtctcctaacaagtttaatcatcggcacgaatgtgctaagattatggaggcccacaaggatcagaagccttggtttggattggagcaagagtatactctcttcgatctttatgggaacccgtacgggtggcccaagggaggtttcccaggccctcaggggccatactactgtggtgtcggaactggcaaggtttattgtcgcgacattgtcgaggcacattacaaggcctgcttgtttgccggaatcaagatctccggaatcaacgccgaggttcttccctcccaatgggagttccaagtcggtccgtgtgtcggtatcgagatgggcgaccatctctggatttccagataccttctgcaccgtgttgccgaagaatttggggttaagatttcgttccaccccaagcccatccctggtgattggaatggctccggtctccataccaacgtgtcgacccaagctatgcgcgatgagggaggcatgaaggctattgaggaggccatccagaagctttcaacccgccatgctgagcacatcgccgtctacggcgatgacaacaccctccgtctcactggcagacatgaaactggaaacattgatgccttctcctatggtgtcgcggacagaggatcttctattagaatccctaggtcttgcgcaaaggaagggaaggggtactttgaagataggcgccctgcatctaatgcttgtccataccagattacgggcatcatgatggagacgatttgtggtggtatttagattatgggtttcctttcctggcggagtttgtttctcttgggttgttttgtattttttccttctttcgtctttttattttagacacgaacgttagcgagaccccatcgaatgaaaagggttcacggaagtctaactattaatgcaaaaatgaaattatggttaaaaaaaaaaaaaaaaaa

SEQ ID NO: 21374 - protein, 358 aa, Tuber borchii
MSENSTIVSNTANLVKFLNLDQKGSILAEYIWIDGANGVRSKTKTLFKKPSSVEDLPEWNFDGSSTGQAPGEDSDIYLRPVAIFPDPFRMGDNILVLAECWNADGSPNKFNHRHECAKIMEAHKDQKPWFGLEQEYTLFDLYGNPYGWPKGGFPGPQGPYYCGVGTGKVYCRDIVEAHYKACLFAGIKISGINAEVLPSQWEFQVGPCVGIEMGDHLWISRYLLHRVAEEFGVKISFHPKPIPGDWNGSGLHTNVSTQAMRDEGGMKAIEEAIQKLSTRHAEHIAVYGDDNTLRLTGRHETGNIDAFSYGVADRGSSIRIPRSCAKEGKGYFEDRRPASNACPYQITGIMMETICGGI

SEQ ID NO: 21375 - DNA, 1407 bp, Vigna aconitifolia
  CDS (78)..(1148)
attcagaaaaaggagaaagagagatctttttgtgctgtgaagaagggtctttccttgtttcttcgtgtcttacttacatgtcgctgctatcagatctcatcaacctcaacctctccgacaccaccgagaagatcatcgcagagtacatatggatcggtggatcaggactggacctaaggagcaaagcaaggactctcccaggaccagttagcgacccttcaaagctgcctaagtggaactatgacggctccagcactggtcaagcccctggagaagacagtgaagtgattatatacccacaagctattttcaaggatccattcagaaggggtaacaatatcttggttatgtgtgatgcttacactccagctggagaacccattcccactaacaagaggcacaatgctgccaagatattcagccatcctgatgttgttgccgaagagccctggtacggtatcgagcaggaatacaccttgttgcagaaggatgtcaactggccacttgggtggcctgttggcggtttccctggacctcagggaccttactactgtggtgctggtgctgataaggcttttgggcgtgacattgttgacgcacattacaaagcctgtctttatgctggcatcaacatcagtggaattaatggagaggttatgccgggtcagtgggaattccaagttggacctgcggttgggatatcagctggtgacgagttgtgggtagctcgttacatcttggagaggatcactgagattgctggtgtggtgctttcctttgaccctaagccaatcaagggtgattggaatggtgccggtgctcacaccaactacagcacgaagacaatgagaaacgatggtggctatgaagtaattaaatcagcaattgaaaaattggggaagaggcacaaggagcatatcgctgcttatggagaaggcaatgaacgccgtctgacaggacgacacgaaactgcagacatcaacaccttcttatggggagttgcaaaccgtggagcttctattagagttgggagggacacggagaaagcagggaagggatactttgaggacagaaggccagcttctaacatggacccgtatgttgttacttccatgattgcagacacaaccattctgtggaagccatgagcaacaacacctgcactttgtctctttctttggggatgggaggaaagggaacattaagtagggatttgctcctttatttcatacctcttactttttaggatttggatttctggtaattgttgtggttcgcttgcttggggccttgctggttggtacaaccaactaccaaggattcttcattgccttccatttctttcccatgttttccgattgttataataatatcattaataatcatatatatatgaaacgtatcctc

SEQ ID NO: 21376 - protein, 356 aa, Vigna aconitifolia
MSLLSDLINLNLSDTTEKIIAEYIWIGGSGLDLRSKARTLPGPVSDPSKLPKWNYDGSSTGQAPGEDSEVIIYPQAIFKDPFRRGNNILVMCDAYTPAGEPIPTNKRHNAAKIFSHPDVVAEEPWYGIEQEYTLLQKDVNWPLGWPVGGFPGPQGPYYCGAGADKAFGRDIVDAHYKACLYAGINISGINGEVMPGQWEFQVGPAVGISAGDELWVARYILERITEIAGVVLSFDPKPIKGDWNGAGAHTNYSTKTMRNDGGYEVIKSAIEKLGKRHKEHIAAYGEGNERRLTGRHETADINTFLWGVANRGASIRVGRDTEKAGKGYFEDRRPASNMDPYVVTSMIADTTILWKP

SEQ ID NO: 21377 - DNA, 1095 bp, Yarrowia lipolytica
  CDS (1)..(1095)
atggttttgtcaaaatacctggacctcccccagcacggagctgtcctggccgagtacatctggatcgatgcccatttcaacatccgatccaagtgcaagactctagacaagaagcccacttccatcgaagacctccccgagtggaactttgacggctcctccacagatcaggctcccggccacgactcggatatctatctccgacccgccgccatctaccccgatcctttccgacgaggcgacaacattattgttctggccgagtgctggaacaacgacggaacccccaacaagttcaaccaccgacacgagtgcgccaagctcatgagcgcccacgagaaggaggtcatctggttcggaatcgagcaggagtacaccatgttcgacgagagcgataaccccgtcggatggcctaagggcggtttccccgctccccagggcccctactactgtggtgtcggaaccggcaaggtctttgctcgagacgttgttgaggcccactaccgagcctgtctctactccggaatcaacatctccggtatcaacgccgaggtcatgccttcccagtgggagtaccaggttggtccctgcgagggtatctccatggccgatgagctgtggatgtcccgatacctgctgcaccgagttgccgaggagtttggcatcaagatctccttccaccccaagcccctgcagggagactggaacggagccggctgtcacaccaacgtgtccaccaagtcgatgcgagagcccggtggaatgaagcacattgaggctgccatcgagaagcttgctgcccgacacaaggagcacattgccgtctacggcgaggacaacgacatgcgactcaccggccgacacgagaccggctccatcggctctttctcttccggagttgccaaccgaggctgctccatccgaattcctcgatctgtggccaaggagggctacggctactttgaggaccgacgacccgcctccaacattgacccctaccttgttaccggtatcatgaccgagaccatctgtggctccattcctgatgccgacatggttgaggagaccaagcgaggtgaggaggagggcttttaa

SEQ ID NO: 21378 - protein, 364 aa, Yarrowia lipolytica
MVLSKYLDLPQHGAVLAEYIWIDAHFNIRSKCKTLDKKPTSIEDLPEWNFDGSSTDQAPGHDSDIYLRPAAIYPDPFRRGDNIIVLAECWNNDGTPNKFNHRHECAKLMSAHEKEVIWFGIEQEYTMFDESDNPVGWPKGGFPAPQGPYYCGVGTGKVFARDVVEAHYRACLYSGINISGINAEVMPSQWEYQVGPCEGISMADELWMSRYLLHRVAEEFGIKISFHPKPLQGDWNGAGCHTNVSTKSMREPGGMKHIEAAIEKLAARHKEHIAVYGEDNDMRLTGRHETGSIGSFSSGVANRGCSIRIPRSVAKEGYGYFEDRRPASNIDPYLVTGIMTETICGSIPDADMVEETKRGEEEGF

SEQ ID NO: 21379 - DNA, 24 bp, Artificial sequence
  (1)..(24): primer
atggctgaagcaagcatcgaaaag

SEQ ID NO: 21380 - DNA, 27 bp, Artificial sequence
  (1)..(27): primer
ttatgaagattctctttcaaattcctt

SEQ ID NO: 21381 - protein, 448 aa, Artificial sequence
  Variant (2)..(2): xaa in position 2 is any amino acid
  Variant (4)..(12): xaa in position 4 to 12 is any amino acid
  Variant (13)..(13): xaa in position 13 is any or no amino acid
  Variant (18)..(18): xaa in position 18 is any amino acid
  Variant (20)..(20): xaa in position 20 is any amino acid
  Variant (22)..(22): xaa in position 22 is any amino acid
  Variant (23)..(33): xaa in position 23 to 33 is any or no amino acid
  Variant (35)..(35): xaa in position 35 is any or no amino acid
  Variant (37)..(37): xaa in position 37 is any or no amino acid
  Variant (39)..(39): xaa in position 39 is any amino acid
  Variant (41)..(45): xaa in position 41 to 45 is any amino acid
  Variant (46)..(51): xaa in position 46 to 51 is any or no amino acid
  Variant (53)..(53): xaa in position 53 is any amino acid
  Variant (54)..(54): xaa in position 54 is any or no amino acid
  Variant (56)..(56): xaa in position 56 is any amino acid
  Variant (63)..(63): xaa in position 63 is any amino acid
  Variant (64)..(64): xaa in position 64 is any or no amino acid
  Variant (67)..(67): xaa in position 67 is any amino acid
  Variant (69)..(69): xaa in position 69 is any amino acid
  Variant (70)..(70): xaa in position 70 is any or no amino acid
  Variant (74)..(74): xaa in position 74 is any or no amino acid
  Variant (76)..(76): xaa in position 76 is any or no amino acid
  Variant (78)..(79): xaa in position 78 to 79 is any amino acid
  Variant (80)..(88): xaa in position 80 to 88 is any or no amino acid
  Variant (90)..(90): xaa in position 90 is any amino acid
  Variant (95)..(98): xaa in position 95 to 98 is any amino acid
  Variant (99)..(103): xaa in position 99 to 103 is any or no amino acid
  Variant (109)..(114): xaa in position 109 to 114 is any amino acid
  Variant (115)..(125): xaa in position 115 to 125 is any or no amino acid
  Variant (127)..(129): xaa in position 127 to 129 is any amino acid
  Variant (131)..(131): xaa in position 131 is any amino acid
  Variant (133)..(141): xaa in position 133 to 141 is any amino acid
  Variant (142)..(149): xaa in position 142 to 149 is any or no amino acid
  Variant (152)..(153): xaa in position 152 to 153 is any or no amino acid
  Variant (155)..(155): xaa in position 155 is any amino acid
  Variant (162)..(165): xaa in position 162 to 165 is any amino acid
  Variant (166)..(174): xaa in position 166 to 174 is any or no amino acid
  Variant (176)..(176): xaa in position 176 is any or no amino acid
  Variant (180)..(180): xaa in position 180 is any amino acid
  Variant (181)..(183): xaa in position 181 to 183 is any or no amino acid
  Variant (194)..(194): xaa in position 194 is any amino acid
  Variant (196)..(196): xaa in position 196 is any amino acid
  Variant (198)..(201): xaa in position 198 to 201 is any amino acid
  Variant (202)..(222): xaa in position 202 to 222 is any or no amino acid
  Variant (227)..(227): xaa in position 227 is any amino acid
  Variant (231)..(233): xaa in position 231 to 233 is any amino acid
  Variant (236)..(236): xaa in position 236 is any amino acid
  Variant (240)..(240): xaa in position 240 is any amino acid
  Variant (242)..(242): xaa in position 242 is any amino acid
  Variant (244)..(244): xaa in position 244 is any amino acid
  Variant (249)..(249): xaa in position 249 is any amino acid
  Variant (252)..(252): xaa in position 252 is any or no amino acid
  Variant (260)..(261): xaa in position 260 to 261 is any amino acid
  Variant (262)..(269): xaa in position 262 to 269 is any or no amino acid
  Variant (272)..(273): xaa in position 272 to 273 is any amino acid
  Variant (276)..(276): xaa in position 276 is any amino acid
  Variant (279)..(279): xaa in position 279 is any amino acid
  Variant (285)..(285): xaa in position 285 is any amino acid
  Variant (288)..(288): xaa in position 288 is any amino acid
  Variant (290)..(291): xaa in position 290 to 291 is any amino acid
  Variant (294)..(295): xaa in position 294 to 295 is any amino acid
  Variant (297)..(298): xaa in position 297 to 298 is any amino acid
  Variant (303)..(303): xaa in position 303 is any amino acid
  Variant (304)..(304): xaa in position 304 is any or no amino acid
  Variant (306)..(306): xaa in position 306 is any amino acid
  Variant (311)..(314): xaa in position 311 to 314 is any or no amino acid
  Variant (316)..(316): xaa in position 316 is any amino acid
  Variant (318)..(318): xaa in position 318 is any amino acid
  Variant (320)..(320): xaa in position 320 is any amino acid
  Variant (321)..(322): xaa in position 321 to 322 is any or no amino acid
  Variant (325)..(326): xaa in position 325 to 326 is any amino acid
  Variant (329)..(331): xaa in position 329 to 331 is any amino acid
  Variant (332)..(333): xaa in position 332 to 333 is any or no amino acid
  Variant (335)..(336): xaa in position 335 to 336 is any amino acid
  Variant (337)..(337): xaa in position 337 is any or no amino acid
  Variant (339)..(341): xaa in position 339 to 341 is any amino acid
  Variant (343)..(346): xaa in position 343 to 346 is any amino acid
  Variant (347)..(347): xaa in position 347 is any or no amino acid
  Variant (350)..(351): xaa in position 350 to 351 is any amino acid
  Variant (354)..(354): xaa in position 354 is any amino acid
  Variant (355)..(355): xaa in position 355 is any or no amino acid
  Variant (357)..(360): xaa in position 357 to 360 is any amino acid
  Variant (361)..(383): xaa in position 361 to 383 is any or no amino acid
  Variant (389)..(389): xaa in position 389 is any amino acid
  Variant (393)..(394): xaa in position 393 to 394 is any amino acid
  Variant (396)..(397): xaa in position 396 to 397 is any amino acid
  Variant (399)..(400): xaa in position 399 to 400 is any amino acid
  Variant (412)..(417): xaa in position 412 to 417 is any amino acid
  Variant (418)..(421): xaa in position 418 to 421 is any or no amino acid
  Variant (424)..(424): xaa in position 424 is any amino acid
  Variant (430)..(430): xaa in position 430 is any amino acid
  Variant (431)..(431): xaa in position 431 is any or no amino acid
  Variant (434)..(434): xaa in position 434 is any amino acid
  Variant (438)..(438): xaa in position 438 is any amino acid
  Variant (440)..(442): xaa in position 440 to 442 is any amino acid
  Variant (444)..(445): xaa in position 444 to 445 is any amino acid
  Variant (447)..(447): xaa in position 447 is any amino acid
LXLXXXXXXXXXXYIWIXGXGXXXXXXXXXXXXRXKXRXLXXXXXXXXXXXLXXWXFDGSSTXXQAXGXXSDVXLXPXXXXXXXXXXXFXDPFRXXXXXXXXXLVMCDXXXXXXXXXXXXXXXXXPXXXNXRXXXXXXXXXXXXXXXXXWFXXGXEQEYTLXXXXXXXXXXXXXPXGWPXXXXGFPGPQGPYYXGXGXXXXXXXXXXXXXXXXXXXXXXXXXGRDIXDAHXXXCLXAGIXIXGXNGEVXPGXQWEFQVGXXXXXXXXXXGIXXGDXLWXARYILXRIXEXXGVXXSXXPKPIXXGXWNGAXXXXGXHXNXXXSTXXMRXXXXXGXXXIXXXIXXXXXRHXXHIXXYXXXXXXXXXXXXXXXXXXXXXXXXXXXRRLTGXHETXXIXXFXXGVANRGASIRVXXXXXXXXXXGYXEDRRPXXSNXDPYXVXXXIXXTXI

SEQ ID NO: 21382 - protein, 17 aa, Artificial sequence
  Variant (2)..(2): xaa in position 2 is Asp, Gly, Asn, Gln or Ser
  Variant (3)..(3): xaa in position 3 is Phe or Tyr
  Variant (9)..(9): xaa in position 9 is any amino acid
  Variant (11)..(12): xaa in position 11 to 12 is any amino acid
  Variant (13)..(13): xaa in position 13 is any or no amino acid
  Variant (15)..(16): xaa in position 15 to 16 is any or no amino acid
WXXDGSSTXQXXXGXXS

SEQ ID NO: 21383 - protein, 51 aa, Artificial sequence
  Variant (2)..(6): xaa in position 2 to 6 is any amino acid
  Variant (8)..(23): xaa in position 8 to 23 is any amino acid
  Variant (24)..(26): xaa in position 24 to 26 is any or no amino acid
  Variant (28)..(28): xaa in position 28 is any amino acid
  Variant (30)..(30): xaa in position 30 is Asn, Pro, Gln or Thr
  Variant (32)..(32): xaa in position 32 is Phe or Tyr
  Variant (33)..(33): xaa in position 33 is any amino acid
  Variant (34)..(34): xaa in position 34 is Phe, Ile, Leu, Met or Val
  Variant (35)..(35): xaa in position 35 is Phe, Ile, Leu or Met
  Variant (36)..(50): xaa in position 36 to 50 is any amino acid
  Variant (51)..(51): xaa in position 51 is Ala, Gly, Ile, Leu or Pro
PXXXXXRXXXXXXXXXXXXXXXXXXXGXEXEXXXXXXXXXXXXXXXXXXXX

SEQ ID NO: 21384 - protein, 34 aa, Artificial sequence
  Variant (2)..(2): xaa in position 2 is any amino acid
  Variant (3)..(3): xaa in position 3 is Phe, Ile, Leu or Val
  Variant (4)..(4): xaa in position 4 is any amino acid
  Variant (5)..(5): xaa in position 5 is Asp, Glu or His
  Variant (6)..(11): xaa in position 6 to 11 is any amino acid
  Variant (12)..(12): xaa in position 12 is Ile, Leu, Met or Val
  Variant (13)..(13): xaa in position 13 is any amino acid
  Variant (14)..(14): xaa in position 14 is Ala or Ser
  Variant (15)..(15): xaa in position 15 is Glu or Gly
  Variant (16)..(16): xaa in position 16 is Phe, Ile, Leu or Val
  Variant (17)..(19): xaa in position 17 to 19 is any amino acid
  Variant (21)..(21): xaa in position 21 is any amino acid
  Variant (23)..(23): xaa in position 23 is Ala, Gly or Pro
  Variant (26)..(27): xaa in position 26 to 27 is any amino acid
  Variant (28)..(28): xaa in position 28 is Ala, Gly or Ser
  Variant (32)..(32): xaa in position 32 is Phe or Tyr
  Variant (34)..(34): xaa in position 34 is Ile or Val
RXXXXXXXXXXXXXXXXXXGXNXEVXXXQWEXQX

SEQ ID NO: 21385 - protein, 33 aa, Artificial sequence
  Variant (2)..(2): xaa in position 2 is any amino acid
  Variant (3)..(3): xaa in position 3 is Ala, Gly or Ser
  Variant (5)..(5): xaa in position 5 is Phe, Trp or Tyr
  Variant (6)..(6): xaa in position 6 is Phe, Ile or Leu
  Variant (7)..(7): xaa in position 7 is Leu or Met
  Variant (8)..(8): xaa in position 8 is any amino acid
  Variant (10)..(10): xaa in position 10 is any amino acid
  Variant (11)..(11): xaa in position 11 is Ala, Cys, Gly, Ser or Thr
  Variant (12)..(14): xaa in position 12 to 14 is any amino acid
  Variant (15)..(15): xaa in position 15 is Ala, Asp, Glu, Gly or Asn
  Variant (16)..(18): xaa in position 16 to 18 is any amino acid
  Variant (19)..(19): xaa in position 19 is Glu, Asn, Ser or Thr
  Variant (20)..(22): xaa in position 20 to 22 is any amino acid
  Variant (25)..(25): xaa in position 25 is any amino acid
  Variant (26)..(26): xaa in position 26 is any or no amino acid
  Variant (28)..(28): xaa in position 28 is any amino acid
  Variant (29)..(30): xaa in position 29 to 30 is any or no amino acid
WXXRXXXXRXXXXXXXXXXXXXKPXXGXXXWNG

SEQ ID NO: 21386 - protein, 51 aa, Artificial sequence
  Variant (4)..(4): xaa in position 4 is any or no amino acid
  Variant (6)..(6): xaa in position 6 is any or no amino acid
  Variant (9)..(16): xaa in position 9 to 16 is any amino acid
  Variant (18)..(18): xaa in position 18 is Ala, Ile or Val
  Variant (19)..(19): xaa in position 19 is Ala, Gly, Pro or Ser
  Variant (20)..(20): xaa in position 20 is any amino acid
  Variant (22)..(22): xaa in position 22 is Ala, Gly or Ser
  Variant (23)..(23): xaa in position 23 is Ala, Cys, Gly, Ser or Thr
  Variant (25)..(25): xaa in position 25 is any amino acid
  Variant (27)..(36): xaa in position 27 to 36 is any amino acid
  Variant (37)..(37): xaa in position 37 is any or no amino acid
  Variant (39)..(39): xaa in position 39 is Trp or Tyr
  Variant (40)..(40): xaa in position 40 is any amino acid
  Variant (45)..(45): xaa in position 45 is Pro or Thr
  Variant (46)..(46): xaa in position 46 is Ala, Gly, Asn, Ser or Thr
  Variant (47)..(47): xaa in position 47 is Ala, Gly, Ser or Val
  Variant (48)..(48): xaa in position 48 is Asn, Gln or Ser
  Variant (49)..(50): xaa in position 49 to 50 is any amino acid
  Variant (51)..(51): xaa in position 51 is Ala or Pro
LTGXHXETXXXXXXXXGXXXRXXSXRXXXXXXXXXXXGXXEDRRXXXXXXX

SEQ ID NO: 21387 - DNA, 393 bp, Escherichia coli
  CDS (1)..(393)
atgcatggccttaacaaagacatcatctttccgttgcagatcttcgccctttcaaataacgtactttacaactttcccgaacaaggagttgtgcccgtgttgtatgttatttacgctcaagacaaagctgatagcctcgaaaaacgcctttccgttcgtccggcacatttagcacgtttacagttactgcatgatgaaggtcgtttgttgacagctggtccaatgccagcggtagacagtaacgatccaggggctgcgggatttactggctcaaccgttattgctgaatttgaatcgctggaagcagctcaggcctgggccgatgctgacccgtacgtagcggcaggagtctatgaacacgtttcagtgaaaccatttaagaaagtgttctga

SEQ ID NO: 21388 - protein, 130 aa, Escherichia coli
MHGLNKDIIFPLQIFALSNNVLYNFPEQGVVPVLYVIYAQDKADSLEKRLSVRPAHLARLQLLHDEGRLLTAGPMPAVDSNDPGAAGFTGSTVIAEFESLEAAQAWADADPYVAAGVYEHVSVKPFKKVF

SEQ ID NO: 21389 - DNA, 297 bp, Mesorhizobium loti MAFF303099
  CDS (1)..(297): transl_table=11
atgctgtttgcttttgtttgcaaggacaagccgggaagcctgcaggtgcgcctcgacacgcggcccgagcatgtcgcctttctcgaagggctgaatgcggacaagaaactggccttcgccggtccgttcctcgatgccgatggcaagcccaatggcagtctcgtggtcgttgaggcgccggatctggccgcggcgcaggccttgtcggccgccgacccctatgccaaggcgggcctgttcgaaagcgtcgaaattcgccagtggaactggacgttcaacaagccggcggctagttaa

SEQ ID NO: 21390 - protein, 98 aa, Mesorhizobium loti MAFF303099
MLFAFVCKDKPGSLQVRLDTRPEHVAFLEGLNADKKLAFAGPFLDADGKPNGSLVVVEAPDLAAAQALSAADPYAKAGLFESVEIRQWNWTFNKPAAS

SEQ ID NO: 21391 - DNA, 297 bp, Vibrio cholerae O1 biovar eltor str. N16961
  CDS (1)..(297): transl_table=11
atgtggtatgtgatttttgcgcaggatgtcgagaactcattagaaaaacgtctgagcgtgcgcccaaaacatctggagcgtttacaacaactgcaagatgaaggccgtctgctcactgcaggccccatgccagccatcgattccgaaaatccgggacaggcaggctttactggctcaaccgtgatcgcggagttcgcctccttagttgaagcacaagcttgggcggatgccgatccttatgtcgcggcgggtgtttatgccaacgtcattgttaaacctttcaaaaaagtattctga

SEQ ID NO: 21392 - protein, 98 aa, Vibrio cholerae O1 biovar eltor str. N16961
MWYVIFAQDVENSLEKRLSVRPKHLERLQQLQDEGRLLTAGPMPAIDSENPGQAGFTGSTVIAEFASLVEAQAWADADPYVAAGVYANVIVKPFKKVF

SEQ ID NO: 21393 - DNA, 300 bp, Pasteurella multocida subsp. multocida str. Pm70
  CDS (1)..(300): transl_table=11
atgatgtactatgttatttttgcacaggataaccctaacaccttagcacaacgtttagccgtgcgtgaaaaacacctcgcccgcttaactcagctccaagcagaagatcgtctattggtcgcgggtcctaatcccgccattgacagtgaaaatccgggtgaggctgggtttactggttcaaccgtgattgctcaatttgccagcttagcggatgcacaacaatgggcgagtgaagatccctatgtggaagcaggcgtatatgcggatgtcatcatcaagccctttaaacgcgttttttaa

SEQ ID NO: 21394 - protein, 99 aa, Pasteurella multocida subsp. multocida str. Pm70
MMYYVIFAQDNPNTLAQRLAVREKHLARLTQLQAEDRLLVAGPNPAIDSENPGEAGFTGSTVIAQFASLADAQQWASEDPYVEAGVYADVIIKPFKRVF

SEQ ID NO: 21395 - DNA, 300 bp, Pseudomonas aeruginosa PAO1
  CDS (1)..(300): transl_table=11
atgctctacgcgatcatcgcccgtgacatccccgcttcccaggaacgccgcctggccagccgcccggcccacctggcccgtctcgaacagctgaaggaagaaggccgcctggtactcgccggcccgcacccggcgatcgacagcaacgacccgggcgccgccggcttcaccggcagcctgatcgtcgccgaattcgattcgctggccgcggcgcagagctgggccgaggccgatccctaccgggccgccggggtgtacgccgaggtggtggtcaagccgttcaagaaagtcctgccctga

SEQ ID NO: 21396 - protein, 99 aa, Pseudomonas aeruginosa PAO1
MLYAIIARDIPASQERRLASRPAHLARLEQLKEEGRLVLAGPHPAIDSNDPGAAGFTGSLIVAEFDSLAAAQSWAEADPYRAAGVYAEVVVKPFKKVLP

SEQ ID NO: 21397 - DNA, 279 bp, Neisseria meningitidis MC58
  CDS (1)..(279): transl_table=11
atgttgctggcaacagacggggaggatgtgcacgaggcgcgtatggcggcacgtcccgaacacctcaaacggctggagacgctgaagtcggaaggccggctgttgacggcaggcccgaatcctttgccggaggactccaaccgcgtttcgggcagtttgattgtggcgcagttcgagtctttggatgcggcgcaggcttgggcggaagacgatccctatgttcatgcaggcgtgtacagcgaagtgctgatcaagccgtttaaagcggtgttcaaataa

SEQ ID NO: 21398 - protein, 92 aa, Neisseria meningitidis MC58
MLLATDGEDVHEARMAARPEHLKRLETLKSEGRLLTAGPNPLPEDSNRVSGSLIVAQFESLDAAQAWAEDDPYVHAGVYSEVLIKPFKAVFK

SEQ ID NO: 21399 - DNA, 291 bp, Neisseria meningitidis Z2491
  CDS (1)..(291): transl_table=11
gtggaatattttatgttgctggcaacagacggggagaatgtgtatgaagcgcgtatggcggcacgtcccgaacacctcaaacggctggagacgctgaagtcggaaggccggctgttgacggcaggcccgaatcctttgccggaggactccaaccgcgtttcgggcagtttgattgtggcgcagttcgagtctttggatgcggcagaggcgtgggcggaagacgatccctatgttcatgcaggcgtgtacagcgaagtgctgatcaagccgtttaaagcggtgttcaaataa

SEQ ID NO: 21400 - protein, 96 aa, Neisseria meningitidis Z2491
MEYFMLLATDGENVYEARMAARPEHLKRLETLKSEGRLLTAGPNPLPEDSNRVSGSLIVAQFESLDAAEAWAEDDPYVHAGVYSEVLIKPFKAVFK

SEQ ID NO: 21401 - DNA, 294 bp, Sinorhizobium meliloti 1021
  CDS (1)..(294): transl_table=11
atgctcttcgcactgctctgcacggacaagcccggcgcgctgcaactcaggctcgacacgcggcccgaccatgtcgcctatctcaacgacctcaatgcccggggcatcctgaagatcgcggggcctttcctcggcgccgacggcaagccgacggggagcctcgtgatcgtcaaggccgatacgctcgaagaggccagggcgctcgccgaggccgatccctatgcgaaggtgggtctcttcgccaatgtcgagatcaaggcctacaactgggtcttcaacaatccggaggcttga

SEQ ID NO: 21402 - protein, 97 aa, Sinorhizobium meliloti 1021
MLFALLCTDKPGALQLRLDTRPDHVAYLNDLNARGILKIAGPFLGADGKPTGSLVIVKADTLEEARALAEADPYAKVGLFANVEIKAYNWVFNNPEA

SEQ ID NO: 21403 - DNA, 282 bp, Caulobacter crescentus CB15
  CDS (1)..(282): transl_table=11
atggccctcttcgccatcctctgcaaggacaagcccggcgcgctggacacccgcctggccacccgccccacccacctcgactatctgaaccagtcgacgggcctgaagctggccggcgcgctgctgggcgatgacggcaatccgatcggctcgctgctgatcgtcgaagccgaggatttggccgccgcccaggcccaggccgacaacgacccgttcaccaccgctggggtgttcgaaagcgtcgaggtgcgtccctggcgcgtggcgatcggcgcgctctga

SEQ ID NO: 21404 - protein, 93 aa, Caulobacter crescentus CB15
MALFAILCKDKPGALDTRLATRPTHLDYLNQSTGLKLAGALLGDDGNPIGSLLIVEAEDLAAAQAQADNDPFTTAGVFESVEVRPWRVAIGAL

SEQ ID NO: 21405 - DNA, 339 bp, Agrobacterium tumefaciens str. C58
  CDS (1)..(339): transl_table=11
atgaacggcggcagcgatcaatcccggctttacgtgcggtttgccgaaagcgatcccaatgcgacggagcagcgggtggcgcagttggaggcgcacaaggcccatttgcgcaatggcgaagcgaagcccgaggggtttcgtatcctggtgtccggtccgatgagcgctggtgacggtggtccgcccgcggcgctcatcatcgccgaggcgcattctcttgaggatgtcatcgccttcagcgacgccgatcccttcgttgttcacggggtctataatcgcattcgtattttgaactggacgccgacgttatcgatgatttccgggctggaatcccgctga

SEQ ID NO: 21406 - protein, 112 aa, Agrobacterium tumefaciens str. C58
MNGGSDQSRLYVRFAESDPNATEQRVAQLEAHKAHLRNGEAKPEGFRILVSGPMSAGDGGPPAALIIAEAHSLEDVIAFSDADPFVVHGVYNRIRILNWTPTLSMISGLESR

SEQ ID NO: 21407 - DNA, 294 bp, Agrobacterium tumefaciens str. C58
  CDS (1)..(294): transl_table=11
atgctgtttgcctttatctgcaaggacaagcccggccatctgaacgtgcgcatggaaacgcgccccgctcatctggagcatctgaacaggctgaacgccgagggcacgctgaagatcgccggcccgtttctggatgccgaaggcaagccgaatggcagccttgtgatcgtggaggcgtccgatatcgatgcggcgaaggctctcgccgatgccgatccctatgccaaggccggcctgttcgagagcgtggatgtgaagccctataactgggtcttcaacaatccgggagcgtga

SEQ ID NO: 21408 - protein, 97 aa, Agrobacterium tumefaciens str. C58
MLFAFICKDKPGHLNVRMETRPAHLEHLNRLNAEGTLKIAGPFLDAEGKPNGSLVIVEASDIDAAKALADADPYAKAGLFESVDVKPYNWVFNNPGA

SEQ ID NO: 21409 - DNA, 300 bp, Xanthomonas axonopodis pv. citri str. 306
  CDS (1)..(300): transl_table=11
gtgtggtacgtaatcgaggggtatgaccggccggacgcattggcggcacggcagcaggcgcggccggcgcatctggcgcgtctgcaggaacttgcggccgccgggcgattgctggtggcgggcccgtgcccggccatcgacgccgaagatccgggtccggccggtttcagcggcagcgtcgtaattgccgagttcgacgctctggacgaggcgcgcgcctgggcagatgccgacccctatgtggaagcgggtgtgtacacgcgcaccgaggtccggccgttccgccgggtattgccatga

SEQ ID NO: 21410 - protein, 99 aa, Xanthomonas axonopodis pv. citri str. 306
MWYVIEGYDRPDALAARQQARPAHLARLQELAAAGRLLVAGPCPAIDAEDPGPAGFSGSVVIAEFDALDEARAWADADPYVEAGVYTRTEVRPFRRVLP

SEQ ID NO: 21411 - DNA, 300 bp, Shewanella oneidensis MR-1
  CDS (1)..(300): transl_table=11
atgtggtatatgatttcagctcaagatgttgaaaacagcttagaaaaacgtttagcagcgcgtcctgcgcatttagcacgcttacaggaactggccgatgaaggtcgcttgctggttgcaggtccacaccccgctatcgatagtgaaaacccaggtgatgcgggttttagcggctcattagtcgtcgcggatttcgattcgttagccacagctcaagcctgggcggatgctgacccttacttcgccgcaggtgtatatcaaagcgttgtggtaaaaccctttaaacgagttctaccctaa

SEQ ID NO: 21412 - protein, 99 aa, Shewanella oneidensis MR-1
MWYMISAQDVENSLEKRLAARPAHLARLQELADEGRLLVAGPHPAIDSENPGDAGFSGSLVVADFDSLATAQAWADADPYFAAGVYQSVVVKPFKRVLP

SEQ ID NO: 21413 - DNA, 333 bp, Pseudomonas putida KT2440
  CDS (1)..(333): transl_table=11
atgacccttctacctccaaacccaaggattgacatgctctacgccattatcgccagcgacgtcgcaaactccctggaaaagcgcctggccgcccgcccggcgcacatcgaacgcctgcagcagctcaaggccgaaggccgcgtggtgttggccggcccgcacccggccatcgacagcaacgacccgggcgaagcgggtttcagcggtagcctgatcgttgccgaattcgaatcgctggcggcggcgcagacctgggccgatgccgacccgtacatcgctgccggcgtgtacgacaaggttgtggtcaagccgttcaagcaagtactgccttga

SEQ ID NO: 21414 - protein, 110 aa, Pseudomonas putida KT2440
MTLLPPNPRIDMLYAIIASDVANSLEKRLAARPAHIERLQQLKAEGRVVLAGPHPAIDSNDPGEAGFSGSLIVAEFESLAAAQTWADADPYIAAGVYDKVVVKPFKQVLP

SEQ ID NO: 21415 - DNA, 300 bp, Pseudomonas syringae pv. tomato str. DC3000
  CDS (1)..(300): transl_table=11
atgctctacgcaatcatcgccactgacgtcgaaaactcgctggaaaagcgcttgagtgtacgccctgcacaccttgaacgcctgaacacgctcaaggatgccggccgcttggtactggccggcccacacccggcggtcgagagcaacgatccgggcgctgccggtttcagcggcagcctggttgtcgccgagttcgaatccttgagcgcagcgaaaacctgggccgaagccgacccgtacgtctcagctggcgtctacgccaacgtcgtggtcaagccgttcaagcaagtcctgccctga

SEQ ID NO: 21416 - protein, 99 aa, Pseudomonas syringae pv. tomato str. DC3000
MLYAIIATDVENSLEKRLSVRPAHLERLNTLKDAGRLVLAGPHPAVESNDPGAAGFSGSLVVAEFESLSAAKTWAEADPYVSAGVYANVVVKPFKQVLP

SEQ ID NO: 21417 - DNA, 297 bp, Vibrio parahaemolyticus RIMD 2210633
  CDS (1)..(297): transl_table=11
atgtggtacgtcatcttttctcaggacgtcgagaactcattggaaaaacgtatgggcgttcgtcctcaacatttagaacgcttgcaacagcttcaagatgaaggtcgtttacttaccgcaggtccaatgccagcgatcgactctgataacccaggagaagccggctttactggttcgacagtcattgctgaattttcctctttggaagatgccaaaacatgggctgacgccgatccttatgtggcggcgggcgtttacgaaaacgtgatcgtaaaaccgttcaaaaaagtgttttaa

SEQ ID NO: 21418 - protein, 98 aa, Vibrio parahaemolyticus RIMD 2210633
MWYVIFSQDVENSLEKRMGVRPQHLERLQQLQDEGRLLTAGPMPAIDSDNPGEAGFTGSTVIAEFSSLEDAKTWADADPYVAAGVYENVIVKPFKKVF

SEQ ID NO: 21419 - DNA, 579 bp, Coxiella burnetii RSA 493
  CDS (1)..(579): transl_table=11
atgtactacgccatttattgtgaagattgcgaggacagttttgaacgccgccgaagcgttcgagaggctcatttacaacgattaaaagaattacacgaaaaaaaccgacttttactcgccggcccactcttaaatgaagacaatgaaaatcctatcgtcggtggggtcaaaggctcgcttatcgtggcagaattcgaaaatattgacgttgctagggaatgggcggcagccgacccttatgttacagctaatgtctattctcgcgttaccatttgtccctttaaaaaagtcttgcctttacacctcatgaaccatcaacaacaagccaaccgcattaaaaaacgactcacggaagtttttaatcctcaaaaattaatcgtaaccgatgaaagtggtaatcacatcggccaccccggcgcccaagaaggcaaaggccattttaaagtagaaatcacagcaaaggcgtttaaaaataaaaatcctatcgaacgccatcgattaatttacgaagccttgagcgatttgatggagacagatattcatgctttacgaatacacgcaacggcagccgaaagttaa

SEQ ID NO: 21420 - protein, 192 aa, Coxiella burnetii RSA 493
MYYAIYCEDCEDSFERRRSVREAHLQRLKELHEKNRLLLAGPLLNEDNENPIVGGVKGSLIVAEFENIDVAREWAAADPYVTANVYSRVTICPFKKVLPLHLMNHQQQANRIKKRLTEVFNPQKLIVTDESGNHIGHPGAQEGKGHFKVEITAKAFKNKNPIERHRLIYEALSDLMETDIHALRIHATAAES

SEQ ID NO: 21421 - DNA, 303 bp, Nitrosomonas europaea ATCC 19718
  CDS (1)..(303): transl_table=11
atgctttatttgatatatggtgaggatgttcccgatagcttggcacagcgggttgccagccgccctgcacatctggccagaattcgtgaattgcaggagcagggaaggctgttactggctggcccatgtccggcgatagatagcattgacccggggccggccgggtttaccggaagtctgatagtggctgagtttgcatcactggatgctgcccgggaatgggcagacgcagacccgtatctgctgtctggcgtgtatgcaaaagtaaccgtcaagccattcaggaaggttctgcctgaatag

SEQ ID NO: 21422 - protein, 100 aa, Nitrosomonas europaea ATCC 19718
MLYLIYGEDVPDSLAQRVASRPAHLARIRELQEQGRLLLAGPCPAIDSIDPGPAGFTGSLIVAEFASLDAAREWADADPYLLSGVYAKVTVKPFRKVLPE

SEQ ID NO: 21423 - DNA, 282 bp, Haemophilus ducreyi 35000HP
  CDS (1)..(282): transl_table=11
atgtattatgttatttttgcacaagataaaccaaatatgttagctactcgtttggctgttcgctcggcacatttagctcgcctaaccgaattacaaactgcgggcaggttattaaccgcggggcctaatcctagtgaagaaggggataatataaccggttcgacagtgattgcggaatttgattcattagcggccgcacaagcttgggctgaacaagatccttatgtcagcgcgggtgtttatcaaaatattatcatcaaaccatttaataacgtgttttaa

SEQ ID NO: 21424 - protein, 93 aa, Haemophilus ducreyi 35000HP
MYYVIFAQDKPNMLATRLAVRSAHLARLTELQTAGRLLTAGPNPSEEGDNITGSTVIAEFDSLAAAQAWAEQDPYVSAGVYQNIIIKPFNNVF

SEQ ID NO: 21425 - DNA, 270 bp, Synechococcus sp. WH 8102
  CDS (1)..(270): transl_table=11
atgtctcgttttgttctctgggggacatacagcgctgatgcgcttgaaaaacgggtgccatttcgccaggaacacctgacacgtctgcagtcattgaaagacgatggtgtcctcatcacccttggaccaactgaggggagtacccacgtgttcggtatttttgaggctgacgcgattggtaccgtccggcagcttgtggaggacgatatctattggaaacaaggaatctggacagcccttgaggtctatccctgggtccaggcattctga

SEQ ID NO: 21426 - protein, 89 aa, Synechococcus sp. WH 8102
MSRFVLWGTYSADALEKRVPFRQEHLTRLQSLKDDGVLITLGPTEGSTHVFGIFEADAIGTVRQLVEDDIYWKQGIWTALEVYPWVQAF

SEQ ID NO: 21427 - DNA, 303 bp, Chromobacterium violaceum ATCC 12472
  CDS (1)..(303): transl_table=11
atgctgtacgccatcatcgcgcgcgaccatcccggcagcctcgagcgccgcatcgcgctgcgcgccgaacaccgcgcgcggctggccgcgctgcaggaccagggccggatgaagctgtccggcccgctgcccgccatcgacagcgccgatcccggcccggccggctactgcggcagcctggtggtggccgagttcgcgtcgctggaagacgcgcgcgcctgggccgcggccgatccgtaccaggcaggcggcgtctacgccagcgtcgacgtccagcccttcgtgcaggttttccccgcatga

SEQ ID NO: 21428 - protein, 100 aa, Chromobacterium violaceum ATCC 12472
MLYAIIARDHPGSLERRIALRAEHRARLAALQDQGRMKLSGPLPAIDSADPGPAGYCGSLVVAEFASLEDARAWAAADPYQAGGVYASVDVQPFVQVFPA

SEQ ID NO: 21429 - DNA, 297 bp, Vibrio vulnificus YJ016
  CDS (1)..(297): transl_table=11
atgtggtatgtcattttttctcaggacgttgagaattcgttggaaaaacgccttagtgtacgcccacaacacctagagagattgcaagcattgcaagacgaaggacgtctattaactgcaggcccgatgccagccatcgactctgacaaccctggtgaagcaggtttcacaggttctaccgtgatcgctgagtttccttctttgcaagaagctcaagcctgggcggatgccgatccttatatcgcagcgggtgtttatgccaatgtgatcgttaaacctttcaagaaagtgttctaa

SEQ ID NO: 21430 - protein, 98 aa, Vibrio vulnificus YJ016
MWYVIFSQDVENSLEKRLSVRPQHLERLQALQDEGRLLTAGPMPAIDSDNPGEAGFTGSTVIAEFPSLQEAQAWADADPYIAAGVYANVIVKPFKKVF

SEQ ID NO: 21431 - DNA, 354 bp, Gibberella zeae PH-1
  CDS (1)..(354)
atggcttcaggcgcagttaccgttcctcctggaaaatacgagtttctcgtcgttgttcatgacaagcccggtatgcttgagaagcgacttgaagttcgaggacagcatttcgataacatgaaacccaatgttgagagcggaaactggaagatgggaggtgccatcctcaactctgttcccaaagacgatagtcccagtagcttggatttcgccggaagcacacttgtctgcattgctgattccgcagaacaagtgcgagagaacttgagcaaggatatctatgccacttctggtgtttgggatatggacaaggtccaaatctaccctttcaaggctgcattcagattcaactaa

SEQ ID NO: 21432 - protein, 117 aa, Gibberella zeae PH-1
MASGAVTVPPGKYEFLVVVHDKPGMLEKRLEVRGQHFDNMKPNVESGNWKMGGAILNSVPKDDSPSSLDFAGSTLVCIADSAEQVRENLSKDIYATSGVWDMDKVQIYPFKAAFRFN

SEQ ID NO: 21433 - DNA, 333 bp, Yarrowia lipolytica CLIB99
  CDS (1)..(333)
atgcaattctttctcgtccaggtcgccgacaagcccggtatgctcgaaaagcgaatgtctctgcgacccgcccatctggaggctctgcagaacaagtctgccggcaacaacttcatcatttgcggcggaggcgttgccgacaagcatcctggcgccggcgaaaccccccaggtgactgggtccacgctgattgtgcagactgacgaccgtgacagcattgtggagaagctcaagggagacgtgtacgccaaggagggcgtttgggatttgaccaatgtcaagattcaggccatgttcatgccccccttctactttaaccgactgctggactag

SEQ ID NO: 21434 - protein, 110 aa, Yarrowia lipolytica CLIB99
MQFFLVQVADKPGMLEKRMSLRPAHLEALQNKSAGNNFIICGGGVADKHPGAGETPQVTGSTLIVQTDDRDSIVEKLKGDVYAKEGVWDLTNVKIQAMFMPPFYFNRLLD

SEQ ID NO: 21435 - DNA, 321 bp, Cryptococcus neoformans var. neoformans JEC21
  CDS (1)..(321)
atgccccgattcctcgtgtacgcccctgatcaccctgactatctggagaagcgactcgctgttaggactgagcaccttgcaagggctaaaattgacgataatgctggtattgtcctttacagcggtcctatccttcctcgcccgggcacgaaagcccgagaagcttctctccctgaaggcaccccaaacatcgcaggaagctttatggtatataagatggacactcttgagcaggtttgggctaggctcaaggaggatgtatactggcgagcagacatttgggacaaggagagaattattgttgaagagttgcttaattga

SEQ ID NO: 21436 - protein, 106 aa, Cryptococcus neoformans var. neoformans JEC21
MPRFLVYAPDHPDYLEKRLAVRTEHLARAKIDDNAGIVLYSGPILPRPGTKAREASLPEGTPNIAGSFMVYKMDTLEQVWARLKEDVYWRADIWDKERIIVEELLN

SEQ ID NO: 21437 - DNA, 303 bp, Acinetobacter sp. ADP1
  CDS (1)..(303): transl_table=11
atgcctttatttgtagtgacctgtaccgataacgaaggtactgttgaaaaacgtttagccactcgtccaaaacatgtcgagcgcttacaaaagctggacgatgaaggcaaactgattgttgcaggcgcaatgccaaaagagtttggtaatccacaagctggtttttacggcagtacaattattgtcgatttcgaaagtcgtgaagctttagatgcatggttacaagaggagccttttctaattgaaggcatttatgcacatattgatgtcaagccattcaataaagcatttccgaaagagtga

SEQ ID NO: 21438 - protein, 100 aa, Acinetobacter sp. ADP1
MPLFVVTCTDNEGTVEKRLATRPKHVERLQKLDDEGKLIVAGAMPKEFGNPQAGFYGSTIIVDFESREALDAWLQEEPFLIEGIYAHIDVKPFNKAFPKE

SEQ ID NO: 21439 - DNA, 297 bp, Erwinia carotovora subsp. atroseptica SCRI1043
  CDS (1)..(297): transl_table=11
atgctctatgtcatttatgctgaagataatgttgattcattagcaaaacgcctgtcggtaagaccagaccatcttgcccgtttacaggcattacgcgatcagggccgactgattaccgctggcccgttacctgctatcgacagcgaagatcccggtcaggctggttttagcggttccgtgatcatcgctgaattcgcatcgctggatgaggcaacagcatgggccaacgccgacccctacatcgcagccggtgtctatcaacgcgtcagtgtgaaacccttcaaaaaagtgttttaa

SEQ ID NO: 21440 - protein, 98 aa, Erwinia carotovora subsp. atroseptica SCRI1043
MLYVIYAEDNVDSLAKRLSVRPDHLARLQALRDQGRLITAGPLPAIDSEDPGQAGFSGSVIIAEFASLDEATAWANADPYIAAGVYQRVSVKPFKKVF

SEQ ID NO: 21441 - DNA, 297 bp, Yersinia pseudotuberculosis IP 32953
  CDS (1)..(297): transl_table=11
atgttttacgtcatatttgctacagatgtacctaactcattggagaagcgaatgtctgtgcgtcctgcgcatttggctcgcttacaggctttacaggatcaaggccgtttactgaccgctggacctaacccagccatcgacagtgccgatcccggtaatgccggctttactggctcgacagtgattgctgacttttcctcattgcaagaagctgagatatgggctgaacaagatccttatgttgccgcaggtgtttaccagtcggtaattattaaaccctttaaacgggtgttttga

SEQ ID NO: 21442 - protein, 98 aa, Yersinia pseudotuberculosis IP 32953
MFYVIFATDVPNSLEKRMSVRPAHLARLQALQDQGRLLTAGPNPAIDSADPGNAGFTGSTVIADFSSLQEAEIWAEQDPYVAAGVYQSVIIKPFKRVF

SEQ ID NO: 21443 - DNA, 285 bp, Mannheimia succiniciproducens MBEL55E
  CDS (1)..(285): transl_table=11
atgatgtactacgttatttttgcacaagataaaccaaacacacttgaaaaacgtctggaagttcgcccgcaacatttagcccgtttagaacaattaaaaacggaaggccgtttgctcaccgccggtccgaatcccagcgaagacggcaaaagcgtaacaggttccaccgttatcgctcaattcgactcattagccgaggctcaagcctgggcacaacaagatccttatgttgatgccggcgtttatggcgaggttatcattaaaccttttaacaaagtgttctag

SEQ ID NO: 21444 - protein, 94 aa, Mannheimia succiniciproducens MBEL55E
MMYYVIFAQDKPNTLEKRLEVRPQHLARLEQLKTEGRLLTAGPNPSEDGKSVTGSTVIAQFDSLAEAQAWAQQDPYVDAGVYGEVIIKPFNKVF

SEQ ID NO: 21445 - DNA, 303 bp, Methylococcus capsulatus str. Bath
  CDS (1)..(303): transl_table=11
gtgctgtatgccatactttgcgaagatcgccccggcagtctcgagatgcggaagggagcccgcccggctcatttgcagcggctcgaccggttgcaggacgaaggccggctggtgctggcggggccgcatccggcgatcgactgcgaggatccgggtgaggccgggttcaccggcagcctgatcgtcgcggaatttccgagcctggaagacgcgcaacgctgggcagacgaagatccttacggtcgcgctggcgtctatgcccgcgtggtggtcaaaccttttcggcaggtatacccgaaatga

SEQ ID NO: 21446 - protein, 100 aa, Methylococcus capsulatus str. Bath
MLYAILCEDRPGSLEMRKGARPAHLQRLDRLQDEGRLVLAGPHPAIDCEDPGEAGFTGSLIVAEFPSLEDAQRWADEDPYGRAGVYARVVVKPFRQVYPK

SEQ ID NO: 21447 - DNA, 300 bp, Photobacterium profundum SS9
  CDS (1)..(300): transl_table=11
atgtggtatgtgattttttctcaggatgtagaaaatagtttagagcgccgtctaagtgttcgtgaaaaacatcttgcgcgcctacaagcactacaagctgaaggacgtcttcttgttgcaggcccaatgccagccattgatagcgagaaccctgatgaagcgggctttacaggttctaccgttatcgctgaattcaattcattagaagatgcaaaaacatgggcagatgcagacccatacattgcagctggtgtttacgctaatgtgattgtaaaaccattcaaaaaagtactgccttaa

SEQ ID NO: 21448 - protein, 99 aa, Photobacterium profundum SS9
MWYVIFSQDVENSLERRLSVREKHLARLQALQAEGRLLVAGPMPAIDSENPDEAGFTGSTVIAEFNSLEDAKTWADADPYIAAGVYANVIVKPFKKVLP

SEQ ID NO: 21449 - DNA, 297 bp, Salmonella enterica subsp. enterica serovar Paratyphi A str. ATCC
  CDS (1)..(297): transl_table=11
gtgctgtatgttatttacgctcaggataatgccaactcgcttgaaaaacgcctctcggtacggcccgcgcatctggcgcgcctgcaacttctgcatgatgaagggcgattattaactgccgggccgatgcccgcagtggacagtaacgatcctggggtagccggatttaccgggtcaacggtgattgctgaatttgaatctttagaagcagcgcaatcctgggctgatgcggatccctacgtcgcagcgggcgtctatgcgcaggtttcggtcaaaccgtataagaagatcttttga

SEQ ID NO: 21450 - protein, 98 aa, Salmonella enterica subsp. enterica serovar Paratyphi A str. ATCC
MLYVIYAQDNANSLEKRLSVRPAHLARLQLLHDEGRLLTAGPMPAVDSNDPGVAGFTGSTVIAEFESLEAAQSWADADPYVAAGVYAQVSVKPYKKIF

SEQ ID NO: 21451 - DNA, 303 bp, Idiomarina loihiensis L2TR
  CDS (1)..(303): transl_table=11
atgtggtttgttattttcgcagaagatcatgagaactctctggaaggtcgtaagcaggcgcgtcctgctcatcttgaacgcttaaaagcgttgcaaaatgacggccgtctgctcgtcgcgggcccctgtccggccatcgcggaactagacccgggcgtgcttggttttaccggctctgtggtcatcgctgaatttgagactctggaagaagcagagcaatgggctaacgacgacccatactggcaagccggtgtctataaaaaagcaacggttaagccatttaacgccgttttaccgaactaa

SEQ ID NO: 21452 - protein, 100 aa, Idiomarina loihiensis L2TR
MWFVIFAEDHENSLEGRKQARPAHLERLKALQNDGRLLVAGPCPAIAELDPGVLGFTGSVVIAEFETLEEAEQWANDDPYWQAGVYKKATVKPFNAVLPN

SEQ ID NO: 21453 - DNA, 300 bp, Azoarcus sp. EbN1
  CDS (1)..(300): transl_table=11
atgctttacgtactcctcggcgaagatgcgccgggttcgcttgaagcgcgcacgagcgcccgtccggcccatctggcccgcctggagggattgcgcgatgaaggacgcctgctgatggcaggcccgctcccggcgatagattccccggatcccggcccggccggtttcttcggcagcctcgtcgtcgccgagttcgcgtcccaaggcgaggccgagcgctggctggccgacgatccctatgtcaaacagggcgtgttcgcgcggatcaccgtgaaacccttcaagaaggtgctgccttga

SEQ ID NO: 21454 - protein, 99 aa, Azoarcus sp. EbN1
MLYVLLGEDAPGSLEARTSARPAHLARLEGLRDEGRLLMAGPLPAIDSPDPGPAGFFGSLVVAEFASQGEAERWLADDPYVKQGVFARITVKPFKKVLP

SEQ ID NO: 21455 - DNA, 270 bp, Silicibacter pomeroyi DSS-3
  CDS (1)..(270): transl_table=11
atgctggttgccctgatcgcccgcgacaaggacggcgccctgcaaacccggctcgacaaccgcgccgcgcatctggcctatatcgaggaaaccggcgttgtctcgcaggccggccccttgctggacggcgacgcgatgatcggctctctggtcatcctcgatgtaagcgacctggccgccgccgaggactgggccgccaacgacccctatgccaaggccgggctgttccagtcggtgcagctgatcccgtggaaaaaggtgatcggctga

SEQ ID NO: 21456 - protein, 89 aa, Silicibacter pomeroyi DSS-3
MLVALIARDKDGALQTRLDNRAAHLAYIEETGVVSQAGPLLDGDAMIGSLVILDVSDLAAAEDWAANDPYAKAGLFQSVQLIPWKKVIG

SEQ ID NO: 21457 - DNA, 513 bp, Xanthomonas oryzae pv. oryzae KACC10331
  CDS (1)..(513): transl_table=11
atgcggcgacggaacagcgaggaggtcgtctacgcgaaccggcggtgggcagcgaatcggtcgtcgagaagaggggtgagcctgggccgacgggccgctgcgtccggttgcgtgtgcagtggtgccaagggtaatgcgtgcgcgggggcggtgtccagcggccaggcggctagaatcggcaggtggatcttcaagtccgaggcgaggtggcgtgtgtggtacttaatcgaagggtatgaccgggccgacgcattggctgcacggcagcaggcgcggccggcgcatctggcgcgtttgcaggcgcttgcggccgccggtcggttgctggtggcgggcccgtgcccggccatcgatgccgaagatccgggcccgtccggtttcagcggcagcgtggtgattgccgaattcgacgcgctggaagatgcgcgcgcctgggccaatgccgacccgtacgtggaagcgggtgtgtatgcgcgcaccgaggtccgcccgttccgccgggtgttgccatga

SEQ ID NO: 21458 - protein, 170 aa, Xanthomonas oryzae pv. oryzae KACC10331
MRRRNSEEVVYANRRWAANRSSRRGVSLGRRAAASGCVCSGAKGNACAGAVSSGQAARIGRWIFKSEARWRVWYLIEGYDRADALAARQQARPAHLARLQALAAAGRLLVAGPCPAIDAEDPGPSGFSGSVVIAEFDALEDARAWANADPYVEAGVYARTEVRPFRRVLP

SEQ ID NO: 21459 - DNA, 303 bp, Vibrio fischeri ES114
  CDS (1)..(303): transl_table=11
atgtggtatgtgattttttctcaagatgttgaaaacagcttagaacgtcgtttaagtgttcgtgaaaaacatctagagcgccttgctcaactacagaatgaaggccgtttattagtagcaggacctatgcctgcaattgattctgaaaatccaggagaagcaggcttcactggttcaacagttattgctgattttgcttcattagaagcagctcaaacttgggctgataatgacccttatattgatgctggtgtttacgcaaaagtaattgttaagccatttaaaaaagtgcttccagcttaa

SEQ ID NO: 21460 - protein, 100 aa, Vibrio fischeri ES114
MWYVIFSQDVENSLERRLSVREKHLERLAQLQNEGRLLVAGPMPAIDSENPGEAGFTGSTVIADFASLEAAQTWADNDPYIDAGVYAKVIVKPFKKVLPA

SEQ ID NO: 21461 - DNA, 291 bp, Neisseria gonorrhoeae FA 1090
  CDS (1)..(291): transl_table=11
gtggaatattttatgttgctggcaacagacggggaggatgtgcatgaagcgcgtatggcggcacgtcccgaacactttaaacggctggaaacgctgaaatcggaaggccgtctgctgacggcaggcccaaacctgctgccggacaatcccgaacgtgtttcgggcagcttgattgtggcacagttcgagtctttggatgcggcgcaggcttgggctgaagacgatccctatgttcatgccggcgtgtacagcgaagtgctgatcaagccgtttaaagcggtgttcaaataa

SEQ ID NO: 21462 - protein, 96 aa, Neisseria gonorrhoeae FA 1090
MEYFMLLATDGEDVHEARMAARPEHFKRLETLKSEGRLLTAGPNLLPDNPERVSGSLIVAQFESLDAAQAWAEDDPYVHAGVYSEVLIKPFKAVFK

SEQ ID NO: 21463 - DNA, 291 bp, Brucella abortus biovar 1 str. 9-941
  CDS (1)..(291): transl_table=11
atgctgtttgccctcctgtgcaatgacaagcccgaccatctgcaagtgcgtctcgatacccgcccggcgcatctggactatctgaagagcctcggcgacgccctgaaattcgccggtccctttctcggcgaagacggcaagcccaatggcagtctcgtggtcgttgaagccgccgacaaggccgcagccgaaaaaatcgccgccagcgacccttatgcgcttgccggcctgttcaaggatgtgaccgtgcgcccatggaactgggccatcaacaaccctgtcaacgcttga

SEQ ID NO: 21464 - protein, 96 aa, Brucella abortus biovar 1 str. 9-941
MLFALLCNDKPDHLQVRLDTRPAHLDYLKSLGDALKFAGPFLGEDGKPNGSLVVVEAADKAAAEKIAASDPYALAGLFKDVTVRPWNWAINNPVNA

SEQ ID NO: 21465 - DNA, 300 bp, Pseudomonas syringae pv. syringae B728a
  CDS (1)..(300): transl_table=11
atgctctacgcaatcatcgccaccgacgtcgaaaactcgctggaaaaacgcctcagcgttcgcccggcacacctggagcgcctcaacgcgctcaaggatgaaggccgtctggtgctggccggtccacacccggcagtcgacagtaacgacccgggcgctgccggtttcagcggcagcctgatcgttgcggagttcgaatcgcaaagcgccgccaaggcgtgggccgaagccgatccgttcgtggccgcaggcgtctacgccaacgtcgtggtcaagccgttcaagcaggttatgccctga

SEQ ID NO: 21466 - protein, 99 aa, Pseudomonas syringae pv. syringae B728a
MLYAIIATDVENSLEKRLSVRPAHLERLNALKDEGRLVLAGPHPAVDSNDPGAAGFSGSLIVAEFESQSAAKAWAEADPFVAAGVYANVVVKPFKQVMP

SEQ ID NO: 21467 - DNA, 300 bp, Xanthomonas campestris pv. campestris str. 8004
  CDS (1)..(300): transl_table=11
gtgtggtacgtaatcgaaggctatgaccgggccgatgccctggcggcacggcagcaggcgagaccggcgcatctgcagcgcctgcaggcactgacggcagaagggcggctgctggtggccggcccatgcccggcaatcgacgccgaggacccgggcccggccggctttagcggcagcgtgatgattgccgagttcgcttcactggaggcagcacgcgcgtgggccgatgccgacccgtatgtggcggccggggtgtatgcgcgggtcgacgtccgcccgttccggcgggtgctgccatga

SEQ ID NO: 21468 - protein, 99 aa, Xanthomonas campestris pv. campestris str. 8004
MWYVIEGYDRADALAARQQARPAHLQRLQALTAEGRLLVAGPCPAIDAEDPGPAGFSGSVMIAEFASLEAARAWADADPYVAAGVYARVDVRPFRRVLP

SEQ ID NO: 21469 - DNA, 300 bp, Pseudomonas fluorescens Pf-5
  CDS (1)..(300): transl_table=11
atgctttacgcaatcattgccacagacgtcgccaactccctggaaaaacgcctggccaaccggccggcgcacctggagcggctgcaagtgctcaaggaccaggggcgcgtggtactcgccggcccgcacccggcgattgacagcaatgacccgggcgcggccggtttcagcggcagcctgatcgtcgccgagttcgactccctgagcgccgcccaggcctgggccgacgccgacccgttcgtgacctgcggcgtctacgcccatgtactggtcaagccgttcaagcaatcgatgccgtaa

SEQ ID NO: 21470 - protein, 99 aa, Pseudomonas fluorescens Pf-5
MLYAIIATDVANSLEKRLANRPAHLERLQVLKDQGRVVLAGPHPAIDSNDPGAAGFSGSLIVAEFDSLSAAQAWADADPFVTCGVYAHVLVKPFKQSMP

SEQ ID NO: 21471 - DNA, 330 bp, Psychrobacter arcticum 273-4
  CDS (1)..(330): transl_table=11
atgtccttattcgccattattggtcacgacgtagcaggcagtagcgcccaacgtcagctgacgcgcccagagcacgttgaacgcttacaactattgaatcatgagcagcggttgattatcgcaggaccaacccctatcgagcacggcaaaaatgagatgtcaggcagccttatcatcgctgatttcgattcgcttgaggcggctcaagattgggcaagcgcggagccgtatttgcgtgacggtgtctacagtcatgtcgacatcaagccatttattcaggcgttaccagcagtgaatgtcagtacaacgaatgaggtaacatcatcgtga

SEQ ID NO: 21472 - protein, 109 aa, Psychrobacter arcticum 273-4
MSLFAIIGHDVAGSSAQRQLTRPEHVERLQLLNHEQRLIIAGPTPIEHGKNEMSGSLIIADFDSLEAAQDWASAEPYLRDGVYSHVDIKPFIQALPAVNVSTTNEVTSS

SEQ ID NO: 21473 - DNA, 303 bp, Colwellia psychrerythraea 34H
  CDS (1)..(303): transl_table=11
atgttttatgttatatacagtgaagatgttgaaaactcactcagcttacgcctatctgttcgcgacaagcatattggacgtttaaaagacttacaagcgcaaggaaaactgttactagcgggtccatgtccagctattgatagtgaagaacctggtgaggctggatttactggttcattaattgttgcagaatttgatagcttagctgccgcacaaacatgggcagatgaagatccttatatcagtgctggtgtttataaaaaagtaacggttaaaccttataaaaaagtattacctgcttaa

SEQ ID NO: 21474 - protein, 100 aa, Colwellia psychrerythraea 34H
MFYVIYSEDVENSLSLRLSVRDKHIGRLKDLQAQGKLLLAGPCPAIDSEEPGEAGFTGSLIVAEFDSLAAAQTWADEDPYISAGVYKKVTVKPYKKVLPA

SEQ ID NO: 21475 - DNA, 300 bp, Pseudomonas syringae pv. phaseolicola 1448A
  CDS (1)..(300): transl_table=11
atgctctacgcaatcatcgccaccgacgtcgaaaactcgctggaaaaacgcctcagcgtgcgcccggcacaccttgagcgcctaaacgcgctcaaggatgaaggccgtctggtgctggccggcccacacccggcagtcgacagcaacgacccgggtgctgccggtttcagcggcagcctgatcgtggccgagtttgaatcgcaaagcgccgccaaggcgtgggccgaagccgatccatatgttgcggcaggcgtctatgccaatgtcgtggtcaagccattcaagctcgtcctgccctga

SEQ ID NO: 21476 - protein, 99 aa, Pseudomonas syringae pv. phaseolicola 1448A
MLYAIIATDVENSLEKRLSVRPAHLERLNALKDEGRLVLAGPHPAVDSNDPGAAGFSGSLIVAEFESQSAAKAWAEADPYVAAGVYANVVVKPFKLVLP

SEQ ID NO: 21477 - DNA, 303 bp, Dechloromonas aromatica RCB
  CDS (1)..(303): transl_table=11
atgctctatgcgatcattgctgaagacaaggccggcacgctggacaagcgcctcgccgcccgtcctgcccacctggagcgcctgctggccttgcaatccgaagctcgcctgatcctggccggcccctgtccggccatcgattcgcccgacccgggcccagccggcttttcaggcagcatcatcatcgccgaattcggctcgctgactgcggcccaaacctgggccgatgccgatccctatatcgcggccggtgtttacgagaaagtcaccatcaagccattcaagaaggcactgccggcgtga

SEQ ID NO: 21478 - protein, 100 aa, Dechloromonas aromatica RCB
MLYAIIAEDKAGTLDKRLAARPAHLERLLALQSEARLILAGPCPAIDSPDPGPAGFSGSIIIAEFGSLTAAQTWADADPYIAAGVYEKVTIKPFKKALPA

SEQ ID NO: 21479 - DNA, 300 bp, Ralstonia eutropha JMP134
  CDS (1)..(300): transl_table=11
atgtatttcgctattgtagccatcgaccgccccggggccaccgatgtcagaaccagcactcgccccgctcaccgcgaatacttgggtacccctcatcctggagtgacttacaggctgggcggaccacttctagcgcctgacggcgcgacgatgatcggttcgttgattgtgatcgaggcgccagatctggtcaccgctgaacgattttcggccggcgatccctacagaaaggcggatctattcgcggaggtctcggtcaggccttgggattgggggtcaggcaatccggacaaaggatga

SEQ ID NO: 21480 - protein, 99 aa, Ralstonia eutropha JMP134
MYFAIVAIDRPGATDVRTSTRPAHREYLGTPHPGVTYRLGGPLLAPDGATMIGSLIVIEAPDLVTAERFSAGDPYRKADLFAEVSVRPWDWGSGNPDKG

SEQ ID NO: 21481 - DNA, 303 bp, Ralstonia eutropha JMP134
  CDS (1)..(303): transl_table=11
atgctttacgcattccacctgatcgacaaacccggtgttggcgagttgcgtctgaaggtccgcccggatcacaagatctacctgggcgccgtcaaggaccagatcgcgtttgccggtccgctgcttgccgaagacggcgagaccatggtcggcagcctgctggtgatcgatttcccgtcactggccgccgcacgcgagtggctgtcccgcgagcccttcacgcgtgccggcatctatggcgccagcagcgtgctggccttcaacaatatgtggccgcagaagaccggctttcccgccgcctga

SEQ ID NO: 21482 - protein, 100 aa, Ralstonia eutropha JMP134
MLYAFHLIDKPGVGELRLKVRPDHKIYLGAVKDQIAFAGPLLAEDGETMVGSLLVIDFPSLAAAREWLSREPFTRAGIYGASSVLAFNNMWPQKTGFPAA

SEQ ID NO: 21483 - DNA, 294 bp, Ralstonia eutropha JMP134
  CDS (1)..(294): transl_table=11
atgaagttcgccgccatcgtcgaatacgtaaacgagcctgagcgccttgcgcaattccggcccgcccatcgcgcctatctgcaagcgctgttgcaacacggacggctggtgatcgccggcccgttcgccgacggcagcggcgcgctgttcgtgtatgaagtcgccaatgaaagcgaggcatcgaagctcgctgccaatgatccgttcgcgaaagcgtcgctgttccgaagcgttgtcatgaagccctggaagctcgtgttcgcgagccaggacaacctgaatctcccgctgtga

SEQ ID NO: 21484 - protein, 97 aa, Ralstonia eutropha JMP134
MKFAAIVEYVNEPERLAQFRPAHRAYLQALLQHGRLVIAGPFADGSGALFVYEVANESEASKLAANDPFAKASLFRSVVMKPWKLVFASQDNLNLPL

SEQ ID NO: 21485 - DNA, 303 bp, Thiobacillus denitrificans ATCC 25259
  CDS (1)..(303): transl_table=11
atgttttacgcgatagtcggacaggacgcggaagggagtctcaccaagcgcgcggccgcccgccccgctcaccttgagcgcctgcagcgtttgcaggacgaaggccgcctgctgctcgccggccccttccctgcgatcgatgccctcgaccccggcgcggccggcttctccggcagcctcatcgtcgccgagttcggcacgctcgacgacgcgcaggcctgggcgagcgccgacccgtacgtcgcggcgggcgtctacagcgaggtcagcgtcaagcccttcaagaaagtcctgccggcatga

SEQ ID NO: 21486 - protein, 100 aa, Thiobacillus denitrificans ATCC 25259
MFYAIVGQDAEGSLTKRAAARPAHLERLQRLQDEGRLLLAGPFPAIDALDPGAAGFSGSLIVAEFGTLDDAQAWASADPYVAAGVYSEVSVKPFKKVLPA

SEQ ID NO: 21487 - DNA, 273 bp, Rhodobacter sphaeroides 2.4.1
  CDS (1)..(273)
atgcgcgtggccctcatctgcaccgacaaggccggtgcgctccagacccggctcgacaatcgctcggcccatctggcctatatcgccgaaaccggcgtggtcgagatggcgggcccgttcctgagccccgaggggcagatgaccggctcgctcgtggtgctcgaggtgggatcgctggccgaggccgaggcctgggccgcaggcgatccctatgcgcaggccggcctcttcgagagcgtcgccatctccgagtggaagaaggtggtgggctga

SEQ ID NO: 21488 - protein, 90 aa, Rhodobacter sphaeroides 2.4.1
MRVALICTDKAGALQTRLDNRSAHLAYIAETGVVEMAGPFLSPEGQMTGSLVVLEVGSLAEAEAWAAGDPYAQAGLFESVAISEWKKVVG

SEQ ID NO: 21489 - DNA, 300 bp, Haemophilus somnus 129PT
  CDS (1)..(300)
atgatgtactatgttatttttgctcaagataaacctgatacattagcattacgcttatctgtcagagaacaacaccttgaacgtttaaaacaattacaagctgaagataggttattaactgcgggacctaatcctgctatagatgatgaaaatcccggagaagcaggttttaccggttcaactgttattgcaaaattcaatagcttagaagaagcggagcaatgggcaaatacagatccttatgttgcagccggtgtatatgataaagtcatcattaaaccatttaaaaaagtcttttaa

SEQ ID NO: 21490 - protein, 99 aa, Haemophilus somnus 129PT
MMYYVIFAQDKPDTLALRLSVREQHLERLKQLQAEDRLLTAGPNPAIDDENPGEAGFTGSTVIAKFNSLEEAEQWANTDPYVAAGVYDKVIIKPFKKVF

SEQ ID NO: 21491 - DNA, 282 bp, Actinobacillus pleuropneumoniae serovar 1 str. 4074
  CDS (1)..(282)
atgtattacgttatttttgcacaagataatccgaatatgcttgagaagcgtttggaagtacgcccggctcatttggctcgtttagaaaaattgcaggcggaaggtcgcttattaacgtccggtcctaacccgacggaagacggcacaagtatcaccggttctaccgtgattgccgaattcgattcgttagccgatgctcaaatctgggcttcggaagatccttatgtagaagccggcgtttacggtgatgtgattatcaagccatttagaaaggtgttctaa

SEQ ID NO: 21492 - protein, 93 aa, Actinobacillus pleuropneumoniae serovar 1 str. 4074
MYYVIFAQDNPNMLEKRLEVRPAHLARLEKLQAEGRLLTSGPNPTEDGTSITGSTVIAEFDSLADAQIWASEDPYVEAGVYGDVIIKPFRKVF

SEQ ID NO: 21493 - DNA, 297 bp, Haemophilus influenzae R2846
  CDS (1)..(297)
atgtactatgttatttttgcccaagatattcccaatacgttagaaaagcgtcttgccgtacgcgagcaacacttggctcgtttaaaacaacttcaagcggaaaatcgcttactgacagcaggcccaaatcctgcaattgatgatgaaaatccgagtgaagctgggtttacaggctcaaccgttattgctcaatttgaaaatctacaagaggcaaaagactgggcggcacaagatccttatgtagaagctggtgtatatgcggatgttattgtaaagccgtttaaaaaagtcttttaa

SEQ ID NO: 21494 - protein, 98 aa, Haemophilus influenzae R2846
MYYVIFAQDIPNTLEKRLAVREQHLARLKQLQAENRLLTAGPNPAIDDENPSEAGFTGSTVIAQFENLQEAKDWAAQDPYVEAGVYADVIVKPFKKVF

SEQ ID NO: 21495 - DNA, 312 bp, Burkholderia cepacia R18194
  CDS (1)..(312)
atggcgcgattctttgcggtgtttgcgacggaccagccgggcatgcgcgacgtgcgcgatcgcgtacggccgattcatcggacttacctgcgctcggccgatcagcacggcgtggtggtgcggctcggtggcccgacgctggacccgcacggcgatgcgatgaacggcacgctgctcgtcgtggaagcggacgacattcaggcagtgatgcagttcatcggcaacgatccgtatgtgaaggaagggctgttctcgcacgtggaagtgcgtccgtgggactggagcctcggtaaccccgagcatcgagtgtga

SEQ ID NO: 21496 - protein, 103 aa, Burkholderia cepacia R18194
MARFFAVFATDQPGMRDVRDRVRPIHRTYLRSADQHGVVVRLGGPTLDPHGDAMNGTLLVVEADDIQAVMQFIGNDPYVKEGLFSHVEVRPWDWSLGNPEHRV

SEQ ID NO: 21497 - DNA, 300 bp, Rubrivivax gelatinosus PM1
  CDS (1)..(300)
atgctcttcgccctgcacatgatcgacaagcccgccagcctcgagctgcgccagcggctgcgcccggcgcaccgggcgcacctcgatctgatcgccgaccgcctggcgatcgccggtccgctgctcgacgagggcggcgcgatggccggcagcctgatcgtcgccgagttcgccgaccgcgccgcggtcgaggactggctggcgaacgagcccttcacggtcggagggctctacgcgcgggtcgacatccggccgttccgcaacgtgtacccgcagcgcgcggggttcgccgaggtctga

SEQ ID NO: 21498 - protein, 99 aa, Rubrivivax gelatinosus PM1
MLFALHMIDKPASLELRQRLRPAHRAHLDLIADRLAIAGPLLDEGGAMAGSLIVAEFADRAAVEDWLANEPFTVGGLYARVDIRPFRNVYPQRAGFAEV

SEQ ID NO: 21499 - DNA, 300 bp, Pseudomonas fluorescens PfO-1
  CDS (1)..(300)
atgctctacgccatcattgccaccgacgtcgccaactccctggaagcccgcctcgctgcgcgcccggcacaccttgaacgcctgcaagtgctcaagggcgaaggccgcatcgtgctggccggcccgcacccggcggtcgacagcaatgatccgggcgcagcgggtttcagcggcagcctgatcgttgccgaattcgactccctgagcgcggcgcaagcctgggccgatgccgatccttacatcgccgccggcgtctatgccaacgtgatcgtcaagccgttcaagcaagtcctgccgtaa

SEQ ID NO: 21500 - protein, 99 aa, Pseudomonas fluorescens PfO-1
MLYAIIATDVANSLEARLAARPAHLERLQVLKGEGRIVLAGPHPAVDSNDPGAAGFSGSLIVAEFDSLSAAQAWADADPYIAAGVYANVIVKPFKQVLP

SEQ ID NO: 21501 - DNA, 360 bp, Rhodospirillum rubrum
  CDS (1)..(360)
atggttgcgccttgccgcggcctcgccctggcggcgatcggccgttcccttccttgcggagcccttcccatgttgtttgccgtgcattgcgttgataagcccgaccacgccgccgttcgcctggagaaccgcgccgcccatttggactacgcccatggctgggatgcgaagatcgtctttggcggtccgctgctctcgggcgatggcaccggcatggtcggcagcctgctggttcttgatgtcgccgaccgcgccgaggccgaggccttttgcgccggcgacccttatggcaaggccgggctgttcgaggcggtgatcatccgcccctataagatcgttctgggtacccgcgccggctga

SEQ ID NO: 21502 - protein, 119 aa, Rhodospirillum rubrum
MVAPCRGLALAAIGRSLPCGALPMLFAVHCVDKPDHAAVRLENRAAHLDYAHGWDAKIVFGGPLLSGDGTGMVGSLLVLDVADRAEAEAFCAGDPYGKAGLFEAVIIRPYKIVLGTRAG

SEQ ID NO: 21503 - DNA, 300 bp, Microbulbifer degradans 2-40
  CDS (1)..(300)
atgctatttgcaataatcagccaagacgtacccaacagcttacccctaagaaaaaccgcacgagccgaccatattgcgcgattaacagagttgcgcgatgaaggccgcttgatactagctggcccccaccctgcaattgagtcagacgaccctggcgacgctgggtttaccggtagcttggtagttgcagaattcgccagcctacaagacgcacaaagctgggcagatagcgacccttacattaaagctggcgtatatgaacgagttaccgttaagccattcaaaaaagtattaccctag

SEQ ID NO: 21504 - protein, 99 aa, Microbulbifer degradans 2-40
MLFAIISQDVPNSLPLRKTARADHIARLTELRDEGRLILAGPHPAIESDDPGDAGFTGSLVVAEFASLQDAQSWADSDPYIKAGVYERVTVKPFKKVLP

SEQ ID NO: 21505 - DNA, 279 bp, Anaeromyxobacter dehalogenans 2CP-C
  CDS (1)..(279): transl_table=11
atgtacttcgcgctcctgtacgagacggtccccgactacgtccagcgccgggcggcgttccgcgccgagcacctcgcggcggcccagcaggcccggcaggagggacggctcctcctcgccggcgcgttcgatccgcccgacggcgcgctcctcgtgttcaaggccgcgagcgccgaggaggtcgaggcgttcgcgcgcgccgacccgtacgtgcggaacggcctggtcacgtcgtggcgcgtccggccgtggacggtggtggtgggcggggaggggtag

SEQ ID NO: 21506 - protein, 92 aa, Anaeromyxobacter dehalogenans 2CP-C
MYFALLYETVPDYVQRRAAFRAEHLAAAQQARQEGRLLLAGAFDPPDGALLVFKAASAEEVEAFARADPYVRNGLVTSWRVRPWTVVVGGEG

SEQ ID NO: 21507 - DNA, 300 bp, Azotobacter vinelandii AvOP
  CDS (1)..(300): transl_table=11
atgctctacgccattatcgccaccgacgtggcaaactccctggacaagcgcctgggcgctcgtcccgcccatctcgcccgtctgcagcaactgaagcaggaaggccgcctggtgctggccggcccgcaccccgccgtggacagctccgatcccggccccgccggcttcagcggcagcctggtggtcgccgagttcgaatccctggaggccgcccgcgcctgggccgatgccgatccctattgcgccgccggcgtgtatgccgaggtcagggtcaaacccttcaacaaggtcctgccctga

SEQ ID NO: 21508 - protein, 99 aa, Azotobacter vinelandii AvOP
MLYAIIATDVANSLDKRLGARPAHLARLQQLKQEGRLVLAGPHPAVDSSDPGPAGFSGSLVVAEFESLEAARAWADADPYCAAGVYAEVRVKPFNKVLP

SEQ ID NO: 21509 - DNA, 312 bp, Burkholderia cenocepacia HI2424
  CDS (1)..(312): transl_table=11
atggcgcgttttttcgcggtgtttgccaccgaccaaccgggcatgcgtgacgtgcgcgaccgcatgcgcccgattcaccggagctatctgcgctcggcggccgagcacggcgtgtatgtgcggctcggcggcccgacgctggacccgcaaggcgacgcgatgaacggcacgctgctcgtcatcgaggcggacgatatccatgcggtgatgcggttcgtcggcaacgacccgtatgtgaaggagggcctgttctcgcacgtcgaggtgcgtccgtgggactggagcctcggcaatcccgagcaaagggtgtga

SEQ ID NO: 21510 - protein, 103 aa, Burkholderia cenocepacia HI2424
MARFFAVFATDQPGMRDVRDRMRPIHRSYLRSAAEHGVYVRLGGPTLDPQGDAMNGTLLVIEADDIHAVMRFVGNDPYVKEGLFSHVEVRPWDWSLGNPEQRV

SEQ ID NO: 21511 - DNA, 300 bp, Chromohalobacter salexigens DSM 3043
  CDS (1)..(300): transl_table=11
atgctttattcgatcgttagcgacgatgtgcaagacagcctggaacgtcgcaaggcggcacgcccggatcacctggcgcggctcgagaaactgcgcgacgaagggcgcctggttctcgccggccccagccccgccgtggatgccgaggacccgggcgaggccggcttcaccggcagcgtggtgatcgccgagttcgacagcctgcaggaggcccaggcgtgggccgatgccgatcccttcgtgatcgccggcgtctacgccaaggtcaccgtcaagccgttcaagaaggtcttgccgtaa

SEQ ID NO: 21512 - protein, 99 aa, Chromohalobacter salexigens DSM 3043
MLYSIVSDDVQDSLERRKAARPDHLARLEKLRDEGRLVLAGPSPAVDAEDPGEAGFTGSVVIAEFDSLQEAQAWADADPFVIAGVYAKVTVKPFKKVLP

SEQ ID NO: 21513 - DNA, 297 bp, Chromohalobacter salexigens DSM 3043
  CDS (1)..(297): transl_table=11
atgaccgaatatgccgtagtcgcttacgactacaccgacgatgatgccctgaaccgccgcctggccaaccgcgaggcgcacctggcgggcgtgcgcgcgctggcccgggagggctgtttcctgagtggcggggcgatcctggatgacgatggcaagatgatcggctccaatgcgcattttcgattcgccgatcgccaggccttgcaggcgtggctggacatcgagccctacatgaccggacgcgtgtgggagcatgtcgatattcgcgaactcaaacgcttcgatcccacggcgtga

SEQ ID NO: 21514 - protein, 98 aa, Chromohalobacter salexigens DSM 3043
MTEYAVVAYDYTDDDALNRRLANREAHLAGVRALAREGCFLSGGAILDDDGKMIGSNAHFRFADRQALQAWLDIEPYMTGRVWEHVDIRELKRFDPTA

SEQ ID NO: 21515 - DNA, 282 bp, Polaromonas sp. JS666
  CDS (1)..(282): transl_table=11
atgctgtttgcaattcatgccctggataaaaaaaattccggctccctgcgtgcggatgcggcgcaagaacatggcgcatttctgggcaacgctgcagcgtgggggctggaaatcgtgttttccgggcctttggtggatgcaaattcacccatcggtagcttgctggttgtcgaggcgcaagagattggtatcgccaagaaatttatcgaggccgatcctctggcgaaggcgggtgtctatgaaaaagtgagcgtgacgggattcctcaaaaagaggggttga

SEQ ID NO: 21516 - protein, 93 aa, Polaromonas sp. JS666
MLFAIHALDKKNSGSLRADAAQEHGAFLGNAAAWGLEIVFSGPLVDANSPIGSLLVVEAQEIGIAKKFIEADPLAKAGVYEKVSVTGFLKKRG

SEQ ID NO: 21517 - DNA, 276 bp, Desulfuromonas acetoxidans DSM 684
  CDS (1)..(276): transl_table=11
atgttgtatgtgattcgttgtattgataaagaagatcatcttgaagtccgtatggctaaccggccaacccatgtcgagtacctcaaaagctttggtgagcgcctttttgttgccggaccaaccctggatgatgccggtgagatgaatggctctgtggtcatcctcgaatgcgaggacaaggctggtgccgaagcttttgccgccaacgatccttatgccaaggccggattattttctgacgtgaccatcagtccctggaaaaaagtcctgccctga

SEQ ID NO: 21518 - protein, 91 aa, Desulfuromonas acetoxidans DSM 684
MLYVIRCIDKEDHLEVRMANRPTHVEYLKSFGERLFVAGPTLDDAGEMNGSVVILECEDKAGAEAFAANDPYAKAGLFSDVTISPWKKVLP

SEQ ID NO: 21519 - DNA, 273 bp, Jannaschia sp. CCS1
  CDS (1)..(273): transl_table=11
atgctttgtgccctcatcgccaccgacaaacccggccacctgcagacccgtctcgacaaccgcgacgcccatctggcctatgcgaaagacagcggcaaactggtcatggcggggccgttcatcgacgaaaatggcgggatgtccggcacgcttctggtgatcgaggtcgatacgatgcaggacgcttacgactttgccgacaacgacccctacgccaaggcgggtctgttcgagaaggtccggatcgagcaatggaagaaggtgatcggctga

SEQ ID NO: 21520 - protein, 90 aa, Jannaschia sp. CCS1
MLCALIATDKPGHLQTRLDNRDAHLAYAKDSGKLVMAGPFIDENGGMSGTLLVIEVDTMQDAYDFADNDPYAKAGLFEKVRIEQWKKVIG

SEQ ID NO: 21521 - DNA, 303 bp, Methylobacillus flagellatus KT
  CDS (1)..(303): transl_table=11
atgtggtataccatcattgcagaagacgttcccggcagcctggaaaaacgcctggctgcccgccctccccaccttgagcgcctgaaggctcttcaggatgcaggtcgcctcctgctggctggcccctttcccgcgatcgacagcaatgatccgggtcctgcaggattcaccggcagcctgattgtggccgagtttgacagtctggaatcggcgcaggcctgggccaatgaggatccatttgtgaacgcaggggtatattccgctgtcacagtcaaaccttttcgcaaaaccttgcctgcatga

SEQ ID NO: 21522 - protein, 100 aa, Methylobacillus flagellatus KT
MWYTIIAEDVPGSLEKRLAARPPHLERLKALQDAGRLLLAGPFPAIDSNDPGPAGFTGSLIVAEFDSLESAQAWANEDPFVNAGVYSAVTVKPFRKTLPA

SEQ ID NO: 21523 - DNA, 300 bp, Shewanella baltica OS155
  CDS (1)..(300): transl_table=11
atgtggtatatgatttcagctcaagattttgagaacagtttagaaaaacgtttagccgctcgccctgcccatttagctcgcctgcaagccctcgccgatgaaggtcgtttactgatcgctggcccacatccagccattgacagcgaaaacccaggtgatgctggctttagtggttcactggttgtcgccgattttgaatccttagtggcagcaaaacactgggccgatgccgatccttatatcgaagcgggcgtgtataaaagcgtggtcgttaaacctttcaaacgagtcctgccctaa

SEQ ID NO: 21524 - protein, 99 aa, Shewanella baltica OS155
MWYMISAQDFENSLEKRLAARPAHLARLQALADEGRLLIAGPHPAIDSENPGDAGFSGSLVVADFESLVAAKHWADADPYIEAGVYKSVVVKPFKRVLP

SEQ ID NO: 21525 - DNA, 300 bp, Shewanella amazonensis SB2B
  CDS (1)..(300): transl_table=11
atgtggtacatgatttcatcccaggacgttgccaacagtctcgaaaaacgccttgcggcccggccagctcaccttgctcgccttcaggagctcgccgatgaaggtcgactgatgattgccggtccacacccggctatcgatagtgataaccccggtgaagccggctttaccggctctttggttgtagccgaatttgaatcactggaactcgcccaggcctgggccgatgccgatccttacattgccgctggggtgtatgaaaaggtgatcgtaaagccctttaagcgagtgttgccctga

SEQ ID NO: 21526 - protein, 99 aa, Shewanella amazonensis SB2B
MWYMISSQDVANSLEKRLAARPAHLARLQELADEGRLMIAGPHPAIDSDNPGEAGFTGSLVVAEFESLELAQAWADADPYIAAGVYEKVIVKPFKRVLP

SEQ ID NO: 21527 - DNA, 297 bp, Ralstonia metallidurans CH34
  CDS (1)..(297): transl_table=11
atgccgtacctcattgagaccttcgacaagcccgaacaccagcacgttcgccaggccaaccggcccgcgcacctggagttcctggcggagaacagcaagctgctgctggcctgcggggccaagctcaatgatgacggcagcgatggcggcggtggcatctacatcgtcgacgtggacacacgcgaggccgcgcgggcactgatcgaggccgatccgttcttcacggccggcctgttcgccgacatccggatcgtgcgctggcgcaaggcgtatctggatggcgtctgccgtctctga

SEQ ID NO: 21528 - protein, 98 aa, Ralstonia metallidurans CH34
MPYLIETFDKPEHQHVRQANRPAHLEFLAENSKLLLACGAKLNDDGSDGGGGIYIVDVDTREAARALIEADPFFTAGLFADIRIVRWRKAYLDGVCRL

SEQ ID NO: 21529 - DNA, 303 bp, Magnetococcus sp. MC-1
  CDS (1)..(303): transl_table=11
atgtactacgccatcgttgcccaagatatcgagaacagcctatccctacggcagagcgcccgcccggcccaccttgagcgtctcaaagcgttacaggcccaggatcgtttactggttgccggcccactacccgctgtggaccgtgaagatcctggcgaggctgggtttaccggcagtgtggtgattgcccagtttgattccctcagccaagcacaagcgtgggcggcggctgacccctatgttgcggcgggggtctatgcccaagtcagtgttaaaccctttaaaaaggtactccctgcttag

SEQ ID NO: 21530 - protein, 100 aa, Magnetococcus sp. MC-1
MYYAIVAQDIENSLSLRQSARPAHLERLKALQAQDRLLVAGPLPAVDREDPGEAGFTGSVVIAQFDSLSQAQAWAAADPYVAAGVYAQVSVKPFKKVLPA

SEQ ID NO: 21531 - DNA, 297 bp, Mesorhizobium sp. BNC1
  CDS (1)..(297): transl_table=11
atgatcttcatcattctttgcaaggataagcccggtcatctgcaagtccgcatggacacgaggccggaccacgtcgcctatctcgatacgcttaatgcggaaggcaagctgaaattcgctggcccgttcctcgacggggagaataagccctgcggcagcatggtcggcatcgaggctgcgagcctcgccgatgccgaggcgctcgcacgctccgacccctatgcacttgccggcctgttcgaatccgtcgagattcgcccgtggaactgggtgttcaacaagccggagagtgcgtga

SEQ ID NO: 21532 - protein, 98 aa, Mesorhizobium sp. BNC1
MIFIILCKDKPGHLQVRMDTRPDHVAYLDTLNAEGKLKFAGPFLDGENKPCGSMVGIEAASLADAEALARSDPYALAGLFESVEIRPWNWVFNKPESA

SEQ ID NO: 21533 - DNA, 273 bp, Silicibacter sp. TM1040
  CDS (1)..(273): transl_table=11
atgctcattgcattgattgcccgcgacaaacccgaccatctgcagacgcgcctcgacaatcgtgcggcgcatctcgcctatatcgaagagaccggcgttgttgcgcaggcgggcccgcttttggaccaaaacggcgagatggttggctctctggtgatcctcgacgtggaggacatggccgccggtgaagcctgggccgcaaacgacccctacaacaaggccggactctttgaggccgttgaacttatcacctggaagaaggtgatcggctga

SEQ ID NO: 21534 - protein, 90 aa, Silicibacter sp. TM1040
MLIALIARDKPDHLQTRLDNRAAHLAYIEETGVVAQAGPLLDQNGEMVGSLVILDVEDMAAGEAWAANDPYNKAGLFEAVELITWKKVIG

SEQ ID NO: 21535 - DNA, 273 bp, Paracoccus denitrificans PD1222
  CDS (1)..(273): transl_table=11
atgccccttttcgccgtgatctgccgcgaccatgccggcaagctgcaaacccgtctcgacacccgcgaaagccacctggccttcatgggcgcgcagcccggcgtcaagctggccggccccttcgtcgagaacggccagccctgcggctcgctgctgatcgtcgagggcgaaagcttgacccaggtcaaggaatgggcggcacaggacccctacaacgcagccgatctgttcgcctcggtcgaggtgatcgagtggaagaaggtgattggctga

SEQ ID NO: 21536 - protein, 90 aa, Paracoccus denitrificans PD1222
MPLFAVICRDHAGKLQTRLDTRESHLAFMGAQPGVKLAGPFVENGQPCGSLLIVEGESLTQVKEWAAQDPYNAADLFASVEVIEWKKVIG

SEQ ID NO: 21537 - DNA, 300 bp, Shewanella denitrificans OS-217
  CDS (1)..(300): transl_table=11
atgtggtatatgatttcttcgcaagatgttgaaaatagtttagaaaagcgcttatcagtccgctcgtttcacttagccagactgcaagaattatctgatgaaggccgcctattagtcgcaggtcctcatccggcaattgataatgaaaatccaggggatgcaggctttaccggctccttggttatcgcagactttgccagccttgagatagctcaagcttgggccgatgctgacccctatattgaggctggcgtttatgccagcgtgatagtgaaaccctttaagcgagtattgccttaa

SEQ ID NO: 21538 - protein, 99 aa, Shewanella denitrificans OS-217
MWYMISSQDVENSLEKRLSVRSFHLARLQELSDEGRLLVAGPHPAIDNENPGDAGFTGSLVIADFASLEIAQAWADADPYIEAGVYASVIVKPFKRVLP

SEQ ID NO: 21539 - DNA, 300 bp, Shewanella frigidimarina NCIMB 400
  CDS (1)..(300): transl_table=11
atgtggtatatgatttcatctcaagatgttgaaaacagtctagaaaagcgtttatctgttcgtgctgaacatttagcacgtttacaagctttagccgatgaaggccgtttattaactgccggaccacaccctgcaattgataatgaaaatcctggtgaagcgggtttcacaggatcattagttattgctgactttccttcattagaagatgcacaagcttgggctgatgtggatccttatatcggtgctggcgtgtacaaaagcgttatcgttaagccatttaaacgagtgcttccttaa

SEQ ID NO: 21540 - protein, 99 aa, Shewanella frigidimarina NCIMB 400
MWYMISSQDVENSLEKRLSVRAEHLARLQALADEGRLLTAGPHPAIDNENPGEAGFTGSLVIADFPSLEDAQAWADVDPYIGAGVYKSVIVKPFKRVLP

SEQ ID NO: 21541 - DNA, 330 bp, Psychrobacter cryohalolentis K5
  CDS (1)..(330): transl_table=11
atgtctttattcgccattatcggtcatgacgtagcaggcagtagcgcgcaacgtcagctgacacgcccagagcacgttgagcgcttacaagtattgaatcgtgagcagcgcttgattatcgcaggaccaacaccgattgaacatggtaaaagcgagatgtcaggcagcctgattatcgcggactttgactcgcttgaggcagctcaaaactgggcaagcgctgagccgtatttgcgtgacggtgtctacagtcatgtcgatatcaagccatttattcaagcgttaccagcagtgaatgtcagcacaacaaatgaggtagcatcatcgtga

SEQ ID NO: 21542 - protein, 109 aa, Psychrobacter cryohalolentis K5
MSLFAIIGHDVAGSSAQRQLTRPEHVERLQVLNREQRLIIAGPTPIEHGKSEMSGSLIIADFDSLEAAQNWASAEPYLRDGVYSHVDIKPFIQALPAVNVSTTNEVASS

SEQ ID NO: 21543 - DNA, 303 bp, Nitrosomonas eutropha C71
  CDS (1)..(303): transl_table=11
atgctctatttaatatacggtgaagatgttccggatagcctggcgcaacgggtagttaaccggcctgcacatttggcgcgaatccaggaattacaggagcaggggagactgttattggcaggcccttgtccggcaattgatagcgtggaccccgggccggcgggttttaccggaagcttgatagtggcagagtttgcgtcactgaatgcggctcaggaatgggcagatgctgatccatacctggcagccggtatttatgcaaaagtggccgtaaagccgttcaggaaggttctgcctgaataa

SEQ ID NO: 21544 - protein, 100 aa, Nitrosomonas eutropha C71
MLYLIYGEDVPDSLAQRVVNRPAHLARIQELQEQGRLLLAGPCPAIDSVDPGPAGFTGSLIVAEFASLNAAQEWADADPYLAAGIYAKVAVKPFRKVLPE

SEQ ID NO: 21545 - DNA, 285 bp, Burkholderia ambifaria AMMD
  CDS (1)..(285): transl_table=11
atgcacttcactgtctactgccttgaccaccccgacatggtcgagcgtcgccttgaaaactacgatgctcacaaggcttatctgcagactgcgcctgtgaatacgctcatttctggtccgctggcaaagccggatggccagacgatgattggcagcttctttctctacgaagctgatgacatcggggaaataaaagcattcatcgaggccgacccgttcaacaaggcgggcatctgggccacggtcgatatcagaccgttcatcaagcgggtcgataaccgctaa

SEQ ID NO: 21546 - protein, 94 aa, Burkholderia ambifaria AMMD
MHFTVYCLDHPDMVERRLENYDAHKAYLQTAPVNTLISGPLAKPDGQTMIGSFFLYEADDIGEIKAFIEADPFNKAGIWATVDIRPFIKRVDNR

SEQ ID NO: 21547 - DNA, 303 bp, Burkholderia cepacia
  CDS (1)..(303): transl_table=11
atgctatttttgatctaccgtaaagacaggccggggagtcttcaagtccgaatcgataactatgcagcccaccttgcctacctggagccgctcaaagcaaagattcaggtaggcggaccgacacttggcgccggaacgggaaccgacgacaaggacatgacgggcagcttcctgatcatggaggcggaaagttgggacgaggtgcacagcttcgtcgagaacgacccgttcacgaaagctggactgtttgccgcgacgatcgtcgaacgctggaagcacggcaagcacaacgactccaaatga

SEQ ID NO: 21548 - protein, 100 aa, Burkholderia cepacia
MLFLIYRKDRPGSLQVRIDNYAAHLAYLEPLKAKIQVGGPTLGAGTGTDDKDMTGSFLIMEAESWDEVHSFVENDPFTKAGLFAATIVERWKHGKHNDSK

SEQ ID NO: 21549 - DNA, 303 bp, uncultured bacterium 577
  CDS (1)..(303)
atgctttacgtaataaatggtgaagatgctccaaatagtctagaaaaacgtataatatctagaccttctcacctagaacgtattaagatattacaaaatgaggggcgcctattactagcagggccatatcctgcaattgatagttcagatcctggtccagctggctttactggtagcctgatcgtagcagagtttatttcattagagatggctagcgcttgggccgaggctgatccatacttaatttctggagtatatacaaaggttacggtcaagccatttaagaaaatattgccagaatga

SEQ ID NO: 21550 - protein, 100 aa, uncultured bacterium 577
MLYVINGEDAPNSLEKRIISRPSHLERIKILQNEGRLLLAGPYPAIDSSDPGPAGFTGSLIVAEFISLEMASAWAEADPYLISGVYTKVTVKPFKKILPE

SEQ ID NO: 21551 - DNA, 273 bp, uncultured proteobacterium
  CDS (1)..(273)
atgcgtattgctgttatcacccgcgataaaccaggacatttacacctgcgtgtggaaacccgtgacgcgcatttggcctatatcaaggagaccggcattgttgaaatggcgggaccgtttttggacgacgcagagcaaatgtgcggctctctgattgttttggaagttgaaactatggccgcagcacaggcttgggctgagaacgacccctataataaagctggattgttcgaaagcgtgaccttgagccagtggaagaaagtcatcggctaa

SEQ ID NO: 21552 - protein, 90 aa, uncultured proteobacterium
MRIAVITRDKPGHLHLRVETRDAHLAYIKETGIVEMAGPFLDDAEQMCGSLIVLEVETMAAAQAWAENDPYNKAGLFESVTLSQWKKVIG

SEQ ID NO: 21553 - DNA, 297 bp, Alcaligenes eutrophus
  CDS (1)..(297): transl_table=11
atgccgtacctgatcgaaaccgtcgacaagcccaatcaccagcatgtgcgccaggccacccgtgccagccacctggattacctggaagccaacaaggacttgctgctggcttgcggcgccaagctcaacgacgatggctcggatgccggaggcggcatctatatcgtcgatgtcgacacccgcgacgcggcacagcaattcatcgacgccgatccgttcaccgaggcgggtttgtttgccgaggtgcgcatcgtgcgctggcgcaaggcctatctcgacggcgtgcgccatctttga

SEQ ID NO: 21554 - protein, 98 aa, Alcaligenes eutrophus
MPYLIETVDKPNHQHVRQATRASHLDYLEANKDLLLACGAKLNDDGSDAGGGIYIVDVDTRDAAQQFIDADPFTEAGLFAEVRIVRWRKAYLDGVRHL

SEQ ID NO: 21555 - DNA, 273 bp, Roseobacter denitrificans
  CDS (1)..(273): transl_table=11
atgctcgtcgctctgatcgctcatgacaaaccgggcgcattgcccattcgtcaggaaaaccgccccgcgcatgtggaatacctcaaatctagtacggctgtgcaacaggctggccccctgctggatgacgccggagagatgtgcggctccctcatcattctggatgtcgcggatatggatgaggccaaagcctgggcgcaaggtgatccttacggtgccgccggactgtttgcatcggtcgatctgatcccctggaaccgggtgattggctga

SEQ ID NO: 21556 - protein, 90 aa, Roseobacter denitrificans
MLVALIAHDKPGALPIRQENRPAHVEYLKSSTAVQQAGPLLDDAGEMCGSLIILDVADMDEAKAWAQGDPYGAAGLFASVDLIPWNRVIG

SEQ ID NO: 21557 - DNA, 297 bp, Haemophilus influenzae
  CDS (1)..(297): transl_table=11
atgtactatgttatttttgcccaagatattcccaatacgttagaaaagcgtcttgccgtacgcgagcaacacttggctcgtttaaaacaacttcaagcggaaaatcgcttactgacagcaggcccaaatcctgcaattgatgatgaaaatccgagtgaagctggttttacaggttcaaccgttattgctcaatttgaaaatctacaagcggcaaaagactgggctgcacaagatccttatgtagaagctggcgtatatgcggatgttattgtaaagccgtttaaaaaagtcttttaa

SEQ ID NO: 21558 - protein, 98 aa, Haemophilus influenzae
MYYVIFAQDIPNTLEKRLAVREQHLARLKQLQAENRLLTAGPNPAIDDENPSEAGFTGSTVIAQFENLQAAKDWAAQDPYVEAGVYADVIVKPFKKVF

SEQ ID NO: 21559 - DNA, 297 bp, Escherichia coli O6
  CDS (1)..(297)
atgttgtatgttatttacgctcaagacaaagctgatagcctcgaaaaacgcctttccgttcgtccggcacatttagcacgtttacagttactgcatgatgaaggtcgtttgttgacagctggtccaatgccagcggtagacagtaacgatccaggggctgcgggatttactggctcaaccgttattgctgaatttgaatcgctggaagcagctcaggcctgggccgatgctgacccgtacgtagcggcaggagtctatgaacacgtttcagtgaaaccatttaagaaagtgttctga

SEQ ID NO: 21560 - protein, 98 aa, Escherichia coli O6
MLYVIYAQDKADSLEKRLSVRPAHLARLQLLHDEGRLLTAGPMPAVDSNDPGAAGFTGSTVIAEFESLEAAQAWADADPYVAAGVYEHVSVKPFKKVF

SEQ ID NO: 21561 - DNA, 24 bp, Artificial sequence
  (1)..(24): primer
atgcatggccttaacaaagacatc

SEQ ID NO: 21562 - DNA, 28 bp, Artificial sequence
  (1)..(28): primer
ttagaacactttcttaaatggtttcact

SEQ ID NO: 21563 - protein, 104 aa, Artificial sequence
  Variant (2)..(2): xaa in position 2 is any amino acid
  Variant (4)..(4): xaa in position 4 is any amino acid
  Variant (6)..(8): xaa in position 6 to 8 is any amino acid
  Variant (10)..(13): xaa in position 10 to 13 is any amino acid
  Variant (15)..(16): xaa in position 15 to 16 is any amino acid
  Variant (18)..(20): xaa in position 18 to 20 is any amino acid
  Variant (22)..(23): xaa in position 22 to 23 is any amino acid
  Variant (26)..(27): xaa in position 26 to 27 is any amino acid
  Variant (29)..(32): xaa in position 29 to 32 is any amino acid
  Variant (33)..(39): xaa in position 33 to 39 is any or no amino acid
  Variant (41)..(42): xaa in position 41 to 42 is any amino acid
  Variant (46)..(53): xaa in position 46 to 53 is any amino acid
  Variant (54)..(67): xaa in position 54 to 67 is any or no amino acid
  Variant (70)..(70): xaa in position 70 is any or no amino acid
  Variant (73)..(73): xaa in position 73 is any amino acid
  Variant (75)..(77): xaa in position 75 to 77 is any amino acid
  Variant (79)..(80): xaa in position 79 to 80 is any amino acid
  Variant (82)..(83): xaa in position 82 to 83 is any amino acid
  Variant (86)..(87): xaa in position 86 to 87 is any amino acid
  Variant (91)..(92): xaa in position 91 to 92 is any amino acid
  Variant (97)..(98): xaa in position 97 to 98 is any amino acid
  Variant (100)..(100): xaa in position 100 is any amino acid
  Variant (102)..(102): xaa in position 102 is any amino acid
MXYXIXXXDXXXXLXXRXXXRXXHLXXLXXXXXXXXXXXLXXAGPXXXXXXXXXXXXXXXXXXXXXXGSXVIXEXXXLXXAXXWAXXDPYXXAGVYXXVXVXPF

SEQ ID NO: 21564 - protein, 20 aa, Artificial sequence
  Variant (2)..(3): xaa in position 2 to 3 is any amino acid
  Variant (4)..(4): xaa in position 4 is Asp, Gly or Asn
  Variant (5)..(6): xaa in position 5 to 6 is any amino acid
  Variant (7)..(7): xaa in position 7 is Ala, Asp, Glu, Gln, Ser or Thr
  Variant (8)..(8): xaa in position 8 is any amino acid
  Variant (10)..(12): xaa in position 10 to 12 is any amino acid
  Variant (14)..(15): xaa in position 14 to 15 is any amino acid
  Variant (17)..(19): xaa in position 17 to 19 is any or no amino acid
DXXXXXXXRXXXRXXHXXXL

SEQ ID NO: 21565 - protein, 34 aa, Artificial sequence
  Variant (2)..(2): xaa in position 2 is Ser or Thr
  Variant (3)..(3): xaa in position 3 is any amino acid
  Variant (4)..(4): xaa in position 4 is Phe, Ile, Leu, Met or Val
  Variant (5)..(5): xaa in position 5 is Gly, Ile, Leu or Val
  Variant (6)..(9): xaa in position 6 to 9 is any amino acid
  Variant (10)..(10): xaa in position 10 is Ala, Asp, Glu, Asn, Ser or Thr
  Variant (11)..(13): xaa in position 11 to 13 is any amino acid
  Variant (14)..(14): xaa in position 14 is Ala, Gly, Ile, Leu or Val
  Variant (15)..(20): xaa in position 15 to 20 is any amino acid
  Variant (21)..(21): xaa in position 21 is Asp or Glu
  Variant (23)..(26): xaa in position 23 to 26 is any amino acid
  Variant (28)..(33): xaa in position 28 to 33 is any or no amino acid
GXXXXXXXXXXXXXXXXXXXXPXXXXGXXXXXXV

SEQ ID NO: 21566 - DNA, 1047 bp, Escherichia coli K12; identical to SEQ ID NO: 1323
  CDS (1)..(1047)

SEQ ID NO: 21567 - protein, 348 aa, Escherichia coli K12; identical to SEQ ID NO: 1324

SEQ ID NO: 21568 - DNA, 1235 bp, Salmonella typhimurium; identical to SEQ ID NO: 1325
  CDS (165)..(1235)

SEQ ID NO: 21569 - protein, 356 aa, Salmonella typhimurium; identical to SEQ ID NO: 1326

SEQ ID NO: 21570 - DNA, 1086 bp, Deinococcus radiodurans; identical to SEQ ID NO: 1327
  CDS (1)..(1086)

SEQ ID NO: 21571 - protein, 361 aa, Deinococcus radiodurans; identical to SEQ ID NO: 1328

SEQ ID NO: 21572 - DNA, 1056 bp, Neisseria meningitidis; identical to SEQ ID NO: 1329
  CDS (1)..(1056)

SEQ ID NO: 21573 - protein, 351 aa, Neisseria meningitidis; identical to SEQ ID NO: 1330

SEQ ID NO: 21574 - DNA, 1047 bp, Yersinia pestis; identical to SEQ ID NO: 1331
  CDS (1)..(1047)

SEQ ID NO: 21575 - protein, 348 aa, Yersinia pestis; identical to SEQ ID NO: 1332

SEQ ID NO: 21576 - DNA, 1071 bp, Escherichia coli; identical to SEQ ID NO: 1333
  CDS (1)..(1071)

SEQ ID NO: 21577 - protein, 356 aa, Escherichia coli; identical to SEQ ID NO: 1334

SEQ ID NO: 21578 - DNA, 1131 bp, Nostoc sp. PCC 7120; identical to SEQ ID NO: 1335
  CDS (1)..(1131)

SEQ ID NO: 21579 - protein, 376 aa, Nostoc sp. PCC 7120; identical to SEQ ID NO: 1336

SEQ ID NO: 21580 - DNA, 1053 bp, Salmonella enterica subsp. enterica serovar Typhi; identical to SEQ ID NO: 1337
  CDS (1)..(1053)

SEQ ID NO: 21581 - protein, 350 aa, Salmonella enterica subsp. enterica serovar Typhi; identical to SEQ ID NO: 1338

SEQ ID NO: 21582 - DNA, 1077 bp, Pseudomonas aeruginosa; identical to SEQ ID NO: 1339
  CDS (1)..(1077)

SEQ ID NO: 21583 - protein, 358 aa, Pseudomonas aeruginosa; identical to SEQ ID NO: 1340

SEQ ID NO: 21584 - DNA, 1047 bp, Buchnera sp; identical to SEQ ID NO: 1341
  CDS (1)..(1047)

SEQ ID NO: 21585 - protein, 348 aa, Buchnera sp; identical to SEQ ID NO: 1342

SEQ ID NO: 21586 - DNA, 1074 bp, Vibrio cholerae; identical to SEQ ID NO: 1343
  CDS (1)..(1074)

SEQ ID NO: 21587 - protein, 357 aa, Vibrio cholerae; identical to SEQ ID NO: 1344

SEQ ID NO: 21588 - DNA, 1038 bp, Lactococcus lactis subsp. lactis; identical to SEQ ID NO: 1345
  CDS (1)..(1038)

SEQ ID NO: 21589 - protein, 345 aa, Lactococcus lactis subsp. lactis; identical to SEQ ID NO: 1346

SEQ ID NO: 21590 - DNA, 1023 bp, Lactococcus lactis subsp. lactis; identical to SEQ ID NO: 1347
  CDS (1)..(1023)

SEQ ID NO: 21591 - protein, 340 aa, Lactococcus lactis subsp. lactis; identical to SEQ ID NO: 1348

SEQ ID NO: 21592 - DNA, 1032 bp, Streptococcus pneumoniae; identical to SEQ ID NO: 1349
  CDS (1)..(1032)

SEQ ID NO: 21593 - protein, 343 aa, Streptococcus pneumoniae; identical to SEQ ID NO: 1350

SEQ ID NO: 21594 - DNA, 1095 bp, Pseudomonas aeruginosa; identical to SEQ ID NO: 1351
  CDS (1)..(1095)

SEQ ID NO: 21595 - protein, 364 aa, Pseudomonas aeruginosa; identical to SEQ ID NO: 1352

SEQ ID NO: 21596 - DNA, 1110 bp, Caulobacter crescentus; identical to SEQ ID NO: 1353
  CDS (1)..(1110)

SEQ ID NO: 21597 - protein, 369 aa, Caulobacter crescentus; identical to SEQ ID NO: 1354

SEQ ID NO: 21598 - DNA, 1032 bp, Streptococcus pneumoniae; identical to SEQ ID NO: 1355
  CDS (1)..(1032)

SEQ ID NO: 21599 - protein, 343 aa, Streptococcus pneumoniae; identical to SEQ ID NO: 1356

SEQ ID NO: 21600 - DNA, 1047 bp, Buchnera aphidicola; identical to SEQ ID NO: 1357
  CDS (1)..(1047)

SEQ ID NO: 21601 - protein, 348 aa, Buchnera aphidicola; identical to SEQ ID NO: 1358

SEQ ID NO: 21602 - DNA, 1089 bp, Haemophilus influenzae; identical to SEQ ID NO: 1359
  CDS (1)..(1089)

SEQ ID NO: 21603 - protein, 362 aa, Haemophilus influenzae; identical to SEQ ID NO: 1360

SEQ ID NO: 21604 - DNA, 1502 bp, Candida albicans; identical to SEQ ID NO: 1361
  CDS (336)..(1442)

SEQ ID NO: 21605 - protein, 368 aa, Candida albicans; identical to SEQ ID NO: 1362

SEQ ID NO: 21606 - DNA, 1113 bp, Saccharomyces cerevisiae; identical to SEQ ID NO: 1363
  CDS (1)..(1113)

SEQ ID NO: 21607 - protein, 370 aa, Saccharomyces cerevisiae; identical to SEQ ID NO: 1364

SEQ ID NO: 21608 - DNA, 2048 bp, Saccharomyces cerevisiae; identical to SEQ ID NO: 1365
  CDS (619)..(1731)

SEQ ID NO: 21609 - protein, 370 aa, Saccharomyces cerevisiae; identical to SEQ ID NO: 1366

SEQ ID NO: 21610 - DNA, 1107 bp, Schizosaccharomyces pombe; identical to SEQ ID NO: 1367
  CDS (1)..(1107)

SEQ ID NO: 21611 - protein, 368 aa, Schizosaccharomyces pombe; identical to SEQ ID NO: 1368

SEQ ID NO: 21612 - DNA, 1089 bp, Amycolatopsis orientalis; identical to SEQ ID NO: 1369
  CDS (1)..(1089)

SEQ ID NO: 21613 - protein, 362 aa, Amycolatopsis orientalis; identical to SEQ ID NO: 1370

SEQ ID NO: 21614 - DNA, 1119 bp, Schizosaccharomyces pombe; identical to SEQ ID NO: 1371
  CDS (1)..(1119)

SEQ ID NO: 21615 - protein, 372 aa, Schizosaccharomyces pombe; identical to SEQ ID NO: 1372

SEQ ID NO: 21616 - DNA, 1248 bp, Corynebacterium glutamicum; identical to SEQ ID NO: 1373
  CDS (101)..(1228)

SEQ ID NO: 21617 - protein, 375 aa, Corynebacterium glutamicum; identical to SEQ ID NO: 1374

SEQ ID NO: 21618 - DNA, 1083 bp, Methylophilus methylotrophus; identical to SEQ ID NO: 1375
  CDS (1)..(1083)

SEQ ID NO: 21619 - protein, 360 aa, Methylophilus methylotrophus; identical to SEQ ID NO: 1376

SEQ ID NO: 21620 - DNA, 1107 bp, Debaryomyces hansenii; identical to SEQ ID NO: 1377
  CDS (1)..(1107)

SEQ ID NO: 21621 - protein, 368 aa, Debaryomyces hansenii; identical to SEQ ID NO: 1378

SEQ ID NO: 21622 - DNA, 1074 bp, Yarrowia lipolytica; identical to SEQ ID NO: 1379
  CDS (1)..(1074)

SEQ ID NO: 21623 - protein, 357 aa, Yarrowia lipolytica; identical to SEQ ID NO: 1380

SEQ ID NO: 21624 - DNA, 1089 bp, Yarrowia lipolytica; identical to SEQ ID NO: 1381
  CDS (1)..(1089)

SEQ ID NO: 21625 - protein, 362 aa, Yarrowia lipolytica; identical to SEQ ID NO: 1382

SEQ ID NO: 21626 - DNA, 1119 bp, Kluyveromyces lactis; identical to SEQ ID NO: 1383
  CDS (1)..(1119)

SEQ ID NO: 21627 - protein, 372 aa, Kluyveromyces lactis; identical to SEQ ID NO: 1384

SEQ ID NO: 21628 - DNA, 1095 bp, Kluyveromyces lactis; identical to SEQ ID NO: 1385
  CDS (1)..(1095)

SEQ ID NO: 21629 - protein, 364 aa, Kluyveromyces lactis; identical to SEQ ID NO: 1386

SEQ ID NO: 21630 - DNA, 1074 bp, Erwinia carotovora subsp; identical to SEQ ID NO: 1387
  CDS (1)..(1074)

SEQ ID NO: 21631 - protein, 357 aa, Erwinia carotovora subsp; identical to SEQ ID NO: 1388

SEQ ID NO: 21632 - DNA, 1047 bp, Erwinia carotovora subsp; identical to SEQ ID NO: 1389
  CDS (1)..(1047)

SEQ ID NO: 21633 - protein, 348 aa, Erwinia carotovora subsp; identical to SEQ ID NO: 1390

SEQ ID NO: 21634 - DNA, 1056 bp, Erwinia carotovora subsp; identical to SEQ ID NO: 1391
  CDS (1)..(1056)

SEQ ID NO: 21635 - protein, 351 aa, Erwinia carotovora subsp; identical to SEQ ID NO: 1392

SEQ ID NO: 21636 - DNA, 1113 bp, Acinetobacter sp; identical to SEQ ID NO: 1393
  CDS (1)..(1113)

SEQ ID NO: 21637 - protein, 370 aa, Acinetobacter sp; identical to SEQ ID NO: 1394

SEQ ID NO: 21638 - DNA, 1056 bp, Acinetobacter sp; identical to SEQ ID NO: 1395
  CDS (1)..(1056)

SEQ ID NO: 21639 - protein, 351 aa, Acinetobacter sp; identical to SEQ ID NO: 1396

SEQ ID NO: 21640 - DNA, 1119 bp, Candida glabrata; identical to SEQ ID NO: 1397
  CDS (1)..(1119)

SEQ ID NO: 21641 - protein, 372 aa, Candida glabrata; identical to SEQ ID NO: 1398

SEQ ID NO: 21642 - DNA, 1071 bp, Candida glabrata; identical to SEQ ID NO: 1399
  CDS (1)..(1071)

SEQ ID NO: 21643 - protein, 356 aa, Candida glabrata; identical to SEQ ID NO: 1400

SEQ ID NO: 21644 - DNA, 1083 bp, Photobacterium profundum; identical to SEQ ID NO: 1401
  CDS (1)..(1083)

SEQ ID NO: 21645 - protein, 360 aa, Photobacterium profundum; identical to SEQ ID NO: 1402

SEQ ID NO: 21646 - DNA, 1053 bp, Photobacterium profundum; identical to SEQ ID NO: 1403
  CDS (1)..(1053)

SEQ ID NO: 21647 - protein, 350 aa, Photobacterium profundum; identical to SEQ ID NO: 1404

SEQ ID NO: 21648 - DNA, 1113 bp, Photobacterium profundum; identical to SEQ ID NO: 1405
  CDS (1)..(1113)

SEQ ID NO: 21649 - protein, 370 aa, Photobacterium profundum; identical to SEQ ID NO: 1406

SEQ ID NO: 21650 - DNA, 1056 bp, Photobacterium profundum; identical to SEQ ID NO: 1407
  CDS (1)..(1056)

SEQ ID NO: 21651 - protein, 351 aa, Photobacterium profundum; identical to SEQ ID NO: 1408

SEQ ID NO: 21652 - DNA, 1092 bp, Parachlamydia sp; identical to SEQ ID NO: 1409
  CDS (1)..(1092)

SEQ ID NO: 21653 - protein, 363 aa, Parachlamydia sp; identical to SEQ ID NO: 1410

SEQ ID NO: 21654 - DNA, 1095 bp, Rhodopseudomonas palustris; identical to SEQ ID NO: 1411
  CDS (1)..(1095)

SEQ ID NO: 21655 - protein, 364 aa, Rhodopseudomonas palustris; identical to SEQ ID NO: 1412

SEQ ID NO: 21656 - DNA, 1100 bp, Amycolatopsis methanolica; identical to SEQ ID NO: 1413
  CDS (1)..(1086)

SEQ ID NO: 21657 - protein, 361 aa, Amycolatopsis methanolica; identical to SEQ ID NO: 1414

SEQ ID NO: 21658 - DNA, 1071 bp, Treponema denticola; identical to SEQ ID NO: 1415
  CDS (1)..(1071)

SEQ ID NO: 21659 - protein, 356 aa, Treponema denticola; identical to SEQ ID NO: 1416

SEQ ID NO: 21660 - DNA, 1068 bp, Geobacter sulfurreducens; identical to SEQ ID NO: 1417
  CDS (1)..(1068)

SEQ ID NO: 21661 - protein, 355 aa, Geobacter sulfurreducens; identical to SEQ ID NO: 1418

SEQ ID NO: 21662 - DNA, 1095 bp, Ashbya gossypii; identical to SEQ ID NO: 1419
  CDS (1)..(1095)

SEQ ID NO: 21663 - protein, 364 aa, Ashbya gossypii; identical to SEQ ID NO: 1420

SEQ ID NO: 21664 - DNA, 1122 bp, Ashbya gossypii; identical to SEQ ID NO: 1421
  CDS (1)..(1122)

SEQ ID NO: 21665 - protein, 373 aa, Ashbya gossypii; identical to SEQ ID NO: 1422

SEQ ID NO: 21666 - DNA, 1098 bp, Amycolatopsis balhimycina; identical to SEQ ID NO: 1423
  CDS (1)..(1098)

SEQ ID NO: 21667 - protein, 365 aa, Amycolatopsis balhimycina; identical to SEQ ID NO: 1424

SEQ ID NO: 21668 - DNA, 1071 bp, Vibrio vulnificus; identical to SEQ ID NO: 1425
  CDS (1)..(1071)

SEQ ID NO: 21669 - protein, 356 aa, Vibrio vulnificus; identical to SEQ ID NO: 1426

SEQ ID NO: 21670 - DNA, 1047 bp, Photorhabdus luminescens; identical to SEQ ID NO: 1427
  CDS (1)..(1047)

SEQ ID NO: 21671 - protein, 348 aa, Photorhabdus luminescens; identical to SEQ ID NO: 1428

SEQ ID NO: 21672 - DNA, 1053 bp, Photorhabdus luminescens; identical to SEQ ID NO: 1429
  CDS (1)..(1053)

SEQ ID NO: 21673 - protein, 350 aa, Photorhabdus luminescens; identical to SEQ ID NO: 1430

SEQ ID NO: 21674 - DNA, 1095 bp, Photorhabdus luminescens; identical to SEQ ID NO: 1431
  CDS (1)..(1095)

SEQ ID NO: 21675 - protein, 364 aa, Photorhabdus luminescens; identical to SEQ ID NO: 1432

SEQ ID NO: 21676 - DNA, 1119 bp, Gloeobacter violaceus; identical to SEQ ID NO: 1433
  CDS (1)..(1119)

SEQ ID NO: 21677 - protein, 372 aa, Gloeobacter violaceus; identical to SEQ ID NO: 1434

SEQ ID NO: 21678 - DNA, 1107 bp, Chromobacterium violaceum; identical to SEQ ID NO: 1435
  CDS (1)..(1107)

SEQ ID NO: 21679 - protein, 368 aa, Chromobacterium violaceum; identical to SEQ ID NO: 1436

SEQ ID NO: 21680 - DNA, 1059 bp, Chromobacterium violaceum; identical to SEQ ID NO: 1437
  CDS (1)..(1059)

SEQ ID NO: 21681 - protein, 352 aa, Chromobacterium violaceum; identical to SEQ ID NO: 1438

SEQ ID NO: 21682 - DNA, 1140 bp, Neurospora crassa; identical to SEQ ID NO: 1439
  CDS (1)..(1140)

SEQ ID NO: 21683 - protein, 379 aa, Neurospora crassa; identical to SEQ ID NO: 1440

SEQ ID NO: 21684 - DNA, 1092 bp, Neurospora crassa; identical to SEQ ID NO: 1441
  CDS (1)..(1092)

SEQ ID NO: 21685 - protein, 363 aa, Neurospora crassa; identical to SEQ ID NO: 1442

SEQ ID NO: 21686 - DNA, 1068 bp, Synechococcus sp; identical to SEQ ID NO: 1443
  CDS (1)..(1068)

SEQ ID NO: 21687 - protein, 355 aa, Synechococcus sp; identical to SEQ ID NO: 1444

SEQ ID NO: 21688 - DNA, 1053 bp, Rhodopirellula baltica; identical to SEQ ID NO: 1445
  CDS (1)..(1053)

SEQ ID NO: 21689 - protein, 350 aa, Rhodopirellula baltica; identical to SEQ ID NO: 1446

SEQ ID NO: 21690 - DNA, 1068 bp, Prochlorococcus marinus subsp; identical to SEQ ID NO: 1447
  CDS (1)..(1068)

SEQ ID NO: 21691 - protein, 355 aa, Prochlorococcus marinus subsp; identical to SEQ ID NO: 1448

SEQ ID NO: 21692 - DNA, 1083 bp, Prochlorococcus marinus; identical to SEQ ID NO: 1449
  CDS (1)..(1083)

SEQ ID NO: 21693 - protein, 360 aa, Prochlorococcus marinus; identical to SEQ ID NO: 1450

SEQ ID NO: 21694 - DNA, 1074 bp, Prochlorococcus marinus; identical to SEQ ID NO: 1451
  CDS (1)..(1074)

SEQ ID NO: 21695 - protein, 357 aa, Prochlorococcus marinus; identical to SEQ ID NO: 1452

SEQ ID NO: 21696 - DNA, 1113 bp, Haemophilus ducreyi; identical to SEQ ID NO: 1453
  CDS (1)..(1113)

SEQ ID NO: 21697 - protein, 370 aa, Haemophilus ducreyi; identical to SEQ ID NO: 1454

SEQ ID NO: 21698 - DNA, 1080 bp, Haemophilus ducreyi; identical to SEQ ID NO: 1455
  CDS (1)..(1080)

SEQ ID NO: 21699 - protein, 359 aa, Haemophilus ducreyi; identical to SEQ ID NO: 1456

SEQ ID NO: 21700 - DNA, 1086 bp, Candidatus Blochmannia floridanus; identical to SEQ ID NO: 1457
  CDS (1)..(1086)

SEQ ID NO: 21701 - protein, 361 aa, Candidatus Blochmannia floridanus; identical to SEQ ID NO: 1458

SEQ ID NO: 21702 - DNA, 1074 bp, Bordetella pertussis; identical to SEQ ID NO: 1459
  CDS (1)..(1074)

SEQ ID NO: 21703 - protein, 357 aa, Bordetella pertussis; identical to SEQ ID NO: 1460

SEQ ID NO: 21704 - DNA, 1119 bp, Bordetella bronchiseptica; identical to SEQ ID NO: 1461
  CDS (1)..(1119)

SEQ ID NO: 21705 - protein, 372 aa, Bordetella bronchiseptica; identical to SEQ ID NO: 1462

SEQ ID NO: 21706 - DNA, 1179 bp, Nitrosomonas europaea; identical to SEQ ID NO: 1463
  CDS (1)..(1179)

SEQ ID NO: 21707 - protein, 392 aa, Nitrosomonas europaea; identical to SEQ ID NO: 1464

SEQ ID NO: 21708 - DNA, 1083 bp, Coxiella burnetii; identical to SEQ ID NO: 1465
  CDS (1)..(1083)

SEQ ID NO: 21709 - protein, 360 aa, Coxiella burnetii; identical to SEQ ID NO: 1466

SEQ ID NO: 21710 - DNA, 834 bp, Vibrio anguillarum; identical to SEQ ID NO: 1467
  CDS (1)..(834)

SEQ ID NO: 21711 - protein, 277 aa, Vibrio anguillarum; identical to SEQ ID NO: 1468

SEQ ID NO: 21712 - DNA, 1143 bp, Xylella fastidiosa; identical to SEQ ID NO: 1469
  CDS (1)..(1143)

SEQ ID NO: 21713 - protein, 380 aa, Xylella fastidiosa; identical to SEQ ID NO: 1470

SEQ ID NO: 21714 - DNA, 1053 bp, Vibrio parahaemolyticus; identical to SEQ ID NO: 1471
  CDS (1)..(1053)

SEQ ID NO: 21715 - protein, 350 aa, Vibrio parahaemolyticus; identical to SEQ ID NO: 1472

SEQ ID NO: 21716 - DNA, 1053 bp, Vibrio parahaemolyticus; identical to SEQ ID NO: 1473
  CDS (1)..(1053)

SEQ ID NO: 21717 - protein, 350 aa, Vibrio parahaemolyticus; identical to SEQ ID NO: 1474

SEQ ID NO: 21718 - DNA, 1074 bp, Vibrio parahaemolyticus; identical to SEQ ID NO: 1475
  CDS (1)..(1074)

SEQ ID NO: 21719 - protein, 357 aa, Vibrio parahaemolyticus; identical to SEQ ID NO: 1476

SEQ ID NO: 21720 - DNA, 1083 bp, Pseudomonas syringae; identical to SEQ ID NO: 1477
  CDS (1)..(1083)

SEQ ID NO: 21721 - protein, 360 aa, Pseudomonas syringae; identical to SEQ ID NO: 1478

SEQ ID NO: 21722 - DNA, 1077 bp, Pseudomonas syringae; identical to SEQ ID NO: 1479
  CDS (1)..(1077)

SEQ ID NO: 21723 - protein, 358 aa, Pseudomonas syringae; identical to SEQ ID NO: 1480

SEQ ID NO: 21724 - DNA, 1062 bp, Pseudomonas putida; identical to SEQ ID NO: 1481
  CDS (1)..(1062)

SEQ ID NO: 21725 - protein, 353 aa, Pseudomonas putida; identical to SEQ ID NO: 1482

SEQ ID NO: 21726 - DNA, 1113 bp, Pseudomonas putida; identical to SEQ ID NO: 1483
  CDS (1)..(1113)

SEQ ID NO: 21727 - protein, 370 aa, Pseudomonas putida; identical to SEQ ID NO: 1484

SEQ ID NO: 21728 - DNA, 1086 bp, Bradyrhizobium japonicum; identical to SEQ ID NO: 1485
  CDS (1)..(1086)

SEQ ID NO: 21729 - protein, 361 aa, Bradyrhizobium japonicum; identical to SEQ ID NO: 1486

SEQ ID NO: 21730 - DNA, 1053 bp, Yersinia pestis; identical to SEQ ID NO: 1487
  CDS (1)..(1053)

SEQ ID NO: 21731 - protein, 350 aa, Yersinia pestis; identical to SEQ ID NO: 1488

SEQ ID NO: 21732 - DNA, 1077 bp, Yersinia pestis; identical to SEQ ID NO: 1489
  CDS (1)..(1077)

SEQ ID NO: 21733 - protein, 358 aa, Yersinia pestis; identical to SEQ ID NO: 1490

SEQ ID NO: 21734 - DNA, 1038 bp, Wigglesworthia glossinidia brevipalpis; identical to SEQ ID NO: 1491
  CDS (1)..(1038)

SEQ ID NO: 21735 - protein, 345 aa, Wigglesworthia glossinidia brevipalpis; identical to SEQ ID NO: 1492

SEQ ID NO: 21736 - DNA, 1053 bp, Vibrio vulnificus; identical to SEQ ID NO: 1493
  CDS (1)..(1053)

SEQ ID NO: 21737 - protein, 350 aa, Vibrio vulnificus; identical to SEQ ID NO: 1494

SEQ ID NO: 21738 - DNA, 1053 bp, Vibrio vulnificus; identical to SEQ ID NO: 1495
  CDS (1)..(1053)

SEQ ID NO: 21739 - protein, 350 aa, Vibrio vulnificus; identical to SEQ ID NO: 1496

SEQ ID NO: 21740 - DNA, 1071 bp, Vibrio vulnificus; identical to SEQ ID NO: 1497
  CDS (1)..(1071)

SEQ ID NO: 21741 - protein, 356 aa, Vibrio vulnificus; identical to SEQ ID NO: 1498

SEQ ID NO: 21742 - DNA, 1062 bp, Synechococcus elongatus; identical to SEQ ID NO: 1499
  CDS (1)..(1062)

SEQ ID NO: 21743 - protein, 353 aa, Synechococcus elongatus; identical to SEQ ID NO: 1500

SEQ ID NO: 21744 - DNA, 1032 bp, Streptococcus mutans; identical to SEQ ID NO: 1501
  CDS (1)..(1032)

SEQ ID NO: 21745 - protein, 343 aa, Streptococcus mutans; identical to SEQ ID NO: 1502

SEQ ID NO: 21746 - DNA, 1035 bp, Streptococcus mutans; identical to SEQ ID NO: 1503
  CDS (1)..(1035)

SEQ ID NO: 21747 - protein, 344 aa, Streptococcus mutans; identical to SEQ ID NO: 1504

SEQ ID NO: 21748 - DNA, 1008 bp, Streptococcus agalactiae; identical to SEQ ID NO: 1505
  CDS (1)..(1008)

SEQ ID NO: 21749 - protein, 335 aa, Streptococcus agalactiae; identical to SEQ ID NO: 1506

SEQ ID NO: 21750 - DNA, 1065 bp, Shewanella oneidensis; identical to SEQ ID NO: 1507
  CDS (1)..(1065)

SEQ ID NO: 21751 - protein, 354 aa, Shewanella oneidensis; identical to SEQ ID NO: 1508

SEQ ID NO: 21752 - DNA, 1092 bp, Shewanella oneidensis; identical to SEQ ID NO: 1509
  CDS (1)..(1092)

SEQ ID NO: 21753 - protein, 363 aa, Shewanella oneidensis; identical to SEQ ID NO: 1510

SEQ ID NO: 21754 - DNA, 1059 bp, Shewanella oneidensis; identical to SEQ ID NO: 1511
  CDS (1)..(1059)

SEQ ID NO: 21755 - protein, 352 aa, Shewanella oneidensis; identical to SEQ ID NO: 1512

SEQ ID NO: 21756 - DNA, 1053 bp, Escherichia coli O6; identical to SEQ ID NO: 1513
  CDS (1)..(1053)

SEQ ID NO: 21757 - protein, 350 aa, Escherichia coli O6; identical to SEQ ID NO: 1514

SEQ ID NO: 21758 - DNA, 1170 bp, Corynebacterium efficiens; identical to SEQ ID NO: 1515
  CDS (1)..(1170)

SEQ ID NO: 21759 - protein, 389 aa, Corynebacterium efficiens; identical to SEQ ID NO: 1516

SEQ ID NO: 21760 - DNA, 1134 bp, Bifidobacterium longum; identical to SEQ ID NO: 1517
  CDS (1)..(1134)

SEQ ID NO: 21761 - protein, 377 aa, Bifidobacterium longum; identical to SEQ ID NO: 1518

SEQ ID NO: 21762 - DNA, 1233 bp, Bifidobacterium longum; identical to SEQ ID NO: 1519
  CDS (1)..(1233)

SEQ ID NO: 21763 - protein, 410 aa, Bifidobacterium longum; identical to SEQ ID NO: 1520

SEQ ID NO: 21764 - DNA, 1221 bp, Phytophthora infestans; identical to SEQ ID NO: 1521
  CDS (20)..(1153)

SEQ ID NO: 21765 - protein, 377 aa, Phytophthora infestans; identical to SEQ ID NO: 1522

SEQ ID NO: 21766 - DNA, 1062 bp, Chlorobium tepidum; identical to SEQ ID NO: 1523
  CDS (1)..(1062)

SEQ ID NO: 21767 - protein, 353 aa, Chlorobium tepidum; identical to SEQ ID NO: 1524

SEQ ID NO: 21768 - DNA, 1074 bp, Xanthomonas campestris; identical to SEQ ID NO: 1525
  CDS (1)..(1074)

SEQ ID NO: 21769 - protein, 357 aa, Xanthomonas campestris; identical to SEQ ID NO: 1526

SEQ ID NO: 21770 - DNA, 1074 bp, Xanthomonas axonopodis; identical to SEQ ID NO: 1527
  CDS (1)..(1074)

SEQ ID NO: 21771 - protein, 357 aa, Xanthomonas axonopodis; identical to SEQ ID NO: 1528

SEQ ID NO: 21772 - DNA, 1080 bp, Ralstonia solanacearum; identical to SEQ ID NO: 1529
  CDS (1)..(1080)

SEQ ID NO: 21773 - protein, 359 aa, Ralstonia solanacearum; identical to SEQ ID NO: 1530

SEQ ID NO: 21774 - DNA, 1179 bp, Ralstonia solanacearum; identical to SEQ ID NO: 1531
  CDS (1)..(1179)

SEQ ID NO: 21775 - protein, 392 aa, Ralstonia solanacearum; identical to SEQ ID NO: 1532

SEQ ID NO: 21776 - DNA, 1065 bp, Synechococcus sp; identical to SEQ ID NO: 1533
  CDS (1)..(1065)

SEQ ID NO: 21777 - protein, 354 aa, Synechococcus sp; identical to SEQ ID NO: 1534

SEQ ID NO: 21778 - DNA, 1035 bp, Escherichia coli; identical to SEQ ID NO: 1535
  CDS (1)..(1035)

SEQ ID NO: 21779 - protein, 344 aa, Escherichia coli; identical to SEQ ID NO: 1536

SEQ ID NO: 21780 - DNA, 1200 bp, Stigmatella aurantiaca; identical to SEQ ID NO: 1537
  CDS (62)..(1147)

SEQ ID NO: 21781 - protein, 361 aa, Stigmatella aurantiaca; identical to SEQ ID NO: 1538

SEQ ID NO: 21782 - DNA, 1092 bp, Rhizobium loti; identical to SEQ ID NO: 1539
  CDS (1)..(1092)

SEQ ID NO: 21783 - protein, 363 aa, Rhizobium loti; identical to SEQ ID NO: 1540

SEQ ID NO: 21784 - DNA, 1083 bp, Amycolatopsis mediterranei; identical to SEQ ID NO: 1541
  CDS (1)..(1083)

SEQ ID NO: 21785 - protein, 360 aa, Amycolatopsis mediterranei; identical to SEQ ID NO: 1542

SEQ ID NO: 21786 - DNA, 1053 bp, Pasteurella multocida; identical to SEQ ID NO: 1543
  CDS (1)..(1053)

SEQ ID NO: 21787 - protein, 350 aa, Pasteurella multocida; identical to SEQ ID NO: 1544

SEQ ID NO: 21788 - DNA, 1086 bp, Pasteurella multocida; identical to SEQ ID NO: 1545
  CDS (1)..(1086)

SEQ ID NO: 21789 - protein, 361 aa, Pasteurella multocida; identical to SEQ ID NO: 1546

SEQ ID NO: 21790 - DNA, 1125 bp, Emericella nidulans; identical to SEQ ID NO: 1547
  CDS (1)..(1125)

SEQ ID NO: 21791 - protein, 374 aa, Emericella nidulans; identical to SEQ ID NO: 1548

SEQ ID NO: 21792 - DNA, 1089 bp, Emericella nidulans; identical to SEQ ID NO: 1549
  CDS (1)..(1089)

SEQ ID NO: 21793 - protein, 362 aa, Emericella nidulans; identical to SEQ ID NO: 1550

SEQ ID NO: 21794 - DNA, 1239 bp, Vibrio cholerae; identical to SEQ ID NO: 1551
  CDS (114)..(1175)

SEQ ID NO: 21795 - protein, 353 aa, Vibrio cholerae; identical to SEQ ID NO: 1552

SEQ ID NO: 21796 - DNA, 2184 bp, Candida albicans; identical to SEQ ID NO: 1553
  CDS (461)..(1573)

SEQ ID NO: 21797 - protein, 370 aa, Candida albicans; identical to SEQ ID NO: 1554

SEQ ID NO: 21798 - DNA, 1047 bp, Buchnera aphidicola; identical to SEQ ID NO: 1555
  CDS (1)..(1047)

SEQ ID NO: 21799 - protein, 348 aa, Buchnera aphidicola; identical to SEQ ID NO: 1556

SEQ ID NO: 21800 - DNA, 1047 bp, Buchnera aphidicola; identical to SEQ ID NO: 1557
  CDS (1)..(1047)

SEQ ID NO: 21801 - protein, 348 aa, Buchnera aphidicola; identical to SEQ ID NO: 1558

SEQ ID NO: 21802 - DNA, 1047 bp, Erwinia herbicola; identical to SEQ ID NO: 1559
  CDS (1)..(1047)

SEQ ID NO: 21803 - protein, 348 aa, Erwinia herbicola; identical to SEQ ID NO: 1560

SEQ ID NO: 21804 - DNA, 1047 bp, Salmonella typhimurium; identical to SEQ ID NO: 1561
  CDS (1)..(1047)

SEQ ID NO: 21805 - protein, 348 aa, Salmonella typhimurium; identical to SEQ ID NO: 1562

SEQ ID NO: 21806 - DNA, 23 bp, Artificial sequence
  (1)..(23): primer
atgaacagaactgacgaactccg

SEQ ID NO: 21807 - DNA, 24 bp, Artificial sequence
  (1)..(24): primer
ttagaagcgggtatctaccgcaga

SEQ ID NO: 21808 - protein, 352 aa, Artificial sequence; identical to SEQ ID NO: 19007
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(40): xaa in position 37 to 40 is any amino acid
  Variant (42)..(43): xaa in position 42 to 43 is any amino acid
  Variant (45)..(46): xaa in position 45 to 46 is any amino acid
  Variant (51)..(51): xaa in position 51 is any amino acid
  Variant (54)..(55): xaa in position 54 to 55 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(128): xaa in position 121 to 128 is any amino acid
  Variant (130)..(130): xaa in position 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(167): xaa in position 166 to 167 is any amino acid
  Variant (170)..(170): xaa in position 170 is any amino acid
  Variant (173)..(173): xaa in position 173 is any amino acid
  Variant (175)..(175): xaa in position 175 is any amino acid
  Variant (180)..(180): xaa in position 180 is any amino acid
  Variant (182)..(182): xaa in position 182 is any amino acid
  Variant (184)..(187): xaa in position 184 to 187 is any amino acid
  Variant (189)..(190): xaa in position 189 to 190 is any amino acid
  Variant (192)..(194): xaa in position 192 to 194 is any amino acid
  Variant (196)..(198): xaa in position 196 to 198 is any amino acid
  Variant (200)..(200): xaa in position 200 is any amino acid
  Variant (202)..(207): xaa in position 202 to 207 is any amino acid
  Variant (209)..(214): xaa in position 209 to 214 is any amino acid
  Variant (216)..(216): xaa in position 216 is any amino acid
  Variant (219)..(221): xaa in position 219 to 221 is any amino acid
  Variant (223)..(224): xaa in position 223 to 224 is any amino acid
  Variant (229)..(237): xaa in position 229 to 237 is any amino acid
  Variant (240)..(268): xaa in position 240 to 268 is any amino acid
  Variant (270)..(270): xaa in position 270 is any amino acid
  Variant (273)..(273): xaa in position 273 is any amino acid
  Variant (276)..(276): xaa in position 276 is any amino acid
  Variant (278)..(281): xaa in position 278 to 281 is any amino acid
  Variant (283)..(284): xaa in position 283 to 284 is any amino acid
  Variant (286)..(291): xaa in position 286 to 291 is any amino acid
  Variant (293)..(295): xaa in position 293 to 295 is any amino acid
  Variant (297)..(304): xaa in position 297 to 304 is any amino acid
  Variant (306)..(306): xaa in position 306 is any amino acid
  Variant (308)..(308): xaa in position 308 is any amino acid
  Variant (311)..(314): xaa in position 311 to 314 is any amino acid
  Variant (316)..(316): xaa in position 316 is any amino acid
  Variant (318)..(333): xaa in position 318 to 333 is any amino acid
  Variant (336)..(336): xaa in position 336 is any amino acid
  Variant (338)..(338): xaa in position 338 is any amino acid
  Variant (341)..(341): xaa in position 341 is any amino acid
  Variant (343)..(344): xaa in position 343 to 344 is any amino acid
  Variant (346)..(347): xaa in position 346 to 347 is any amino acid
  Variant (349)..(351): xaa in position 349 to 351 is any amino acid

SEQ ID NO: 21809 - protein, 24 aa, Artificial sequence
  Variant (2)..(2): xaa in position 2 is any amino acid
  Variant (3)..(3): xaa in position 3 is Leu, Val, Phe, Ile, Ala or Met
  Variant (4)..(4): xaa in position 4 is Val, Ile, Leu or Ala
  Variant (5)..(5): xaa in position 5 is Val or Ile
  Variant (6)..(6): xaa in position 6 is Val, Ile, Cys or Thr
  Variant (11)..(11): xaa in position 11 is Ile, Val, Ser or Leu
  Variant (12)..(12): xaa in position 12 is His or Asp
  Variant (13)..(13): xaa in position 13 is Asp or Asn
  Variant (14)..(15): xaa in position 14 to 15 is any amino acid
  Variant (16)..(16): xaa in position 16 is Ala, Ser, Gln or Thr
  Variant (17)..(17): xaa in position 17 is Ala, Val or Gly
  Variant (18)..(18): xaa in position 18 is any amino acid
  Variant (19)..(19): xaa in position 19 is Glu, Asp, Ala or Gln
  Variant (21)..(21): xaa in position 21 is Ala, Gly, Cys or Ser
  Variant (22)..(22): xaa in position 22 is any amino acid
  Variant (23)..(23): xaa in position 23 is Arg, Lys, Gln, His or Leu
  Variant (24)..(24): xaa in position 24 is Leu, Ile or Phe
RXXXXXGPCSXXXXXXXXXYXXXX

SEQ ID NO: 21810 - protein, 42 aa, Artificial sequence; identical to SEQ ID NO: 2884
  Variant (1)..(1): xaa in position 1 is Leu, Ile, Phe or Met
  Variant (2)..(2): xaa in position 2 is any amino acid
  Variant (3)..(3): xaa in position 3 is Ile, Val, Leu or Met
  Variant (4)..(4): xaa in position 4 is Val, Ile or Leu
  Variant (7)..(7): xaa in position 7 is Val, Ala or Thr
  Variant (9)..(9): xaa in position 9 is Phe, Leu, Thr or Val
  Variant (10)..(10): xaa in position 10 is Glu or Ala
  Variant (15)..(16): xaa in position 15 to 16 is any amino acid
  Variant (17)..(17): xaa in position 17 is any or no amino acid
  Variant (19)..(19): xaa in position 19 is Trp or Tyr
  Variant (20)..(20): xaa in position 20 is Lys or Arg
  Variant (22)..(22): xaa in position 22 is Leu, Phe, Met or Tyr
  Variant (23)..(23): xaa in position 23 is Ile, Val, Ala or Leu
  Variant (24)..(24): xaa in position 24 is any amino acid
  Variant (25)..(25): xaa in position 25 is Asp, Glu or Gln
  Variant (27)..(27): xaa in position 27 is any amino acid
  Variant (28)..(28): xaa in position 28 is Leu, Met, Ile, Val, Ala or Thr
  Variant (29)..(29): xaa in position 29 is Asp, Asn or Ser
  Variant (30)..(33): xaa in position 30 to 33 is any amino acid
  Variant (34)..(34): xaa in position 34 is Ile, Val, Leu or Met
  Variant (35)..(36): xaa in position 35 to 36 is any amino acid
  Variant (38)..(38): xaa in position 38 is Leu, Ile, Met or Val
  Variant (39)..(40): xaa in position 39 to 40 is any amino acid
  Variant (41)..(41): xaa in position 41 is Ala, Ser, Gly, Val or Thr

SEQ ID NO: 21811 - protein, 65 aa, Artificial sequence; identical to SEQ ID NO: 2885
  Variant (2)..(2): xaa in position 2 is any amino acid
  Variant (4)..(4): xaa in position 4 is Asp, Tyr, Gln, Asn or Glu
  Variant (5)..(9): xaa in position 5 to 9 is any amino acid
  Variant (10)..(10): xaa in position 10 is Tyr, Phe or Leu
  Variant (11)..(12): xaa in position 11 to 12 is any amino acid
  Variant (13)..(13): xaa in position 13 is Asp or Glu
  Variant (14)..(15): xaa in position 14 to 15 is any amino acid
  Variant (16)..(16): xaa in position 16 is Ser, Ala, Thr or Cys
  Variant (17)..(17): xaa in position 17 is Trp, Phe, Tyr, Leu or Val
  Variant (18)..(18): xaa in position 18 is any amino acid
  Variant (19)..(19): xaa in position 19 is Ala or Ser
  Variant (20)..(20): xaa in position 20 is Ile or Val
  Variant (24)..(24): xaa in position 24 is Thr, Ser or Asn
  Variant (25)..(25): xaa in position 25 is Thr, Val, Ala, Ser or Ile
  Variant (26)..(26): xaa in position 26 is Glu or Ala
  Variant (27)..(27): xaa in position 27 is Ser, Asp or Asn
  Variant (29)..(29): xaa in position 29 is any amino acid
  Variant (32)..(32): xaa in position 32 is Glu, Gln, Phe or Met
  Variant (33)..(33): xaa in position 33 is Leu, Met, Val, Ile or Phe
  Variant (34)..(34): xaa in position 34 is Ala, Ser, Thr, Cys or Val
  Variant (36)..(36): xaa in position 36 is Gly, Ala or Asn
  Variant (37)..(39): xaa in position 37 to 39 is any amino acid
  Variant (40)..(40): xaa in position 40 is Pro or Ala
  Variant (41)..(41): xaa in position 41 is Val, Ile, Thr or Leu
  Variant (43)..(43): xaa in position 43 is Phe, Met, Tyr or Ile
  Variant (46)..(46): xaa in position 46 is any amino acid
  Variant (47)..(47): xaa in position 47 is Thr, Ser or Arg
  Variant (48)..(48): xaa in position 48 is any amino acid
  Variant (50)..(53): xaa in position 50 to 53 is any amino acid
  Variant (54)..(54): xaa in position 54 is Ala or Met
  Variant (55)..(55): xaa in position 55 is any amino acid
  Variant (56)..(56): xaa in position 56 is Asp, Asn or Glu
  Variant (57)..(57): xaa in position 57 is Ala or Gly
  Variant (58)..(59): xaa in position 58 to 59 is any amino acid
  Variant (60)..(60): xaa in position 60 is Ala or Ser
  Variant (61)..(61): xaa in position 61 is Ala, Ser, Val or Thr
  Variant (62)..(64): xaa in position 62 to 64 is any amino acid
  Variant (65)..(65): xaa in position 65 is His or Gln

SEQ ID NO: 21812 - protein, 71 aa, Artificial sequence; identical to SEQ ID NO: 2886
  Variant (1)..(1): xaa in position 1 is Thr or Ser
  Variant (2)..(2): xaa in position 2 is any amino acid
  Variant (5)..(7): xaa in position 5 to 7 is any amino acid
  Variant (8)..(8): xaa in position 8 is His or Phe
  Variant (9)..(9): xaa in position 9 is Val, Ile, Leu or Ala
  Variant (10)..(10): xaa in position 10 is Ile or Val
  Variant (11)..(11): xaa in position 11 is Leu or Met
  Variant (14)..(14): xaa in position 14 is Gly, Ser or Ala
  Variant (15)..(16): xaa in position 15 to 16 is any amino acid
  Variant (17)..(22): xaa in position 17 to 22 is any or no amino acid
  Variant (23)..(23): xaa in position 23 is Pro, Thr or Ser
  Variant (25)..(25): xaa in position 25 is Tyr, Phe or His
  Variant (26)..(29): xaa in position 26 to 29 is any amino acid
  Variant (30)..(30): xaa in position 30 is Val, Ile or Leu
  Variant (31)..(36): xaa in position 31 to 36 is any amino acid
  Variant (37)..(37): xaa in position 37 is Leu, Met, Ile, Tyr or His
  Variant (38)..(40): xaa in position 38 to 40 is any amino acid
  Variant (41)..(51): xaa in position 41 to 51 is any or no amino acid
  Variant (52)..(52): xaa in position 52 is Leu, Ile or Val
  Variant (53)..(53): xaa in position 53 is Met, Val, Ile or Leu
  Variant (54)..(54): xaa in position 54 is Ile or Val
  Variant (56)..(56): xaa in position 56 is Cys, Phe, Ala, Thr, Tyr or Val
  Variant (57)..(57): xaa in position 57 is Ser, Asn or Ala
  Variant (59)..(59): xaa in position 59 is Gly, Ala or Asp
  Variant (61)..(61): xaa in position 61 is Ser or Cys
  Variant (62)..(62): xaa in position 62 is any amino acid
  Variant (64)..(66): xaa in position 64 to 66 is any amino acid
  Variant (67)..(67): xaa in position 67 is Arg, Asn, Lys, Leu or Glu
  Variant (69)..(70): xaa in position 69 to 70 is any amino acid
  Variant (71)..(71): xaa in position 71 is Val or Ile

SEQ ID NO: 21813 - protein, 41 aa, Artificial sequence; identical to SEQ ID NO: 2887
  Variant (2)..(2): xaa in position 2 is any amino acid
  Variant (4)..(4): xaa in position 4 is Ile, Leu, Val, Ala or Met
  Variant (7)..(7): xaa in position 7 is His, Asn, Phe or Tyr
  Variant (8)..(8): xaa in position 8 is Leu or Ile
  Variant (9)..(10): xaa in position 9 to 10 is any amino acid
  Variant (12)..(12): xaa in position 12 is any amino acid
  Variant (14)..(19): xaa in position 14 to 19 is any amino acid
  Variant (20)..(30): xaa in position 20 to 30 is any or no amino acid
  Variant (32)..(32): xaa in position 32 is any amino acid
  Variant (34)..(34): xaa in position 34 is Ile or Val
  Variant (37)..(37): xaa in position 37 is Ala, Pro, Gly, Lys, Ser or Glu
  Variant (39)..(39): xaa in position 39 is Ile, Leu or Val
  Variant (40)..(40): xaa in position 40 is any amino acid
  Variant (41)..(41): xaa in position 41 is Trp, Ile, Leu or Phe

SEQ ID NO: 21814 - DNA, 1122 bp, Escherichia coli K12
  CDS (1)..(1122)
atggttgctgaattgaccgcattacgcgatcaaattgatgaagtcgataaagcgctgctgaatttattagcgaagcgtctggaactggttgctgaagtgggcgaggtgaaaagccgctttggactgcctatttatgttccggagcgcgaggcatctatgttggcctcgcgtcgtgcagaggcggaagctctgggtgtaccgccagatctgattgaggatgttttgcgtcgggtgatgcgtgaatcttactccagtgaaaacgacaaaggatttaaaacactttgtccgtcactgcgtccggtggttatcgtcggcggtggcggtcagatgggacgcctgttcgagaagatgctgaccctctcgggttatcaggtgcggattctggagcaacatgactgggatcgagcggctgatattgttgccgatgccggaatggtgattgttagtgtgccaatccacgttactgagcaagttattggcaaattaccgcctttaccgaaagattgtattctggtcgatctggcatcagtgaaaaatgggccattacaggccatgctggtggcgcatgatggtccggtgctggggctacacccgatgttcggtccggacagcggtagcctggcaaagcaagttgtggtctggtgtgatggacgtaaaccggaagcataccaatggtttctggagcaaattcaggtctggggcgctcggctgcatcgtattagcgccgtcgagcacgatcagaatatggcgtttattcaggcactgcgccactttgctacttttgcttacgggctgcacctggcagaagaaaatgttcagcttgagcaacttctggcgctctcttcgccgatttaccgccttgagctggcgatggtcgggcgactgtttgctcaggatccgcagctttatgccgacatcattatgtcgtcagagcgtaatctggcgttaatcaaacgttactataagcgtttcggcgaggcgattgagttgctggagcagggcgataagcaggcgtttattgacagtttccgcaaggtggagcactggttcggcgattacgcacagcgttttcagagtgaaagccgcgtgttattgcgtcaggcgaatgacaatcgccagtaa

SEQ ID NO: 21815 - protein, 373 aa, Escherichia coli K12
MVAELTALRDQIDEVDKALLNLLAKRLELVAEVGEVKSRFGLPIYVPEREASMLASRRAEAEALGVPPDLIEDVLRRVMRESYSSENDKGFKTLCPSLRPVVIVGGGGQMGRLFEKMLTLSGYQVRILEQHDWDRAADIVADAGMVIVSVPIHVTEQVIGKLPPLPKDCILVDLASVKNGPLQAMLVAHDGPVLGLHPMFGPDSGSLAKQVVVWCDGRKPEAYQWFLEQIQVWGARLHRISAVEHDQNMAFIQALRHFATFAYGLHLAEENVQLEQLLALSSPIYRLELAMVGRLFAQDPQLYADIIMSSERNLALIKRYYKRFGEAIELLEQGDKQAFIDSFRKVEHWFGDYAQRFQSESRVLLRQANDNRQ

SEQ ID NO: 21816 - DNA, 1122 bp, Yersinia pestis
  CDS (1)..(1122)
atggtggctgaactgactgctttacgcgatcaaattgatgaagtcgataaagcgttgttggatttgctggctaaacgcctgcatttggtggctgaagtcggtgaagtaaaaagccgttatggcttgccgatatatgttccggatcgtgaggcggcaatgctggcctcacgccggcaagaagccggggcactaggtgttccgccggatttaattgaagatgtgctgcgtcgggtgatgcgggaatcttataccagcgaaaatgataaaggcttcaagacattatgcccggaactgcgtccagtggttatcatcggtggtcaagggcagatgggtcggttatttagccggatgcttaatctgtctggttatcaggtgagaacactggagcaagaagattggtcacaagctgaatctattctggctgatgccgggatggtgattgtgagtgtccccattcatatcactgaagaggtgattaatcggctacccaaattaccagcagattgtattttgctggatttggcctcggtaaaaaataaacccctgcaagctatgctggcagcccatgaagggccagttttggggttgcatccaatgtttggccctgatgtcggcagcttggcgaagcaagtcgtggtgtattgtgatggacgcgatccacaggcgtatcagtggttactggagcagctacaggtctggggagcaagattgcaccgtatcagcgcggtcgaacatgatcaaaacatggcgttcattcaggctctgaggcattttgcgacttttgcgtacggattgcatctggcggaagaaaatgtgcaattggaacaattgctggcactgtcttcaccaatttatcgcctggagctggcaatggttgggcggctatttgcacaagatccacagctttacgctgatatcattatgtcgtcggaagataatctggcgctgattaaacgttactacaaacgctttggtgaggcgctcaccttgttagagcaccatgataaacaagcgtttgttcaaagtttcgagaaagtagaacactggtttggtgattacgcggaacgtttcttggtagagagccgttcattactgcgtcaggcgaacgataatcgtcagtag

SEQ ID NO: 21817 - protein, 373 aa, Yersinia pestis
MVAELTALRDQIDEVDKALLDLLAKRLHLVAEVGEVKSRYGLPIYVPDREAAMLASRRQEAGALGVPPDLIEDVLRRVMRESYTSENDKGFKTLCPELRPVVIIGGQGQMGRLFSRMLNLSGYQVRTLEQEDWSQAESILADAGMVIVSVPIHITEEVINRLPKLPADCILLDLASVKNKPLQAMLAAHEGPVLGLHPMFGPDVGSLAKQVVVYCDGRDPQAYQWLLEQLQVWGARLHRISAVEHDQNMAFIQALRHFATFAYGLHLAEENVQLEQLLALSSPIYRLELAMVGRLFAQDPQLYADIIMSSEDNLALIKRYYKRFGEALTLLEHHDKQAFVQSFEKVEHWFGDYAERFLVESRSLLRQANDNRQ

SEQ ID NO: 21818 - DNA, 1122 bp, Salmonella enterica subsp. enterica serovar Typhi
  CDS (1)..(1122)
atggttgctgaattgaccgcgttacgcgatcaaatagatgatgtcgataaagcgttgttgaatttactggctaagcgcctggaactggttgccaaagtcggcgaggtgaaaagccgttttggcctgcctatttacgtgccggagcgtgaggcctctatgctggcttcacgacgggcggaagcagaagcgatcggtgtcccgcccgatctcattgaagatgtcctgcgccgggtaatgcgtgaatcttactccagcgaaaatgataaggggttcaaaacgctttgtccttctctgcgtccggtcgtcattgtgggcggcggcggacagatggggcgtctgtttgaaaaaatgctcacgctgtcgggctatcaggtccgtattctggaacaacaggactggccgcgcgccagggacattgtcgccgatgccggaatggtgatcgtcagcgtgccgattcatgttactgaacaggtcatagcgcaactgccgcccctgccgtccgactgtattctggtcgatctggcatcggtgaaaagcggtccgttacaggcaatgttggcggcccatgatggccccgtgctgggcttgcacccgatgtttggcccggacagcgggagcctggcgaagcaggtggtggtctggtgtgatgggcgtcaaccggaagcgtatcagtggttccttgagcaaatccaggtgtggggcgcgcggttgcaccgaattagcgctgtcgagcacgatcagaacatggcttttatccaggcgctgcgccactttgctaccttcgcttatgggctgcatctggcggaagagaacgtccagcttgagcagcttctggcgctatcatcgccgatttatcgactggagctggcgatggtcgggcgtctgttcgcccaggacccgcagctgtatgcagacattattatgtcgtcggagcgcaatctggcgcttatcaagcgttactataaacgttttggcgatgcgatcgggttactggaacagggtgataagcaggcttttatcgacagttttcgcaaagttgaacactggtttggcgattatgccagacgcttccagaatgaaagccgtgtgttattacgtcaggcgaatgacagccgaccataa

SEQ ID NO: 21819 - protein, 373 aa, Salmonella enterica subsp. enterica serovar Typhi
MVAELTALRDQIDDVDKALLNLLAKRLELVAKVGEVKSRFGLPIYVPEREASMLASRRAEAEAIGVPPDLIEDVLRRVMRESYSSENDKGFKTLCPSLRPVVIVGGGGQMGRLFEKMLTLSGYQVRILEQQDWPRARDIVADAGMVIVSVPIHVTEQVIAQLPPLPSDCILVDLASVKSGPLQAMLAAHDGPVLGLHPMFGPDSGSLAKQVVVWCDGRQPEAYQWFLEQIQVWGARLHRISAVEHDQNMAFIQALRHFATFAYGLHLAEENVQLEQLLALSSPIYRLELAMVGRLFAQDPQLYADIIMSSERNLALIKRYYKRFGDAIGLLEQGDKQAFIDSFRKVEHWFGDYARRFQNESRVLLRQANDSRP

SEQ ID NO: 21820 - DNA, 1128 bp, Vibrio cholerae
  CDS (1)..(1128)
atggccgtagagttgaatcagttacgcgaccaaatcgatgaagtcgataagcagatggtggagctactggcgcgccgtctggcattggtggagcaggtcgggcaagtgaaaagtcgatatgggttaccgatttatgctcccgatcgtgaagcggcaatgctcgcttcacgtcgagcggaagcggaaagcaaaggtgttccgccccaactgattgaagatattttgcgccgaaccatgcgtgaatcctacgccagtgaaaaggactccggctttaaatgccttaatcctgagttacgttccgtggtgatcgtcggtggtaacggtcagcttgggcgactatttggccgtatgtttaaactctctggctatcaagtcaaagtgctgggcagccaagattgggacaaagcggatgaactgctcagtgatgctggcttagtggtggtcacggtacctatccatttgacgctcggtgttatcgaaaagctgcgccagttaccggacgattgcattttgtgcgatctcacctcaatcaaagccaagccgcttgccgccatgctacaagtgcacaaaggtccagtggttgggctgcaccctatgtttggtccagacgttccaagcttggcgaagcaggtgattgtttactgtgatggtcgaggcaatgaacactaccaatggctcttgcaacagtttgctatttggggcgcaagcttgtgccagattgatgcggatgaacatgatcgtggtatgacacttattcaagcactgcgccacttcacttcctttgcttatggcttgcatctgaccaaagagaacccgaacttggcacaactgctgaaactcagttcaccgatttaccgtttagagcttgccatggtcggacggctatttgggcaagatccccatctgtacggcgatattattctctcatcaccagaaaatattgagatgatccagcgttttcatcgctgcttaagcgatgcggttgagttggtgagcgcgggcgataaggcgagttttgtggctcaatttgaacgagttagccagtggtttggtgattattcacagcagtttatgcatgagagccaaaacttgctcaaacaagcgaatgatgcgatccacagaggttaa

SEQ ID NO: 21821 - protein, 375 aa, Vibrio cholerae
MAVELNQLRDQIDEVDKQMVELLARRLALVEQVGQVKSRYGLPIYAPDREAAMLASRRAEAESKGVPPQLIEDILRRTMRESYASEKDSGFKCLNPELRSVVIVGGNGQLGRLFGRMFKLSGYQVKVLGSQDWDKADELLSDAGLVVVTVPIHLTLGVIEKLRQLPDDCILCDLTSIKAKPLAAMLQVHKGPVVGLHPMFGPDVPSLAKQVIVYCDGRGNEHYQWLLQQFAIWGASLCQIDADEHDRGMTLIQALRHFTSFAYGLHLTKENPNLAQLLKLSSPIYRLELAMVGRLFGQDPHLYGDIILSSPENIEMIQRFHRCLSDAVELVSAGDKASFVAQFERVSQWFGDYSQQFMHESQNLLKQANDAIHRG

SEQ ID NO: 21822 - DNA, 1134 bp, Haemophilus influenzae
  CDS (1)..(1134)
atgagttttatggaagcccttaaagatttacgttctgaaattgattcgcttgatcgcgaacttatccaactttttgctaaacgtcttgagttggtttctcaagtcggtaaagtgaaacatcaacatggattacctatttatgcgccagaacgtgaaatagcaatgctccaagcacgtcgtttagaagctgaaaaagcaggcatttcagccgatttaattgaagatgttctacgccgttttatgcgtgaatcctatgccaatgaaaaccaatttggttttaaaactatcaattctgatattcacaaaattgttattgtgggcggttatggtaaattaggcggcttatttgcccgttatttacgtgcatctggctatccaatttctattttagatcgcgaagattgggcggtggctgaaagtattttagcgaatgctgatgtcgtgatcgtttccgtccctattaatctcaccttagaaacaattgaacgcttaaaaccttatttaacggaaaacatgctacttgcagatttaacctctgttaagcgtgaaccgctagcgaaaatgcttgaagttcatactggtgctgttttaggtttacatccaatgtttggtgcagatattgcaagtatggcaaaacaagtggttgtgcgttgtgatggacgttttcctgaacgttatgaatggttacttgagcaaattcaaatttggggtgcaaaaatttatcaaaccaatgccacagaacacgatcataatatgacttatatacaagccttgcgccatttttcgacttttgcgaatggtttacacctttccaaacagcccattaatctcgctaatttattggcactttcttcccctatttatcggttagaacttgcgatgataggtcgtttatttgcgcaagatgcagagctttacgcagatattattatggataagtcagaaaatttagcggtaattgaaacgctaaaacaaacttacgacgaagccttaactttctttgaaaataatgatcgtcaaggttttattgatgctttccacaaggtgcgtgactggtttggcgattattccgaacaatttttaaaagaaagccgtcagctattgcaacaggcaaatgatttgaaacaagggtag

SEQ ID NO: 21823 - protein, 377 aa, Haemophilus influenzae
MSFMEALKDLRSEIDSLDRELIQLFAKRLELVSQVGKVKHQHGLPIYAPEREIAMLQARRLEAEKAGISADLIEDVLRRFMRESYANENQFGFKTINSDIHKIVIVGGYGKLGGLFARYLRASGYPISILDREDWAVAESILANADVVIVSVPINLTLETIERLKPYLTENMLLADLTSVKREPLAKMLEVHTGAVLGLHPMFGADIASMAKQVVVRCDGRFPERYEWLLEQIQIWGAKIYQTNATEHDHNMTYIQALRHFSTFANGLHLSKQPINLANLLALSSPIYRLELAMIGRLFAQDAELYADIIMDKSENLAVIETLKQTYDEALTFFENNDRQGFIDAFHKVRDWFGDYSEQFLKESRQLLQQANDLKQG

SEQ ID NO: 21824 - DNA, 1122 bp, Erwinia herbicola
  CDS (1)..(1122)
atggtggctgaactgaccgcgttacgcgatcaaattgacagtgtagataaagcgctgctggatctgctggctaagcgactggaactggtggccgaggtaggtgaggtgaagagccgttacggcctgcctatctatgtgcctgagcgtgaggcgtcgatgctggcttcgcgtcgcaaagaggccgaagcgctcggcgtaccaccggatctgattgaggatgtgctgcgtcgcgtgatgcgggaatcctataccagcgagaatgataaaggctttaaaaccctctgtcctgaactgcgcccggtggtgattgtcggtggtaagggccagatgggccggctgtttgaaaaaatgctcgggctatcaggctacacggttaaaacgctggataaagaggactggcctcaggctgagactctgctcagcgatgccggaatggtgatcattagcgtgccgattcacctgaccgagcaggtgattgcccaactgccaccactgccggaagattgtattctggtcgatctggcgtcagtcaaaaaccggcctctgcaggcaatgctggctgcccataacgggcctgtactgggtctgcatccgatgtttggcccggacagcggcagcctggcaaaacaggtggtggtctggtgtgatggaagacaaccggaagcgtatcagtggttcctggagcagattcaggtctggggtgcgcgtctgcatcgtatcagcgctgttgagcatgaccagaacatggcattcattcaggcgctgcgtcactttgctaccttcgcttatggtctgcatttagccgaagagaacgtcaatctggatcagctgctggcgctctcgtcgcccatttaccggcttgaactggcgatggtggggcggttgttcgctcaggatccgcaactctatgcggatatcatcatgtcttcagagagtaatctggcgctgataaaacgctattaccagcggtttggtgaagcgattgcgctgctggagcagggcgacaagcaggcgtttatcgccagctttaaccgggttgaacagtggtttggcgatcacgcaaaacgcttcctggtcgaaagccgaagcctgttgcgatcggccaatgacagccgcccataa

SEQ ID NO: 21825 - protein, 373 aa, Erwinia herbicola
MVAELTALRDQIDSVDKALLDLLAKRLELVAEVGEVKSRYGLPIYVPEREASMLASRRKEAEALGVPPDLIEDVLRRVMRESYTSENDKGFKTLCPELRPVVIVGGKGQMGRLFEKMLGLSGYTVKTLDKEDWPQAETLLSDAGMVIISVPIHLTEQVIAQLPPLPEDCILVDLASVKNRPLQAMLAAHNGPVLGLHPMFGPDSGSLAKQVVVWCDGRQPEAYQWFLEQIQVWGARLHRISAVEHDQNMAFIQALRHFATFAYGLHLAEENVNLDQLLALSSPIYRLELAMVGRLFAQDPQLYADIIMSSESNLALIKRYYQRFGEAIALLEQGDKQAFIASFNRVEQWFGDHAKRFLVESRSLLRSANDSRP

SEQ ID NO: 21826 - DNA, 1131 bp, Mannheimia succiniciproducens MBEL55E
  CDS (1)..(1131)
atggaagcactcaaagaaatcagagccgaaatcgatcaattggatcgagagttgttagaagtttttgccaaacgtttagcgttagtcaaaaaggtcggagaaattaaacatcaacaaggtttgccgatttatgtaccggaacgcgaagcagatatgctggcggctcggcgttcagaagcggaaaaaatgggcatacctgcggatttaattgaagatgtgttacgtcgtgttatgcgggagtcttacgctaacgaacatgaacacggttttaaaaccgttaatccggcgattaaaaaaattgttattgtaggcggtaaaggcaaattaggcggcttattcgggcgttttctgacggcttcaggctactttgtggaagcgttgggaagcaaagattgggacaacgcaaaggctattttggccggtgcaaatgcggtaatcgtttgtgtgcctatcgtaaaaaccttggaaaccattgaacgcttaaaaccttatttaacggaagatatgttattgacggatctaacctccgtaaaacgccgcccgttggaaaaaatgctggaaattcatcaaggcgcggtcgtaggcttgcatccgatgtttgggcccgatatcgcaagcatggcaaaacaggtggttgtacgttgcgacgggcgttatccggagcgttatcaatggctgttggaacaaattcaaatgtggggcgcgcgaatttatcaggcggatgccgccgagcatgaccacagcatgacctatattcaagcattacgtcattttgccacctttgccaacggtttacatctttcaagacaaccggtgaaattagctaatttattagccttatcttcaccgatttatcgtctggaacttgcgatgatcgggcgtttgtttgcgcaagacggtagtttatatgccgatattattatggataagccggaaaacctggaagtaatcgaaagtttaaaacaaagctatgaagacagcttaaaattctttgaaaacggtgatagagaaggctttattaaaacctttaacaaagtgagagaatggttcggcgattattcggaacaatttatgaaagaaagccgtcaactgctgcaacaagctaacgattatcgtcataatagtctctga

SEQ ID NO: 21827 - protein, 376 aa, Mannheimia succiniciproducens MBEL55E
MEALKEIRAEIDQLDRELLEVFAKRLALVKKVGEIKHQQGLPIYVPEREADMLAARRSEAEKMGIPADLIEDVLRRVMRESYANEHEHGFKTVNPAIKKIVIVGGKGKLGGLFGRFLTASGYFVEALGSKDWDNAKAILAGANAVIVCVPIVKTLETIERLKPYLTEDMLLTDLTSVKRRPLEKMLEIHQGAVVGLHPMFGPDIASMAKQVVVRCDGRYPERYQWLLEQIQMWGARIYQADAAEHDHSMTYIQALRHFATFANGLHLSRQPVKLANLLALSSPIYRLELAMIGRLFAQDGSLYADIIMDKPENLEVIESLKQSYEDSLKFFENGDREGFIKTFNKVREWFGDYSEQFMKESRQLLQQANDYRHNSL

SEQ ID NO: 21828 - DNA, 1122 bp, Erwinia carotovora
  CDS (1)..(1122)
atggtagctgaactgaccgcattacgtgatcagatagatgaggtagataaggagcttgtcgcgctcttatcacgtcggttgcgtttggtggcggaagtgggtgaagtgaaaagccgctatggtttgcccatttatgcgcccgatcgtgaagcggccatgctcagctcacgtcgtaacgaggcggcgtcgatgggggttccaccggatcttattgaagatatcctgcggcgcaccatgcgcgaatcctattccagcgaaaacgacaaaggttttaaaacgctgtgtccacaattgcgtccggtcgtcatcattggtggccgtggtcaaatgggcaatttgtttgagaagatgctgacgctatcgggatatcaggtgaggatcctggagcaagatgactggccgcgcgctgatgagctgttgtctgatgcaggtatggtgattgtcagcgtgccgattcacgttaccgaacaggttattgccagtctgcctatcttgccggatgactgtattctggtcgatctggcatcggtaaaaaatggcccgcttcaggcgatgctggcggcgcataatggtccggtactcggtttgcaccctatgtttgggccagacagcggcagccttgccaaacaggttgtcgtttattgcgatggccgacagccggaggcctatcagtggttactggaacagattcaggtatggggcgcgcgtctgcatcgcattagcgcagttgaacacgatcagaacatgatgttcattcaagcgctgcgccacttcgctacatttgcctatggcctgcatttagcggaagagaatgtgcagcttgaacagctattagcactgtcatcgccaatctatcgattggaattgatcatggttggtaggttgtttgcgcaggatccgcagctttatgccgacattattatgtcttcagaggataatttggcgttgattaagcgttactacaaacgttttggcgaagccattgagttactggagcaaacagataaagcggaatttattagcagcttcaaaaaagttgaacactggttcggcgattatgccaagcgttttcaggcggagagccgagtgcttttacgtcaggcaaacgacattcgccaataa

SEQ ID NO: 21829 - protein, 373 aa, Erwinia carotovora
MVAELTALRDQIDEVDKELVALLSRRLRLVAEVGEVKSRYGLPIYAPDREAAMLSSRRNEAASMGVPPDLIEDILRRTMRESYSSENDKGFKTLCPQLRPVVIIGGRGQMGNLFEKMLTLSGYQVRILEQDDWPRADELLSDAGMVIVSVPIHVTEQVIASLPILPDDCILVDLASVKNGPLQAMLAAHNGPVLGLHPMFGPDSGSLAKQVVVYCDGRQPEAYQWLLEQIQVWGARLHRISAVEHDQNMMFIQALRHFATFAYGLHLAEENVQLEQLLALSSPIYRLELIMVGRLFAQDPQLYADIIMSSEDNLALIKRYYKRFGEAIELLEQTDKAEFISSFKKVEHWFGDYAKRFQAESRVLLRQANDIRQ

SEQ ID NO: 21830 - DNA, 1128 bp, Photobacterium profundum
  CDS (1)..(1128)
atggttgctgaactgagcaaattaagagatcaaatcgatgatgttgatcagcaaatggtagagcttttagctcgccgtttatcattagtagaagaagtgggtcatgttaaaagcctgcatggtttacctatttatgcgccagaccgtgaagccgcaatgttagcctcacgccgtcatgaagctgagcaaaaaggtgtgccgcctgatctgattgaagacattttgcgccgtaccatgcgtgaatcttattcgagtgaaaatgattcagggtttaaatgcttaaagcctgaacttcgccctattgttgttgtgggtgggcatggtcagctaggtggattgttctgtcgtttatttgaactttcaggttaccaagtacgtcaactaggcagccaagattgggatcgtgcggatgagatccttgcagatgcgggtatggttgtcgtctctgtaccgattaacatcactgagcaaatcattggtaaactttccaacttaccagatgactgtattcttgctgatttaacctcgatcaagagtggcccattacaggcaatgctagaagtgcataatggccccgtgattggtttacatccaatgtttggtcccgatatttctagcttggcgaagcaagtgattgtgtattgcgatgggcgaaaccctgaaaattaccaatggttacttgagcaatttcagatttggggggcaacgctaaatcgtattagtgcgattgaacatgatcaaggtatgacgctgatccaagctttacgccactttacgtcatttgtttatggtgtgcatttggcagaggaagatccgaagatcgagcaactcatgtcgttaagttcaccgatttatcgcttagaacttgcaatggtcggtcgcttgtttgctcaagatgcacaattgtatgccgacattattatgtctgcgccgcaaaacgttgcgatgattaaacgcttccaccaacgttttggtgaggctatcaagatgcttgagacgcaagataaagaggcgttcaaacaagcatttaatcaggtcgagcattggttcggtgattatgcgggacacttccttgctgaaagccaaggtttgttaaggcaagcgaacgattcaacccaccgttcgtaa

SEQ ID NO: 21831 - protein, 375 aa, Photobacterium profundum
MVAELSKLRDQIDDVDQQMVELLARRLSLVEEVGHVKSLHGLPIYAPDREAAMLASRRHEAEQKGVPPDLIEDILRRTMRESYSSENDSGFKCLKPELRPIVVVGGHGQLGGLFCRLFELSGYQVRQLGSQDWDRADEILADAGMVVVSVPINITEQIIGKLSNLPDDCILADLTSIKSGPLQAMLEVHNGPVIGLHPMFGPDISSLAKQVIVYCDGRNPENYQWLLEQFQIWGATLNRISAIEHDQGMTLIQALRHFTSFVYGVHLAEEDPKIEQLMSLSSPIYRLELAMVGRLFAQDAQLYADIIMSAPQNVAMIKRFHQRFGEAIKMLETQDKEAFKQAFNQVEHWFGDYAGHFLAESQGLLRQANDSTHRS

SEQ ID NO: 21832 - DNA, 1128 bp, Vibrio vulnificus
  CDS (1)..(1128)
atggcagttgaactgaacgcattgcgtgaacagattgatgcagtagacaaacagatgttggcgctattggctcagcgcttggcattggtagagcaagttggccatgtgaaaagccaacatggcttaccgatttatgcacccgatagagaagcggcgatgctggcctctcgtcgtgcagaagccgaaaaaatcggcgtacctccacagctcattgaggacattttgcgccgaaccatgcgtgaatcttatgccagtgagaaagattctgggtttaaatgtctcaatccggacttgcgttctgtggtgatcattggtggtcatggccagttgggtggtctgtttgctcgcatgtttaccctctcgggttaccaggtcaaaatcttaggcagtaaggattggcaccgcgctgatgagatattggatggggcaggattggtggtggttaccgtgccgattcatttaacccaaggggtgattgaaaagctgacccaactgccatcggattgcattttgtgtgacctcacttcgatcaagtcgaagccgctgaaaaccatgctcgatgtgcactctgggccggttgttggtttgcaccctatgtttggtcccgatgtgccgagtttagccaagcaagtgattgtctactgtgatggtcgaggtgctgagcaatatcagtggttactgcagcagtttaagatttggggggcaagcttgtgccaaattgaggccagcgaacacgaccacggcatgacgttaattcaagcattaaggcactttacttcctttgcctatggcatgcatttgagtcaggaaaatccaagtctcgataaactgctgaaactgagctcgcccatttaccgtcttgagttagcgatggtagggcgtctgtttgcccaagacccaaacttgtatggcgacattattctttcgtcgcaagagaacatcgacatgatcaagcgtttccatcgccgctttggcgaggcactagagatgttagatcagcacgataaagcgcgttttgttgaacgtttcacgcaagtgagtgattggtttggggggtattcgcagcagtttatggcggaaagccaaaacttactcaaacaagcgaatgacaacttgcatcgtgattaa

SEQ ID NO: 21833 - protein, 375 aa, Vibrio vulnificus
MAVELNALREQIDAVDKQMLALLAQRLALVEQVGHVKSQHGLPIYAPDREAAMLASRRAEAEKIGVPPQLIEDILRRTMRESYASEKDSGFKCLNPDLRSVVIIGGHGQLGGLFARMFTLSGYQVKILGSKDWHRADEILDGAGLVVVTVPIHLTQGVIEKLTQLPSDCILCDLTSIKSKPLKTMLDVHSGPVVGLHPMFGPDVPSLAKQVIVYCDGRGAEQYQWLLQQFKIWGASLCQIEASEHDHGMTLIQALRHFTSFAYGMHLSQENPSLDKLLKLSSPIYRLELAMVGRLFAQDPNLYGDIILSSQENIDMIKRFHRRFGEALEMLDQHDKARFVERFTQVSDWFGGYSQQFMAESQNLLKQANDNLHRD

SEQ ID NO: 21834 - DNA, 1122 bp, Photorhabdus luminescens
  CDS (1)..(1122)
atggcggctgaattatctcaattgcgggataagattgatgaagtggataaagctttgctgggcttgctggcaaagcgtctggaattggttgcagagattggtgaggtaaaaagtcagaatgggctgtcaatttatgcacctgacagagaaatggcgatgcttgcttcacgtcggcaggaggccgaagagtttggtgttccaccggatttaattgaggatattctgcgccgcattatgcgggagtcttataccagtgagaataacaaagggtttaaaacgctttgccctcaattggggccgatagtcattgttggtggcttgggcaaaatggggaaactatttggccgtttgttaactttgtctggttatgaagtcagaaatctggaaccacaagattggcctaacgcggaacaaattctggcgggagtggggatggtgattatcagtgtacctattcatttgacagaagaagttattcgccgtttaccgccattacctgaccattgcattttggtggacttagcgtccgttaaacagcagccattacaggctatgcttgatgtgcataaaggtccagtgttgggattacatcctatgtttgggccggatgtcggtagtttggtaaaacaagttgttgtttactgtgacggacgtcaagaggaagcttatcaatggtttttagaacagttgttaatttggggggcttgcttgcatcaaatgagccctgaacagcatgataaaaacatgagctttattcaggcgttgcgccatttcacgacatttgcttatgggcaacatctcgcacaggaaggggcggatttacaacaactgttatcaatatcttcacctatttaccgtttggaattgatcatggtcgggcgcttatttgcgcaagatccccagctctacgcggatattattatgtcatcaccagagaatattgatcttatacgccgttatcatcaaagttttggacaagcgttagagatattggaaagccaggacaaacgggcttttgtcagcagttttgaagatgttagtgaatggtttggtgattatgcacctcgttttatgagggaaagcagggtattgcttcaacaagcgaatgatagtcgccaataa

SEQ ID NO: 21835 - protein, 373 aa, Photorhabdus luminescens
MAAELSQLRDKIDEVDKALLGLLAKRLELVAEIGEVKSQNGLSIYAPDREMAMLASRRQEAEEFGVPPDLIEDILRRIMRESYTSENNKGFKTLCPQLGPIVIVGGLGKMGKLFGRLLTLSGYEVRNLEPQDWPNAEQILAGVGMVIISVPIHLTEEVIRRLPPLPDHCILVDLASVKQQPLQAMLDVHKGPVLGLHPMFGPDVGSLVKQVVVYCDGRQEEAYQWFLEQLLIWGACLHQMSPEQHDKNMSFIQALRHFTTFAYGQHLAQEGADLQQLLSISSPIYRLELIMVGRLFAQDPQLYADIIMSSPENIDLIRRYHQSFGQALEILESQDKRAFVSSFEDVSEWFGDYAPRFMRESRVLLQQANDSRQ

SEQ ID NO: 21836 - DNA, 1134 bp, Candidatus Blochmannia floridanus
  CDS (1)..(1134)
atgatggatagattaaattttttacgtagtgaaattgataaaatagatcaaagtttgttaaatttattatctaaaagattatcattagtttctcaggtaggtgaaattaaaagtcaacttggtttatttatttatgatccggaaagagaaaagatgattttatctcaaagaaaacaggaagcattaaaattaggtatttctcctaatttggtcagagatatattacgtcgaattatgcgagagtcttattcttatgaaaatgaaaaaggatttaaaaagttatatccaagttctaggccagtggtgattattgggggtaatggccgaatgggacaatttttctttaaaatgttaactttatcaggatatcaagtaagaattttagatcaagatgattggatacatgctaagtctatattaactaatgttggtgtagtgtttattagtgtacctatttattcggtaatcaaagtaattaatcaattacctcatttatcgaatgattgtattatcgtggatttgtcttctgtaaaaaagagttctttaacagctatattaaagattcatactggaccagttttaggattacatccaatgtttagtccggatactactattaccgctagtatgataaaaaaagttgtaatttgttgtgacggtcgttatcctcaagaatatcaatggttattgcagcagttaaaattatggggagcaaaagtatattattgtaattttattgaacatgataagtatatgagttttatacaaagtttatgtcattttacaatttttgttatgggatatcatttgtttaaagaaaatattgatttaaaaaaaattttatctttttcttccccaatgtttcaattggaattaatattaataggccgattatttacacaaaatcctcaattatatgcagatattattatgtcatctaaaaataatattattgtaattaagcgttattataaaagattaggaaaaatgttaatgttattggaacaaaataataaagaagaatttataaatcaatttaaaaaaattaaatgttggttagatagttatgctggtatttttttaaaagatagctcaaatttattaaaatatattaatgatattcaggaatattaa

SEQ ID NO: 21837 - protein, 377 aa, Candidatus Blochmannia floridanus
MMDRLNFLRSEIDKIDQSLLNLLSKRLSLVSQVGEIKSQLGLFIYDPEREKMILSQRKQEALKLGISPNLVRDILRRIMRESYSYENEKGFKKLYPSSRPVVIIGGNGRMGQFFFKMLTLSGYQVRILDQDDWIHAKSILTNVGVVFISVPIYSVIKVINQLPHLSNDCIIVDLSSVKKSSLTAILKIHTGPVLGLHPMFSPDTTITASMIKKVVICCDGRYPQEYQWLLQQLKLWGAKVYYCNFIEHDKYMSFIQSLCHFTIFVMGYHLFKENIDLKKILSFSSPMFQLELILIGRLFTQNPQLYADIIMSSKNNIIVIKRYYKRLGKMLMLLEQNNKEEFINQFKKIKCWLDSYAGIFLKDSSNLLKYINDIQEY

SEQ ID NO: 21838 - DNA, 1128 bp, Vibrio parahaemolyticus
  CDS (1)..(1128)
atggcagttgaacttaacgcattgcgcgatcagattgatgcagtcgacaaacaaatgcttgagcttttggctcagcgtttagagctggtagaaaaagttggggaagtaaaaagtgaacacggtttgcctatttacgcccctgatcgtgaagcggcgatgctggcgtctcgccgagcagaagctgagaaaatgggtgtcccacctcagcttatcgaagacattcttcgtcgtaccatgcgtgagtcttatgccagtgagaaagattccggttttaagtgtttgaacccagaattacgttcagtggtcattattggtggtaatggccagttaggcggtctgtttggccgcatgttcaagctatcaggttaccaagtgaaagttttgggtagcaaagattggggtcgtgcggatgagattctcaaagacgcaggcttagtggttgtcaccgtaccgattcacctgacggaaggggtgattgaaaaactgggcaacttgccacaagactgcattctgtgtgacctgacgtctatcaagtcaaagccgctgcaagcgatgttgaatgtgcacgctggacctgtggttggtttacacccgatgttcggccctgatgttcctagccttgccaagcaggtgattgtttactgtgatggacgtggtaaagagcaataccaatggttgttgcaacagtttggtatttggggcgcgagcttgtgtcagattgatgcgcaagagcacgatcatggcatgacgttaatccaagcgctgcgccacttcacgtcatttgcttacggaatgcaccttagcaaagagaacccgaatattgagcaactgttgaaactgagctcgccaatctaccgtcttgaattggcaatggtggggcgtctgtttggtcaggatccaaatctctacggtgacatcattctcgcatcgcaagagaacatcgatatgatcaagcgtttccatcaacgctttggggaagcgcttgcgattttagacagcaaagacaaggctaaatttgtagaaagttttgagcaggtgagtgattggtttggccaatactctcagcaatttatgaacgagagccaaaacttactgaaacaggcgaatgacaatatccatcgtggataa

SEQ ID NO: 21839 - protein, 375 aa, Vibrio parahaemolyticus
MAVELNALRDQIDAVDKQMLELLAQRLELVEKVGEVKSEHGLPIYAPDREAAMLASRRAEAEKMGVPPQLIEDILRRTMRESYASEKDSGFKCLNPELRSVVIIGGNGQLGGLFGRMFKLSGYQVKVLGSKDWGRADEILKDAGLVVVTVPIHLTEGVIEKLGNLPQDCILCDLTSIKSKPLQAMLNVHAGPVVGLHPMFGPDVPSLAKQVIVYCDGRGKEQYQWLLQQFGIWGASLCQIDAQEHDHGMTLIQALRHFTSFAYGMHLSKENPNIEQLLKLSSPIYRLELAMVGRLFGQDPNLYGDIILASQENIDMIKRFHQRFGEALAILDSKDKAKFVESFEQVSDWFGQYSQQFMNESQNLLKQANDNIHRG

SEQ ID NO: 21840 - DNA, 1140 bp, Shewanella oneidensis
  CDS (1)..(1140)
atgaatgaaaaaaccacatccgaattagaacatcttcgaggactgatcgacggtgtcgatcagcaattgctgcatttactgcgtaaacgcttagatttagtcgcccaagtcggcacggtaaagcacgctgcaggattacccatttatgcaccacagcgtgaagcggcaatgctggcaaaacgccgtgaagaagcccaaaccatgggcattgcgccacaattgattgaagatattttacgtcgcctaatgcgtgaatcctatcttaatgaaaaggatgttggctttaagcaagtcaagaatgatttaggttcggtagttatagtgggcggtaaaggccagcttggcgggctgtttcaacaaatgctgagactgtcaggttatcaagtgaaagtgctcgataaagatgattggcaacaagcggaatgcttatttgccgatgctggattggtattagtgacagtgcctattgccatcacctgcgacattatccgtgaaaagctaactcagttaccacgggactgtattctagccgatttaacctccatcaagacggaacccatgcaggcgatgttggccgctcataaggggcctgttgtcggctttcatccgatgtttggtccagatgtcggtagcttagctaagcaggttgtggtggtgtgtcatgggcgcgaagctgataaataccaatggttactcgaacaaattgccatttggggcgcacggattgtcgaagctgagcctgaatgtcacgataatgcgatgcaactggtgcaggcgatgcgccatttctcaacctttgtctatggcttaaatctttgcaaagaagaggcggatatagagactttattgaaatttagctcgccaatctaccgcttagagttagcgatggtgggccgtttatttgcccaaagcccggagctttacgctgatattatttttgctcagcaggagagccagcatgcgattggcgattatctggataactatcgcgaagccttagaattgctgaaacggggcgatagagaggagtttatcaatcagttccaaatggttgccaagtggtttggtgattttgcaccgcagtttcagcgcgaaagtcgcatgatgctgcaatcggtaagtgatatgaaaacgaactga

SEQ ID NO: 21841 - protein, 379 aa, Shewanella oneidensis
MNEKTTSELEHLRGLIDGVDQQLLHLLRKRLDLVAQVGTVKHAAGLPIYAPQREAAMLAKRREEAQTMGIAPQLIEDILRRLMRESYLNEKDVGFKQVKNDLGSVVIVGGKGQLGGLFQQMLRLSGYQVKVLDKDDWQQAECLFADAGLVLVTVPIAITCDIIREKLTQLPRDCILADLTSIKTEPMQAMLAAHKGPVVGFHPMFGPDVGSLAKQVVVVCHGREADKYQWLLEQIAIWGARIVEAEPECHDNAMQLVQAMRHFSTFVYGLNLCKEEADIETLLKFSSPIYRLELAMVGRLFAQSPELYADIIFAQQESQHAIGDYLDNYREALELLKRGDREEFINQFQMVAKWFGDFAPQFQRESRMMLQSVSDMKTN

SEQ ID NO: 21842 - DNA, 1125 bp, Pasteurella multocida
  CDS (1)..(1125)
atggatacgttaaataagttaagaacacagattgatcaagttgatcgtcagttattacagcttttagcacagcgacttgagttagtgaaacaagtcggtgaagtcaagcatcaacaaggtctgccgatttatgtgccagaacgtgaagcggagatgctcaacgcccgccgtgcggaagctgaaacgttaggggtatctgctgatttaattgaagatgtattacgtcgtatcatgcgagaatcttatgcgcgggaaaaccaatttggttttaaaaccgtgaatccggcgatcaaaaaaatcgtgatcgtaggtgggggagggaaacttggtagcttgtttgcacgttatttcacattgtctggttactatgttgagattttagagcaacaggattggcaaagtgcggacaagattttgaacgaaacagatgtgattgttgtttcggtaccgatcgccaaaaccgtcgaaacaattaaacgtttgaagccttatttgacagataatatgctgttggtggatttaacttcagttaagcgtgcaccattacaagcgatgttagacgtgcacgctggcgcggtattaggtttacatccaatgtttggtccggatatcgccagcatggcaaaacaagtgattgtacgctgtgatggtcgttttgaatcacgttatcaatggctgatcacccaaatacaaatttggggggcaaaattctaccaagttgaggcgactgaacacgatcatagtatgacgtatgtacaagcgttgcgacacttttccacttttgctaatggcttacatttatcaaaacaaccggttcaattagcgaatttattggcactttcttcgccaatttattgcttagaattggcgatgattgggcgtttatttgcgcaagatgcagaactttatgccgatattattttagataagcctgaaaatctcgcggtcattgagagtttaaagcaaagttatgaagaaagtttggcattttttacccatggtgataagcaggcattcattgacagctttgaacaagttaaacaatggtttggtgaatactcggagcagtttctgaaagaaagtcgccagttgctccaacaagcaaatgattatcgacaaatttaa

SEQ ID NO: 21843 - protein, 374 aa, Pasteurella multocida
MDTLNKLRTQIDQVDRQLLQLLAQRLELVKQVGEVKHQQGLPIYVPEREAEMLNARRAEAETLGVSADLIEDVLRRIMRESYARENQFGFKTVNPAIKKIVIVGGGGKLGSLFARYFTLSGYYVEILEQQDWQSADKILNETDVIVVSVPIAKTVETIKRLKPYLTDNMLLVDLTSVKRAPLQAMLDVHAGAVLGLHPMFGPDIASMAKQVIVRCDGRFESRYQWLITQIQIWGAKFYQVEATEHDHSMTYVQALRHFSTFANGLHLSKQPVQLANLLALSSPIYCLELAMIGRLFAQDAELYADIILDKPENLAVIESLKQSYEESLAFFTHGDKQAFIDSFEQVKQWFGEYSEQFLKESRQLLQQANDYRQI

SEQ ID NO: 21844 - DNA, 24 bp, Artificial sequence
  (1)..(24): primer
atggttgctgaattgaccgcatta

SEQ ID NO: 21845 - DNA, 23 bp, Artificial sequence
  (1)..(23): primer
ttactggcgattgtcattcgcct

SEQ ID NO: 21846 - protein, 370 aa, Artificial sequence
  Variant (2)..(4): xaa in position 2 to 4 is any amino acid
  Variant (6)..(7): xaa in position 6 to 7 is any amino acid
  Variant (10)..(11): xaa in position 10 to 11 is any amino acid
  Variant (13)..(21): xaa in position 13 to 21 is any amino acid
  Variant (24)..(24): xaa in position 24 is any amino acid
  Variant (27)..(29): xaa in position 27 to 29 is any amino acid
  Variant (31)..(32): xaa in position 31 to 32 is any amino acid
  Variant (34)..(36): xaa in position 34 to 36 is any amino acid
  Variant (39)..(39): xaa in position 39 is any amino acid
  Variant (42)..(42): xaa in position 42 is any amino acid
  Variant (44)..(44): xaa in position 44 is any amino acid
  Variant (47)..(49): xaa in position 47 to 49 is any amino acid
  Variant (51)..(52): xaa in position 51 to 52 is any amino acid
  Variant (54)..(55): xaa in position 54 to 55 is any amino acid
  Variant (58)..(60): xaa in position 58 to 60 is any amino acid
  Variant (62)..(65): xaa in position 62 to 65 is any amino acid
  Variant (67)..(68): xaa in position 67 to 68 is any amino acid
  Variant (70)..(70): xaa in position 70 is any amino acid
  Variant (74)..(74): xaa in position 74 is any amino acid
  Variant (80)..(81): xaa in position 80 to 81 is any amino acid
  Variant (83)..(85): xaa in position 83 to 85 is any amino acid
  Variant (89)..(97): xaa in position 89 to 97 is any amino acid
  Variant (99)..(100): xaa in position 99 to 100 is any amino acid
  Variant (103)..(103): xaa in position 103 is any amino acid
  Variant (105)..(106): xaa in position 105 to 106 is any amino acid
  Variant (108)..(109): xaa in position 108 to 109 is any amino acid
  Variant (111)..(116): xaa in position 111 to 116 is any amino acid
  Variant (120)..(123): xaa in position 120 to 123 is any amino acid
  Variant (125)..(127): xaa in position 125 to 127 is any amino acid
  Variant (130)..(131): xaa in position 130 to 131 is any amino acid
  Variant (133)..(145): xaa in position 133 to 145 is any amino acid
  Variant (149)..(154): xaa in position 149 to 154 is any amino acid
  Variant (156)..(161): xaa in position 156 to 161 is any amino acid
  Variant (163)..(169): xaa in position 163 to 169 is any amino acid
  Variant (172)..(172): xaa in position 172 is any amino acid
  Variant (174)..(174): xaa in position 174 is any amino acid
  Variant (176)..(182): xaa in position 176 to 182 is any amino acid
  Variant (184)..(185): xaa in position 184 to 185 is any amino acid
  Variant (187)..(187): xaa in position 187 is any amino acid
  Variant (189)..(189): xaa in position 189 is any amino acid
  Variant (191)..(191): xaa in position 191 is any amino acid
  Variant (193)..(193): xaa in position 193 is any amino acid
  Variant (198)..(199): xaa in position 198 to 199 is any amino acid
  Variant (201)..(205): xaa in position 201 to 205 is any amino acid
  Variant (207)..(208): xaa in position 207 to 208 is any amino acid
  Variant (210)..(210): xaa in position 210 is any amino acid
  Variant (212)..(214): xaa in position 212 to 214 is any amino acid
  Variant (216)..(216): xaa in position 216 is any amino acid
  Variant (219)..(222): xaa in position 219 to 222 is any amino acid
  Variant (224)..(224): xaa in position 224 is any amino acid
  Variant (226)..(228): xaa in position 226 to 228 is any amino acid
  Variant (230)..(232): xaa in position 230 to 232 is any amino acid
  Variant (236)..(244): xaa in position 236 to 244 is any amino acid
  Variant (247)..(248): xaa in position 247 to 248 is any amino acid
  Variant (250)..(252): xaa in position 250 to 252 is any amino acid
  Variant (254)..(256): xaa in position 254 to 256 is any amino acid
  Variant (259)..(260): xaa in position 259 to 260 is any amino acid
  Variant (262)..(263): xaa in position 262 to 263 is any amino acid
  Variant (265)..(266): xaa in position 265 to 266 is any amino acid
  Variant (268)..(280): xaa in position 268 to 280 is any amino acid
  Variant (284)..(286): xaa in position 284 to 286 is any amino acid
  Variant (290)..(292): xaa in position 290 to 292 is any amino acid
  Variant (297)..(297): xaa in position 297 is any amino acid
  Variant (299)..(301): xaa in position 299 to 301 is any amino acid
  Variant (304)..(304): xaa in position 304 is any amino acid
  Variant (308)..(316): xaa in position 308 to 316 is any amino acid
  Variant (318)..(338): xaa in position 318 to 338 is any amino acid
  Variant (340)..(342): xaa in position 340 to 342 is any amino acid
  Variant (344)..(348): xaa in position 344 to 348 is any amino acid
  Variant (350)..(356): xaa in position 350 to 356 is any amino acid
  Variant (358)..(360): xaa in position 358 to 360 is any amino acid
  Variant (362)..(364): xaa in position 362 to 364 is any amino acid
  Variant (366)..(369): xaa in position 366 to 369 is any amino acid
LXXXRXXIDXXDXXXXXXXXXRLXLVXXXGXXKXXXGLXIYXPXREXXXLXXRXXEAXXXGXXXXLXXDXLRRXMRESYXXEXXXGFKXXXXXXXXXVXXGGXGXXGXXFXXXXXXSGYXXXXLXXXDWXXAXXXXXXXXXXXXXVPIXXXXXXIXXXXXXLXXXXXXXDLXSXKXXXXXXXLXXHXGXVXGXHPMFXXDXXXXXSXXKXVXXXCXGRXXXXYXWXXXQXXXWGAXXXXXXXXXHDXXMXXXQXXXHFXXFXXGXXLXXXXXXXXXXXXXSSPXXXLELXXXGRLFXQXXXLYXDIIXXXXXXXXXIXXXXXXXXXXXXXXXXXXXXXFXXXFXXXXXWXXXXXXXFXXXSXXXLXXXXD

SEQ ID NO: 21847 - protein, 370 aa, Artificial sequence
  Variant (2)..(3): xaa in position 2 to 3 is any amino acid
  Variant (6)..(7): xaa in position 6 to 7 is any amino acid
  Variant (10)..(10): xaa in position 10 is any amino acid
  Variant (13)..(17): xaa in position 13 to 17 is any amino acid
  Variant (21)..(21): xaa in position 21 is any amino acid
  Variant (24)..(24): xaa in position 24 is any amino acid
  Variant (27)..(28): xaa in position 27 to 28 is any amino acid
  Variant (31)..(31): xaa in position 31 is any amino acid
  Variant (34)..(36): xaa in position 34 to 36 is any amino acid
  Variant (42)..(42): xaa in position 42 is any amino acid
  Variant (44)..(44): xaa in position 44 is any amino acid
  Variant (48)..(48): xaa in position 48 is any amino acid
  Variant (51)..(52): xaa in position 51 to 52 is any amino acid
  Variant (55)..(55): xaa in position 55 is any amino acid
  Variant (58)..(60): xaa in position 58 to 60 is any amino acid
  Variant (62)..(63): xaa in position 62 to 63 is any amino acid
  Variant (65)..(65): xaa in position 65 is any amino acid
  Variant (70)..(70): xaa in position 70 is any amino acid
  Variant (74)..(74): xaa in position 74 is any amino acid
  Variant (80)..(81): xaa in position 80 to 81 is any amino acid
  Variant (83)..(85): xaa in position 83 to 85 is any amino acid
  Variant (89)..(91): xaa in position 89 to 91 is any amino acid
  Variant (93)..(97): xaa in position 93 to 97 is any amino acid
  Variant (100)..(100): xaa in position 100 is any amino acid
  Variant (103)..(103): xaa in position 103 is any amino acid
  Variant (105)..(106): xaa in position 105 to 106 is any amino acid
  Variant (108)..(108): xaa in position 108 is any amino acid
  Variant (111)..(115): xaa in position 111 to 115 is any amino acid
  Variant (120)..(120): xaa in position 120 is any amino acid
  Variant (122)..(123): xaa in position 122 to 123 is any amino acid
  Variant (125)..(127): xaa in position 125 to 127 is any amino acid
  Variant (130)..(131): xaa in position 130 to 131 is any amino acid
  Variant (133)..(135): xaa in position 133 to 135 is any amino acid
  Variant (137)..(138): xaa in position 137 to 138 is any amino acid
  Variant (141)..(141): xaa in position 141 is any amino acid
  Variant (143)..(143): xaa in position 143 is any amino acid
  Variant (145)..(145): xaa in position 145 is any amino acid
  Variant (149)..(150): xaa in position 149 to 150 is any amino acid
  Variant (152)..(154): xaa in position 152 to 154 is any amino acid
  Variant (156)..(157): xaa in position 156 to 157 is any amino acid
  Variant (159)..(161): xaa in position 159 to 161 is any amino acid
  Variant (163)..(164): xaa in position 163 to 164 is any amino acid
  Variant (169)..(169): xaa in position 169 is any amino acid
  Variant (172)..(172): xaa in position 172 is any amino acid
  Variant (174)..(174): xaa in position 174 is any amino acid
  Variant (176)..(177): xaa in position 176 to 177 is any amino acid
  Variant (180)..(180): xaa in position 180 is any amino acid
  Variant (184)..(185): xaa in position 184 to 185 is any amino acid
  Variant (187)..(187): xaa in position 187 is any amino acid
  Variant (191)..(191): xaa in position 191 is any amino acid
  Variant (201)..(205): xaa in position 201 to 205 is any amino acid
  Variant (207)..(207): xaa in position 207 is any amino acid
  Variant (212)..(212): xaa in position 212 is any amino acid
  Variant (214)..(214): xaa in position 214 is any amino acid
  Variant (219)..(222): xaa in position 219 to 222 is any amino acid
  Variant (226)..(226): xaa in position 226 is any amino acid
  Variant (228)..(228): xaa in position 228 is any amino acid
  Variant (230)..(232): xaa in position 230 to 232 is any amino acid
  Variant (236)..(241): xaa in position 236 to 241 is any amino acid
  Variant (243)..(243): xaa in position 243 is any amino acid
  Variant (247)..(248): xaa in position 247 to 248 is any amino acid
  Variant (250)..(251): xaa in position 250 to 251 is any amino acid
  Variant (259)..(260): xaa in position 259 to 260 is any amino acid
  Variant (263)..(263): xaa in position 263 is any amino acid
  Variant (265)..(265): xaa in position 265 is any amino acid
  Variant (268)..(269): xaa in position 268 to 269 is any amino acid
  Variant (271)..(273): xaa in position 271 to 273 is any amino acid
  Variant (275)..(276): xaa in position 275 to 276 is any amino acid
  Variant (279)..(279): xaa in position 279 is any amino acid
  Variant (292)..(292): xaa in position 292 is any amino acid
  Variant (300)..(301): xaa in position 300 to 301 is any amino acid
  Variant (308)..(312): xaa in position 308 to 312 is any amino acid
  Variant (314)..(316): xaa in position 314 to 316 is any amino acid
  Variant (318)..(326): xaa in position 318 to 326 is any amino acid
  Variant (328)..(334): xaa in position 328 to 334 is any amino acid
  Variant (337)..(338): xaa in position 337 to 338 is any amino acid
  Variant (340)..(342): xaa in position 340 to 342 is any amino acid
  Variant (344)..(345): xaa in position 344 to 345 is any amino acid
  Variant (347)..(348): xaa in position 347 to 348 is any amino acid
  Variant (352)..(352): xaa in position 352 is any amino acid
  Variant (354)..(356): xaa in position 354 to 356 is any amino acid
  Variant (358)..(359): xaa in position 358 to 359 is any amino acid
  Variant (362)..(363): xaa in position 362 to 363 is any amino acid
  Variant (366)..(366): xaa in position 366 is any amino acid
LXXLRXXIDXVDXXXXXLLAXRLXLVXXVGXVKXXXGLPIYXPXREAXMLXXRRXEAXXXGXXPXLIEDXLRRXMRESYXXEXXXGFKXXXPXXXXXVIXGGXGXXGXLFXXXXXLSGYXVXXLXXXDWXXAXXXLXXAGXVXVXVPIXXTXXXIXXLXXXLXXDCILXDLXSXKXXPLXAMLXXHXGPVXGLHPMFGPDXXXXXSXAKQVXVXCDGRXXXXYQWXLXQXXXWGAXXXXXXAXEHDXXMXXIQALRHFXXFAXGXHLXXEXXXLXXLLXLSSPIYRLELAMXGRLFAQDXXLYADIIXXXXXNXXXIXXXXXXXXXAXXXXXXXDKXXFXXXFXXVXXWFGXYXXXFXXESXXLLXQAND

SEQ ID NO: 21848 - protein, 62 aa, Artificial sequence
  Variant (2)..(3): xaa in position 2 to 3 is any amino acid
  Variant (4)..(4): xaa in position 4 is Leu or Ile
  Variant (6)..(7): xaa in position 6 to 7 is any amino acid
  Variant (10)..(10): xaa in position 10 is any amino acid
  Variant (11)..(11): xaa in position 11 is Val, Leu or Ile
  Variant (13)..(13): xaa in position 13 is Lys, Gln or Arg
  Variant (14)..(14): xaa in position 14 is any amino acid
  Variant (15)..(15): xaa in position 15 is Leu or Met
  Variant (16)..(16): xaa in position 16 is Leu, Val or Ile
  Variant (17)..(17): xaa in position 17 is any amino acid
  Variant (18)..(18): xaa in position 18 is Leu or Val
  Variant (19)..(19): xaa in position 19 is Leu or Phe
  Variant (20)..(20): xaa in position 20 is Ala, Ser or Arg
  Variant (21)..(21): xaa in position 21 is Lys, Gln or Arg
  Variant (24)..(24): xaa in position 24 is any amino acid
  Variant (27)..(27): xaa in position 27 is any amino acid
  Variant (28)..(28): xaa in position 28 is Gln, Glu or Lys
  Variant (29)..(29): xaa in position 29 is Val or Ile
  Variant (31)..(31): xaa in position 31 is any amino acid
  Variant (32)..(32): xaa in position 32 is Val or Ile
  Variant (34)..(34): xaa in position 34 is Ser or His
  Variant (35)..(36): xaa in position 35 to 36 is any amino acid
  Variant (39)..(39): xaa in position 39 is any amino acid
  Variant (42)..(42): xaa in position 42 is Ala, Val or Asp
  Variant (44)..(44): xaa in position 44 is Asp, Glu or Gln
  Variant (47)..(48): xaa in position 47 to 48 is any amino acid
  Variant (49)..(49): xaa in position 49 is Met or Ile
  Variant (51)..(52): xaa in position 51 to 52 is any amino acid
  Variant (54)..(54): xaa in position 54 is Arg or Lys
  Variant (55)..(55): xaa in position 55 is any amino acid
  Variant (58)..(60): xaa in position 58 to 60 is any amino acid
  Variant (62)..(62): xaa in position 62 is Val or Ile
LXXXRXXIDXXDXXXXXXXXXRLXLVXXXGXXKXXXGLXIYXPXREXXXLXXRXXEAXXXGX

SEQ ID NO: 21849 - protein, 23 aa, Artificial sequence
  Variant (2)..(2): xaa in position 2 is Ile, Val or Leu
  Variant (3)..(3): xaa in position 3 is Glu or Arg
  Variant (5)..(5): xaa in position 5 is Ile, Val or Leu
  Variant (9)..(9): xaa in position 9 is any amino acid
  Variant (15)..(16): xaa in position 15 to 16 is any amino acid
  Variant (18)..(18): xaa in position 18 is Asn, Lys or His
  Variant (19)..(20): xaa in position 19 to 20 is any amino acid
LXXDXLRRXMRESYXXEXXXGFK

SEQ ID NO: 21850 - protein, 52 aa, Artificial sequence
  Variant (1)..(1): xaa in position 1 is Val, Ile or Leu
  Variant (3)..(3): xaa in position 3 is Ile, Val or Leu
  Variant (4)..(4): xaa in position 4 is Val, Ile or Leu
  Variant (7)..(7): xaa in position 7 is any amino acid
  Variant (9)..(9): xaa in position 9 is Gln, Lys or Arg
  Variant (10)..(10): xaa in position 10 is Leu or Met
  Variant (12)..(12): xaa in position 12 is any amino acid
  Variant (13)..(13): xaa in position 13 is Leu or Phe
  Variant (15)..(15): xaa in position 15 is any amino acid
  Variant (16)..(16): xaa in position 16 is Arg, Lys or Gln
  Variant (17)..(17): xaa in position 17 is any amino acid
  Variant (18)..(18): xaa in position 18 is Leu or Phe
  Variant (19)..(19): xaa in position 19 is any amino acid
  Variant (20)..(20): xaa in position 20 is Leu or Ala
  Variant (24)..(24): xaa in position 24 is any amino acid
  Variant (25)..(25): xaa in position 25 is Val or Ile
  Variant (26)..(27): xaa in position 26 to 27 is any amino acid
  Variant (29)..(29): xaa in position 29 is Glu, Gly or Asp
  Variant (30)..(31): xaa in position 30 to 31 is any amino acid
  Variant (34)..(35): xaa in position 34 to 35 is any amino acid
  Variant (37)..(38): xaa in position 37 to 38 is any amino acid
  Variant (39)..(39): xaa in position 39 is Ile or Leu
  Variant (40)..(40): xaa in position 40 is Leu, Val or Phe
  Variant (41)..(42): xaa in position 41 to 42 is any amino acid
  Variant (43)..(43): xaa in position 43 is Ala, Val or Thr
  Variant (44)..(44): xaa in position 44 is Gly, Asp or Asn
  Variant (45)..(45): xaa in position 45 is Met, Leu, Val or Ala
  Variant (46)..(46): xaa in position 46 is Val, Ile or Leu
  Variant (47)..(47): xaa in position 47 is Ile, Leu, Val or Phe
  Variant (48)..(48): xaa in position 48 is Val, Ile or Leu
  Variant (49)..(49): xaa in position 49 is Ser, Thr or Cys
XVXXGGXGXXGXXFXXXXXXSGYXXXXLXXXDWXXAXXXXXXXXXXXXXVPI

SEQ ID NO: 21851 - protein, 34 aa, Artificial sequence
  Variant (1)..(1): xaa in position 1 is Ile, Leu or Val
  Variant (2)..(2): xaa in position 2 is Leu, Ile or Val
  Variant (3)..(3): xaa in position 3 is any amino acid
  Variant (6)..(6): xaa in position 6 is Thr, Ala or Ser
  Variant (8)..(8): xaa in position 8 is Val, Ile or Leu
  Variant (10)..(11): xaa in position 10 to 11 is any amino acid
  Variant (12)..(12): xaa in position 12 is Pro or Ser
  Variant (13)..(13): xaa in position 13 is Leu or Met
  Variant (14)..(15): xaa in position 14 to 15 is any amino acid
  Variant (16)..(16): xaa in position 16 is Met or Ile
  Variant (18)..(18): xaa in position 18 is any amino acid
  Variant (19)..(19): xaa in position 19 is Val, Ala or Ile
  Variant (21)..(21): xaa in position 21 is any amino acid
  Variant (23)..(23): xaa in position 23 is Pro or Ala
  Variant (25)..(25): xaa in position 25 is Leu, Val or Ile
  Variant (27)..(27): xaa in position 27 is Leu or Phe
  Variant (32)..(32): xaa in position 32 is Gly or Ser
  Variant (33)..(33): xaa in position 33 is Pro or Ala
XXXDLXSXKXXXXXXXLXXHXGXVXGXHPMFXXD

SEQ ID NO: 21852 - protein, 30 aa, Artificial sequence
  Variant (2)..(2): xaa in position 2 is Leu or Met
  Variant (3)..(3): xaa in position 3 is Ala, Ile or Val
  Variant (5)..(5): xaa in position 5 is Gln or Lys
  Variant (7)..(8): xaa in position 7 to 8 is Val, Ile or Leu
  Variant (9)..(9): xaa in position 9 is any amino acid
  Variant (11)..(11): xaa in position 11 is Asp or His
  Variant (14)..(17): xaa in position 14 to 17 is any amino acid
  Variant (19)..(19): xaa in position 19 is Gln or Glu
  Variant (21)..(21): xaa in position 21 is Leu or Phe
  Variant (22)..(22): xaa in position 22 is Leu, Ile or Val
  Variant (23)..(23): xaa in position 23 is Glu, Gln or Thr
  Variant (25)..(25): xaa in position 25 is Ile, Phe or Leu
  Variant (26)..(26): xaa in position 26 is any amino acid
  Variant (27)..(27): xaa in position 27 is Ile, Val, Leu or Met
SXXKXVXXXCXGRXXXXYXWXXXQXXXWGA

SEQ ID NO: 21853 - protein, 23 aa, Artificial sequence
  Variant (3)..(4): xaa in position 3 to 4 is any amino acid
  Variant (6)..(6): xaa in position 6 is any amino acid
  Variant (7)..(7): xaa in position 7 is Phe, Leu or Tyr
  Variant (8)..(8): xaa in position 8 is Ile or Val
  Variant (10)..(10): xaa in position 10 is Ala or Ser
  Variant (11)..(11): xaa in position 11 is Leu or Met
  Variant (12)..(12): xaa in position 12 is Arg or Cys
  Variant (15)..(15): xaa in position 15 is Ala, Thr or Ser
  Variant (16)..(16): xaa in position 16 is Thr, Ser or Ile
  Variant (18)..(18): xaa in position 18 is Ala or Val
  Variant (19)..(19): xaa in position 19 is any amino acid
  Variant (21)..(21): xaa in position 21 is any amino acid
  Variant (22)..(22): xaa in position 22 is His or Asn
HDXXMXXXQXXXHFXXFXXGXXL

SEQ ID NO: 21854 - protein, 37 aa, Artificial sequence
  Variant (4)..(4): xaa in position 4 is Ile, Met, Leu or Phe
  Variant (5)..(5): xaa in position 5 is Tyr or Phe
  Variant (6)..(6): xaa in position 6 is Arg, Gln or Cys
  Variant (10)..(10): xaa in position 10 is Ala or Ile
  Variant (11)..(11): xaa in position 11 is Met, Leu, Val or Ile
  Variant (12)..(12): xaa in position 12 is Val, Ile or Leu
  Variant (17)..(17): xaa in position 17 is Ala, Gly or Thr
  Variant (19)..(21): xaa in position 19 to 21 is any amino acid
  Variant (24)..(24): xaa in position 24 is Ala or Gly
  Variant (28)..(28): xaa in position 28 is Met, Leu or Phe
  Variant (29)..(29): xaa in position 29 is Ser, Asp or Ala
  Variant (30)..(32): xaa in position 30 to 32 is any amino acid
  Variant (33)..(33): xaa in position 33 is Asn or Ser
  Variant (34)..(34): xaa in position 34 is Leu, Ile, Val or Gln
  Variant (35)..(35): xaa in position 35 is any amino acid
  Variant (36)..(36): xaa in position 36 is Leu, Met, Val or Ala
SSPXXXLELXXXGRLFXQXXXLYXDIIXXXXXXXXXI

SEQ ID NO: 21855 - DNA, 1071 bp, Escherichia coli K12; identical to SEQ ID NO: 1333
  CDS (1)..(1071)

SEQ ID NO: 21856 - protein, 356 aa, Escherichia coli K12; identical to SEQ ID NO: 1334

SEQ ID NO: 21857 - DNA, 1235 bp, Salmonella typhimurium; identical to SEQ ID NO: 1325
  CDS (165)..(1235)

SEQ ID NO: 21858 - protein, 356 aa, Salmonella typhimurium; identical to SEQ ID NO: 1326

SEQ ID NO: 21859 - DNA, 1086 bp, Deinococcus radiodurans; identical to SEQ ID NO: 1327
  CDS (1)..(1086)

SEQ ID NO: 21860 - protein, 361 aa, Deinococcus radiodurans; identical to SEQ ID NO: 1328

SEQ ID NO: 21861 - DNA, 1056 bp, Neisseria meningitidis; identical to SEQ ID NO: 1329
  CDS (1)..(1056)

SEQ ID NO: 21862 - protein, 351 aa, Neisseria meningitidis; identical to SEQ ID NO: 1330

SEQ ID NO: 21863 - DNA, 1047 bp, Yersinia pestis; identical to SEQ ID NO: 1331
  CDS (1)..(1047)

SEQ ID NO: 21864 - protein, 348 aa, Yersinia pestis; identical to SEQ ID NO: 1332

SEQ ID NO: 21865 - DNA, 1047 bp, Salmonella enterica subsp. enterica serovar Typhi; identical to SEQ ID NO: 1575
  CDS (1)..(1047)

SEQ ID NO: 21866 - protein, 348 aa, Salmonella enterica subsp. enterica serovar Typhi; identical to SEQ ID NO: 1576

SEQ ID NO: 21867 - DNA, 1047 bp, Escherichia coli; identical to SEQ ID NO: 1323
  CDS (1)..(1047)

SEQ ID NO: 21868 - protein, 348 aa, Escherichia coli; identical to SEQ ID NO: 1324

SEQ ID NO: 21869 - DNA, 1188 bp, Escherichia coli; identical to SEQ ID NO: 1579
  CDS (92)..(1144)

SEQ ID NO: 21870 - protein, 350 aa, Escherichia coli; identical to SEQ ID NO: 1580

SEQ ID NO: 21871 - DNA, 1131 bp, Nostoc sp. PCC 7120; identical to SEQ ID NO: 1335
  CDS (1)..(1131)

SEQ ID NO: 21872 - protein, 376 aa, Nostoc sp. PCC 7120; identical to SEQ ID NO: 1336

SEQ ID NO: 21873 - DNA, 1053 bp, Salmonella enterica subsp. enterica serovar Typhi; identical to SEQ ID NO: 1337
  CDS (1)..(1053)

SEQ ID NO: 21874 - protein, 350 aa, Salmonella enterica subsp. enterica serovar Typhi; identical to SEQ ID NO: 1338

SEQ ID NO: 21875 - DNA, 1077 bp, Pseudomonas aeruginosa; identical to SEQ ID NO: 1339
  CDS (1)..(1077)

SEQ ID NO: 21876 - protein, 358 aa, Pseudomonas aeruginosa; identical to SEQ ID NO: 1340

SEQ ID NO: 21877 - DNA, 1047 bp, Buchnera sp; identical to SEQ ID NO: 1341
  CDS (1)..(1047)

SEQ ID NO: 21878 - protein, 348 aa, Buchnera sp; identical to SEQ ID NO: 1342

SEQ ID NO: 21879 - DNA, 1032 bp, Streptococcus pneumoniae; identical to SEQ ID NO: 1589
  CDS (1)..(1032)

SEQ ID NO: 21880 - protein, 343 aa, Streptococcus pneumoniae; identical to SEQ ID NO: 1590

SEQ ID NO: 21881 - DNA, 1074 bp, Vibrio cholerae; identical to SEQ ID NO: 1343
  CDS (1)..(1074)

SEQ ID NO: 21882 - protein, 357 aa, Vibrio cholerae; identical to SEQ ID NO: 1344

SEQ ID NO: 21883 - DNA, 1038 bp, Lactococcus lactis subsp. lactis; identical to SEQ ID NO: 1345
  CDS (1)..(1038)

SEQ ID NO: 21884 - protein, 345 aa, Lactococcus lactis subsp. lactis; identical to SEQ ID NO: 1346

SEQ ID NO: 21885 - DNA, 1023 bp, Lactococcus lactis subsp. lactis; identical to SEQ ID NO: 1347
  CDS (1)..(1023)

SEQ ID NO: 21886 - protein, 340 aa, Lactococcus lactis subsp. lactis; identical to SEQ ID NO: 1348

SEQ ID NO: 21887 - DNA, 1032 bp, Streptococcus pneumoniae; identical to SEQ ID NO: 1597
  CDS (1)..(1032)

SEQ ID NO: 21888 - protein, 343 aa, Streptococcus pneumoniae; identical to SEQ ID NO: 1350

SEQ ID NO: 21889 - DNA, 1095 bp, Pseudomonas aeruginosa; identical to SEQ ID NO: 1351
  CDS (1)..(1095)

SEQ ID NO: 21890 - protein, 364 aa, Pseudomonas aeruginosa; identical to SEQ ID NO: 1352

SEQ ID NO: 21891 - DNA, 1110 bp, Caulobacter crescentus; identical to SEQ ID NO: 1353
  CDS (1)..(1110)

SEQ ID NO: 21892 - protein, 369 aa, Caulobacter crescentus; identical to SEQ ID NO: 1354

SEQ ID NO: 21893 - DNA, 1143 bp, Xylella fastidiosa; identical to SEQ ID NO: 1603
  CDS (1)..(1143)

SEQ ID NO: 21894 - protein, 380 aa, Xylella fastidiosa; identical to SEQ ID NO: 1604

SEQ ID NO: 21895 - DNA, 1047 bp, Buchnera aphidicola; identical to SEQ ID NO: 1357
  CDS (1)..(1047)

SEQ ID NO: 21896 - protein, 348 aa, Buchnera aphidicola; identical to SEQ ID NO: 1358

SEQ ID NO: 21897 - DNA, 1089 bp, Haemophilus influenzae; identical to SEQ ID NO: 1359
  CDS (1)..(1089)

SEQ ID NO: 21898 - protein, 362 aa, Haemophilus influenzae; identical to SEQ ID NO: 1360

SEQ ID NO: 21899 - DNA, 1502 bp, Candida albicans; identical to SEQ ID NO: 1361
  CDS (336)..(1442)

SEQ ID NO: 21900 - protein, 368 aa, Candida albicans; identical to SEQ ID NO: 1362

SEQ ID NO: 21901 - DNA, 1113 bp, Saccharomyces cerevisiae; identical to SEQ ID NO: 1363
  CDS (1)..(1113)

SEQ ID NO: 21902 - protein, 370 aa, Saccharomyces cerevisiae; identical to SEQ ID NO: 1364

SEQ ID NO: 21903 - DNA, 2048 bp, Saccharomyces cerevisiae; identical to SEQ ID NO: 1365
  CDS (619)..(1731)

SEQ ID NO: 21904 - protein, 370 aa, Saccharomyces cerevisiae; identical to SEQ ID NO: 1366

SEQ ID NO: 21905 - DNA, 1107 bp, Schizosaccharomyces pombe; identical to SEQ ID NO: 1367
  CDS (1)..(1107)

SEQ ID NO: 21906 - protein, 368 aa, Schizosaccharomyces pombe; identical to SEQ ID NO: 1368

SEQ ID NO: 21907 - DNA, 1089 bp, Amycolatopsis orientalis; identical to SEQ ID NO: 1369
  CDS (1)..(1089)

SEQ ID NO: 21908 - protein, 362 aa, Amycolatopsis orientalis; identical to SEQ ID NO: 1370

SEQ ID NO: 21909 - DNA, 1248 bp, Corynebacterium glutamicum; identical to SEQ ID NO: 1373
  CDS (101)..(1228)

SEQ ID NO: 21910 - protein, 375 aa, Corynebacterium glutamicum; identical to SEQ ID NO: 1374

SEQ ID NO: 21911 - DNA, 1083 bp, Methylophilus methylotrophus; identical to SEQ ID NO: 1375
  CDS (1)..(1083)

SEQ ID NO: 21912 - protein, 360 aa, Methylophilus methylotrophus; identical to SEQ ID NO: 1376

SEQ ID NO: 21913 - DNA, 1047 bp, Yersinia pseudotuberculosis IP 32953; identical to SEQ ID NO: 1623
  CDS (1)..(1047)

SEQ ID NO: 21914 - protein, 348 aa, Yersinia pseudotuberculosis IP 32953; identical to SEQ ID NO: 1624

SEQ ID NO: 21915 - DNA, 1053 bp, Yersinia pseudotuberculosis IP 32953; identical to SEQ ID NO: 1487
  CDS (1)..(1053)

SEQ ID NO: 21916 - protein, 350 aa, Yersinia pseudotuberculosis IP 32953; identical to SEQ ID NO: 1488

SEQ ID NO: 21917 - DNA, 1107 bp, Debaryomyces hansenii CBS767; identical to SEQ ID NO: 1377
  CDS (1)..(1107)

SEQ ID NO: 21918 - protein, 368 aa, Debaryomyces hansenii CBS767; identical to SEQ ID NO: 1378

SEQ ID NO: 21919 - DNA, 1074 bp, Yarrowia lipolytica CLIB99; identical to SEQ ID NO: 1379
  CDS (1)..(1074)

SEQ ID NO: 21920 - protein, 357 aa, Yarrowia lipolytica CLIB99; identical to SEQ ID NO: 1380

SEQ ID NO: 21921 - DNA, 1089 bp, Yarrowia lipolytica CLIB99; identical to SEQ ID NO: 1381
  CDS (1)..(1089)

SEQ ID NO: 21922 - protein, 362 aa, Yarrowia lipolytica CLIB99; identical to SEQ ID NO: 1382

SEQ ID NO: 21923 - DNA, 1119 bp, Kluyveromyces lactis NRRL Y; identical to SEQ ID NO: 1383
  CDS (1)..(1119)

SEQ ID NO: 21924 - protein, 372 aa, Kluyveromyces lactis NRRL Y; identical to SEQ ID NO: 1384

SEQ ID NO: 21925 - DNA, 1095 bp, Kluyveromyces lactis NRRL Y; identical to SEQ ID NO: 1385
  CDS (1)..(1095)

SEQ ID NO: 21926 - protein, 364 aa, Kluyveromyces lactis NRRL Y; identical to SEQ ID NO: 1386

SEQ ID NO: 21927 - DNA, 1074 bp, Erwinia carotovora; identical to SEQ ID NO: 1387
  CDS (1)..(1074)

SEQ ID NO: 21928 - protein, 357 aa, Erwinia carotovora; identical to SEQ ID NO: 1388

SEQ ID NO: 21929 - DNA, 1047 bp, Erwinia carotovora; identical to SEQ ID NO: 1389
  CDS (1)..(1047)

SEQ ID NO: 21930 - protein, 348 aa, Erwinia carotovora; identical to SEQ ID NO: 1390

SEQ ID NO: 21931 - DNA, 1056 bp, Erwinia carotovora; identical to SEQ ID NO: 1391
  CDS (1)..(1056)

SEQ ID NO: 21932 - protein, 351 aa, Erwinia carotovora; identical to SEQ ID NO: 1392

SEQ ID NO: 21933 - DNA, 1113 bp, Acinetobacter sp; identical to SEQ ID NO: 1393
  CDS (1)..(1113)

SEQ ID NO: 21934 - protein, 370 aa, Acinetobacter sp; identical to SEQ ID NO: 1394

SEQ ID NO: 21935 - DNA, 1056 bp, Acinetobacter sp; identical to SEQ ID NO: 1395
  CDS (1)..(1056)

SEQ ID NO: 21936 - protein, 351 aa, Acinetobacter sp; identical to SEQ ID NO: 1396

SEQ ID NO: 21937 - DNA, 1119 bp, Candida glabrata CBS138; identical to SEQ ID NO: 1397
  CDS (1)..(1119)

SEQ ID NO: 21938 - protein, 372 aa, Candida glabrata CBS138; identical to SEQ ID NO: 1398

SEQ ID NO: 21939 - DNA, 1071 bp, Candida glabrata CBS138; identical to SEQ ID NO: 1399
  CDS (1)..(1071)

SEQ ID NO: 21940 - protein, 356 aa, Candida glabrata CBS138; identical to SEQ ID NO: 1400

SEQ ID NO: 21941 - DNA, 1083 bp, Photobacterium profundum; identical to SEQ ID NO: 1401
  CDS (1)..(1083)

SEQ ID NO: 21942 - protein, 360 aa, Photobacterium profundum; identical to SEQ ID NO: 1402

SEQ ID NO: 21943 - DNA, 1053 bp, Photobacterium profundum; identical to SEQ ID NO: 1403
  CDS (1)..(1053)

SEQ ID NO: 21944 - protein, 350 aa, Photobacterium profundum; identical to SEQ ID NO: 1404

SEQ ID NO: 21945 - DNA, 1113 bp, Photobacterium profundum; identical to SEQ ID NO: 1405
  CDS (1)..(1113)

SEQ ID NO: 21946 - protein, 370 aa, Photobacterium profundum; identical to SEQ ID NO: 1406

SEQ ID NO: 21947 - DNA, 1056 bp, Photobacterium profundum; identical to SEQ ID NO: 1407
  CDS (1)..(1056)

SEQ ID NO: 21948 - protein, 351 aa, Photobacterium profundum; identical to SEQ ID NO: 1408

SEQ ID NO: 21949 - DNA, 1092 bp, Parachlamydia sp; identical to SEQ ID NO: 1409
  CDS (1)..(1092)

SEQ ID NO: 21950 - protein, 363 aa, Parachlamydia sp; identical to SEQ ID NO: 1410

SEQ ID NO: 21951 - DNA, 1095 bp, Rhodopseudomonas palustris; identical to SEQ ID NO: 1411
  CDS (1)..(1095)

SEQ ID NO: 21952 - protein, 364 aa, Rhodopseudomonas palustris; identical to SEQ ID NO: 1412

SEQ ID NO: 21953 - DNA, 1100 bp, Amycolatopsis methanolica; identical to SEQ ID NO: 1413
  CDS (1)..(1086)

SEQ ID NO: 21954 - protein, 361 aa, Amycolatopsis methanolica; identical to SEQ ID NO: 1414

SEQ ID NO: 21955 - DNA, 1071 bp, Treponema denticola; identical to SEQ ID NO: 1415
  CDS (1)..(1071)

SEQ ID NO: 21956 - protein, 356 aa, Treponema denticola; identical to SEQ ID NO: 1416

SEQ ID NO: 21957 - DNA, 1020 bp, Geobacter sulfurreducens; identical to SEQ ID NO: 1667
  CDS (1)..(1020)

SEQ ID NO: 21958 - protein, 339 aa, Geobacter sulfurreducens; identical to SEQ ID NO: 1668

SEQ ID NO: 21959 - DNA, 1068 bp, Geobacter sulfurreducens; identical to SEQ ID NO: 1417
  CDS (1)..(1068)

SEQ ID NO: 21960 - protein, 355 aa, Geobacter sulfurreducens; identical to SEQ ID NO: 1418

SEQ ID NO: 21961 - DNA, 1122 bp, Ashbya gossypii; identical to SEQ ID NO: 1421
  CDS (1)..(1122)

SEQ ID NO: 21962 - protein, 373 aa, Ashbya gossypii; identical to SEQ ID NO: 1422

SEQ ID NO: 21963 - DNA, 1098 bp, Amycolatopsis balhimycina; identical to SEQ ID NO: 1423
  CDS (1)..(1098)

SEQ ID NO: 21964 - protein, 365 aa, Amycolatopsis balhimycina; identical to SEQ ID NO: 1424

SEQ ID NO: 21965 - DNA, 1053 bp, Vibrio vulnificus; identical to SEQ ID NO: 1675
  CDS (1)..(1053)

SEQ ID NO: 21966 - protein, 350 aa, Vibrio vulnificus; identical to SEQ ID NO: 1676

SEQ ID NO: 21967 - DNA, 1047 bp, Photorhabdus luminescens; identical to SEQ ID NO: 1427
  CDS (1)..(1047)

SEQ ID NO: 21968 - protein, 348 aa, Photorhabdus luminescens; identical to SEQ ID NO: 1428

SEQ ID NO: 21969 - DNA, 1053 bp, Photorhabdus luminescens; identical to SEQ ID NO: 1429
  CDS (1)..(1053)

SEQ ID NO: 21970 - protein, 350 aa, Photorhabdus luminescens; identical to SEQ ID NO: 1430

SEQ ID NO: 21971 - DNA, 1095 bp, Photorhabdus luminescens; identical to SEQ ID NO: 1431
  CDS (1)..(1095)

SEQ ID NO: 21972 - protein, 364 aa, Photorhabdus luminescens; identical to SEQ ID NO: 1432

SEQ ID NO: 21973 - DNA, 1119 bp, Gloeobacter violaceus; identical to SEQ ID NO: 1433
  CDS (1)..(1119)

SEQ ID NO: 21974 - protein, 372 aa, Gloeobacter violaceus; identical to SEQ ID NO: 1434

SEQ ID NO: 21975 - DNA, 1107 bp, Chromobacterium violaceum; identical to SEQ ID NO: 1435
  CDS (1)..(1107)

SEQ ID NO: 21976 - protein, 368 aa, Chromobacterium violaceum; identical to SEQ ID NO: 1436

SEQ ID NO: 21977 - DNA, 1059 bp, Chromobacterium violaceum; identical to SEQ ID NO: 1437
  CDS (1)..(1059)

SEQ ID NO: 21978 - protein, 352 aa, Chromobacterium violaceum; identical to SEQ ID NO: 1438

SEQ ID NO: 21979 - DNA, 1140 bp, Neurospora crassa; identical to SEQ ID NO: 1439
  CDS (1)..(1140)

SEQ ID NO: 21980 - protein, 379 aa, Neurospora crassa; identical to SEQ ID NO: 1440

SEQ ID NO: 21981 - DNA, 1092 bp, Neurospora crassa; identical to SEQ ID NO: 1441
  CDS (1)..(1092)

SEQ ID NO: 21982 - protein, 363 aa, Neurospora crassa; identical to SEQ ID NO: 1442

SEQ ID NO: 21983 - DNA, 1068 bp, Synechococcus sp; identical to SEQ ID NO: 1443
  CDS (1)..(1068)

SEQ ID NO: 21984 - protein, 355 aa, Synechococcus sp; identical to SEQ ID NO: 1444

SEQ ID NO: 21985 - DNA, 1053 bp, Rhodopirellula baltica; identical to SEQ ID NO: 1445
  CDS (1)..(1053)

SEQ ID NO: 21986 - protein, 350 aa, Rhodopirellula baltica; identical to SEQ ID NO: 1446

SEQ ID NO: 21987 - DNA, 1068 bp, Prochlorococcus marinus subsp; identical to SEQ ID NO: 1447
  CDS (1)..(1068)

SEQ ID NO: 21988 - protein, 355 aa, Prochlorococcus marinus subsp; identical to SEQ ID NO: 1448

SEQ ID NO: 21989 - DNA, 1083 bp, Prochlorococcus marinus; identical to SEQ ID NO: 1449
  CDS (1)..(1083)

SEQ ID NO: 21990 - protein, 360 aa, Prochlorococcus marinus; identical to SEQ ID NO: 1450

SEQ ID NO: 21991 - DNA, 1074 bp, Prochlorococcus marinus; identical to SEQ ID NO: 1451
  CDS (1)..(1074)

SEQ ID NO: 21992 - protein, 357 aa, Prochlorococcus marinus; identical to SEQ ID NO: 1452

SEQ ID NO: 21993 - DNA, 1113 bp, Haemophilus ducreyi; identical to SEQ ID NO: 1453
  CDS (1)..(1113)

SEQ ID NO: 21994 - protein, 370 aa, Haemophilus ducreyi; identical to SEQ ID NO: 1454

SEQ ID NO: 21995 - DNA, 1080 bp, Haemophilus ducreyi; identical to SEQ ID NO: 1455
  CDS (1)..(1080)

SEQ ID NO: 21996 - protein, 359 aa, Haemophilus ducreyi; identical to SEQ ID NO: 1456

SEQ ID NO: 21997 - DNA, 1086 bp, Candidatus Blochmannia floridanus; identical to SEQ ID NO: 1457
  CDS (1)..(1086)

SEQ ID NO: 21998 - protein, 361 aa, Candidatus Blochmannia floridanus; identical to SEQ ID NO: 1458

SEQ ID NO: 21999 - DNA, 1074 bp, Bordetella pertussis; identical to SEQ ID NO: 1459
  CDS (1)..(1074)

SEQ ID NO: 22000 - protein, 357 aa, Bordetella pertussis; identical to SEQ ID NO: 1460

SEQ ID NO: 22001 - DNA, 1119 bp, Bordetella bronchiseptica; identical to SEQ ID NO: 1461
  CDS (1)..(1119)

SEQ ID NO: 22002 - protein, 372 aa, Bordetella bronchiseptica; identical to SEQ ID NO: 1462

SEQ ID NO: 22003 - DNA, 1179 bp, Nitrosomonas europaea; identical to SEQ ID NO: 1463
  CDS (1)..(1179)

SEQ ID NO: 22004 - protein, 392 aa, Nitrosomonas europaea; identical to SEQ ID NO: 1464

SEQ ID NO: 22005 - DNA, 1083 bp, Coxiella burnetii; identical to SEQ ID NO: 1465
  CDS (1)..(1083)

SEQ ID NO: 22006 - protein, 360 aa, Coxiella burnetii; identical to SEQ ID NO: 1466

SEQ ID NO: 22007 - DNA, 1143 bp, Xylella fastidiosa; identical to SEQ ID NO: 1469
  CDS (1)..(1143)

SEQ ID NO: 22008 - protein, 380 aa, Xylella fastidiosa; identical to SEQ ID NO: 1470

SEQ ID NO: 22009 - DNA, 1053 bp, Vibrio parahaemolyticus; identical to SEQ ID NO: 1471
  CDS (1)..(1053)

SEQ ID NO: 22010 - protein, 350 aa, Vibrio parahaemolyticus; identical to SEQ ID NO: 1472

SEQ ID NO: 22011 - DNA, 1053 bp, Vibrio parahaemolyticus; identical to SEQ ID NO: 1473
  CDS (1)..(1053)

SEQ ID NO: 22012 - protein, 350 aa, Vibrio parahaemolyticus; identical to SEQ ID NO: 1474

SEQ ID NO: 22013 - DNA, 1074 bp, Vibrio parahaemolyticus; identical to SEQ ID NO: 1475
  CDS (1)..(1074)

SEQ ID NO: 22014 - protein, 357 aa, Vibrio parahaemolyticus; identical to SEQ ID NO: 1476

SEQ ID NO: 22015 - DNA, 1083 bp, Pseudomonas syringae; identical to SEQ ID NO: 1477
  CDS (1)..(1083)

SEQ ID NO: 22016 - protein, 360 aa, Pseudomonas syringae; identical to SEQ ID NO: 1478

SEQ ID NO: 22017 - DNA, 1077 bp, Pseudomonas syringae; identical to SEQ ID NO: 1479
  CDS (1)..(1077)

SEQ ID NO: 22018 - protein, 358 aa, Pseudomonas syringae; identical to SEQ ID NO: 1480

SEQ ID NO: 22019 - DNA, 1062 bp, Pseudomonas putida; identical to SEQ ID NO: 1481
  CDS (1)..(1062)

SEQ ID NO: 22020 - protein, 353 aa, Pseudomonas putida; identical to SEQ ID NO: 1482

SEQ ID NO: 22021 - DNA, 1113 bp, Pseudomonas putida; identical to SEQ ID NO: 1483
  CDS (1)..(1113)

SEQ ID NO: 22022 - protein, 370 aa, Pseudomonas putida; identical to SEQ ID NO: 1484

SEQ ID NO: 22023 - DNA, 1086 bp, Bradyrhizobium japonicum; identical to SEQ ID NO: 1485
  CDS (1)..(1086)

SEQ ID NO: 22024 - protein, 361 aa, Bradyrhizobium japonicum; identical to SEQ ID NO: 1486

SEQ ID NO: 22025 - DNA, 1077 bp, Yersinia pestis; identical to SEQ ID NO: 1489
  CDS (1)..(1077)

SEQ ID NO: 22026 - protein, 358 aa, Yersinia pestis; identical to SEQ ID NO: 1490

SEQ ID NO: 22027 - DNA, 1038 bp, Wigglesworthia glossinidia brevipalpis; identical to SEQ ID NO: 1491
  CDS (1)..(1038)

SEQ ID NO: 22028 - protein, 345 aa, Wigglesworthia glossinidia brevipalpis; identical to SEQ ID NO: 1492

SEQ ID NO: 22029 - DNA, 1071 bp, Vibrio vulnificus; identical to SEQ ID NO: 1739
  CDS (1)..(1071)

SEQ ID NO: 22030 - protein, 356 aa, Vibrio vulnificus; identical to SEQ ID NO: 1740

SEQ ID NO: 22031 - DNA, 1053 bp, Vibrio vulnificus; identical to SEQ ID NO: 1495
  CDS (1)..(1053)

SEQ ID NO: 22032 - protein, 350 aa, Vibrio vulnificus; identical to SEQ ID NO: 1496

SEQ ID NO: 22033 - DNA, 1071 bp, Vibrio vulnificus; identical to SEQ ID NO: 1497
  CDS (1)..(1071)

SEQ ID NO: 22034 - protein, 356 aa, Vibrio vulnificus; identical to SEQ ID NO: 1498

SEQ ID NO: 22035 - DNA, 1062 bp, Synechococcus elongatus; identical to SEQ ID NO: 1499
  CDS (1)..(1062)

SEQ ID NO: 22036 - protein, 353 aa, Synechococcus elongatus; identical to SEQ ID NO: 1500

SEQ ID NO: 22037 - DNA, 1032 bp, Streptococcus mutans; identical to SEQ ID NO: 1501
  CDS (1)..(1032)

SEQ ID NO: 22038 - protein, 343 aa, Streptococcus mutans; identical to SEQ ID NO: 1502

SEQ ID NO: 22039 - DNA, 1035 bp, Streptococcus mutans; identical to SEQ ID NO: 1503
  CDS (1)..(1035)

SEQ ID NO: 22040 - protein, 344 aa, Streptococcus mutans; identical to SEQ ID NO: 1504

SEQ ID NO: 22041 - DNA, 1008 bp, Streptococcus agalactiae; identical to SEQ ID NO: 1505
  CDS (1)..(1008)

SEQ ID NO: 22042 - protein, 335 aa, Streptococcus agalactiae; identical to SEQ ID NO: 1506

SEQ ID NO: 22043 - DNA, 1065 bp, Shewanella oneidensis; identical to SEQ ID NO: 1507
  CDS (1)..(1065)

SEQ ID NO: 22044 - protein, 354 aa, Shewanella oneidensis; identical to SEQ ID NO: 1508

SEQ ID NO: 22045 - DNA, 1092 bp, Shewanella oneidensis; identical to SEQ ID NO: 1509
  CDS (1)..(1092)

SEQ ID NO: 22046 - protein, 363 aa, Shewanella oneidensis; identical to SEQ ID NO: 1510

SEQ ID NO: 22047 - DNA, 1059 bp, Shewanella oneidensis; identical to SEQ ID NO: 1511
  CDS (1)..(1059)

SEQ ID NO: 22048 - protein, 352 aa, Shewanella oneidensis; identical to SEQ ID NO: 1512

SEQ ID NO: 22049 - DNA, 1053 bp, Escherichia coli O6; identical to SEQ ID NO: 1513
  CDS (1)..(1053)

SEQ ID NO: 22050 - protein, 350 aa, Escherichia coli O6; identical to SEQ ID NO: 1514

SEQ ID NO: 22051 - DNA, 1170 bp, Corynebacterium efficiens; identical to SEQ ID NO: 1515
  CDS (1)..(1170)

SEQ ID NO: 22052 - protein, 389 aa, Corynebacterium efficiens; identical to SEQ ID NO: 1516

SEQ ID NO: 22053 - DNA, 1134 bp, Bifidobacterium longum; identical to SEQ ID NO: 1517
  CDS (1)..(1134)

SEQ ID NO: 22054 - protein, 377 aa, Bifidobacterium longum; identical to SEQ ID NO: 1518

SEQ ID NO: 22055 - DNA, 1233 bp, Bifidobacterium longum; identical to SEQ ID NO: 1519
  CDS (1)..(1233)

SEQ ID NO: 22056 - protein, 410 aa, Bifidobacterium longum; identical to SEQ ID NO: 1520

SEQ ID NO: 22057 - DNA, 1221 bp, Phytophthora infestans; identical to SEQ ID NO: 1521
  CDS (20)..(1153)

SEQ ID NO: 22058 - protein, 377 aa, Phytophthora infestans; identical to SEQ ID NO: 1522

SEQ ID NO: 22059 - DNA, 1062 bp, Chlorobium tepidum; identical to SEQ ID NO: 1523
  CDS (1)..(1062)

SEQ ID NO: 22060 - protein, 353 aa, Chlorobium tepidum; identical to SEQ ID NO: 1524

SEQ ID NO: 22061 - DNA, 1074 bp, Xanthomonas campestris; identical to SEQ ID NO: 1525
  CDS (1)..(1074)

SEQ ID NO: 22062 - protein, 357 aa, Xanthomonas campestris; identical to SEQ ID NO: 1526

SEQ ID NO: 22063 - DNA, 1074 bp, Xanthomonas axonopodis; identical to SEQ ID NO: 1527
  CDS (1)..(1074)

SEQ ID NO: 22064 - protein, 357 aa, Xanthomonas axonopodis; identical to SEQ ID NO: 1528

SEQ ID NO: 22065 - DNA, 1080 bp, Ralstonia solanacearum; identical to SEQ ID NO: 1529
  CDS (1)..(1080)

SEQ ID NO: 22066 - protein, 359 aa, Ralstonia solanacearum; identical to SEQ ID NO: 1530

SEQ ID NO: 22067 - DNA, 1179 bp, Ralstonia solanacearum; identical to SEQ ID NO: 1531
  CDS (1)..(1179)

SEQ ID NO: 22068 - protein, 392 aa, Ralstonia solanacearum; identical to SEQ ID NO: 1532

SEQ ID NO: 22069 - DNA, 1065 bp, Synechococcus sp; identical to SEQ ID NO: 1533
  CDS (1)..(1065)

SEQ ID NO: 22070 - protein, 354 aa, Synechococcus sp; identical to SEQ ID NO: 1534

SEQ ID NO: 22071 - DNA, 1035 bp, Escherichia coli; identical to SEQ ID NO: 1535
  CDS (1)..(1035)

SEQ ID NO: 22072 - protein, 344 aa, Escherichia coli; identical to SEQ ID NO: 1536

SEQ ID NO: 22073 - DNA, 1200 bp, Stigmatella aurantiaca; identical to SEQ ID NO: 1537
  CDS (62)..(1147)

SEQ ID NO: 22074 - protein, 361 aa, Stigmatella aurantiaca; identical to SEQ ID NO: 1538

SEQ ID NO: 22075 - DNA, 1092 bp, Rhizobium loti; identical to SEQ ID NO: 1539
  CDS (1)..(1092)

SEQ ID NO: 22076 - protein, 363 aa, Rhizobium loti; identical to SEQ ID NO: 1540

SEQ ID NO: 22077 - DNA, 1083 bp, Amycolatopsis mediterranei; identical to SEQ ID NO: 1541
  CDS (1)..(1083)

SEQ ID NO: 22078 - protein, 360 aa, Amycolatopsis mediterranei; identical to SEQ ID NO: 1542

SEQ ID NO: 22079 - DNA, 1053 bp, Pasteurella multocida; identical to SEQ ID NO: 1543
  CDS (1)..(1053)

SEQ ID NO: 22080 - protein, 350 aa, Pasteurella multocida; identical to SEQ ID NO: 1544

SEQ ID NO: 22081 - DNA, 1086 bp, Pasteurella multocida; identical to SEQ ID NO: 1545
  CDS (1)..(1086)

SEQ ID NO: 22082 - protein, 361 aa, Pasteurella multocida; identical to SEQ ID NO: 1546

SEQ ID NO: 22083 - DNA, 1089 bp, Emericella nidulans; identical to SEQ ID NO: 1549
  CDS (1)..(1089)

SEQ ID NO: 22084 - protein, 362 aa, Emericella nidulans; identical to SEQ ID NO: 1550

SEQ ID NO: 22085 - DNA, 1239 bp, Vibrio cholerae; identical to SEQ ID NO: 1551
  CDS (114)..(1175)

SEQ ID NO: 22086 - protein, 353 aa, Vibrio cholerae; identical to SEQ ID NO: 1552

SEQ ID NO: 22087 - DNA, 1113 bp, Candida albicans; identical to SEQ ID NO: 1797
  CDS (1)..(1113)

SEQ ID NO: 22088 - protein, 370 aa, Candida albicans; identical to SEQ ID NO: 1554

SEQ ID NO: 22089 - DNA, 1047 bp, Buchnera aphidicola; identical to SEQ ID NO: 1557
  CDS (1)..(1047)

SEQ ID NO: 22090 - protein, 348 aa, Buchnera aphidicola; identical to SEQ ID NO: 1558

SEQ ID NO: 22091 - DNA, 1047 bp, Erwinia herbicola; identical to SEQ ID NO: 1559
  CDS (1)..(1047)

SEQ ID NO: 22092 - protein, 348 aa, Erwinia herbicola; identical to SEQ ID NO: 1560

SEQ ID NO: 22093 - DNA, 23 bp, Artificial sequence
  (1)..(23): primer
atgcaaaaagacgcgctgaataa

SEQ ID NO: 22094 - DNA, 21 bp, Artificial sequence
  (1)..(21): primer
ttaagccacgcgagccgtcag

SEQ ID NO: 22095 - protein, 296 aa, Artificial sequence; identical to SEQ ID NO: 2896
  Variant (5)..(35): xaa in position 5 to 35 is any amino acid
  Variant (37)..(37): xaa in position 37 is any amino acid
  Variant (39)..(40): xaa in position 39 to 40 is any amino acid
  Variant (42)..(42): xaa in position 42 is any amino acid
  Variant (45)..(47): xaa in position 45 to 47 is any amino acid
  Variant (49)..(50): xaa in position 49 to 50 is any amino acid
  Variant (52)..(55): xaa in position 52 to 55 is any amino acid
  Variant (57)..(66): xaa in position 57 to 66 is any amino acid
  Variant (68)..(71): xaa in position 68 to 71 is any amino acid
  Variant (73)..(108): xaa in position 73 to 108 is any amino acid
  Variant (112)..(117): xaa in position 112 to 117 is any amino acid
  Variant (120)..(122): xaa in position 120 to 122 is any amino acid
  Variant (124)..(131): xaa in position 124 to 131 is any amino acid
  Variant (134)..(136): xaa in position 134 to 136 is any amino acid
  Variant (138)..(170): xaa in position 138 to 170 is any amino acid
  Variant (173)..(179): xaa in position 173 to 179 is any amino acid
  Variant (182)..(191): xaa in position 182 to 191 is any amino acid
  Variant (193)..(222): xaa in position 193 to 222 is any amino acid
  Variant (224)..(225): xaa in position 224 to 225 is any amino acid
  Variant (227)..(227): xaa in position 227 is any amino acid
  Variant (229)..(260): xaa in position 229 to 260 is any amino acid
  Variant (262)..(262): xaa in position 262 is any amino acid
  Variant (264)..(268): xaa in position 264 to 268 is any amino acid
  Variant (270)..(288): xaa in position 270 to 288 is any amino acid
  Variant (290)..(290): xaa in position 290 is any amino acid
  Variant (292)..(292): xaa in position 292 is any amino acid
  Variant (295)..(295): xaa in position 295 is any amino acid

SEQ ID NO: 22096 - protein, 352 aa, Artificial sequence; identical to SEQ ID NO: 2895
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(40): xaa in position 37 to 40 is any amino acid
  Variant (43)..(43): xaa in position 43 is any amino acid
  Variant (45)..(46): xaa in position 45 to 46 is any amino acid
  Variant (51)..(51): xaa in position 51 is any amino acid
  Variant (54)..(55): xaa in position 54 to 55 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(130): xaa in position 121 to 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(150): xaa in position 148 to 150 is any amino acid
  Variant (152)..(152): xaa in position 152 is any amino acid
  Variant (163)..(163): xaa in position 163 is any amino acid
  Variant (167)..(167): xaa in position 167 is any amino acid
  Variant (170)..(170): xaa in position 170 is any amino acid
  Variant (173)..(173): xaa in position 173 is any amino acid
  Variant (175)..(175): xaa in position 175 is any amino acid
  Variant (182)..(182): xaa in position 182 is any amino acid
  Variant (184)..(187): xaa in position 184 to 187 is any amino acid
  Variant (189)..(190): xaa in position 189 to 190 is any amino acid
  Variant (192)..(194): xaa in position 192 to 194 is any amino acid
  Variant (196)..(198): xaa in position 196 to 198 is any amino acid
  Variant (200)..(200): xaa in position 200 is any amino acid
  Variant (202)..(207): xaa in position 202 to 207 is any amino acid
  Variant (209)..(214): xaa in position 209 to 214 is any amino acid
  Variant (216)..(216): xaa in position 216 is any amino acid
  Variant (219)..(221): xaa in position 219 to 221 is any amino acid
  Variant (223)..(224): xaa in position 223 to 224 is any amino acid
  Variant (229)..(237): xaa in position 229 to 237 is any amino acid
  Variant (240)..(268): xaa in position 240 to 268 is any amino acid
  Variant (270)..(270): xaa in position 270 is any amino acid
  Variant (273)..(273): xaa in position 273 is any amino acid
  Variant (276)..(276): xaa in position 276 is any amino acid
  Variant (278)..(281): xaa in position 278 to 281 is any amino acid
  Variant (283)..(284): xaa in position 283 to 284 is any amino acid
  Variant (286)..(291): xaa in position 286 to 291 is any amino acid
  Variant (293)..(295): xaa in position 293 to 295 is any amino acid
  Variant (297)..(304): xaa in position 297 to 304 is any amino acid
  Variant (306)..(306): xaa in position 306 is any amino acid
  Variant (308)..(308): xaa in position 308 is any amino acid
  Variant (311)..(314): xaa in position 311 to 314 is any amino acid
  Variant (316)..(316): xaa in position 316 is any amino acid
  Variant (318)..(333): xaa in position 318 to 333 is any amino acid
  Variant (336)..(336): xaa in position 336 is any amino acid
  Variant (338)..(338): xaa in position 338 is any amino acid
  Variant (341)..(341): xaa in position 341 is any amino acid
  Variant (343)..(344): xaa in position 343 to 344 is any amino acid
  Variant (346)..(347): xaa in position 346 to 347 is any amino acid
  Variant (349)..(351): xaa in position 349 to 351 is any amino acid

SEQ ID NO: 22097 - protein, 26 aa, Artificial sequence
  Variant (1)..(1): xaa in position 1 is Asp or Asn
  Variant (2)..(2): xaa in position 2 is any amino acid
  Variant (4)..(4): xaa in position 4 is any amino acid
  Variant (5)..(5): xaa in position 5 is Leu, Val, Ile, Phe, Ala or Met
  Variant (6)..(6): xaa in position 6 is Val, Ile, Leu or Ala
  Variant (7)..(7): xaa in position 7 is Val or Ile
  Variant (8)..(8): xaa in position 8 is Val, Ile, Cys or Thr
  Variant (13)..(13): xaa in position 13 is Ile, Val, Ser or Leu
  Variant (14)..(14): xaa in position 14 is His or Asp
  Variant (15)..(15): xaa in position 15 is Asp or Asn
  Variant (16)..(18): xaa in position 16 to 18 is any amino acid
  Variant (19)..(19): xaa in position 19 is Ala, Val or Gly
  Variant (20)..(20): xaa in position 20 is any amino acid
  Variant (21)..(21): xaa in position 21 is Glu, Asp, Ala or Gln
  Variant (23)..(23): xaa in position 23 is Ala, Gly, Ser or Cys
  Variant (24)..(25): xaa in position 24 to 25 is any amino acid
  Variant (26)..(26): xaa in position 26 is Leu, Ile or Phe
XXRXXXXXGPCSXXXXXXXXXYXXXX

SEQ ID NO: 22098 - protein, 40 aa, Artificial sequence; identical to SEQ ID NO: 2890
  Variant (1)..(1): xaa in position 1 is Ile, Val, Leu or Met
  Variant (2)..(2): xaa in position 2 is Val, Ile or Leu
  Variant (5)..(5): xaa in position 5 is Val, Ala or Thr
  Variant (7)..(7): xaa in position 7 is Phe, Leu, Thr or Val
  Variant (8)..(8): xaa in position 8 is Glu, Ala or Gln
  Variant (13)..(14): xaa in position 13 to 14 is any amino acid
  Variant (15)..(15): xaa in position 15 is any or no amino acid
  Variant (17)..(17): xaa in position 17 is Trp or Tyr
  Variant (18)..(18): xaa in position 18 is Lys or Arg
  Variant (20)..(20): xaa in position 20 is Leu, Phe, Tyr or Met
  Variant (21)..(21): xaa in position 21 is Ile, Val, Ala or Leu
  Variant (22)..(22): xaa in position 22 is any amino acid
  Variant (23)..(23): xaa in position 23 is Asp, Glu or Gln
  Variant (25)..(25): xaa in position 25 is any amino acid
  Variant (26)..(26): xaa in position 26 is Leu, Met, Ile, Val, Ala or Thr
  Variant (27)..(27): xaa in position 27 is Asp, Asn or Ser
  Variant (28)..(31): xaa in position 28 to 31 is any amino acid
  Variant (32)..(32): xaa in position 32 is Ile, Val, Leu or Met
  Variant (33)..(34): xaa in position 33 to 34 is any amino acid
  Variant (36)..(36): xaa in position 36 is Leu, Ile, Met or Val
  Variant (37)..(38): xaa in position 37 to 38 is any amino acid
  Variant (39)..(39): xaa in position 39 is Ala, Ser, Gly, Val or Thr

SEQ ID NO: 22099 - protein, 58 aa, Artificial sequence; identical to SEQ ID NO: 2891
  Variant (1)..(1): xaa in position 1 is Tyr, Phe or Leu
  Variant (2)..(3): xaa in position 2 to 3 is any amino acid
  Variant (4)..(4): xaa in position 4 is Asp or Glu
  Variant (5)..(6): xaa in position 5 to 6 is any amino acid
  Variant (7)..(7): xaa in position 7 is Ser, Ala, Thr or Cys
  Variant (8)..(8): xaa in position 8 is Trp, Leu, Phe, Tyr or Val
  Variant (9)..(9): xaa in position 9 is any amino acid
  Variant (10)..(10): xaa in position 10 is Ala or Ser
  Variant (11)..(11): xaa in position 11 is Ile or Val
  Variant (15)..(15): xaa in position 15 is Thr, Ser or Asn
  Variant (16)..(16): xaa in position 16 is Thr, Val, Ala or Ser
  Variant (17)..(17): xaa in position 17 is Glu or Ala
  Variant (18)..(18): xaa in position 18 is Ser, Asp or Asn
  Variant (20)..(20): xaa in position 20 is any amino acid
  Variant (23)..(23): xaa in position 23 is Glu, Gln, Phe or Met
  Variant (24)..(24): xaa in position 24 is Leu, Met, Val or Ile
  Variant (25)..(25): xaa in position 25 is Ala, Ser, Thr, Cys or Val
  Variant (27)..(27): xaa in position 27 is Gly or Ala
  Variant (28)..(28): xaa in position 28 is Leu, Ile, Met or Val
  Variant (29)..(30): xaa in position 29 to 30 is any amino acid
  Variant (31)..(31): xaa in position 31 is Pro or Ala
  Variant (32)..(32): xaa in position 32 is Val, Ile or Thr
  Variant (34)..(34): xaa in position 34 is Phe, Met, Tyr or Ile
  Variant (37)..(37): xaa in position 37 is any amino acid
  Variant (38)..(38): xaa in position 38 is Thr or Arg
  Variant (39)..(39): xaa in position 39 is any amino acid
  Variant (41)..(41): xaa in position 41 is any amino acid
  Variant (42)..(42): xaa in position 42 is Leu, Ile, Val, Ala, Thr or Phe
  Variant (43)..(44): xaa in position 43 to 44 is any amino acid
  Variant (45)..(45): xaa in position 45 is Ala or Met
  Variant (46)..(46): xaa in position 46 is any amino acid
  Variant (47)..(47): xaa in position 47 is Asp, Asn or Glu
  Variant (48)..(48): xaa in position 48 is Ala or Gly
  Variant (49)..(50): xaa in position 49 to 50 is any amino acid
  Variant (51)..(51): xaa in position 51 is Ala or Ser
  Variant (52)..(52): xaa in position 52 is Ala, Ser, Val or Thr
  Variant (53)..(55): xaa in position 53 to 55 is any amino acid
  Variant (56)..(56): xaa in position 56 is His or Gln
  Variant (57)..(57): xaa in position 57 is any amino acid
  Variant (58)..(58): xaa in position 58 is Phe, Tyr, His or Val

SEQ ID NO: 22100 - protein, 25 aa, Artificial sequence
  Variant (1)..(1): xaa in position 1 is Thr or Ser
  Variant (2)..(2): xaa in position 2 is any amino acid
  Variant (5)..(7): xaa in position 5 to 7 is any amino acid
  Variant (8)..(8): xaa in position 8 is His or Phe
  Variant (9)..(9): xaa in position 9 is Val, Ile, Leu or Ala
  Variant (10)..(10): xaa in position 10 is Ile or Val
  Variant (11)..(11): xaa in position 11 is Leu or Met
  Variant (14)..(14): xaa in position 14 is Gly, Ser or Ala
  Variant (15)..(16): xaa in position 15 to 16 is any amino acid
  Variant (17)..(22): xaa in position 17 to 22 is any or no amino acid
  Variant (23)..(23): xaa in position 23 is Pro, Thr or Ser
  Variant (25)..(25): xaa in position 25 is Tyr, Phe or His
XXGNXXXXXXXRGXXXXXXXXXXNX

SEQ ID NO: 22101 - protein, 52 aa, Artificial sequence; identical to SEQ ID NO: 2893
  Variant (1)..(1): xaa in position 1 is Leu, Ile or Val
  Variant (2)..(2): xaa in position 2 is Met, Val, Ile or Leu
  Variant (3)..(3): xaa in position 3 is Ile or Val
  Variant (5)..(5): xaa in position 5 is any amino acid
  Variant (6)..(6): xaa in position 6 is Ser, Asn or Ala
  Variant (8)..(8): xaa in position 8 is Ala, Gly or Asp
  Variant (10)..(10): xaa in position 10 is Ser or Cys
  Variant (11)..(11): xaa in position 11 is any amino acid
  Variant (13)..(15): xaa in position 13 to 15 is any amino acid
  Variant (16)..(16): xaa in position 16 is Arg, Asn, Lys, Leu or Glu
  Variant (18)..(19): xaa in position 18 to 19 is any amino acid
  Variant (20)..(20): xaa in position 20 is Val or Ile
  Variant (21)..(23): xaa in position 21 to 23 is any amino acid
  Variant (24)..(24): xaa in position 24 is Val, Ile, Leu, Thr or Ala
  Variant (25)..(26): xaa in position 25 to 26 is any amino acid
  Variant (27)..(27): xaa in position 27 is Gln, Asn or Arg
  Variant (28)..(28): xaa in position 28 is Ile, Leu, Val, Arg or Met
  Variant (29)..(30): xaa in position 29 to 30 is any amino acid
  Variant (31)..(31): xaa in position 31 is Gly, Asn or Asp
  Variant (32)..(34): xaa in position 32 to 34 is any amino acid
  Variant (35)..(37): xaa in position 35 to 37 is any or no amino acid
  Variant (38)..(38): xaa in position 38 is Ile, Val or Leu
  Variant (39)..(39): xaa in position 39 is any amino acid
  Variant (41)..(41): xaa in position 41 is any amino acid
  Variant (43)..(43): xaa in position 43 is Ile, Leu, Val, Ala or Met
  Variant (46)..(46): xaa in position 46 is His, Phe, Asn or Tyr
  Variant (47)..(47): xaa in position 47 is Leu or Ile
  Variant (48)..(49): xaa in position 48 to 49 is any amino acid
  Variant (51)..(51): xaa in position 51 is any amino acid

SEQ ID NO: 22102 - protein, 19 aa, Artificial sequence
  Variant (1)..(1): xaa in position 1 is Tyr, Phe, Lys or Arg
  Variant (3)..(3): xaa in position 3 is any amino acid
  Variant (5)..(5): xaa in position 5 is Ile or Val
  Variant (8)..(8): xaa in position 8 is any amino acid
  Variant (10)..(10): xaa in position 10 is Ile, Leu or Val
  Variant (11)..(11): xaa in position 11 is any amino acid
  Variant (12)..(12): xaa in position 12 is Trp, Ile, Phe or Leu
  Variant (13)..(14): xaa in position 13 to 14 is any amino acid
  Variant (15)..(15): xaa in position 15 is Thr or Ser
  Variant (16)..(18): xaa in position 16 to 18 is any amino acid
  Variant (19)..(19): xaa in position 19 is Leu, Ile, Val or Phe
XGXSXTDXCXXXXXXXXXX

SEQ ID NO: 22103 - DNA, 2374 bp, Escherichia coli K12; identical to SEQ ID NO: 1805
  CDS (86)..(2281)

SEQ ID NO: 22104 - protein, 731 aa, Escherichia coli K12; identical to SEQ ID NO: 1806

SEQ ID NO: 22105 - DNA, 2961 bp, Hafnia alvei; identical to SEQ ID NO: 1807
  CDS (185)..(2404)

SEQ ID NO: 22106 - protein, 739 aa, Hafnia alvei; identical to SEQ ID NO: 1808

SEQ ID NO: 22107 - DNA, 4341 bp, Escherichia coli; identical to SEQ ID NO: 1809
  CDS (660)..(2858)

SEQ ID NO: 22108 - protein, 732 aa, Escherichia coli; identical to SEQ ID NO: 1810

SEQ ID NO: 22109 - DNA, 1850 bp, Bacillus subtilis; identical to SEQ ID NO: 1811
  CDS (312)..(1784)

SEQ ID NO: 22110 - protein, 490 aa, Bacillus subtilis; identical to SEQ ID NO: 1812

SEQ ID NO: 22111 - DNA, 3091 bp, Lactobacillus sp; identical to SEQ ID NO: 1813
  CDS (572)..(2767)

SEQ ID NO: 22112 - protein, 731 aa, Lactobacillus sp; identical to SEQ ID NO: 1814

SEQ ID NO: 22113 - DNA, 1449 bp, Bacillus halodurans; identical to SEQ ID NO: 1815
  CDS (1)..(1449)

SEQ ID NO: 22114 - protein, 482 aa, Bacillus halodurans; identical to SEQ ID NO: 1816

SEQ ID NO: 22115 - DNA, 2196 bp, Sinorhizobium meliloti; identical to SEQ ID NO: 1817
  CDS (1)..(2196)

SEQ ID NO: 22116 - protein, 731 aa, Sinorhizobium meliloti; identical to SEQ ID NO: 1818

SEQ ID NO: 22117 - DNA, 1380 bp, Listeria innocua; identical to SEQ ID NO: 1819
  CDS (1)..(1380)

SEQ ID NO: 22118 - protein, 459 aa, Listeria innocua; identical to SEQ ID NO: 1820

SEQ ID NO: 22119 - DNA, 2307 bp, Yersinia pestis; identical to SEQ ID NO: 1821
  CDS (1)..(2307)

SEQ ID NO: 22120 - protein, 768 aa, Yersinia pestis; identical to SEQ ID NO: 1822

SEQ ID NO: 22121 - DNA, 2145 bp, Salmonella enterica subsp. enterica serovar Typhi; identical to SEQ ID NO: 1823
  CDS (1)..(2145)

SEQ ID NO: 22122 - protein, 714 aa, Salmonella enterica subsp. enterica serovar Typhi; identical to SEQ ID NO: 1824

SEQ ID NO: 22123 - DNA, 1467 bp, Nostoc sp. PCC 7120; identical to SEQ ID NO: 1825
  CDS (1)..(1467)

SEQ ID NO: 22124 - protein, 488 aa, Nostoc sp. PCC 7120; identical to SEQ ID NO: 1826

SEQ ID NO: 22125 - DNA, 2163 bp, Yersinia pestis; identical to SEQ ID NO: 1827
  CDS (1)..(2163)

SEQ ID NO: 22126 - protein, 720 aa, Yersinia pestis; identical to SEQ ID NO: 1828

SEQ ID NO: 22127 - DNA, 2271 bp, Salmonella enterica subsp. enterica serovar Typhi; identical to SEQ ID NO: 1829
  CDS (1)..(2271)

SEQ ID NO: 22128 - protein, 756 aa, Salmonella enterica subsp. enterica serovar Typhi; identical to SEQ ID NO: 1830

SEQ ID NO: 22129 - DNA, 2148 bp, Escherichia coli; identical to SEQ ID NO: 1831
  CDS (1)..(2148)

SEQ ID NO: 22130 - protein, 715 aa, Escherichia coli; identical to SEQ ID NO: 1832

SEQ ID NO: 22131 - DNA, 2835 bp, Escherichia coli; identical to SEQ ID NO: 1833
  CDS (571)..(2712)

SEQ ID NO: 22132 - protein, 713 aa, Escherichia coli; identical to SEQ ID NO: 1834

SEQ ID NO: 22133 - DNA, 1446 bp, Clostridium acetobutylicum; identical to SEQ ID NO: 1835
  CDS (1)..(1446)

SEQ ID NO: 22134 - protein, 481 aa, Clostridium acetobutylicum; identical to SEQ ID NO: 1836

SEQ ID NO: 22135 - DNA, 1464 bp, Clostridium acetobutylicum; identical to SEQ ID NO: 1837
  CDS (1)..(1464)

SEQ ID NO: 22136 - protein, 487 aa, Clostridium acetobutylicum; identical to SEQ ID NO: 1838

SEQ ID NO: 22137 - DNA, 2256 bp, Pseudomonas aeruginosa; identical to SEQ ID NO: 1839
  CDS (1)..(2256)

SEQ ID NO: 22138 - protein, 751 aa, Pseudomonas aeruginosa; identical to SEQ ID NO: 1840

SEQ ID NO: 22139 - DNA, 2853 bp, Mycobacterium leprae; identical to SEQ ID NO: 1841
  CDS (1)..(2853)

SEQ ID NO: 22140 - protein, 950 aa, Mycobacterium leprae; identical to SEQ ID NO: 1842

SEQ ID NO: 22141 - DNA, 2202 bp, Vibrio cholerae; identical to SEQ ID NO: 1843
  CDS (1)..(2202)

SEQ ID NO: 22142 - protein, 733 aa, Vibrio cholerae; identical to SEQ ID NO: 1844

SEQ ID NO: 22143 - DNA, 2163 bp, Vibrio cholerae; identical to SEQ ID NO: 1845
  CDS (1)..(2163)

SEQ ID NO: 22144 - protein, 720 aa, Vibrio cholerae; identical to SEQ ID NO: 1846

SEQ ID NO: 22145 - DNA, 2163 bp, Haemophilus influenzae; identical to SEQ ID NO: 1847
  CDS (1)..(2163)

SEQ ID NO: 22146 - protein, 720 aa, Haemophilus influenzae; identical to SEQ ID NO: 1848

SEQ ID NO: 22147 - DNA, 2844 bp, Mycobacterium tuberculosis; identical to SEQ ID NO: 1849
  CDS (1)..(2844)

SEQ ID NO: 22148 - protein, 947 aa, Mycobacterium tuberculosis; identical to SEQ ID NO: 1850

SEQ ID NO: 22149 - DNA, 1476 bp, Streptococcus pneumoniae; identical to SEQ ID NO: 1851
  CDS (1)..(1476)

SEQ ID NO: 22150 - protein, 491 aa, Streptococcus pneumoniae; identical to SEQ ID NO: 1852

SEQ ID NO: 22151 - DNA, 1476 bp, Bacillus halodurans; identical to SEQ ID NO: 1853
  CDS (1)..(1476)

SEQ ID NO: 22152 - protein, 491 aa, Bacillus halodurans; identical to SEQ ID NO: 1854

SEQ ID NO: 22153 - DNA, 2349 bp, Sinorhizobium meliloti; identical to SEQ ID NO: 1855
  CDS (1)..(2349)

SEQ ID NO: 22154 - protein, 782 aa, Sinorhizobium meliloti; identical to SEQ ID NO: 1856

SEQ ID NO: 22155 - DNA, 1476 bp, Streptococcus pneumoniae; identical to SEQ ID NO: 1857
  CDS (1)..(1476)

SEQ ID NO: 22156 - protein, 491 aa, Streptococcus pneumoniae; identical to SEQ ID NO: 1858

SEQ ID NO: 22157 - DNA, 2271 bp, Escherichia coli; identical to SEQ ID NO: 1859
  CDS (1)..(2271)

SEQ ID NO: 22158 - protein, 756 aa, Escherichia coli; identical to SEQ ID NO: 1860

SEQ ID NO: 22159 - DNA, 1443 bp, Bacillus subtilis; identical to SEQ ID NO: 1861
  CDS (1)..(1443)

SEQ ID NO: 22160 - protein, 480 aa, Bacillus subtilis; identical to SEQ ID NO: 1862

SEQ ID NO: 22161 - DNA, 1452 bp, Synechocystis sp; identical to SEQ ID NO: 1863
  CDS (1)..(1452)

SEQ ID NO: 22162 - protein, 483 aa, Synechocystis sp; identical to SEQ ID NO: 1864

SEQ ID NO: 22163 - DNA, 2307 bp, Yersinia pseudotuberculosis IP 32953; identical to SEQ ID NO: 1865
  CDS (1)..(2307)

SEQ ID NO: 22164 - protein, 768 aa, Yersinia pseudotuberculosis IP 32953; identical to SEQ ID NO: 1866

SEQ ID NO: 22165 - DNA, 1467 bp, Symbiobacterium thermophilum; identical to SEQ ID NO: 1867
  CDS (1)..(1467)

SEQ ID NO: 22166 - protein, 488 aa, Symbiobacterium thermophilum; identical to SEQ ID NO: 1868

SEQ ID NO: 22167 - DNA, 1410 bp, Symbiobacterium thermophilum; identical to SEQ ID NO: 1869
  CDS (1)..(1410)

SEQ ID NO: 22168 - protein, 469 aa, Symbiobacterium thermophilum; identical to SEQ ID NO: 1870

SEQ ID NO: 22169 - DNA, 2154 bp, Erwinia carotovora; identical to SEQ ID NO: 1871
  CDS (1)..(2154)

SEQ ID NO: 22170 - protein, 717 aa, Erwinia carotovora; identical to SEQ ID NO: 1872

SEQ ID NO: 22171 - DNA, 2790 bp, Acinetobacter sp; identical to SEQ ID NO: 1873
  CDS (1)..(2790)

SEQ ID NO: 22172 - protein, 929 aa, Acinetobacter sp; identical to SEQ ID NO: 1874

SEQ ID NO: 22173 - DNA, 1482 bp, Bacillus thuringiensis; identical to SEQ ID NO: 1875
  CDS (1)..(1482)

SEQ ID NO: 22174 - protein, 493 aa, Bacillus thuringiensis; identical to SEQ ID NO: 1876

SEQ ID NO: 22175 - DNA, 1422 bp, Bacillus thuringiensis; identical to SEQ ID NO: 1877
  CDS (1)..(1422)

SEQ ID NO: 22176 - protein, 473 aa, Bacillus thuringiensis; identical to SEQ ID NO: 1878

SEQ ID NO: 22177 - DNA, 2358 bp, Rhodopseudomonas palustris; identical to SEQ ID NO: 1879
  CDS (1)..(2358)

SEQ ID NO: 22178 - protein, 785 aa, Rhodopseudomonas palustris; identical to SEQ ID NO: 1880

SEQ ID NO: 22179 - DNA, 2837 bp, Shigella boydii; identical to SEQ ID NO: 1881
  CDS (165)..(2435)

SEQ ID NO: 22180 - protein, 756 aa, Shigella boydii; identical to SEQ ID NO: 1882

SEQ ID NO: 22181 - DNA, 1380 bp, Listeria monocytogenes; identical to SEQ ID NO: 1883
  CDS (1)..(1380)

SEQ ID NO: 22182 - protein, 459 aa, Listeria monocytogenes; identical to SEQ ID NO: 1884

SEQ ID NO: 22183 - DNA, 1482 bp, Bacillus cereus; identical to SEQ ID NO: 1885
  CDS (1)..(1482)

SEQ ID NO: 22184 - protein, 493 aa, Bacillus cereus; identical to SEQ ID NO: 1886

SEQ ID NO: 22185 - DNA, 1422 bp, Bacillus cereus; identical to SEQ ID NO: 1887
  CDS (1)..(1422)

SEQ ID NO: 22186 - protein, 473 aa, Bacillus cereus; identical to SEQ ID NO: 1888

SEQ ID NO: 22187 - DNA, 1458 bp, Mycobacterium paratuberculosis; identical to SEQ ID NO: 1889
  CDS (1)..(1458)

SEQ ID NO: 22188 - protein, 485 aa, Mycobacterium paratuberculosis; identical to SEQ ID NO: 1890

SEQ ID NO: 22189 - DNA, 2853 bp, Mycobacterium paratuberculosis; identical to SEQ ID NO: 1891
  CDS (1)..(2853)

SEQ ID NO: 22190 - protein, 950 aa, Mycobacterium paratuberculosis; identical to SEQ ID NO: 1892

SEQ ID NO: 22191 - DNA, 2100 bp, Lactobacillus johnsonii; identical to SEQ ID NO: 1893
  CDS (1)..(2100)

SEQ ID NO: 22192 - protein, 699 aa, Lactobacillus johnsonii; identical to SEQ ID NO: 1894

SEQ ID NO: 22193 - DNA, 3625 bp, Vibrio parahaemolyticus; identical to SEQ ID NO: 1895
  CDS (1451)..(3625)

SEQ ID NO: 22194 - protein, 724 aa, Vibrio parahaemolyticus; identical to SEQ ID NO: 1896

SEQ ID NO: 22195 - DNA, 2142 bp, Shigella flexneri; identical to SEQ ID NO: 1897
  CDS (1)..(2142)

SEQ ID NO: 22196 - protein, 713 aa, Shigella flexneri; identical to SEQ ID NO: 1898

SEQ ID NO: 22197 - DNA, 2181 bp, Vibrio vulnificus; identical to SEQ ID NO: 1899
  CDS (1)..(2181)

SEQ ID NO: 22198 - protein, 726 aa, Vibrio vulnificus; identical to SEQ ID NO: 1900

SEQ ID NO: 22199 - DNA, 2307 bp, Photorhabdus luminescens; identical to SEQ ID NO: 1901
  CDS (1)..(2307)

SEQ ID NO: 22200 - protein, 768 aa, Photorhabdus luminescens; identical to SEQ ID NO: 1902

SEQ ID NO: 22201 - DNA, 1404 bp, Gloeobacter violaceus; identical to SEQ ID NO: 1903
  CDS (1)..(1404)

SEQ ID NO: 22202 - protein, 467 aa, Gloeobacter violaceus; identical to SEQ ID NO: 1904

SEQ ID NO: 22203 - DNA, 2259 bp, Chromobacterium violaceum; identical to SEQ ID NO: 1905
  CDS (1)..(2259)

SEQ ID NO: 22204 - protein, 752 aa, Chromobacterium violaceum; identical to SEQ ID NO: 1906

SEQ ID NO: 22205 - DNA, 1251 bp, Chromobacterium violaceum; identical to SEQ ID NO: 1907
  CDS (1)..(1251)

SEQ ID NO: 22206 - protein, 416 aa, Chromobacterium violaceum; identical to SEQ ID NO: 1908

SEQ ID NO: 22207 - DNA, 2352 bp, Fusobacterium nucleatum subsp; identical to SEQ ID NO: 1909
  CDS (1)..(2352)

SEQ ID NO: 22208 - protein, 783 aa, Fusobacterium nucleatum subsp; identical to SEQ ID NO: 1910

SEQ ID NO: 22209 - DNA, 2196 bp, Shigella flexneri; identical to SEQ ID NO: 1911
  CDS (1)..(2196)

SEQ ID NO: 22210 - protein, 731 aa, Shigella flexneri; identical to SEQ ID NO: 1912

SEQ ID NO: 22211 - DNA, 2271 bp, Bordetella pertussis; identical to SEQ ID NO: 1913
  CDS (1)..(2271)

SEQ ID NO: 22212 - protein, 756 aa, Bordetella pertussis; identical to SEQ ID NO: 1914

SEQ ID NO: 22213 - DNA, 2271 bp, Bordetella parapertussis; identical to SEQ ID NO: 1915
  CDS (1)..(2271)

SEQ ID NO: 22214 - protein, 756 aa, Bordetella parapertussis; identical to SEQ ID NO: 1916

SEQ ID NO: 22215 - DNA, 1422 bp, Bacillus cereus; identical to SEQ ID NO: 1917
  CDS (1)..(1422)

SEQ ID NO: 22216 - protein, 473 aa, Bacillus cereus; identical to SEQ ID NO: 1918

SEQ ID NO: 22217 - DNA, 1422 bp, Bacillus anthracis; identical to SEQ ID NO: 1919
  CDS (1)..(1422)

SEQ ID NO: 22218 - protein, 473 aa, Bacillus anthracis; identical to SEQ ID NO: 1920

SEQ ID NO: 22219 - DNA, 2271 bp, Shigella flexneri; identical to SEQ ID NO: 1921
  CDS (1)..(2271)

SEQ ID NO: 22220 - protein, 756 aa, Shigella flexneri; identical to SEQ ID NO: 1922

SEQ ID NO: 22221 - DNA, 2136 bp, Shigella flexneri; identical to SEQ ID NO: 1923
  CDS (1)..(2136)

SEQ ID NO: 22222 - protein, 711 aa, Shigella flexneri; identical to SEQ ID NO: 1924

SEQ ID NO: 22223 - DNA, 2127 bp, Escherichia coli; identical to SEQ ID NO: 1925
  CDS (1)..(2127)

SEQ ID NO: 22224 - protein, 708 aa, Escherichia coli; identical to SEQ ID NO: 1926

SEQ ID NO: 22225 - DNA, 1563 bp, Oryza sativa; identical to SEQ ID NO: 1927
  CDS (1)..(1563)

SEQ ID NO: 22226 - protein, 520 aa, Oryza sativa; identical to SEQ ID NO: 1928

SEQ ID NO: 22227 - DNA, 2181 bp, Vibrio parahaemolyticus; identical to SEQ ID NO: 1929
  CDS (1)..(2181)

SEQ ID NO: 22228 - protein, 726 aa, Vibrio parahaemolyticus; identical to SEQ ID NO: 1930

SEQ ID NO: 22229 - DNA, 4026 bp, Vibrio parahaemolyticus; identical to SEQ ID NO: 1931
  CDS (1779)..(3914)

SEQ ID NO: 22230 - protein, 711 aa, Vibrio parahaemolyticus; identical to SEQ ID NO: 1932

SEQ ID NO: 22231 - DNA, 1461 bp, Clostridium tetani; identical to SEQ ID NO: 1933
  CDS (1)..(1461)

SEQ ID NO: 22232 - protein, 486 aa, Clostridium tetani; identical to SEQ ID NO: 1934

SEQ ID NO: 22233 - DNA, 1416 bp, Clostridium tetani; identical to SEQ ID NO: 1935
  CDS (1)..(1416)

SEQ ID NO: 22234 - protein, 471 aa, Clostridium tetani; identical to SEQ ID NO: 1936

SEQ ID NO: 22235 - DNA, 2766 bp, Bradyrhizobium japonicum; identical to SEQ ID NO: 1937
  CDS (1)..(2766)

SEQ ID NO: 22236 - protein, 921 aa, Bradyrhizobium japonicum; identical to SEQ ID NO: 1938

SEQ ID NO: 22237 - DNA, 2517 bp, Bradyrhizobium japonicum; identical to SEQ ID NO: 1939
  CDS (1)..(2517)

SEQ ID NO: 22238 - protein, 838 aa, Bradyrhizobium japonicum; identical to SEQ ID NO: 1940

SEQ ID NO: 22239 - DNA, 2181 bp, Vibrio vulnificus; identical to SEQ ID NO: 1941
  CDS (1)..(2181)

SEQ ID NO: 22240 - protein, 726 aa, Vibrio vulnificus; identical to SEQ ID NO: 1942

SEQ ID NO: 22241 - DNA, 2109 bp, Vibrio vulnificus; identical to SEQ ID NO: 1943
  CDS (1)..(2109)

SEQ ID NO: 22242 - protein, 702 aa, Vibrio vulnificus; identical to SEQ ID NO: 1944

SEQ ID NO: 22243 - DNA, 2163 bp, Shewanella oneidensis; identical to SEQ ID NO: 1945
  CDS (1)..(2163)

SEQ ID NO: 22244 - protein, 720 aa, Shewanella oneidensis; identical to SEQ ID NO: 1946

SEQ ID NO: 22245 - DNA, 1419 bp, Oceanobacillus iheyensis; identical to SEQ ID NO: 1947
  CDS (1)..(1419)

SEQ ID NO: 22246 - protein, 472 aa, Oceanobacillus iheyensis; identical to SEQ ID NO: 1948

SEQ ID NO: 22247 - DNA, 2154 bp, Escherichia coli O6; identical to SEQ ID NO: 1949
  CDS (1)..(2154)

SEQ ID NO: 22248 - protein, 717 aa, Escherichia coli O6; identical to SEQ ID NO: 1950

SEQ ID NO: 22249 - DNA, 2271 bp, Escherichia coli O6; identical to SEQ ID NO: 1951
  CDS (1)..(2271)

SEQ ID NO: 22250 - protein, 756 aa, Escherichia coli O6; identical to SEQ ID NO: 1952

SEQ ID NO: 22251 - DNA, 2370 bp, Escherichia coli O6; identical to SEQ ID NO: 1953
  CDS (1)..(2370)

SEQ ID NO: 22252 - protein, 789 aa, Escherichia coli O6; identical to SEQ ID NO: 1954

SEQ ID NO: 22253 - DNA, 2136 bp, Escherichia coli O6; identical to SEQ ID NO: 1955
  CDS (1)..(2136)

SEQ ID NO: 22254 - protein, 711 aa, Escherichia coli O6; identical to SEQ ID NO: 1956

SEQ ID NO: 22255 - DNA, 2208 bp, Escherichia coli O6; identical to SEQ ID NO: 1957
  CDS (1)..(2208)

SEQ ID NO: 22256 - protein, 735 aa, Escherichia coli O6; identical to SEQ ID NO: 1958

SEQ ID NO: 22257 - DNA, 2142 bp, Escherichia coli O6; identical to SEQ ID NO: 1959
  CDS (1)..(2142)

SEQ ID NO: 22258 - protein, 713 aa, Escherichia coli O6; identical to SEQ ID NO: 1960

SEQ ID NO: 22259 - DNA, 1488 bp, Thermoanaerobacter tengcongensis; identical to SEQ ID NO: 1961
  CDS (1)..(1488)

SEQ ID NO: 22260 - protein, 495 aa, Thermoanaerobacter tengcongensis; identical to SEQ ID NO: 1962

SEQ ID NO: 22261 - DNA, 1419 bp, Thermoanaerobacter tengcongensis; identical to SEQ ID NO: 1963
  CDS (1)..(1419)

SEQ ID NO: 22262 - protein, 472 aa, Thermoanaerobacter tengcongensis; identical to SEQ ID NO: 1964

SEQ ID NO: 22263 - DNA, 2352 bp, Fusobacterium nucleatum; identical to SEQ ID NO: 1965
  CDS (1)..(2352)

SEQ ID NO: 22264 - protein, 783 aa, Fusobacterium nucleatum; identical to SEQ ID NO: 1966

SEQ ID NO: 22265 - DNA, 1431 bp, Clostridium perfringens; identical to SEQ ID NO: 1967
  CDS (1)..(1431)

SEQ ID NO: 22266 - protein, 476 aa, Clostridium perfringens; identical to SEQ ID NO: 1968

SEQ ID NO: 22267 - DNA, 1455 bp, Clostridium perfringens; identical to SEQ ID NO: 1969
  CDS (1)..(1455)

SEQ ID NO: 22268 - protein, 484 aa, Clostridium perfringens; identical to SEQ ID NO: 1970

SEQ ID NO: 22269 - DNA, 2280 bp, Ralstonia solanacearum; identical to SEQ ID NO: 1971
  CDS (1)..(2280)

SEQ ID NO: 22270 - protein, 759 aa, Ralstonia solanacearum; identical to SEQ ID NO: 1972

SEQ ID NO: 22271 - DNA, 2271 bp, Salmonella typhimurium; identical to SEQ ID NO: 1973
  CDS (1)..(2271)

SEQ ID NO: 22272 - protein, 756 aa, Salmonella typhimurium; identical to SEQ ID NO: 1974

SEQ ID NO: 22273 - DNA, 2136 bp, Salmonella typhimurium; identical to SEQ ID NO: 1975
  CDS (1)..(2136)

SEQ ID NO: 22274 - protein, 711 aa, Salmonella typhimurium; identical to SEQ ID NO: 1976

SEQ ID NO: 22275 - DNA, 2199 bp, Salmonella typhimurium; identical to SEQ ID NO: 1977
  CDS (1)..(2199)

SEQ ID NO: 22276 - protein, 732 aa, Salmonella typhimurium; identical to SEQ ID NO: 1978

SEQ ID NO: 22277 - DNA, 2142 bp, Salmonella typhimurium; identical to SEQ ID NO: 1979
  CDS (1)..(2142)

SEQ ID NO: 22278 - protein, 713 aa, Salmonella typhimurium; identical to SEQ ID NO: 1980

SEQ ID NO: 22279 - DNA, 2136 bp, Vibrio vulnificus; identical to SEQ ID NO: 1981
  CDS (1)..(2136)

SEQ ID NO: 22280 - protein, 711 aa, Vibrio vulnificus; identical to SEQ ID NO: 1982

SEQ ID NO: 22281 - DNA, 2163 bp, Pasteurella multocida; identical to SEQ ID NO: 1983
  CDS (1)..(2163)

SEQ ID NO: 22282 - protein, 720 aa, Pasteurella multocida; identical to SEQ ID NO: 1984

SEQ ID NO: 22283 - DNA, 2139 bp, Moritella japonica; identical to SEQ ID NO: 1985
  CDS (1)..(2139)

SEQ ID NO: 22284 - protein, 712 aa, Moritella japonica; identical to SEQ ID NO: 1986

SEQ ID NO: 22285 - DNA, 1479 bp, Streptomyces coelicolor; identical to SEQ ID NO: 1987
  CDS (1)..(1479)

SEQ ID NO: 22286 - protein, 492 aa, Streptomyces coelicolor; identical to SEQ ID NO: 1988

SEQ ID NO: 22287 - DNA, 2130 bp, Eikenella corrodens; identical to SEQ ID NO: 1989
  CDS (1)..(2130)

SEQ ID NO: 22288 - protein, 709 aa, Eikenella corrodens; identical to SEQ ID NO: 1990

SEQ ID NO: 22289 - DNA, 2271 bp, Escherichia coli; identical to SEQ ID NO: 1859
  CDS (4)..(2271)

SEQ ID NO: 22290 - protein, 755 aa, Escherichia coli; identical to SEQ ID NO: 1992

SEQ ID NO: 22291 - DNA, 2196 bp, Lactobacillus sp; identical to SEQ ID NO: 1993
  CDS (1)..(2196)

SEQ ID NO: 22292 - protein, 731 aa, Lactobacillus sp; identical to SEQ ID NO: 1814

SEQ ID NO: 22293 - DNA, 1482 bp, Bacillus anthracis; identical to SEQ ID NO: 1995
  CDS (1)..(1482)

SEQ ID NO: 22294 - protein, 493 aa, Bacillus anthracis; identical to SEQ ID NO: 1996

SEQ ID NO: 22295 - DNA, 1383 bp, Bacillus cereus; identical to SEQ ID NO: 1997
  CDS (1)..(1383)

SEQ ID NO: 22296 - protein, 460 aa, Bacillus cereus; identical to SEQ ID NO: 1998

SEQ ID NO: 22297 - DNA, 20 bp, Artificial sequence
  (1)..(20): primer
atggggcagggttttccacc

SEQ ID NO: 22298 - DNA, 25 bp, Artificial sequence
  (1)..(25): primer
ttacttcaacacataaccgtacaac

SEQ ID NO: 22299 - protein, 642 aa, Artificial sequence; identical to SEQ ID NO: 2902
  Variant (2)..(5): xaa in position 2 to 5 is any amino acid
  Variant (7)..(58): xaa in position 7 to 58 is any amino acid
  Variant (60)..(61): xaa in position 60 to 61 is any amino acid
  Variant (63)..(66): xaa in position 63 to 66 is any amino acid
  Variant (68)..(71): xaa in position 68 to 71 is any amino acid
  Variant (73)..(76): xaa in position 73 to 76 is any amino acid
  Variant (78)..(90): xaa in position 78 to 90 is any amino acid
  Variant (92)..(92): xaa in position 92 is any amino acid
  Variant (94)..(113): xaa in position 94 to 113 is any amino acid
  Variant (116)..(116): xaa in position 116 is any amino acid
  Variant (120)..(131): xaa in position 120 to 131 is any amino acid
  Variant (133)..(188): xaa in position 133 to 188 is any amino acid
  Variant (191)..(191): xaa in position 191 is any amino acid
  Variant (193)..(215): xaa in position 193 to 215 is any amino acid
  Variant (217)..(217): xaa in position 217 is any amino acid
  Variant (219)..(224): xaa in position 219 to 224 is any amino acid
  Variant (226)..(290): xaa in position 226 to 290 is any amino acid
  Variant (292)..(292): xaa in position 292 is any amino acid
  Variant (295)..(300): xaa in position 295 to 300 is any amino acid
  Variant (302)..(302): xaa in position 302 is any amino acid
  Variant (304)..(305): xaa in position 304 to 305 is any amino acid
  Variant (307)..(333): xaa in position 307 to 333 is any amino acid
  Variant (337)..(337): xaa in position 337 is any amino acid
  Variant (339)..(341): xaa in position 339 to 341 is any amino acid
  Variant (343)..(355): xaa in position 343 to 355 is any amino acid
  Variant (357)..(370): xaa in position 357 to 370 is any amino acid
  Variant (372)..(457): xaa in position 372 to 457 is any amino acid
  Variant (460)..(460): xaa in position 460 is any amino acid
  Variant (462)..(494): xaa in position 462 to 494 is any amino acid
  Variant (496)..(497): xaa in position 496 to 497 is any amino acid
  Variant (499)..(505): xaa in position 499 to 505 is any amino acid
  Variant (507)..(520): xaa in position 507 to 520 is any amino acid
  Variant (522)..(524): xaa in position 522 to 524 is any amino acid
  Variant (526)..(620): xaa in position 526 to 620 is any amino acid
  Variant (622)..(624): xaa in position 622 to 624 is any amino acid
  Variant (626)..(630): xaa in position 626 to 630 is any amino acid
  Variant (635)..(640): xaa in position 635 to 640 is any amino acid

SEQ ID NO: 22300 - protein, 101 aa, Artificial sequence; identical to SEQ ID NO: 1322
  Variant (2)..(23): xaa in position 2 to 23 is any amino acid
  Variant (24)..(30): xaa in position 24 to 30 is any or no amino acid
  Variant (32)..(32): xaa in position 32 is any amino acid
  Variant (37)..(39): xaa in position 37 to 39 is any amino acid
  Variant (41)..(55): xaa in position 41 to 55 is any amino acid
  Variant (56)..(57): xaa in position 56 to 57 is any or no amino acid
  Variant (59)..(62): xaa in position 59 to 62 is any amino acid
  Variant (64)..(64): xaa in position 64 is any amino acid
  Variant (67)..(70): xaa in position 67 to 70 is any amino acid
  Variant (72)..(72): xaa in position 72 is any amino acid
  Variant (75)..(77): xaa in position 75 to 77 is any amino acid
  Variant (79)..(85): xaa in position 79 to 85 is any amino acid
  Variant (87)..(90): xaa in position 87 to 90 is any amino acid
  Variant (92)..(93): xaa in position 92 to 93 is any amino acid
  Variant (97)..(97): xaa in position 97 is any amino acid
  Variant (100)..(100): xaa in position 100 is any amino acid

SEQ ID NO: 22301 - protein, 76 aa, Artificial sequence; identical to SEQ ID NO: 2897
  Variant (1)..(1): xaa in position 1 is Leu, Met or Val
  Variant (2)..(2): xaa in position 2 is Gly or Asp
  Variant (3)..(3): xaa in position 3 is Asp, Ser, Asn, Gln or Gly
  Variant (4)..(4): xaa in position 4 is Leu or Arg
  Variant (5)..(6): xaa in position 5 to 6 is any amino acid
  Variant (7)..(7): xaa in position 7 is His or Pro
  Variant (8)..(8): xaa in position 8 is any amino acid
  Variant (9)..(9): xaa in position 9 is Gly, Ser, Glu or Asp
  Variant (10)..(13): xaa in position 10 to 13 is any amino acid
  Variant (14)..(14): xaa in position 14 is Ala or Ser
  Variant (15)..(15): xaa in position 15 is Gln, Glu or Met
  Variant (16)..(18): xaa in position 16 to 18 is any amino acid
  Variant (19)..(19): xaa in position 19 is Ala or Ser
  Variant (20)..(21): xaa in position 20 to 21 is any amino acid
  Variant (22)..(22): xaa in position 22 is Phe, Tyr, Trp or Val
  Variant (23)..(23): xaa in position 23 is any amino acid
  Variant (24)..(24): xaa in position 24 is Ala, Ser or Val
  Variant (25)..(27): xaa in position 25 to 27 is any amino acid
  Variant (28)..(28): xaa in position 28 is Tyr, Phe or Trp
  Variant (29)..(30): xaa in position 29 to 30 is any amino acid
  Variant (31)..(31): xaa in position 31 is Val, Thr, Leu or Ile
  Variant (32)..(32): xaa in position 32 is any amino acid
  Variant (34)..(34): xaa in position 34 is Thr or Ser
  Variant (35)..(35): xaa in position 35 is Ser or Thr
  Variant (36)..(36): xaa in position 36 is any amino acid
  Variant (37)..(37): xaa in position 37 is Ser, Ala or Gly
  Variant (38)..(38): xaa in position 38 is Asn, Ile, Val or Ser
  Variant (39)..(51): xaa in position 39 to 51 is any amino acid
  Variant (52)..(52): xaa in position 52 is Val, Ile, Leu or Ala
  Variant (53)..(53): xaa in position 53 is Leu, Ile, Val or Met
  Variant (54)..(55): xaa in position 54 to 55 is any amino acid
  Variant (57)..(57): xaa in position 57 is Asn or Asp
  Variant (58)..(58): xaa in position 58 is any amino acid
  Variant (60)..(60): xaa in position 60 is Lys, Gln or Arg
  Variant (61)..(61): xaa in position 61 is Ser or Ala
  Variant (62)..(65): xaa in position 62 to 65 is any amino acid
  Variant (66)..(66): xaa in position 66 is any or no amino acid
  Variant (67)..(67): xaa in position 67 is Leu, Ile, Met or Val
  Variant (68)..(73): xaa in position 68 to 73 is any amino acid
  Variant (74)..(74): xaa in position 74 is Pro or Ala
  Variant (75)..(75): xaa in position 75 is any amino acid
  Variant (76)..(76): xaa in position 76 is Tyr, Phe or Trp

SEQ ID NO: 22302 - protein, 39 aa, Artificial sequence; identical to SEQ ID NO: 2898
  Variant (1)..(1): xaa in position 1 is Val, Ile, Leu, Phe or Thr
  Variant (2)..(2): xaa in position 2 is Ile, Val, Leu, Phe or Ala
  Variant (3)..(5): xaa in position 3 to 5 is any amino acid
  Variant (6)..(6): xaa in position 6 is Thr, Asn or Ser
  Variant (7)..(7): xaa in position 7 is Tyr, Phe or Pro
  Variant (8)..(8): xaa in position 8 is Asp, Tyr, Phe or His
  Variant (10)..(12): xaa in position 10 to 12 is any amino acid
  Variant (13)..(13): xaa in position 13 is Asn, Asp or Ser
  Variant (14)..(25): xaa in position 14 to 25 is any amino acid
  Variant (26)..(29): xaa in position 26 to 29 is any or no amino acid
  Variant (30)..(30): xaa in position 30 is Ile, Val, Leu or Phe
  Variant (31)..(31): xaa in position 31 is any amino acid
  Variant (32)..(32): xaa in position 32 is Phe, Val, Trp or Ile
  Variant (34)..(34): xaa in position 34 is Glu, Ser or Cys
  Variant (36)..(36): xaa in position 36 is Trp or His
  Variant (37)..(37): xaa in position 37 is any amino acid
  Variant (38)..(38): xaa in position 38 is Ala, Gly, Pro or Val
  Variant (39)..(39): xaa in position 39 is Tyr, His or Phe

SEQ ID NO: 22303 - protein, 84 aa, Artificial sequence; identical to SEQ ID NO: 2899
  Variant (1)..(1): xaa in position 1 is Ser or Leu
  Variant (2)..(2): xaa in position 2 is any amino acid
  Variant (5)..(7): xaa in position 5 to 7 is any amino acid
  Variant (8)..(8): xaa in position 8 is Ala, Gly or Ser
  Variant (9)..(9): xaa in position 9 is Leu, Phe, Met or Ile
  Variant (10)..(10): xaa in position 10 is Ser, Thr, Arg or Glu
  Variant (11)..(11): xaa in position 11 is Gln or Met
  Variant (12)..(12): xaa in position 12 is any amino acid
  Variant (13)..(13): xaa in position 13 is Ser or Ala
  Variant (14)..(14): xaa in position 14 is any amino acid
  Variant (15)..(15): xaa in position 15 is Ile, Leu, Met, Val or Phe
  Variant (16)..(16): xaa in position 16 is His, Asn, Leu or Ile
  Variant (17)..(25): xaa in position 17 to 25 is any amino acid
  Variant (26)..(33): xaa in position 26 to 33 is any or no amino acid
  Variant (34)..(34): xaa in position 34 is Phe, Val, Leu, Met or Ile
  Variant (35)..(42): xaa in position 35 to 42 is any amino acid
  Variant (43)..(43): xaa in position 43 is Ser or Thr
  Variant (44)..(44): xaa in position 44 is Thr or Ser
  Variant (46)..(47): xaa in position 46 to 47 is any amino acid
  Variant (48)..(48): xaa in position 48 is Tyr, Gln or Val
  Variant (49)..(49): xaa in position 49 is any amino acid
  Variant (50)..(50): xaa in position 50 is Leu, Ile, Phe or Met
  Variant (51)..(51): xaa in position 51 is any amino acid
  Variant (52)..(52): xaa in position 52 is Ala or Ser
  Variant (53)..(53): xaa in position 53 is Ser, Ala or Thr
  Variant (54)..(54): xaa in position 54 is any amino acid
  Variant (55)..(55): xaa in position 55 is Asp or Glu
  Variant (56)..(63): xaa in position 56 to 63 is any amino acid
  Variant (64)..(65): xaa in position 64 to 65 is any or no amino acid
  Variant (66)..(66): xaa in position 66 is Gly, Ala, Lys or Asn
  Variant (67)..(73): xaa in position 67 to 73 is any amino acid
  Variant (74)..(74): xaa in position 74 is Ile, Val, Leu, Tyr or Phe
  Variant (75)..(80): xaa in position 75 to 80 is any amino acid
  Variant (81)..(81): xaa in position 81 is Arg or Lys
  Variant (82)..(83): xaa in position 82 to 83 is any amino acid
  Variant (84)..(84): xaa in position 84 is Ile, Leu, Val, Met, Phe, Ala or Thr

SEQ ID NO: 22304 - protein, 31 aa, Artificial sequence; identical to SEQ ID NO: 2900
  Variant (1)..(1): xaa in position 1 is Val, Ile, Leu, Cys or Arg
  Variant (2)..(5): xaa in position 2 to 5 is any amino acid
  Variant (6)..(9): xaa in position 6 to 9 is any or no amino acid
  Variant (10)..(10): xaa in position 10 is Gly, Thr, Asp or Asn
  Variant (11)..(11): xaa in position 11 is any amino acid
  Variant (12)..(12): xaa in position 12 is Ile, Val or Thr
  Variant (13)..(13): xaa in position 13 is any amino acid
  Variant (14)..(14): xaa in position 14 is Ala, Gly, Thr or Leu
  Variant (15)..(16): xaa in position 15 to 16 is any amino acid
  Variant (17)..(17): xaa in position 17 is Val, Ile, Ala, Leu or Phe
  Variant (18)..(19): xaa in position 18 to 19 is any amino acid
  Variant (24)..(24): xaa in position 24 is Ile, Val or Phe
  Variant (25)..(26): xaa in position 25 to 26 is any amino acid
  Variant (27)..(27): xaa in position 27 is Val, Leu, Ile, Phe or Met
  Variant (28)..(29): xaa in position 28 to 29 is any amino acid
  Variant (31)..(31): xaa in position 31 is Glu or Gln

SEQ ID NO: 22305 - DNA, 819 bp, Escherichia coli K12
  CDS (1)..(819)
atggaaacctatgctgtttttggtaatccgatagcccacagcaaatcgccattcattcatcagcaatttgctcagcaactgaatattgaacatccctatgggcgcgtgttggcacccatcaatgatttcatcaacacactgaacgctttctttagtgctggtggtaaaggtgcgaatgtgacggtgccttttaaagaagaggcttttgccagagcggatgagcttactgaacgggcagcgttggctggtgctgttaataccctcatgcggttagaagatggacgcctgctgggtgacaataccgatggtgtaggcttgttaagcgatctggaacgtctgtcttttatccgccctggtttacgtattctgcttatcggcgctggtggagcatctcgcggcgtactactgccactcctttccctggactgtgcggtgacaataactaatcggacggtatcccgcgcggaagagttggctaaattgtttgcgcacactggcagtattcaggcgttgagtatggacgaactggaaggtcatgagtttgatctcattattaatgcaacatccagtggcatcagtggtgatattccggcgatcccgtcatcgctcattcatccaggcatttattgctatgacatgttctatcagaaaggaaaaactccttttctggcatggtgtgagcagcgaggctcaaagcgtaatgctgatggtttaggaatgctggtggcacaggcggctcatgcctttcttctctggcacggtgttctgcctgacgtagaaccagttataaagcaattgcaggaggaattgtccgcgtga

SEQ ID NO: 22306 - protein, 272 aa, Escherichia coli K12
METYAVFGNPIAHSKSPFIHQQFAQQLNIEHPYGRVLAPINDFINTLNAFFSAGGKGANVTVPFKEEAFARADELTERAALAGAVNTLMRLEDGRLLGDNTDGVGLLSDLERLSFIRPGLRILLIGAGGASRGVLLPLLSLDCAVTITNRTVSRAEELAKLFAHTGSIQALSMDELEGHEFDLIINATSSGISGDIPAIPSSLIHPGIYCYDMFYQKGKTPFLAWCEQRGSKRNADGLGMLVAQAAHAFLLWHGVLPDVEPVIKQLQEELSA

SEQ ID NO: 22307 - DNA, 792 bp, Helicobacter pylori
  CDS (1)..(792)
atgaaattaaaatcttttggggtttttggaaatcccattaagcattccaaatcgcccttaatccataacgcttgttttttaacttttcaaaaagaattaaggtttttggggcattaccaccccatattactccctttagaaagccacatcaaaagcgagtttttgcatttgggattgagtggggctaatgtaaccttaccctttaaagaaagggcgtttcaagtttgcgataaaatcaaaggtatcgcgcttgaatgcggagcggtcaatacgcttgttttagaaaatgatgagcttgtgggttacaataccgacgctttagggttttatctttctttaaagcaaaaaaactatcaaaacgctttgattttaggagctggggggagcgctaaagccctagcgtgtgaattgaaaaaacaaggcttacaagtgagcgtgttgaaccgctcttctaggggattggattttttccaacgcctgggctgtgattgttttatggagcctcctaaaagcgcttttgatttgattattaacgccacttcagcgagtttgcataacgaattgcctttgaataaagaggttttgaaagggtattttaaagagggcaagctcgcttatgatttggcgtatgggtttttaacgccctttttgtctttagccaaagagttaaaaaccccttttcaagacggaaaagacatgctcatctatcaagctgctttaagttttgaaaaattcagcgcttctcaaatcccttattcaaaagcgtttgaagtcatgcgaagtgttttttga

SEQ ID NO: 22308 - protein, 263 aa, Helicobacter pylori
MKLKSFGVFGNPIKHSKSPLIHNACFLTFQKELRFLGHYHPILLPLESHIKSEFLHLGLSGANVTLPFKERAFQVCDKIKGIALECGAVNTLVLENDELVGYNTDALGFYLSLKQKNYQNALILGAGGSAKALACELKKQGLQVSVLNRSSRGLDFFQRLGCDCFMEPPKSAFDLIINATSASLHNELPLNKEVLKGYFKEGKLAYDLAYGFLTPFLSLAKELKTPFQDGKDMLIYQAALSFEKFSASQIPYSKAFEVMRSVF

SEQ ID NO: 22309 - DNA, 843 bp, Bacillus subtilis
  CDS (1)..(843)
atgaaaaagctgtacggggttatcggaaatcctattggccattctatgtcacctgatattcataacgcatcattgaaagacctcgggcttgacggacattatcatgccttcaaggtagaagagaatgatctggaggatgcggtaaaaggaataagagctctaggcgtacaaggaatcaatgtgactgttccgcacaaggtttccattatggattatttggatcatattgatgagagtgcaaaagtgctcggtgccgtaaacacggtcagaagagagggagataagcttgtcggatacaataccgatggggaaggcttcgtgaagtcattaatgaaggtattagacaagcccatctctgaactgtcattcttaatgatcggcgctggcggagcggcgagagccatttttacaacatttgtccgaaataccccgaaaaaatttgacatttgcaaccggacgttagaaaaagcaaagcggcttacagaagctactccctcgtttcacaataaagaagtattaagcataaaagaagcagaagaacgtcttgagcagtatgatgttatcatccatacaacgtctgtgggcatgtatccgaacgtggacgatgtgccgctttcattacagcgtgccgcgagcagtgccgtcgtatgtgatatcgtgtataatccaatacagacggcacttttaaaagaagcaagccaaaaaggcttgaaaacactcgatggtgtgggcatgtttgttgaacaggcagcattgtctttccaattgtggactggacaagagcctaatattgaaaaaatgagatctattgtaataggaaaattaggaggaacagaatgttaa

SEQ ID NO: 22310 - protein, 280 aa, Bacillus subtilis
MKKLYGVIGNPIGHSMSPDIHNASLKDLGLDGHYHAFKVEENDLEDAVKGIRALGVQGINVTVPHKVSIMDYLDHIDESAKVLGAVNTVRREGDKLVGYNTDGEGFVKSLMKVLDKPISELSFLMIGAGGAARAIFTTFVRNTPKKFDICNRTLEKAKRLTEATPSFHNKEVLSIKEAEERLEQYDVIIHTTSVGMYPNVDDVPLSLQRAASSAVVCDIVYNPIQTALLKEASQKGLKTLDGVGMFVEQAALSFQLWTGQEPNIEKMRSIVIGKLGGTEC

SEQ ID NO: 22311 - DNA, 801 bp, Helicobacter pylori
  CDS (1)..(801)
atgaaattaaaatcttttggggtttttgggaatcccattaaacattccaaatcgcccttaatccataacgcttgttttttaacttttcaaaaagaattagggtttttggggcattaccaccccatattactccctttagaaagccgtatcaaaaacgagtttttacatttgggattgagtggggctaatgtaaccctaccctttaaagaaagggcgtttcaaatttgcgacaaaatcaaaggtatcgcgcttgaatgcgcttcagtcaatacgcttgttttagaaaatgatgagcttgtgggttacaataccgacgctttagggttttacctctctttaaaacaccaaaactaccaaaacgaccaaaacgctttgattttaggcgctggggggagtgctaaagccctagcgtgcggattacaaaaacaaggcttaaaagtgagcgtgttaaaccgctctgctaggggattggattttttccaacgcttgggctgtgattgttttatggagcctcctaaaagcgcttttgatttgatcattaacgccacttcagcgagtttgcataacgaattgcctttaaataaagaggttttgaaagggtattttaaagagagcaagctcgcttatgatttggcgtatgggtttttaacgccctttttgtctctggctaaagagttaaaaatcccctttcaagacgggaaagacatgctcatctatcaagcctctttaagttttgaaaaattcagcgattctcaaattccttattcaaaagcgtttgaagtcatgcgaagtgttttttga

SEQ ID NO: 22312 - protein, 266 aa, Helicobacter pylori
MKLKSFGVFGNPIKHSKSPLIHNACFLTFQKELGFLGHYHPILLPLESRIKNEFLHLGLSGANVTLPFKERAFQICDKIKGIALECASVNTLVLENDELVGYNTDALGFYLSLKHQNYQNDQNALILGAGGSAKALACGLQKQGLKVSVLNRSARGLDFFQRLGCDCFMEPPKSAFDLIINATSASLHNELPLNKEVLKGYFKESKLAYDLAYGFLTPFLSLAKELKIPFQDGKDMLIYQASLSFEKFSDSQIPYSKAFEVMRSVF

SEQ ID NO: 22313 - DNA, 855 bp, Streptococcus pneumoniae
  CDS (1)..(855)
atgaagcttgatggctatacacgtttagctgcagttgttgccaatcctattaagcattctatttctcccttcatccacaatagagcctttgaggcgacagctaccaacggtgcttatgtggcttgggagattgaagcgagtgacttggtagaaacagtggccaatattcgtcgctaccagatgtttggcatcaatctgtccatgccctataaggagcaggtgattccttatttggataagctgagcgatgaagcgcgcttgattggtgcggttaatacggttgtcaatgagaatggcaatttaattggatataatacagatggcaagggattttttaagtgcttgccttcttttacaatttcaggtaaaaagatgaccctgctgggtgcaggtggtgcggctaaatcaatcttggcacaggctattttggatggcgtcagtcagatttcggtctttgttcgttccgtttctatggaaaaaacaagaccttacctagacaagttacaggagcagacaggttttaaagtggatttgtgtgctttagaatatgtttctgaactgcaagcaaggattgccgagtcggatttgctagttaatgccaccagtgtgggcatggatggccaatcctctcctgttcctgaaaacatagtcttaccagaaactcttttagttgcagatatcatataccaaccctttgaaacaccgtttttgaaatgggctagaagtcagggcaatccagcagtcaatggtctgggaatgttactctatcaagctgcagaagcttttcaactgtggacaggcaaggaaatgccgacagaagagatttggcagtctttaacagaaaaataccaataa

SEQ ID NO: 22314 - protein, 284 aa, Streptococcus pneumoniae
MKLDGYTRLAAVVANPIKHSISPFIHNRAFEATATNGAYVAWEIEASDLVETVANIRRYQMFGINLSMPYKEQVIPYLDKLSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQGNPAVNGLGMLLYQAAEAFQLWTGKEMPTEEIWQSLTEKYQ

SEQ ID NO: 22315 - DNA, 870 bp, Nostoc sp. PCC 7120
  CDS (1)..(870)
atgattacaggcaaaactaaactattaggggtaattggacatccggtggaacattcgctctcaccagtgatgcacaatgcagcgatcgctcaattaggattagattatgtatatctgccttttcctatagcaccagataatttagaagcagcgatcgctcttttggctactattggtgttgttggttttagtgtgaccattcctcacaaacaagcaatcatccccctgctttccgaaattagcccagttgctcaagctataggcgcggtaaatactgtcacccgtcaaaataatcaatgggtggggacaaacacagatatagaagggtttattgcccctttgcagacaacatataaacgagattggagtcagcaaatcgccgtaattttaggtaatggtggcgctgcgagagctgttgttgctggttgttatcaactgggttttgcggaaattcatgtggtggggcgcaatgtgcaacgcttagaagaatttcgccacagttgggaaaattcccccattgctgagaatttacaagtgcatacctgggattatctagcaaagctcatccctcaagctaacttactggtgaacacaaccccgatagggatgtatccgcaggttgatgagtcgcctttgagtgcagaggaactggtgaatttacaaactggtactattgcctatgatttgatatatattcccaaaccaacgcaatttctccaaaaagcccaacaacaaggcgcaattattatcgacggcttagaaatgttagttcagcaaggtgtagctgctttaaaaatttggttgcagcaggacgatattcctgtagatgtcatgcgtcaagctttaattaagcacttaggtctaaagtga

SEQ ID NO: 22316 - protein, 289 aa, Nostoc sp. PCC 7120
MITGKTKLLGVIGHPVEHSLSPVMHNAAIAQLGLDYVYLPFPIAPDNLEAAIALLATIGVVGFSVTIPHKQAIIPLLSEISPVAQAIGAVNTVTRQNNQWVGTNTDIEGFIAPLQTTYKRDWSQQIAVILGNGGAARAVVAGCYQLGFAEIHVVGRNVQRLEEFRHSWENSPIAENLQVHTWDYLAKLIPQANLLVNTTPIGMYPQVDESPLSAEELVNLQTGTIAYDLIYIPKPTQFLQKAQQQGAIIIDGLEMLVQQGVAALKIWLQQDDIPVDVMRQALIKHLGLK

SEQ ID NO: 22317 - DNA, 849 bp, Agrobacterium tumefaciens
  CDS (1)..(849)
atgccccatgactttctcgccgagataaccggctccttcgccatgccggccggagagaacccgacggtcgccatgatcgaggctgcctatcagcatcacggcctgaactggcgttatatcaatctggaggtcagccccgaaaacctgaaggatgccgtggcgggtgcacgtgcgatgggctgggccgggttcaactgctccattccccacaaggtcgcggtcatccagcatctcgacggcctgggggaatccgccgagatcatcggcgccgtcaacaccatcgtccggcggggcgacaggctgatcggcgaaaacaccgatggcaagggtttcgtcaaggcgcttcgcgacgtcatcgacccgaaggacaagaaggtcgtgctgttcggcgccggcggcgcggcgcgcgcggtgtgtgtcgaggtggcactcgccggtgccgcgcatatcaccgtggtcaaccgcaaccgggaacgtggtgaaaccgtggcgcggctgattgacgaaaagacgccggccaccgccaccttcgccgcatgggaagacgccttcgccattcccgaagagacggatatcgtcattcacgccacctcggtaggcctttatcctgatatagacggcttgcccgacatcgatctgaagacgctgcgtccctccatggtcgttgccgacggcatccataatccgccgcgcacgcggctgatccgtgccgcagaggccgcgggcagcaagacggccgatggtctcggcatgctggtcaatcagggcgtcataggcatcaaatattggaccggggtcgatgttgacgcctatgtaatgcggcaggccctcgtcgatctcaatctctaa

SEQ ID NO: 22318 - protein, 282 aa, Agrobacterium tumefaciens
MPHDFLAEITGSFAMPAGENPTVAMIEAAYQHHGLNWRYINLEVSPENLKDAVAGARAMGWAGFNCSIPHKVAVIQHLDGLGESAEIIGAVNTIVRRGDRLIGENTDGKGFVKALRDVIDPKDKKVVLFGAGGAARAVCVEVALAGAAHITVVNRNRERGETVARLIDEKTPATATFAAWEDAFAIPEETDIVIHATSVGLYPDIDGLPDIDLKTLRPSMVVADGIHNPPRTRLIRAAEAAGSKTADGLGMLVNQGVIGIKYWTGVDVDAYVMRQALVDLNL

SEQ ID NO: 22319 - DNA, 870 bp, Listeria monocytogenes
  CDS (1)..(870)
atggaaaatagaatttcaggaacgactaggcttcttggcttaattgggacacccatagaccattcaaaatctccaatcatgtataattacagttttcaaaaagcgggtttggattatgcttacctagcctttgacacacctatccaaaaagttgcagatactattaaggcaatcaagacatttaatcttcgtggtgcaaatgtaaccatgccttgtaaaagtgaagttttaaaacacatggatgacctttcccctgccgcacggatgattggcgctgttaacactatcgtaaatgaagacgggaaactaactgggcatatcacagacggccttggttttattgcaaatttgcgagatgctagtgtagatgttgccggcaaaaaaatgactataattggtgctggtggcgcggctacagcaatccaagtccagtgtgcacttgatggggccaaggaaatcaccatttttaatattaaagacgctttttatgacaaagcgaaacaaaccgttgcttctattaaacaagaagtcccaaattgcatcgtacatatttatgatttgaacgatacagaaaaactaaatgcagaaattaccactagcgatatccttgttaatgcaacactcgttggtatgcatccgaatgaacatgaaacacctattagcgatacatccgtttttagaaaagaacttatcgttgcagatattatttataatcctaaaaaaacgcaacttctactagatgctgaagctgctggttgtaagactgtaggcgggttaggaatgcttttgtggcaaggcgctgaagcatacaaattgtttactggtaaagatatgccagtttcagaagtaaaagatctatatttcaactaa

SEQ ID NO: 22320 - protein, 289 aa, Listeria monocytogenes
MENRISGTTRLLGLIGTPIDHSKSPIMYNYSFQKAGLDYAYLAFDTPIQKVADTIKAIKTFNLRGANVTMPCKSEVLKHMDDLSPAARMIGAVNTIVNEDGKLTGHITDGLGFIANLRDASVDVAGKKMTIIGAGGAATAIQVQCALDGAKEITIFNIKDAFYDKAKQTVASIKQEVPNCIVHIYDLNDTEKLNAEITTSDILVNATLVGMHPNEHETPISDTSVFRKELIVADIIYNPKKTQLLLDAEAAGCKTVGGLGMLLWQGAEAYKLFTGKDMPVSEVKDLYFN

SEQ ID NO: 22321 - DNA, 822 bp, Listeria innocua
  CDS (1)..(822)
atggaaaaatatgttgttatcggaaatcctattcgtcactcgttatcaccagctatgcaaaatcggattttccaagaacttggaatgaacgcggagtataactctgttttgatagaagaagatacttttgagacagaaataaaaaaattaatggattctggagtgcgcggatttaatatcacgacaccatttaaagagcgtattctaccatttttagatgaattagaggatttggcagcagcatcaggcgcagtgaatacagtgcttagaaaagatggcaagtggtatggcttcaacacagatggcaaaggttatttagaaggcttagaagaaattcgttcaattacaaaagacgattctattttaatcacaggagcaggtggagctagtaaagcaatttatcttgcacttaaaagccatactgaggcgaaaataaccgttgccaatcgaacaacggaaaaagcgatagaaatgacgaaagataatgataatcatcatgccatgacactagaacaagctgaaaaagaactggctgattttacaattattatccaaactacttctatcggtctagaagcttctaagaataaaagcccaatttcgctttctaatttaacaaaaggaacaatttgttctgatattatttataatccagccgaaacagcctttttaaaagaagcaaagaaaaatggggctattacacaaaatggtttaccaatgtttgttaatcaaggggcactagcctttgaaatatggactggcattaagccagagcgatcaatgatgaaagaagcagtactcgaacaattaggaggaaactaa

SEQ ID NO: 22322 - protein, 273 aa, Listeria innocua
MEKYVVIGNPIRHSLSPAMQNRIFQELGMNAEYNSVLIEEDTFETEIKKLMDSGVRGFNITTPFKERILPFLDELEDLAAASGAVNTVLRKDGKWYGFNTDGKGYLEGLEEIRSITKDDSILITGAGGASKAIYLALKSHTEAKITVANRTTEKAIEMTKDNDNHHAMTLEQAEKELADFTIIIQTTSIGLEASKNKSPISLSNLTKGTICSDIIYNPAETAFLKEAKKNGAITQNGLPMFVNQGALAFEIWTGIKPERSMMKEAVLEQLGGN

SEQ ID NO: 22323 - DNA, 861 bp, Agrobacterium tumefaciens
  CDS (1)..(861)
atggctgattcacgtgaaacattaactataaatgccttcgttgtcggttacccgatcaaacattcccggtcgccgatcatccattcctattggctgaaaaaattcggtatcgccggttcctatacggcagttgaggtctccccagacgatttcccgaagttcattgcaacgctgaaggaaggcaagccgggtgcagcggtgggcggtaacgccaccattccgcacaaggaagcggcttaccggttggccgatcatcccgatgccttggcggaagaactcggcgccgccaacaccatctggatggaggagggtaaactccacgcgaccaacacggatggttacggtttcgtctcgaacctggacgagcggcatccgggctgggataagacccagcgcgcggtggtgttcggcgccggcggtgcaagccgggccgtcattcagtcgctgcgtgatcgggatgttgcggaaattcacgtcgtgaaccgtacggtcgagcgcgctcgcgaactggccgaccgctttggcccacgggtcttttcccatccccaggcagcgcttcaggaggtcatgcacggcgcggggttgttcgtgaatacgacatcgctcggaatgaatggaaccgaagcgccgcatcttgatttttcgcatctcgcggccaatgcggtggtgaccgatatcgtctacgtgccgttgaaaacgccgatcctcaacatggcgcaagagcagggcatcgcaaccgtcgatgggctcggcatgttgcttcatcaggcaaaacctggtttcaggcgatggttcggcaggattccggaggtggatgaaacccttcgttccctgatcatcgcggatatggagaaacattga

SEQ ID NO: 22324 - protein, 286 aa, Agrobacterium tumefaciens
MADSRETLTINAFVVGYPIKHSRSPIIHSYWLKKFGIAGSYTAVEVSPDDFPKFIATLKEGKPGAAVGGNATIPHKEAAYRLADHPDALAEELGAANTIWMEEGKLHATNTDGYGFVSNLDERHPGWDKTQRAVVFGAGGASRAVIQSLRDRDVAEIHVVNRTVERARELADRFGPRVFSHPQAALQEVMHGAGLFVNTTSLGMNGTEAPHLDFSHLAANAVVTDIVYVPLKTPILNMAQEQGIATVDGLGMLLHQAKPGFRRWFGRIPEVDETLRSLIIADMEKH

SEQ ID NO: 22325 - DNA, 870 bp, Brucella melitensis
  CDS (1)..(870)
atggatgacaaaagcatggccagggggcgaaaggctttcgttaccggatttccgatcaggcattcgcgttcgccgctgatccacggtttctggttgaaggaactgggcattgacgggtcttatgaggctgtggaagtcaagccggaagatttctcctcttttgcagcttcgcttgccgcaaatggctttgcgggcggaaatgtcaccattccccacaaggaggcggcctatgccgctgctgaaagccttgatgaagcagcccgcgccatcggcgcggtcaacacactctggcttgaaaatggcaggctttgcggcggcaacaccgatgcctatggttttgccgccaatctggatgcttccgctcccggctgggacaaggctgatcgcgctttggttctgggtgccggcggggcaagccgggcggtggttcatgcgcttttgtcgcgcggcgtctgtcatgtttcggtggtgaaccgcacgttgagccgggcggaagaactggcggcgcatttcggcgcgcgcgtttacgcccatggctgggatgaggcgcaagctcttgtttccaatgctggtcttatcgtcaacacgaccgcgctcggcatgagcgggcatggcgagggacaggattttccgatcgaccttacatgcgcgccgaaagaggcggtggcgacagatatcgtctatgtgccgcttagaacagctttcctgaacaaagccgaaaaagccggtttgaagacagtggacgggcttggcatgttgctgcatcaggctgttccgggctttgaacgatggttcgggcaaaggccgcaggtgacgcaggcattgcgagagcatattctggcggatatggcgaaggctggtgcgctatga

SEQ ID NO: 22326 - protein, 289 aa, Brucella melitensis
MDDKSMARGRKAFVTGFPIRHSRSPLIHGFWLKELGIDGSYEAVEVKPEDFSSFAASLAANGFAGGNVTIPHKEAAYAAAESLDEAARAIGAVNTLWLENGRLCGGNTDAYGFAANLDASAPGWDKADRALVLGAGGASRAVVHALLSRGVCHVSVVNRTLSRAEELAAHFGARVYAHGWDEAQALVSNAGLIVNTTALGMSGHGEGQDFPIDLTCAPKEAVATDIVYVPLRTAFLNKAEKAGLKTVDGLGMLLHQAVPGFERWFGQRPQVTQALREHILADMAKAGAL

SEQ ID NO: 22327 - DNA, 876 bp, Listeria innocua
  CDS (1)..(876)
atgacaaacaaaatcactgaaagaatcacaggacacacagaattaatcgggttaatcgccactccaatcagacacagtttatcaccaacaatgcacaacgaagcttttgcaaaactagggcttgattatgtataccttgcttttgaagttggagacaaagaactgaaagatgttgtacaagggttccgagcaatgaacttacgcggctggaatgtttctatgccaaataaaacaaatatccataaatacttagataaactttctccagcggctgaacttgtaggggcagtaaacacagttgttaatgatgacggcgtgttaactggacacatcacggacggcactggctatatgcgtgcgttaaaagaagccggtcatgatattatcggtaaaaaaatgacaatttgtggtgctggtggtgccgcaacagctatctgcatccaagctgctctcgatggcgtgaaagaaatctcgattttcaacagaaaagacgatttttatgccaatgctgaaaaaacagtagaaaaaatcaatacaaaaacaaattgtaaagcacaattatttgatatggaagaccacgaacaattacgtaaagaaatcgcagaaagtgtgattttcacgaatgcgactggcgttgggatgaaacctttcgaaggcgaaacacttctaccaagtgcagatatgcttcgtccagaattaatcgtttcggatgttgtttacaaaccaactaaaacaagattgctggaaatcgctgaagaacaaggctgtcaaacacttaatggtctaggcatgatgctttggcaaggtgcgaaagctttcgaaatttggacacacaaagaaatgccagttgattacattaaagaaatcctattttaa

SEQ ID NO: 22328 - protein, 291 aa, Listeria innocua
MTNKITERITGHTELIGLIATPIRHSLSPTMHNEAFAKLGLDYVYLAFEVGDKELKDVVQGFRAMNLRGWNVSMPNKTNIHKYLDKLSPAAELVGAVNTVVNDDGVLTGHITDGTGYMRALKEAGHDIIGKKMTICGAGGAATAICIQAALDGVKEISIFNRKDDFYANAEKTVEKINTKTNCKAQLFDMEDHEQLRKEIAESVIFTNATGVGMKPFEGETLLPSADMLRPELIVSDVVYKPTKTRLLEIAEEQGCQTLNGLGMMLWQGAKAFEIWTHKEMPVDYIKEILF

SEQ ID NO: 22329 - DNA, 870 bp, Listeria innocua
  CDS (1)..(870)
atggaaaaaagaatttcaggatcaactcggcttctaagtttaattggtacacccgtagaccattcaaaatccccaatcatgtataattatagttttcaaaaagctggtttagattatgcgtatcttgcatttgatattcctgtaagtaaagtcgctgatgcaattgctgctatcaagacttttaacctgcgtggctctaacgtaaccatgccttgtaaaagtgaagttttaaaatacatggatgaactttcccctgctgcgcgaatgattggtgctgtaaataccattataaatgaagatgggaaactaaccggacatatcacagacggtcttggttttgctagtaatttacgggattctggtgtagatgtggcgggcaaaaaaatgaccatcatcggcgctggtggtgcagcaacagcaatccaagttcagtgcgcacttgatggggccaaggaaatcgccatttttaatattaaagatgatttttatgaaaaagctaaacaaacgattgcttctattaaacaagaagttcctgactgcatcgtacatatttatgacttaaatgacgcagcaaaattacatgaggaaatagcgactagtgatattttagtaaatgctacactcgttggtatgcatccacatgaaaatgaaacgcctgtcaaagatacgactgtcttcagaaaagatttaatcgtcaccgatgttgtctacaatccaaagaaaaccagacttttgctagatgcagaagctgctggttcaaaaactataggcggactaggcatgcttttatggcaaggcgcagaagcatacaaactgttcacaggtaaagatatgcctgtttcagaagtaaaagatttatattttaattaa

SEQ ID NO: 22330 - protein, 289 aa, Listeria innocua
MEKRISGSTRLLSLIGTPVDHSKSPIMYNYSFQKAGLDYAYLAFDIPVSKVADAIAAIKTFNLRGSNVTMPCKSEVLKYMDELSPAARMIGAVNTIINEDGKLTGHITDGLGFASNLRDSGVDVAGKKMTIIGAGGAATAIQVQCALDGAKEIAIFNIKDDFYEKAKQTIASIKQEVPDCIVHIYDLNDAAKLHEEIATSDILVNATLVGMHPHENETPVKDTTVFRKDLIVTDVVYNPKKTRLLLDAEAAGSKTIGGLGMLLWQGAEAYKLFTGKDMPVSEVKDLYFN

SEQ ID NO: 22331 - DNA, 852 bp, Brucella melitensis
  CDS (1)..(852)
atgtggctggcggtctttatatggcctgacattatgattaccggacataccaagctttacggcattgtcgccaatccgattgcccatgtaaaaacgcctgaggaggtgaacaagcattttgcggccttgggccatgacggcgtgctggttccttttcatgttctgccggaaaatctggcacagttcgtcaacagccttcgcaagctcgaaaatctgggcgggctggttgtcaccgtgccacacaagacggcaattctctccctttgtgacaggctggaaggcgatgccgccgctattggggctgccaacgtcatccggcgcgagagtgatggcacgcttgtcggtgtcatgttggacggcaaggggtttgtgagtgggcttgtggccagcgatattgacgtcaccggcatgaacgcctgtctccttggcgcgggcggggcggcttcggccatcgcctttgccttggcggaggccggcgtcgcgcggctcaccattgtaaaccgttccgaggacaaagctcgcgatcttgctgcgcgagtgagtgagcgttatcccgctgtccagatcgatgccggagcaccgcaaacggcaagccgcgatctcatcatcaatgcgacatcgctgggtcttcgggctggtgatccgctgccgcttgacgatcttgccttccatgccggccagatcgtcgcggaagtgatcatggagccggaagtgacgccgcttctggctgctgcccgcgacaagggtgcgcgcattcatttcggccgcccgatgctgcgccagcaaattcgtctcatggctgaacatatgggtgcaaaggcgaacgccgacgtgcagaagccgacggagtaa

SEQ ID NO: 22332 - protein, 283 aa, Brucella melitensis
MWLAVFIWPDIMITGHTKLYGIVANPIAHVKTPEEVNKHFAALGHDGVLVPFHVLPENLAQFVNSLRKLENLGGLVVTVPHKTAILSLCDRLEGDAAAIGAANVIRRESDGTLVGVMLDGKGFVSGLVASDIDVTGMNACLLGAGGAASAIAFALAEAGVARLTIVNRSEDKARDLAARVSERYPAVQIDAGAPQTASRDLIINATSLGLRAGDPLPLDDLAFHAGQIVAEVIMEPEVTPLLAAARDKGARIHFGRPMLRQQIRLMAEHMGAKANADVQKPTE

SEQ ID NO: 22333 - DNA, 822 bp, Yersinia pestis
  CDS (1)..(822)
atggatcagaagtttgcagtatttggtaatcctattagtcatagtaaatcgccgaggatccatacgcttttttccgagcaaacaggcattgaacatcgatatggtaaggtattagctccttctgaagcctttgagaacacattagtatctttttttgctgatggtgcccagggagcgaacattaccacaccgtttaaagaacgcgcatatgaccaatgtgatgaattaaccgaccgtgcatctctggcaggggctgttaatacgattaagcgtttggaagatgggcgcttgttgggtgacaacacagatggtattggtttgctcagtgatcttgaacgacaaaacttgatccgaacaactgatcatattttgttggttggggctggtggcgctgcccgaggagtgatccttcctctactttcttatgggtgtactgtggttgttaccaaccggacacatacccgggcgcagcaactggccaaagtatttaaccatattggtgatattgatgtttgtgaaatgtcggagttggctggacaacgattcgatttggttataaatgcgacggcatcaggccttcatggagaggtacctaacttaccagcagctatacttacttctcaaacacgttgttacgatatgttctatcaggcgggaaccacaccattcttggcttgggcacaacgattgggtttagcagattatgccgatggtttaggaatgctggtagggcaagcagcacatgctttcaaactttggcacggtgtgatgcctgaaattacgccagtattagcccagctacgcagtgagttaggtaaatag

SEQ ID NO: 22334 - protein, 273 aa, Yersinia pestis
MDQKFAVFGNPISHSKSPRIHTLFSEQTGIEHRYGKVLAPSEAFENTLVSFFADGAQGANITTPFKERAYDQCDELTDRASLAGAVNTIKRLEDGRLLGDNTDGIGLLSDLERQNLIRTTDHILLVGAGGAARGVILPLLSYGCTVVVTNRTHTRAQQLAKVFNHIGDIDVCEMSELAGQRFDLVINATASGLHGEVPNLPAAILTSQTRCYDMFYQAGTTPFLAWAQRLGLADYADGLGMLVGQAAHAFKLWHGVMPEITPVLAQLRSELGK

SEQ ID NO: 22335 - DNA, 771 bp, Salmonella enterica subsp. enterica serovar Typhi
  CDS (1)..(771)
atgacaaagcgcattaataaagacactcaggtctgcatgtccctggctgcacgcccaagtaacttcggtacacgctttcacaactatctgtacgaagcgctggatctcaattatctctacaaagctttctcgccgaccgatcttacgcaggccattagcggcgtgcgcgggctggggatacgtgggtgcgcgatctctatgccatttaaggaagcctgcattccgctggtggatgaactggatgcttccgctaaggcgtacaacaccgattacattgcaatagctcgcttgctggcgaattacaaggtctctcccgaccaggtgtttgctttgcgtggcagcggtggtatggcaaaggcggtggcctgcgcgctgaaggatgcggggtttacccgtggttatattgtcgcgattgatgaagcgtcaggtaaacaactggccgaactctatggctatgaatggcgcccggataccgacggtattgaagccgatttgttaattaacgccacgcctatcggaatggctggcggtaatgatgccgacaaactctcttattccgaacaagaagtggataaggcgagcgttatctttgatgtggtggcgctaccgcccgtcacgccgctaatccgctacgcccgtgaacgcggtaaaaccgtgattatcggttccgaagtgtttgctattcaggccgtggagcaatttgtcctttataccgggattcgcccggatgacgcactgttccagaaagccgcggcctggtcacgtctgtaa

SEQ ID NO: 22336 - protein, 256 aa, Salmonella enterica subsp. enterica serovar Typhi
MTKRINKDTQVCMSLAARPSNFGTRFHNYLYEALDLNYLYKAFSPTDLTQAISGVRGLGIRGCAISMPFKEACIPLVDELDASAKAYNTDYIAIARLLANYKVSPDQVFALRGSGGMAKAVACALKDAGFTRGYIVAIDEASGKQLAELYGYEWRPDTDGIEADLLINATPIGMAGGNDADKLSYSEQEVDKASVIFDVVALPPVTPLIRYARERGKTVIIGSEVFAIQAVEQFVLYTGIRPDDALFQKAAAWSRL

SEQ ID NO: 22337 - DNA, 870 bp, Agrobacterium tumefaciens
  CDS (1)..(870)
atgacagaaaaaaccgcctacaaggtcggcctgataggcgccgacatccagctttccaaatcgcccgcgctgcatatgcgtgagggtgcggcccatggcctcgactattcctacgagcttgtggatgtcaccgcccgcaaactgccgcagagtagccttcccgctcttctcgacgagctggaggcgcgcggttttgccgggacgaacatcacccatcctttcaagcaggccgttattccgcatctgcacgaactctccgacgacgcccgcatgttgggcgcggtcaacaccgttgtcttccgggatggacgccgcatcggccacaataccgactggtacggtttttacgaaagcttcgtgcgcggcctgccggatgcaaaacgcgaccgggcacttctggtcggcgcaggtggcgccggcgttgcggtggcccatgccgcgttgaagctcgatattatcaggctggatatcttcgaccgggattttccaagagccgaacgtctcgccgacgagctcaatgcccgttttggtgaaggccgcgccttcgcggtgaaggacccggccgactcgctgccctttgccgatggcctgatccatgccacgccgatgggcatgcccgcgcatcccggcatgccggttgcggccgagctgatcgaacaaaagcactgggtcgccgatatcgtctatatgccgctggtgaccgagcttctggcgactgcggccagcaagggatgccgaaccctgcccggcggcggcatgaccgtgttccaggccgtcggcgcatttcgcctcttttgcggccgcgagccggatgcgaaacgcatgacggcgcatttcacagaactttgcatggcggagggcgtggcatga

SEQ ID NO: 22338 - protein, 289 aa, Agrobacterium tumefaciens
MTEKTAYKVGLIGADIQLSKSPALHMREGAAHGLDYSYELVDVTARKLPQSSLPALLDELEARGFAGTNITHPFKQAVIPHLHELSDDARMLGAVNTVVFRDGRRIGHNTDWYGFYESFVRGLPDAKRDRALLVGAGGAGVAVAHAALKLDIIRLDIFDRDFPRAERLADELNARFGEGRAFAVKDPADSLPFADGLIHATPMGMPAHPGMPVAAELIEQKHWVADIVYMPLVTELLATAASKGCRTLPGGGMTVFQAVGAFRLFCGREPDAKRMTAHFTELCMAEGVA

SEQ ID NO: 22339 - DNA, 786 bp, Brucella melitensis
  CDS (1)..(786)
atgacggttactggccatacaagggtgttcgccattatcgcggacccggttcatcatgtccgcacgccgcaggccctgaacgccttatttgctgcgcgtggctatgacggcatcgtcgtgcccgctgccgttcccgccagcgggctgaaatatgcagcggctgccctgcgtgccttcggcaattggggcggtttcattgtcaccgtgccgcacaagacggaaatgcccgccttttgcgaccggctgacgccgcgcgcgcaagcagccggggcggtgaatgtgatccgccgcgaggccgatgggagcctgacgggcgaattgctggatggtgtcggttttgtgcgcgggcttgccaatgcgggccatgatgtgaagggcaggagcgtttatcttgccggtgcaggcggtgcggcttcggccattgcctttgcccttgcagaggcgggcgttgtccgcttgacggtcgtgaaccgttccagcgaaaaggccgggcagcttgttgcgcggctgaaggaacatttcccggcgggcatgttcgtatcgcagggtacgcctgccggtcatgacatcatcgtcaacggcacgtcgcttggcctgaaagaaggcgatgcactgccggtggacccgcaatatctccggcctgaaatgctggtggcagaggttatcatgtcgccggaagtgacgccgcttttgcagatcgcgaaagatagcggctgctctatccatcccggcaaggccatgctggatggccagttggccgagatgttcgatttcttcacgcgataa

SEQ ID NO: 22340 - protein, 261 aa, Brucella melitensis
MTVTGHTRVFAIIADPVHHVRTPQALNALFAARGYDGIVVPAAVPASGLKYAAAALRAFGNWGGFIVTVPHKTEMPAFCDRLTPRAQAAGAVNVIRREADGSLTGELLDGVGFVRGLANAGHDVKGRSVYLAGAGGAASAIAFALAEAGVVRLTVVNRSSEKAGQLVARLKEHFPAGMFVSQGTPAGHDIIVNGTSLGLKEGDALPVDPQYLRPEMLVAEVIMSPEVTPLLQIAKDSGCSIHPGKAMLDGQLAEMFDFFTR

SEQ ID NO: 22341 - DNA, 822 bp, Buchnera sp
  CDS (1)..(822)
atgtttaaatgcaaaaattttaattatgctgtatttggaaatcctataaatcatagtaaatctcctgaaattcatagtttattttcaaaacagacaggtatttctcatttttataaatcttgtaatgttccattaaatagcttgtatgctgttttacaagatttttttaaaaaagacggtcgaggtgcaaatattaccgcaccatttaaacaagaagcttattttttttgtaataagttaactaaaagagcagaagttgctcaatctgttaatacgttgaaaaaaatagataattgtaatattttaggagataatacagacggaattggtttgttatcggatttaataagattgaattttataaaaaaaaattattcaatattgataatcggtgcaggtggtgctgctagaggtgttctttttcctcttttatcatatgggtgttcgatttgtatttttaatagaactgttttaaatgccgagaaattagtcttacaattccataaatacggaaatataaatgtttttaatacaaattcgttacatgtaaaatcttttgatttgattattaatgcaacatcgcattttattcaagataaagataattttattcctttttcttgcgtatcttctaagacatgcttttatgatatgaattatcaaacagataatacatttttttttgattggtctcgtaaaacaggatctaattttttttctaacggaataggtatgttagtttttcaagcagcccattctttttttctatggcataatgtgcttccagaaatagattatattattgatcttttaaataaataa

SEQ ID NO: 22342 - protein, 273 aa, Buchnera sp
MFKCKNFNYAVFGNPINHSKSPEIHSLFSKQTGISHFYKSCNVPLNSLYAVLQDFFKKDGRGANITAPFKQEAYFFCNKLTKRAEVAQSVNTLKKIDNCNILGDNTDGIGLLSDLIRLNFIKKNYSILIIGAGGAARGVLFPLLSYGCSICIFNRTVLNAEKLVLQFHKYGNINVFNTNSLHVKSFDLIINATSHFIQDKDNFIPFSCVSSKTCFYDMNYQTDNTFFFDWSRKTGSNFFSNGIGMLVFQAAHSFFLWHNVLPEIDYIIDLLNK

SEQ ID NO: 22343 - DNA, 4767 bp, Saccharomyces cerevisiae
  CDS (1)..(4767)
atggtgcagttagccaaagtcccaattctaggaaatgatattatccacgttgggtataacattcatgaccatttggttgaaaccataattaaacattgtccttcttcgacatacgttatttgcaatgatacgaacttgagtaaagttccatactaccagcaattagtcctggaattcaaggcttctttgccagaaggctctcgtttacttacttatgttgttaaaccaggtgagacaagtaaaagtagagaaaccaaagcgcagctagaagattatcttttagtggaaggatgtactcgtgatacggttatggtagcgatcggtggtggtgttattggtgacatgattgggttcgttgcatctacatttatgagaggtgttcgtgttgtccaagtaccaacatccttattggcaatggtcgattcctccattggtggtaaaactgctattgacactcctctaggtaaaaactttattggtgcattttggcaaccaaaatttgtccttgtagatattaaatggctagaaacgttagccaagagagagtttatcaatgggatggcagaagttatcaagactgcttgtatttggaacgctgacgaatttactagattagaatcaaacgcttcgttgttcttaaatgttgttaatggggcaaaaaatgtcaaggttaccaatcaattgacaaacgagattgacgagatatcgaatacagatattgaagctatgttggatcatacatataagttagttcttgagagtattaaggtcaaagcggaagttgtctcttcggatgaacgtgaatccagtctaagaaaccttttgaacttcggacattctattggtcatgcttatgaagctatactaaccccacaagcattacatggtgaatgtgtgtccattggtatggttaaagaggcggaattatcccgttatttcggtattctctcccctacccaagttgcacgtctatccaagattttggttgcctacgggttgcctgtttcgcctgatgagaaatggtttaaagagctaaccttacataagaaaacaccattggatatcttattgaagaaaatgagtattgacaagaaaaacgagggttccaaaaagaaggtggtcattttagaaagtattggtaagtgctatggtgactccgctcaatttgttagcgatgaagacctgagatttattctaacagatgaaaccctcgtttaccccttcaaggacatccctgctgatcaacagaaagttgttatcccccctggttctaagtccatctccaatcgtgctttaattcttgctgccctcggtgaaggtcaatgtaaaatcaagaacttattacattctgatgatactaaacatatgttaaccgctgttcatgaattgaaaggtgctacgatatcatgggaagataatggtgagacggtagtggtggaaggacatggtggttccacattgtcagcttgtgctgaccccttatatctaggtaatgcaggtactgcatctagatttttgacttccttggctgccttggtcaattctacttcaagccaaaagtatatcgttttaactggtaacgcaagaatgcaacaaagaccaattgctcctttggtcgattctttgcgtgctaatggtactaaaattgagtacttgaataatgaaggttccctgccaatcaaagtttatactgattcggtattcaaaggtggtagaattgaattagctgctacagtttcttctcagtacgtatcctctatcttgatgtgtgccccatacgctgaagaacctgtaactttggctcttgttggtggtaagccaatctctaaattgtacgtcgatatgacaataaaaatgatggaaaaattcggtatcaatgttgaaacttctactacagaaccttacacttattatattccaaagggacattatattaacccatcagaatacgtcattgaaagtgatgcctcaagtgctacatacccattggccttcgccgcaatgactggtactaccgtaacggttccaaacattggttttgagtcgttacaaggtgatgccagatttgcaagagatgtcttgaaacctatgggttgtaaaataactcaaacggcaacttcaactactgtttcgggtcctcctgtaggtactttaaagccattaaaacatgttgatatggagccaatgactgatgcgttcttaactgcatgtgttgttgccgctatttcgcacgacagtgatccaaattctgcaaatacaaccaccattgaaggtattgcaaaccagcgtgtcaaagagtgtaacagaattttggccatggctacagagctcgccaaatttggcgtcaaaactacagaattaccagatggtattcaagtccatggtttaaactcgataaaagatttgaaggttccttccgactcttctggacctgtcggtgtatgcacatatgatgatcatcgtgtggccatgagtttctcgcttcttgcaggaatggtaaattctcaaaatgaacgtgacgaagttgctaatcctgtaagaatacttgaaagacattgtactggtaaaacctggcctggctggtgggatgtgttacattccgaactaggtgccaaattagatggtgcagaacctttagagtgcacatccaaaaagaactcaaagaaaagcgttgtcattattggcatgagagcagctggcaaaactactataagtaaatggtgcgcatccgctctgggttacaaattagttgacctagacgagctgtttgagcaacagcataacaatcaaagtgttaaacaatttgttgtggagaacggttgggagaagttccgtgaggaagaaacaagaattttcaaggaagttattcaaaattacggcgatgatggatatgttttctcaacaggtggcggtattgttgaaagcgctgagtctagaaaagccttaaaagattttgcctcatcaggtggatacgttttacacttacatagggatattgaggagacaattgtctttttacaaagtgatccttcaagacctgcctatgtggaagaaattcgtgaagtttggaacagaagggaggggtggtataaagaatgctcaaatttctctttctttgctcctcattgctccgcagaagctgagttccaagctctaagaagatcgtttagtaagtacattgcaaccattacaggtgtcagagaaatagaaattccaagcggaagatctgcctttgtgtgtttaacctttgatgacttaactgaacaaactgagaatttgactccaatctgttatggttgtgaggctgtagaggtcagagtagaccatttggctaattactctgctgatttcgtgagtaaacagttatctatattgcgtaaagccactgacagtattcctatcatttttactgtgcgaaccatgaagcaaggtggcaactttcctgatgaagagttcaaaaccttgagagagctatacgatattgccttgaagaatggtgttgaattccttgacttagaactaactttacctactgatatccaatatgaggttattaacaaaaggggcaacaccaagatcattggttcccatcatgacttccaaggattatactcctgggacgacgctgaatgggaaaacagattcaatcaagcgttaactcttgatgtggatgttgtaaaatttgtgggtacggctgttaatttcgaagataatttgagactggaacactttagggatacacacaagaataagcctttaattgcagttaatatgacttctaaaggtagcatttctcgtgttttgaataatgttttaacacctgtgacatcagatttattgcctaactccgctgcccctggccaattgacagtagcacaaattaacaagatgtatacatctatgggaggtatcgagcctaaggaactgtttgttgttggaaagccaattggccactctagatcgccaattttacataacactggctatgaaattttaggtttacctcacaagttcgataaatttgaaactgaatccgcacaattggtgaaagaaaaacttttggacggaaacaagaactttggcggtgctgcagtcacaattcctctgaaattagatataatgcagtacatggatgaattgactgatgctgctaaagttattggtgctgtaaacacagttataccattgggtaacaagaagtttaagggtgataataccgactggttaggtatccgtaatgccttaattaacaatggcgttcccgaatatgttggtcataccgctggtttggttatcggtgcaggtggcacttctagagccgccctttacgccttgcacagtttaggttgcaaaaagatcttcataatcaacaggacaacttcgaaattgaagccattaatagagtcacttccatctgaattcaacattattggaatagagtccactaaatctatagaagagattaaggaacacgttggcgttgctgtcagctgtgtaccagccgacaaaccattagatgacgaacttttaagtaagctggagagattccttgtgaaaggtgcccatgctgcttttgtaccaaccttattggaagccgcatacaaaccaagcgttactcccgttatgacaatttcacaagacaaatatcaatggcacgttgtccctggatcacaaatgttagtacaccaaggtgtagctcagtttgaaaagtggacaggattcaagggccctttcaaggccatttttgatgccgttacgaaagagtag

SEQ ID NO: 22344 - protein, 1588 aa, Saccharomyces cerevisiae
MVQLAKVPILGNDIIHVGYNIHDHLVETIIKHCPSSTYVICNDTNLSKVPYYQQLVLEFKASLPEGSRLLTYVVKPGETSKSRETKAQLEDYLLVEGCTRDTVMVAIGGGVIGDMIGFVASTFMRGVRVVQVPTSLLAMVDSSIGGKTAIDTPLGKNFIGAFWQPKFVLVDIKWLETLAKREFINGMAEVIKTACIWNADEFTRLESNASLFLNVVNGAKNVKVTNQLTNEIDEISNTDIEAMLDHTYKLVLESIKVKAEVVSSDERESSLRNLLNFGHSIGHAYEAILTPQALHGECVSIGMVKEAELSRYFGILSPTQVARLSKILVAYGLPVSPDEKWFKELTLHKKTPLDILLKKMSIDKKNEGSKKKVVILESIGKCYGDSAQFVSDEDLRFILTDETLVYPFKDIPADQQKVVIPPGSKSISNRALILAALGEGQCKIKNLLHSDDTKHMLTAVHELKGATISWEDNGETVVVEGHGGSTLSACADPLYLGNAGTASRFLTSLAALVNSTSSQKYIVLTGNARMQQRPIAPLVDSLRANGTKIEYLNNEGSLPIKVYTDSVFKGGRIELAATVSSQYVSSILMCAPYAEEPVTLALVGGKPISKLYVDMTIKMMEKFGINVETSTTEPYTYYIPKGHYINPSEYVIESDASSATYPLAFAAMTGTTVTVPNIGFESLQGDARFARDVLKPMGCKITQTATSTTVSGPPVGTLKPLKHVDMEPMTDAFLTACVVAAISHDSDPNSANTTTIEGIANQRVKECNRILAMATELAKFGVKTTELPDGIQVHGLNSIKDLKVPSDSSGPVGVCTYDDHRVAMSFSLLAGMVNSQNERDEVANPVRILERHCTGKTWPGWWDVLHSELGAKLDGAEPLECTSKKNSKKSVVIIGMRAAGKTTISKWCASALGYKLVDLDELFEQQHNNQSVKQFVVENGWEKFREEETRIFKEVIQNYGDDGYVFSTGGGIVESAESRKALKDFASSGGYVLHLHRDIEETIVFLQSDPSRPAYVEEIREVWNRREGWYKECSNFSFFAPHCSAEAEFQALRRSFSKYIATITGVREIEIPSGRSAFVCLTFDDLTEQTENLTPICYGCEAVEVRVDHLANYSADFVSKQLSILRKATDSIPIIFTVRTMKQGGNFPDEEFKTLRELYDIALKNGVEFLDLELTLPTDIQYEVINKRGNTKIIGSHHDFQGLYSWDDAEWENRFNQALTLDVDVVKFVGTAVNFEDNLRLEHFRDTHKNKPLIAVNMTSKGSISRVLNNVLTPVTSDLLPNSAAPGQLTVAQINKMYTSMGGIEPKELFVVGKPIGHSRSPILHNTGYEILGLPHKFDKFETESAQLVKEKLLDGNKNFGGAAVTIPLKLDIMQYMDELTDAAKVIGAVNTVIPLGNKKFKGDNTDWLGIRNALINNGVPEYVGHTAGLVIGAGGTSRAALYALHSLGCKKIFIINRTTSKLKPLIESLPSEFNIIGIESTKSIEEIKEHVGVAVSCVPADKPLDDELLSKLERFLVKGAHAAFVPTLLEAAYKPSVTPVMTISQDKYQWHVVPGSQMLVHQGVAQFEKWTGFKGPFKAIFDAVTKE

SEQ ID NO: 22345 - DNA, 849 bp, Methanococcus jannaschii
  CDS (1)..(849)
atgataaatgctaaaacaaaggttattgggttgattggacatcctgtagaacattctttctcaccaattatgcacaatgcagcttttaaagataaaggattaaattatgtttatgttgcatttgatgtgttgccagaaaatttaaagtatgtaatagatggggctaaagcccttggaatagttggatttaatgtaacaatccctcataaaatagagattatgaagtatttggatgagatagataaagatgctcaattaattggggctgttaatactataaaaatagaggatgggaaagcaatcggctataatactgatggtattggggcgaggatggctttagaggaagaaattggaagagttaaagacaaaaatatagttatttatggagctggaggggctgcaagagctgtagcatttgaattagcaaaagataataacataataatagccaatagaaccgttgaaaaagctgaagcattagctaaagaaatagcagaaaaattaaataagaaatttggtgaagaagttaaattcagtggattagatgtggatttagatggagttgatataataattaacgctactccaataggaatgtatccgaatattgatgttgaaccaatagttaaagcagagaagttgagagaggatatggtggttatggatttaatttataatccattggagacggttttattgaaagaggcaaaaaaagttaatgcaaaaacaataaacgggttaggaatgttgatatatcagggagcagttgcatttaaaatatggactggtgtagaaccaaatatagaagttatgaaaaacgcaataattgataagataactaaataa

SEQ ID NO: 22346 - protein, 282 aa, Methanococcus jannaschii
MINAKTKVIGLIGHPVEHSFSPIMHNAAFKDKGLNYVYVAFDVLPENLKYVIDGAKALGIVGFNVTIPHKIEIMKYLDEIDKDAQLIGAVNTIKIEDGKAIGYNTDGIGARMALEEEIGRVKDKNIVIYGAGGAARAVAFELAKDNNIIIANRTVEKAEALAKEIAEKLNKKFGEEVKFSGLDVDLDGVDIIINATPIGMYPNIDVEPIVKAEKLREDMVVMDLIYNPLETVLLKEAKKVNAKTINGLGMLIYQGAVAFKIWTGVEPNIEVMKNAIIDKITK

SEQ ID NO: 22347 - DNA, 783 bp, Methanobacterium thermoautotrophicum
  CDS (1)..(783)
atgcacaacgcggcgttcaggagccttggtatggactggatatacgtaccattccctgtgaagccagagaacctgaaagcagcggttgagggcctgagggcccttggggttgagggtgtgaatgtgacaataccccacaaggaggccgtcctggagtacattgatgatatccatgggacagcggccctgataggtgccgttaacactctgaaattcgatgacgggaccgtcaggggatacaataccgatgcctcagggtgcttaagggcccttgaagaggtgacatccgttgagggttcatccgtccttatactgggggcgggtggggctgcaagggcctgtgcattccagcttgcagagaagggggcctcggatataaccatactgaacaggacccctgaaaaggcccgcctccttgcagaggatatggctgataaactgggctttgaggcatcatacgggggctatgaacttatccaggggtctgtgaaatcggctgatatcctcatagacaccacgccggtgggcatgcatccccacacagatgacaggccactggtgggggctgaactcatgcatgagggtctggtggtccatgacctcgtgtacaaccctcaaaggacggtcctcctgagagaggctgagagggcgtcagccatcccggtttcagggatccgtatgctcctctatcagggcgttgaggccttcaggatctggaccgggagggacccgcccctggatgtcatggaagacgccctgaaaagggtccttaacagggattaa

SEQ ID NO: 22348 - protein, 260 aa, Methanobacterium thermoautotrophicum
MHNAAFRSLGMDWIYVPFPVKPENLKAAVEGLRALGVEGVNVTIPHKEAVLEYIDDIHGTAALIGAVNTLKFDDGTVRGYNTDASGCLRALEEVTSVEGSSVLILGAGGAARACAFQLAEKGASDITILNRTPEKARLLAEDMADKLGFEASYGGYELIQGSVKSADILIDTTPVGMHPHTDDRPLVGAELMHEGLVVHDLVYNPQRTVLLREAERASAIPVSGIRMLLYQGVEAFRIWTGRDPPLDVMEDALKRVLNRD

SEQ ID NO: 22349 - DNA, 1437 bp, Chlamydia trachomatis
  CDS (1)..(1437)
atgctatgcacaacaattagtggaccttctttcctggaagctaagaagcagatactacgctctttaaaagaatgtcattgctttgaaatgcgggtagatcttctttctgtatcttgtttagaactcaagaaactcatggaactagctcctatttccattcttgcatggaaaaaacctgaatcatgctcacaagcagactggatagataaaatgcaatcgctagctgagctaaatccaaactatctagacttggaaaaagattttccagaagaggatatgatacgcattcgacaactccatcctcaaattaagatcattcgttccttacatactagtgagcataccgacattatacaactctatgcacatatgcgatcttcagcagctgactactataaattcgctgtttcctcttcctcaacgacagatctcctagatatctgtcaccaaaaacgctctcttcctgaaaatacaactgtagtttgtctaggaggaatggggcgcccttcacgaatactctccccgatcttacaaaatccatttacctacgcaagaagtacaggatcttcccccgtagctccagggcaattttctctcaaacaccactatttctacaatttcgcaagcctttctgctcaatcccccatctgcgctcttataggagacacttcacgaagtatcgggcatttaacccataatcctttcttttcccaactcggagtagcttgcccatatattaaactccctttaacccctcaagagctccctaaattcttctctaccattcgcacgcaaccctttttaggagtcagcgtgacttccccattgaaaactgctgttctaccgtttcttgataaacaagctccatctgtgaaagcttccggatcctgtaatacgctagtcattcgccaaggagaaattgaaggacatgataccgatggcgaagggttgttttctgtattgatgcagcaccaaattcctttaaataaccaacgagttgctattataggagcaggtggagcagctcaatccatagcaactcgattgagcagagcaaactgtgaacttcttatttttaaccgcactaaagcgcatgctgaggatctagcttctcgttgccaggcaaaagcattctcgctggaggaactccctctacacagagtctcccttatcatcaattgccttcctccttcttgtaccattcctaaagcagttgctccctgtgttgtcgatattaatacaattcctaaacatagtacgttcactcagtatgctcgatctcagggaagctccattatttatggtcatgagatgttcacgcagcaagctctcttacaatttcgtttatggttccctacgctctctttcaagcatttggaaaaaacctttattcgtagagctgctgtcttagcttctcttttttccatcgcaccataa

SEQ ID NO: 22350 - protein, 478 aa, Chlamydia trachomatis
MLCTTISGPSFLEAKKQILRSLKECHCFEMRVDLLSVSCLELKKLMELAPISILAWKKPESCSQADWIDKMQSLAELNPNYLDLEKDFPEEDMIRIRQLHPQIKIIRSLHTSEHTDIIQLYAHMRSSAADYYKFAVSSSSTTDLLDICHQKRSLPENTTVVCLGGMGRPSRILSPILQNPFTYARSTGSSPVAPGQFSLKHHYFYNFASLSAQSPICALIGDTSRSIGHLTHNPFFSQLGVACPYIKLPLTPQELPKFFSTIRTQPFLGVSVTSPLKTAVLPFLDKQAPSVKASGSCNTLVIRQGEIEGHDTDGEGLFSVLMQHQIPLNNQRVAIIGAGGAAQSIATRLSRANCELLIFNRTKAHAEDLASRCQAKAFSLEELPLHRVSLIINCLPPSCTIPKAVAPCVVDINTIPKHSTFTQYARSQGSSIIYGHEMFTQQALLQFRLWFPTLSFKHLEKTFIRRAAVLASLFSIAP

SEQ ID NO: 22351 - DNA, 993 bp, Deinococcus radiodurans
  CDS (1)..(993)
atgggctcccgccgtttcgtgcgcgggccgctccgggcgcccggcccctacactgtgactgtgaatgtgtccgcccccgacccgtccgcctctgtccctgcccggagcggctccggtccccgccgcgcttttttgttcgctgacccggcggcgcactcgctctcgccccggatgcaccgcgccgcgttcgcctgggcgggactgaacggcacctacgacgccgagcgggtgcccgctcccgagttgccgacggcgatggcccggctgcgggcgccggacgtactcggcgccaacctcagcctgccgcacaaggaagccgcgctgccgctgctcgacgggctgtcggacgcggcccgcgccatcggggccgtgaacaccgtgattcaccgcgctgggcaactttatggtgacaacaccgacgcgccggggctgttgcaggccctcgcaggcagcgggctgactgggcggctgggcgccgcagaccgggtggtcgttctcggggccggcggcgcggcgcgggcggcggtgtacgccggggcggtgattctgggccgcgaggtctgggtggtcaaccgcaccccggcgcgggcgcgggcgctcgctgcggggtggcagggtggaggagaggtccgcgctgccgggcccggtgaggtgccgtgggggcaggtcggcctcgtcatcaacagcagcagcgccgggctggacaaccccgaagaaacgccgcttcccggcttcgacttcggacagctgccggcccacgccggggtgtacgacatggtgtacaagccgcgccgaacccgattgatgcgcgacgccgaggccgccgggctgcctgctgaaaacggcctggggatgctggcgcagcaggcccggctggcgtttaccgcctggaccggggtagacgtgccggtttcggtctttctggccgcgctggaagctccggctacagggcgtggcgcaggcgacgccgcccgtactgaggccacacggtga

SEQ ID NO: 22352 - protein, 330 aa, Deinococcus radiodurans
MGSRRFVRGPLRAPGPYTVTVNVSAPDPSASVPARSGSGPRRAFLFADPAAHSLSPRMHRAAFAWAGLNGTYDAERVPAPELPTAMARLRAPDVLGANLSLPHKEAALPLLDGLSDAARAIGAVNTVIHRAGQLYGDNTDAPGLLQALAGSGLTGRLGAADRVVVLGAGGAARAAVYAGAVILGREVWVVNRTPARARALAAGWQGGGEVRAAGPGEVPWGQVGLVINSSSAGLDNPEETPLPGFDFGQLPAHAGVYDMVYKPRRTRLMRDAEAAGLPAENGLGMLAQQARLAFTAWTGVDVPVSVFLAALEAPATGRGAGDAARTEATR

SEQ ID NO: 22353 - DNA, 822 bp, Deinococcus radiodurans
  CDS (1)..(822)
atgcttcccgctccccggtttgaccgtgacacccggctttgcatgagtctcgccgccgggcccggcaacttcggcacccgttttcacaattatctgtatgagttgctgggcctgaactacatgtacaaggcgttcaccacgcaggatttacctgctgccatcggcggcatccgggcgctggggattcgtgggtgcgcggtgagcatgccgttcaaggaagcggtgattccgctgctcgacgaactgatgccgtcggcggcggccatcgagtcggtgaacacgatcgtcaacgatgacggcgtgctgcgggcttataacaccgattacgaagccgttcgcctgctgattcgggaaaaagaactcgacccgtcctggcgtgtcggcgtgcgcggcagcggcggcatgggcaaggcggtggcgtcggcgctgcgggacgcgggctttgaaaacggcgtgctggtcgcccgcaacgaggcggcggggcgcgaactggccgggcggctgggctggcgctggacgcccgagccggaagctgccgacctgctggtcaacgtcacgcccatcggcatggcgggggggccggaggaacacgatctcagctttgcgccggagctgattgcccaggcccgcgccgtgttcgacgtggtggcgctgcccgccgaaacgccgctgattgccgaggcgcggcggcagggcaagcccgtcgtgaccggggaagaagtcgcggcacttcaggccctcgaacagttcgtgctctacacgggcgtgcggcccacgccggaacaggtgcaggcagcggcggcctgggcacggcaggggtaa

SEQ ID NO: 22354 - protein, 273 aa, Deinococcus radiodurans
MLPAPRFDRDTRLCMSLAAGPGNFGTRFHNYLYELLGLNYMYKAFTTQDLPAAIGGIRALGIRGCAVSMPFKEAVIPLLDELMPSAAAIESVNTIVNDDGVLRAYNTDYEAVRLLIREKELDPSWRVGVRGSGGMGKAVASALRDAGFENGVLVARNEAAGRELAGRLGWRWTPEPEAADLLVNVTPIGMAGGPEEHDLSFAPELIAQARAVFDVVALPAETPLIAEARRQGKPVVTGEEVAALQALEQFVLYTGVRPTPEQVQAAAAWARQG

SEQ ID NO: 22355 - DNA, 789 bp, Campylobacter jejuni
  CDS (1)..(789)
atgaaatttttagcagttataggcgatcctatttctcactctaaatcgcctagaatgcataataatgctattaaagccttagggcttgatagcatttatacacgctatcatttaagaaatgctaactgtttaagagaagatttttttaaattaggacttagtggagctaatattactttgccttttaaggaaaaagctttagatattgctgatgtgaaggatgattttgctagaaatattggctctgcaaatactttatgcttaaaagaagataaaatttacgcttataatactgatgctttaggttttttagaagctattaaggattttgataatataaaaaaagctttgattttgggtgctggaggtacagctttggcgcttgcttatgtattaaaacaaaaaggcgtagaagtgtatatagctaatcgtagtaaagaaagatttaaagattttttagcttatccaacttatctttataaaaacttgcaagattttgactttgatttggttataaattcaacttctgctggattaaaagatgaaaatttaccttgtgatagggagcttttagatagaattttacctaaagctaaatttgcttttgaggtaatttatggcagagaaacacctttttatagattgtgtaaagagtatcatttaaaaattaaagatggacttgatatgcttttatggcaaggagtttttgcttttgaacttttttttgaaatacaagataaaagagagatgataaaaaatgcaatgcaacaggcattgattttaaagtag

SEQ ID NO: 22356 - protein, 262 aa, Campylobacter jejuni
MKFLAVIGDPISHSKSPRMHNNAIKALGLDSIYTRYHLRNANCLREDFFKLGLSGANITLPFKEKALDIADVKDDFARNIGSANTLCLKEDKIYAYNTDALGFLEAIKDFDNIKKALILGAGGTALALAYVLKQKGVEVYIANRSKERFKDFLAYPTYLYKNLQDFDFDLVINSTSAGLKDENLPCDRELLDRILPKAKFAFEVIYGRETPFYRLCKEYHLKIKDGLDMLLWQGVFAFELFFEIQDKREMIKNAMQQALILK

SEQ ID NO: 22357 - DNA, 837 bp, Mycobacterium leprae
  CDS (1)..(837)
atgtccttgacagcgtgcgctaacaaggggccgcgaaaagctggaattattggttctccaatcgcgcattcccgttccccgcacttgcacctggccgcttaccgtgcactgcgtctccacgactggacgtatgagcggatcgaatgcgatgctgaagagctcccgactgtcgttagcgggttcgggccgcagtgggtcggcgtttcagtgaccatgccgggcaaattcgccgcgctgcggttcgccgatgagcacactgcacgtgccagcctggttgggtcggctaacacgctgctgcggacccagcgcggctggcgggccgacaacaccgacattgatggtgtggcgggggcgctggcggcgatcgggcctttggcagggcgtgcgctagtgtgcgggtcgggcggcactgctccggcggctgtgatggggttggctgaactgggcgtcaccgatatcaccgttttggcacgcaatcccgacaaggcgtcccggttggtcgatctcggggttcaggtcggtgtggcgacccgattgtgcggtctggacagcggtggcttggcagatgaggtgaaggctgccgaagtgctggttagtacggtaccggcagatgtggctgcgcggtatgtcgatgtcttcgcgacggtcccggtgctgctagatgcaatctacgacccgtggcctacgccactggtcgcagcggtgtccgcggcgggcggccgagtgatcagcggcttgcaaatgctgttgcatcaagcgtttgcgcaggtggagcaattcaccgggatgcctgcaccgcgagaggcgatggcttgtgctctggcgggtttgcattag

SEQ ID NO: 22358 - protein, 278 aa, Mycobacterium leprae
MSLTACANKGPRKAGIIGSPIAHSRSPHLHLAAYRALRLHDWTYERIECDAEELPTVVSGFGPQWVGVSVTMPGKFAALRFADEHTARASLVGSANTLLRTQRGWRADNTDIDGVAGALAAIGPLAGRALVCGSGGTAPAAVMGLAELGVTDITVLARNPDKASRLVDLGVQVGVATRLCGLDSGGLADEVKAAEVLVSTVPADVAARYVDVFATVPVLLDAIYDPWPTPLVAAVSAAGGRVISGLQMLLHQAFAQVEQFTGMPAPREAMACALAGLH

SEQ ID NO: 22359 - DNA, 858 bp, Caulobacter crescentus
  CDS (1)..(858)
atgaccaacgccatcacgggcgcggccattgtcggcggtgtctgcggtcaaccgatcaagcattcgatgagcccggtgatccacaacgcctggatcgcagcggccggccttgacgcggcttatgtgccattcgccccggcggctgatcggttcgagacctttgtcgacggtttgcgtggcggcgcggtgcgcgggctcaacgtcaccattccgttcaaggagcgggcgctggccgtcgccgacaccgccagcgatctggcgcggatggccggggcggccaatctgttggtgttcaatgaggacggcagcgtccatgccgacaataccgacggcccgggcctgctgggcgccatcgcgatccaggcgcctggcttcgacgtcacggccgcacctgtggtcattctcggcgcgggtggcgcggcccggggagcggtcgcggccctgctgctggccggcgcgccgcgcatagctgtcgtcaaccgcactgtcgcgcgcgcccaggacctggccgacacgttcggggagaaggtcgtagccaagggcgaagacgccctccccgctctgctgccagaagcgggattgatcatcaacgcgacctcgctaggtctgggcggcggcgctgggccgtcagccgacttgaccctgacccccaagaccgccgtcgtgatggacatggtctacaagccgctgcggacagagttcctgcgccgggccgaggccgccggtcgccgtacggtggacgggctggagatgctgctgcgtcaggcgatccccaccttcgagaccatttatggccaggccccctcccccaagatcgacgttcgggtcctggcgctcaagctcctgggcgaggtctga

SEQ ID NO: 22360 - protein, 285 aa, Caulobacter crescentus
MTNAITGAAIVGGVCGQPIKHSMSPVIHNAWIAAAGLDAAYVPFAPAADRFETFVDGLRGGAVRGLNVTIPFKERALAVADTASDLARMAGAANLLVFNEDGSVHADNTDGPGLLGAIAIQAPGFDVTAAPVVILGAGGAARGAVAALLLAGAPRIAVVNRTVARAQDLADTFGEKVVAKGEDALPALLPEAGLIINATSLGLGGGAGPSADLTLTPKTAVVMDMVYKPLRTEFLRRAEAAGRRTVDGLEMLLRQAIPTFETIYGQAPSPKIDVRVLALKLLGEV

SEQ ID NO: 22361 - DNA, 867 bp, Escherichia coli
  CDS (1)..(867)
atggatgttaccgcaaaatacgaattgattgggttgatggcctatcctatccgccacagtttatcgcccgaaatgcagaataaagccttagaaaaagcgggattgccatttacctatatggccttcgaagtggataacgatagctttcctggagcaattgaaggattaaaagccctcaaaatgcgcggaactggtgtatcgatgccgaacaaacaactggcgtgtgaatatgttgatgaattaacaccagctgccaaactggtgggggccatcaacaccatcgttaatgatgatggctatctgcgtggctataacaccgacggcacgggccatattcgcgccattaaagagagcggttttgatatcaaaggcaaaacgatggtgctgttaggggccggtggtgcctcaacggcaattggcgcgcagggggcaattgaaggtttaaaagaaattaaactctttaaccgtcgggatgagttcttcgataaagccctcgccttcgcgcagcgggttaatgaaaacaccgattgtgtcgtcacggtcaccgatctcgccgatcagcaagcctttgctgaagccctggcttccgccgacattttaaccaatggcacaaaagtgggtatgaaaccccttgagaatgaatcattggttaatgatatcagtctgttacatccgggacttctggtcactgaatgcgtgtataacccgcatatgacgaagttattgcagcaggcgcaacaagctggttgcaaaacgattgatggatacggcatgttgttgtggcaaggggctgaacagttcacattatggactggcaaagatttccctctggaatatgttaaacaggtcatggggttcggtgcctga

SEQ ID NO: 22362 - protein, 288 aa, Escherichia coli
MDVTAKYELIGLMAYPIRHSLSPEMQNKALEKAGLPFTYMAFEVDNDSFPGAIEGLKALKMRGTGVSMPNKQLACEYVDELTPAAKLVGAINTIVNDDGYLRGYNTDGTGHIRAIKESGFDIKGKTMVLLGAGGASTAIGAQGAIEGLKEIKLFNRRDEFFDKALAFAQRVNENTDCVVTVTDLADQQAFAEALASADILTNGTKVGMKPLENESLVNDISLLHPGLLVTECVYNPHMTKLLQQAQQAGCKTIDGYGMLLWQGAEQFTLWTGKDFPLEYVKQVMGFGA

SEQ ID NO: 22363 - DNA, 810 bp, Mycobacterium tuberculosis
  CDS (1)..(810)
atgagcgaaggtcccaaaaaagccggcgtgcttggttcgccgatcgcgcattcccgctccccgcagctgcacctggccgcctaccgggcgttggggctgcacgactggacctatgagcgcatcgaatgcggtgcggccgagttgcccgtcgtggtcggtggtttcggaccggagtgggtcggtgtttcggtgaccatgccgggcaagttcgccgccctgcggttcgccgacgagcgcaccgcacgcgcggaccttgtcggttcggccaacaccctggttcggacgccgcatggctggcgggccgacaacaccgacatcgacggggtggccggggcgttgggggcggctgctggacacgcgctggtgctggggtccggggggaccgcaccggcggccgtggtggggctggccgaactcggggtcaccgacatcaccgtggtggcgcgcaactcggacaaggcggcccggctggtggacctgggcacacgggtcggcgtggcgacccggttctgcgcgttcgacagcggtgggttggccgatgcggtggccgccgcggaagtgctggtcagcaccattccagcggaggtggccgcggggtatgccggcaccttggccgcgatcccggtgctgttggacgccatctacgatccgtggcccacaccgctggccgccgcggtcggatcggcgggcgggcgggtgatcagcgggctgcagatgttgctgcatcaggcgttcgcgcaggtggagcagttcaccgggctacccgccccccgcgaagcgatgacttgcgcgctggccgcgttggactag

SEQ ID NO: 22364 - protein, 269 aa, Mycobacterium tuberculosis
MSEGPKKAGVLGSPIAHSRSPQLHLAAYRALGLHDWTYERIECGAAELPVVVGGFGPEWVGVSVTMPGKFAALRFADERTARADLVGSANTLVRTPHGWRADNTDIDGVAGALGAAAGHALVLGSGGTAPAAVVGLAELGVTDITVVARNSDKAARLVDLGTRVGVATRFCAFDSGGLADAVAAAEVLVSTIPAEVAAGYAGTLAAIPVLLDAIYDPWPTPLAAAVGSAGGRVISGLQMLLHQAFAQVEQFTGLPAPREAMTCALAALD

SEQ ID NO: 22365 - DNA, 837 bp, Bacillus halodurans
  CDS (1)..(837)
atgaaaaagctttttggtcttttggggcaccctgtcggtcattcattatcaccgctcatgcataaccaaatgtttcaattgttagatttcgatggttattaccatgcattcgacgtggagccgtctcagttagagaaagctgtagaaggggctcgggcgttacaaatgcaaggcttcaatgtgacaatcccgcataaggtgacaattatggattatctcgacatggtcgatgaagaagcgcaagaaattggagctgtaaatacggtagtaatgaaagacgggcaattgttcggttctaatacagatgggcaagggtacttagagtctttgatggatgttgtgacaactccttttccgacacaagatgtgttgattattggtgcaggtggtgccgctcgagcgatcgggacggtgcttaaacgggagaaggttcgatccattacgatcgcgaatcgaacgttggcaaaagccgaggaatttagcggagtccttgaatcgagtgagacaagctgttcagctctttccctaaaagaagctgaacaacaactagaacgtttctcggttattattaacactacatctgtcgggatgagcccccgtgtcgacgatatgcctttgtcccttgaacgtttatcaagggagacggttgttagcgatttaatctataatccacttgaaacgaaatttttacgtgaagccaaacaaaaaggcgcaaaaacggtagatgggttagggatgtttgtcaatcaaggggcgcttgctttcgaattatggacaggtttacgccctgatcgtgaaaaaatgagacgctgtgttttagaacagctaggaggataa

SEQ ID NO: 22366 - protein, 278 aa, Bacillus halodurans
MKKLFGLLGHPVGHSLSPLMHNQMFQLLDFDGYYHAFDVEPSQLEKAVEGARALQMQGFNVTIPHKVTIMDYLDMVDEEAQEIGAVNTVVMKDGQLFGSNTDGQGYLESLMDVVTTPFPTQDVLIIGAGGAARAIGTVLKREKVRSITIANRTLAKAEEFSGVLESSETSCSALSLKEAEQQLERFSVIINTTSVGMSPRVDDMPLSLERLSRETVVSDLIYNPLETKFLREAKQKGAKTVDGLGMFVNQGALAFELWTGLRPDREKMRRCVLEQLGG

SEQ ID NO: 22367 - DNA, 810 bp, Sulfolobus solfataricus
  CDS (1)..(810)
atgcttgaagaaataaattatgatactaagttattcggtctaataggtaaaaacataaagtacacgctatccccttatattcataatttctcatttagaacactaggaataaatgcagtttatctagtttttgatctcgacgaaatgaaattcaagcgtagtattagtgggatattggaaattgcagaaggacttaatgttacgataccgtataaggatgaagtaatgaaatatttggataatactgatacgcactccacgagaattcaagctgtaaatacaatatataaaaaaagtggttataacactgattatttagcaataaaaaatcttgtaagaaagaagattaagaatgtatctggctacgaatgttacatatatggggctggaggtgcagcaaaagcagcagcttttgcgttatctgaattaggatgctctagtattagtattgtgaatagaacaaaatcaagggcttatgagttagctgaattattaaataagaacggttataacgcgtcaattaaagagaattgcaacattacaaataatatacttattgtcaatagcactcctaattcttctgtagtcccagaggactgtgttaaaaaatctgatcttgttatagaatttgtttatagaccagttgagactgagttaattaaaaatgctaaaaaatatggtatacaatatataaacggtctagaaattttagtgaatcaagctgtagaagcggagaagatatggtttaataagagtgtggcagatgaaaagattatagagtatctttatgccagggaactcgtttggtaa

SEQ ID NO: 22368 - protein, 269 aa, Sulfolobus solfataricus
MLEEINYDTKLFGLIGKNIKYTLSPYIHNFSFRTLGINAVYLVFDLDEMKFKRSISGILEIAEGLNVTIPYKDEVMKYLDNTDTHSTRIQAVNTIYKKSGYNTDYLAIKNLVRKKIKNVSGYECYIYGAGGAAKAAAFALSELGCSSISIVNRTKSRAYELAELLNKNGYNASIKENCNITNNILIVNSTPNSSVVPEDCVKKSDLVIEFVYRPVETELIKNAKKYGIQYINGLEILVNQAVEAEKIWFNKSVADEKIIEYLYARELVW

SEQ ID NO: 22369 - DNA, 795 bp, Pyrococcus abyssi
  CDS (1)..(795)
atgaaagtttatggcttgataggaaagcccgtttcacactccttaagccccgttatgcacaatgccctcttcaggaagtatggaatagatgcagtttacgtaacctttgaggttgaggagctcggtaaggctattgatggtgttagggccctcggaatttctgggctcaacgttaccatgccctataaggaggtggtcaccaaattcttggatgagttgtccgaggatgctagggaaattaacagtgttaatactataataaatctggagggttcactaatcggatatacaaccgatggtgtaggggctagaaaagctttggaaaggtttaccgagattgagggaagaaacgtgctaatccttggagcagggggagctgggaaggctatagcgtatgagctatctaagattgcaaacattgtcgttctaaataggacaccctctaaggctaaatccttggagaagttcggtgtgaagggaggaagcttggatgagttacccaattacgtgggttgggcggatgtattgattaacgcaacctcggtgggaatgggaacaaatgaaagcttagttcccaggaggctcttgaggagggaactcatagttatggatatagtctacaaaccccttaaaacgagactattgagggatgccgaaagcgttgggtgcagagttatagatggcttgtggatgctaatctatcagggagccgagagctttaaactttggactgggatatatccggatgtggagcttatgaggagggtttcccttgagaggctcgggaagggctag

SEQ ID NO: 22370 - protein, 264 aa, Pyrococcus abyssi
MKVYGLIGKPVSHSLSPVMHNALFRKYGIDAVYVTFEVEELGKAIDGVRALGISGLNVTMPYKEVVTKFLDELSEDAREINSVNTIINLEGSLIGYTTDGVGARKALERFTEIEGRNVLILGAGGAGKAIAYELSKIANIVVLNRTPSKAKSLEKFGVKGGSLDELPNYVGWADVLINATSVGMGTNESLVPRRLLRRELIVMDIVYKPLKTRLLRDAESVGCRVIDGLWMLIYQGAESFKLWTGIYPDVELMRRVSLERLGKG

SEQ ID NO: 22371 - DNA, 810 bp, Neisseria meningitidis
  CDS (1)..(810)
atgaccgccctcccccgctacgccgttttcggcaaccccgtcgcccacagcaaatcgccgcaaattcatcaacaatttgcccttcaggaaggcgttgacattgaatacgaacgcatttgcgccgacatcggcggtttcgcgcaggcggtttcgacattttttgaaacaggcggttgcggggcaaacgttaccgtaccgttcaaacaggaagcgtttcatctggcggacgagcattccgaacgcgcattggcggcaggtgcggtcaatacgctgattccgttgaaaaacggcaagctgcgtggcgacaacaccgacggtatcggtttgaccaacgacatcacgcaggtcaaaaatattgccatcgagggcaaaaccattttgcttttgggcgcaggcggcgcggtgcgcggcgtgattcctgttttgaaagaacaccgtcctgcccgtatcgtcattgccaaccgtacccgcgccaaagccgaggaattggcgcagcttttcggcattgaagccgtcccgatggcggacgtgaacggcggttttgatatcatcatcaacggcacgtcgggcggtctaaacggtcagattcccgatattccgcccgatatttttcaaaactgcgcgcttgcctacgatatggtgtacggctgcgcggcaaaaccgtttttagattttgcacgacaatcgggtgcgaaaaaaactgccgacggactgggtatgctagtcggtcaagcggcggcttcctacgccctctggcgcggatttacgcccgatatccgccccgttatcgaatacatgaaagccctataa

SEQ ID NO: 22372 - protein, 269 aa, Neisseria meningitidis
MTALPRYAVFGNPVAHSKSPQIHQQFALQEGVDIEYERICADIGGFAQAVSTFFETGGCGANVTVPFKQEAFHLADEHSERALAAGAVNTLIPLKNGKLRGDNTDGIGLTNDITQVKNIAIEGKTILLLGAGGAVRGVIPVLKEHRPARIVIANRTRAKAEELAQLFGIEAVPMADVNGGFDIIINGTSGGLNGQIPDIPPDIFQNCALAYDMVYGCAAKPFLDFARQSGAKKTADGLGMLVGQAAASYALWRGFTPDIRPVIEYMKAL

SEQ ID NO: 22373 - DNA, 861 bp, Lactococcus lactis subsp. lactis
  CDS (1)..(861)
atgaacattaacggctacactcgtatggctgctgttgtagcaaacccaattaaacacagcttgtcaccatttattcataatctggcttttgatttaacgaatgaaaatggtgtttatttagcatgggaagttgaggctgaaaaattgccagctattgtggataatgttcgtactttggacatgtatggacttaatatttcaatgccttataaaacagaaattactccatttatggatgaattgagtccggcagctgaattaattggagctgttaatacagtagtcaatcaatcagggaaattaattggacacaatacagatggcataggatttttcaatagtttagaaaaatatcatttcaatatccaaaataaacaaatgcttattcttggtggagggggtgcagcaattgcaattattgctcaggcagctttgtctggagctaaaaaaattgtggtcgcagcaagaaaatcggcctcatatattccgctaaaagaaaaattggaaaagctgtcagtaaaaacagggattgaaattttactgacagacttatctgaagctgatagattacaaaaagagttgaaacagaccgacttattagtaaatgcaacctcagtcggaatggacggagaatctttgccgctggaaaagagcttagttcttcctgaaaaacttttggtggtagatgctatttataaagttagagaaacaccatttttacgttgggcaaaagggcaaggagctcaaactgaaaatggacttggcatgctcattggacaggcggcggaaagcttttatttatggacaggtaaaaaaatgcctgttgcagaaattacattagaaatggagaaagaagcatga

SEQ ID NO: 22374 - protein, 286 aa, Lactococcus lactis subsp. lactis
MNINGYTRMAAVVANPIKHSLSPFIHNLAFDLTNENGVYLAWEVEAEKLPAIVDNVRTLDMYGLNISMPYKTEITPFMDELSPAAELIGAVNTVVNQSGKLIGHNTDGIGFFNSLEKYHFNIQNKQMLILGGGGAAIAIIAQAALSGAKKIVVAARKSASYIPLKEKLEKLSVKTGIEILLTDLSEADRLQKELKQTDLLVNATSVGMDGESLPLEKSLVLPEKLLVVDAIYKVRETPFLRWAKGQGAQTENGLGMLIGQAAESFYLWTGKKMPVAEITLEMEKEA

SEQ ID NO: 22375 - DNA, 810 bp, Aquifex aeolicus
  CDS (1)..(810)
atgattaacgcccaaacgcagctatacggagtaataggctttcccgtaaagcattccctatcccccgttttccagaatgcccttataagatacgctggtcttaatgcggtatacctcgcctttgagattaaccccgaagaactaaaaaaagcctttgaaggatttaaggctcttaaggttaaagggattaacgtaaccgtccccttcaaggaagaaatcattcccctccttgactacgttgaggacacagctaaggaaataggtgccgtaaacacggtaaagtttgaaaacggaaaagcttacggctacaacaccgactggataggttttttaaaatccctaaagagcttaattccagaggtaaaagaaaaaagtattctcgtccttggagctggaggagcttccagagcggttatttacgctcttgtaaaagaaggggcaaaggtatttctgtggaacaggacaaaggaaaaggcaataaagctagctcaaaagtttcccttagaggttgtaaactctcccgaagaagtaattgacaaggttcaagtaattgtaaacacgacgagcgtaggactaaaagacaaggatcccgaaattttcaattacgacttaataaagaaagaccacgtagtcgtggacataatctacaaagagacaaagcttttaaagaaggcaaaagaaaagggagctaaactctttgacgggcttcccatgcttctgtggcagggaatagaagctttcaagatatggaacggatgtgaagttccctactctgtggcagaaagatctgtaagagatctccgtgggtaa

SEQ ID NO: 22376 - protein, 269 aa, Aquifex aeolicus
MINAQTQLYGVIGFPVKHSLSPVFQNALIRYAGLNAVYLAFEINPEELKKAFEGFKALKVKGINVTVPFKEEIIPLLDYVEDTAKEIGAVNTVKFENGKAYGYNTDWIGFLKSLKSLIPEVKEKSILVLGAGGASRAVIYALVKEGAKVFLWNRTKEKAIKLAQKFPLEVVNSPEEVIDKVQVIVNTTSVGLKDKDPEIFNYDLIKKDHVVVDIIYKETKLLKKAKEKGAKLFDGLPMLLWQGIEAFKIWNGCEVPYSVAERSVRDLRG

SEQ ID NO: 22377 - DNA, 678 bp, Aeropyrum pernix
  CDS (1)..(678)
atggcgggggagctgcacggcttcaacgtcaccaaacccctgaagagggaggccctctcgctggcctcaaccctagacagccacgccagggccataggggcggttaacactatggtggctggcgaggaggggtgggaggggttcaacaccgactggaagggcttcctagactccctcaagctctacacagcatcacccccggacaccgccctcgtcataggcgcggggggcgcggggagggcggcggcctatgccctggcaacctggggggcggggagggtcctgatagcgagcaggacaggcctcacagccaggagggcggcccaggatcttgccggcctgggggccgaggtggagcccgtacccccgggtgggcttgaggatgctgcggcagcctcggacgtcgtcgtcaacgccacccccctgggctgggacggcgtctccacacccgtagagagggggttcagggaggggtgtatagcggtggacatggtgtacaggcccctcgccacacccttcctcaggcgggcggcggccagcggctgcacccccgtggacggcctctggatgctggcgatccaggccgctgagaacatagcggtctggctagggctggaggccagcccggttgagctgaggacctacgccctcgaggccatgcgtgggggtcgaggctaa

SEQ ID NO: 22378 - protein, 225 aa, Aeropyrum pernix
MAGELHGFNVTKPLKREALSLASTLDSHARAIGAVNTMVAGEEGWEGFNTDWKGFLDSLKLYTASPPDTALVIGAGGAGRAAAYALATWGAGRVLIASRTGLTARRAAQDLAGLGAEVEPVPPGGLEDAAAASDVVVNATPLGWDGVSTPVERGFREGCIAVDMVYRPLATPFLRRAAASGCTPVDGLWMLAIQAAENIAVWLGLEASPVELRTYALEAMRGGRG

SEQ ID NO: 22379 - DNA, 849 bp, Xylella fastidiosa
  CDS (1)..(849)
atgcctgtgtcccgttttgctgtgtttggtcatcccattgctcactcgctatcaccgcgcatccataccgagtttggccgtcagatgggtgtcgcgctgaactatcttgcatttgatgttgccccagatgcgtttcgtgtttcgctggagcgttttgttgcggagggtggatgtggtgcaaacgtgacgttgcctcttaaggaggctgcatttgaggtgtgcacaactttaagtgcacgtgcacgccgtgccggtgcggtcaatacgctatctcgggttgacggtgtttggcatggtgagaataccgatgggacaggtttagtacgtaacttgacggagcggcatggtttggatttgcgtggtcgccgcgctttgctgcttggcgctggtggcgctgcacgtggtgtggctcctgcattgctggatgccggcattactgagatggtgatagttaaccgctcccctgagcgtgccgatatgctgtgcgatgcgcttggtgaacctggcagagtcagtgcacgctactggggtgacttgggtgatcttggaaattttgagttgatcgttaacgcgacttcgatcggaaacacatccgatatgcggactttctctctgccgcgttcgttgttggacagtatgactgcggcggtagacctgaattacggtagtgcagcagtccccttcctggcctgggcgcatgcggttgagacccgctatgtgatcgacgggttaggtatgttggttgagcaagcggctgaaagtttctctctctggcacggtcggcgcccggatactgatccagtgtatacggtattacattcagagtatggcgctcctggtcggtcatga

SEQ ID NO: 22380 - protein, 282 aa, Xylella fastidiosa
MPVSRFAVFGHPIAHSLSPRIHTEFGRQMGVALNYLAFDVAPDAFRVSLERFVAEGGCGANVTLPLKEAAFEVCTTLSARARRAGAVNTLSRVDGVWHGENTDGTGLVRNLTERHGLDLRGRRALLLGAGGAARGVAPALLDAGITEMVIVNRSPERADMLCDALGEPGRVSARYWGDLGDLGNFELIVNATSIGNTSDMRTFSLPRSLLDSMTAAVDLNYGSAAVPFLAWAHAVETRYVIDGLGMLVEQAAESFSLWHGRRPDTDPVYTVLHSEYGAPGRS

SEQ ID NO: 22381 - DNA, 855 bp, Pseudomonas aeruginosa
  CDS (1)..(855)
atgagcgcgccgcgatcggttctcgccggcctgatcggtgccggcatccaggcgtcgcggacccctgccctgcacgagcgcgagggcgacgcccagggcatccgctatctgtaccggctgatcgatctcgacccgctgggcaagtcggcggacgacctggagttcctgctcgccgccgccagcgacctcggcttcaccgggctgaacgtcaccttcccctgcaagcaggcgatcatccccctgctcgacgacctctccgccgaggcacgcggcatcggcgcggtgaacaccgtggtgctgcgcgatggccggcgcatcggccacaacaccgactgcctgggcttcgccgagggctttcggcgcggcctggccgacgcgccgcgccagcgcgtggtgcagatgggcgcgggcggcgccggcgcggcagtggcccatgcgctgctcgccgagggcgtcgagcggctggtcctgttcgacgtcgacccggcgcgggcccaggccctcgcggacaacctcaaccagcacttcggcgcgccacgagcgctcgccggcagcgacctggccggcgccctgggcgacgcccagggattggtcaacaccaccccggtgggcatggccaagctacccggcatgccggtgccggcggaactgttgcgcgccgacctgtgggtcgccgaggtgatctactttccgctggaaaccgagctgctgcgccaggcccgcgccctcggctgccgcacactggacggcggcaccatggcggtgttccaggcggtgaaggcattcgaactgttcagcggggtgacggccgacgccgcgcgcatgcaggcgcacttcgccagcctgggcgactga

SEQ ID NO: 22382 - protein, 284 aa, Pseudomonas aeruginosa
MSAPRSVLAGLIGAGIQASRTPALHEREGDAQGIRYLYRLIDLDPLGKSADDLEFLLAAASDLGFTGLNVTFPCKQAIIPLLDDLSAEARGIGAVNTVVLRDGRRIGHNTDCLGFAEGFRRGLADAPRQRVVQMGAGGAGAAVAHALLAEGVERLVLFDVDPARAQALADNLNQHFGAPRALAGSDLAGALGDAQGLVNTTPVGMAKLPGMPVPAELLRADLWVAEVIYFPLETELLRQARALGCRTLDGGTMAVFQAVKAFELFSGVTADAARMQAHFASLGD

SEQ ID NO: 22383 - DNA, 1104 bp, Clostridium acetobutylicum
  CDS (1)..(1104)
atgaaggaacttgaagaaataagaaaagaaatagacgaggtagataaaattataacagagctttttgaaaaaagaatgaatttggttatggaagttgctgagtataaagaaaaaaatagtattccagttagtgatagcaaaagagaaaaaaaagttatagataaaaatataggttacttaaagaataaggaatattctgaggttcttaaggagttttatattaattttatgaacctaagtaaaaagttggagagaaaaagaatttataatgaagaaaaaacgagtgttaatacatcaatttatggtcttataggagaaaagttaggacacagccattcatcatatattcataagcttatttttgaaaaggtaggcattaagggaatatataatttgtttgaggttccaaaagaaaagcttaaagaatcagtagatacctttaaaattataaaatgcggtggattaaatgtaacaataccttataaggtggaggttatgaaggagctatatgaaatttcagagaaagcaagaaaaataggggctgtaaatactttgaagttttcacgagaaggcataagtgggtttaatacagattacattggatttggaaaaatgcttagtaaatttagggttgaaataaagaataatatatgtgttgttttaggaagtggtggagcagcaagagctgtgcttcagtatttaaaggacaactttgcaaaagacatatatgtggttactagaaaccctgaaaagacttctgagatttacggagaatttaaagtcataagttatgatgaactttcaaatttaaagggagatgttataattaactgtactccaaagggtatgtatccaaaagagggggaatcgcctgtagataaagaagttgtagctaagttttcttcagctgtagatctaatatataatccagtagaaactttatttttaaagtatgctagagagagtggagtaaaggctgtaaatggtctttatatgttagttagccaggctgcagcgtcagaagagatatggaatgatatttctatagatgaaatcatagttgatgaaatatttgaagttttggaggaaaaaataaaatcatga

SEQ ID NO: 22384 - protein, 367 aa, Clostridium acetobutylicum
MKELEEIRKEIDEVDKIITELFEKRMNLVMEVAEYKEKNSIPVSDSKREKKVIDKNIGYLKNKEYSEVLKEFYINFMNLSKKLERKRIYNEEKTSVNTSIYGLIGEKLGHSHSSYIHKLIFEKVGIKGIYNLFEVPKEKLKESVDTFKIIKCGGLNVTIPYKVEVMKELYEISEKARKIGAVNTLKFSREGISGFNTDYIGFGKMLSKFRVEIKNNICVVLGSGGAARAVLQYLKDNFAKDIYVVTRNPEKTSEIYGEFKVISYDELSNLKGDVIINCTPKGMYPKEGESPVDKEVVAKFSSAVDLIYNPVETLFLKYARESGVKAVNGLYMLVSQAAASEEIWNDISIDEIIVDEIFEVLEEKIKS

SEQ ID NO: 22385 - DNA, 810 bp, Archaeoglobus fulgidus
  CDS (1)..(810)
atgctctaccttggcgtcataggttaccccatcaagcactcagtctctcccgcaatgcacaatgcagctttacagcatgaggggatagaggggatttatctggcttttgaggttaagccagacaggctgagggatgcagttttcggtgctaaagccttgggattcagggggcttaacgtcacgatccccttcaaggagagcgtcgtggagttcgttgagcttgaaggtgaggcggctaagataaagacagtgaacaccatcgaccttgttgagatggtgggatacaacacggatgtttatggtgtcaaggcagccctttcgggaaccgagcttggtgggaagactgcgctggttgttggtgcaggcggggcggggaaggctgctgcattggctttgctggatatgggctcaactgttatcgttgcaaacagaaccgaggagaaggggagagaagcggttgaaatgctgagaagatatggggagtgcattttctggcctttgagcagagtagaggagctgaaagggaaggtggatgttgttgttaacgccacacctctcggaatgcggggatttaaggcagaaattccggttccgccttcaatgctcgatggagttgagctggtctttgacaccgtttacaatcctatggaaaccccgctgattcgtgaggcgaagaagaggggctgcaaggtcgtttacggcatagaaatgctcgtccatcagggggcaaaggccttcgaaatctggacgggcattgagcctgacgttggggtgatgagggaggctgctttgagggctttgaggttttga

SEQ ID NO: 22386 - protein, 269 aa, Archaeoglobus fulgidus
MLYLGVIGYPIKHSVSPAMHNAALQHEGIEGIYLAFEVKPDRLRDAVFGAKALGFRGLNVTIPFKESVVEFVELEGEAAKIKTVNTIDLVEMVGYNTDVYGVKAALSGTELGGKTALVVGAGGAGKAAALALLDMGSTVIVANRTEEKGREAVEMLRRYGECIFWPLSRVEELKGKVDVVVNATPLGMRGFKAEIPVPPSMLDGVELVFDTVYNPMETPLIREAKKRGCKVVYGIEMLVHQGAKAFEIWTGIEPDVGVMREAALRALRF

SEQ ID NO: 22387 - DNA, 837 bp, Vibrio cholerae
  CDS (1)..(837)
atggcttctcaaatcgatcagtatgccgtttttggtaaccccattaatcacagtaaatccccttttattcatacgctgtttgcacgacaaactcagcagtccatgatctataccgcacagtgcgtgccagtggatgggtttactgaggcggcgaaacatttttttgcgcaaggtggacgaggttgtaatgttaccgtgccatttaaagaggaggcgtaccgctttgccgatcgcttaacggagcgcgcgcgtttagccggtgcggtaaacacgttaaaaaagctggatgatggcgaaatactcggagacaacaccgatggtgaaggcttagtgcaagatctactcgcgcagcaagtgctactgaaaggcgcgacgattttgttgattggtgctggtggtgcggcgcgtggcgtgctcaagccgttattagatcagcagccggcctctattaccgtcacgaatcgtacctttgcgaaagcggagcagttggctgagcttgtggccgcttatggtgaggtaaaggcgcaagcgttcgaacagcttaaacaaagttatgatgtgatcatcaactcgacctctgccagtctcgatggcgaattgcctgcgattgatccggtgatcttttcatctcgctccgtctgctatgacatgatgtatggcaaaggctataccgtgtttaatcaatgggcgcgacaacatggctgcgcgcaagcgatcgatggcttaggcatgttagtgggacaagcggctgaaagttttatgctatggcgtggtttacgtccgggcacgaaacaaattttgcgtgaactgcgtaaaaatctagaaggtgcgctatga

SEQ ID NO: 22388 - protein, 278 aa, Vibrio cholerae
MASQIDQYAVFGNPINHSKSPFIHTLFARQTQQSMIYTAQCVPVDGFTEAAKHFFAQGGRGCNVTVPFKEEAYRFADRLTERARLAGAVNTLKKLDDGEILGDNTDGEGLVQDLLAQQVLLKGATILLIGAGGAARGVLKPLLDQQPASITVTNRTFAKAEQLAELVAAYGEVKAQAFEQLKQSYDVIINSTSASLDGELPAIDPVIFSSRSVCYDMMYGKGYTVFNQWARQHGCAQAIDGLGMLVGQAAESFMLWRGLRPGTKQILRELRKNLEGAL

SEQ ID NO: 22389 - DNA, 825 bp, Pseudomonas aeruginosa
  CDS (1)..(825)
atggaccgctattgcgtattcggcaaccccatcggccacagcaagtcgccgctgatccaccgcctgttcgccgagcagaccggcgaggcgctggtctatgacgcgcaactggcgccgctggacgatttccccgggttcgcccggcgcttcttcgagcagggcaagggcgccaatgtcaccgtgccgttcaaggaagaggcctatcgtctggtggacgagttgagcgagcgggccacccgggccggggcggtgaacaccctgatccgcctcgccgacggtcgcctgcgcggcgacaacaccgacggcgccggcctgctgcgggacctgacggcgaacgccggggtcgagctgcgcggcaagcgggttctcctgctcggcgccggcggtgcggtgcgtggggtgctcgaacccttcctcggcgagtgcccggcggagttgctgatcgccaaccgcacggcgcggaaggccgtggacctggccgagcggttcgccgacctcggcgcggtgcacggctgcggtttcgccgaggtcgaagggcctttcgacctgatcgtcaacggcacctcggccagtcttgccggcgacgtgccgccgctggcgcagagcgtgatcgagcccggccgtaccgtctgctacgacatgatgtatgccaaggaaccgactgccttcaaccgctgggccgccgaacgcggtgcggcgcgtaccctggatggcctgggcatgctggtggagcaggccgccgaggcattcttcctctggcgcggcgtgcgtcctgcctcggcgccagtgttggagacgctgcgccgacagttggcaactgtctga

SEQ ID NO: 22390 - protein, 274 aa, Pseudomonas aeruginosa
MDRYCVFGNPIGHSKSPLIHRLFAEQTGEALVYDAQLAPLDDFPGFARRFFEQGKGANVTVPFKEEAYRLVDELSERATRAGAVNTLIRLADGRLRGDNTDGAGLLRDLTANAGVELRGKRVLLLGAGGAVRGVLEPFLGECPAELLIANRTARKAVDLAERFADLGAVHGCGFAEVEGPFDLIVNGTSASLAGDVPPLAQSVIEPGRTVCYDMMYAKEPTAFNRWAAERGAARTLDGLGMLVEQAAEAFFLWRGVRPASAPVLETLRRQLATV

SEQ ID NO: 22391 - DNA, 816 bp, Haemophilus influenzae
  CDS (1)..(816)
atgatcaacaaagatacccaactctgcatgtctttatcaggtcgtccgagtaatttcggtactacctttcacaattatttgtacgacaagctaggattaaatttcatttataaagcattcaccacgcaagatattgagcacgccatcaaaggcgttcgtgcattaggcatccgtggttgtgctgtttcaatgccattcaaagaaacttgtatgccatttttagatgaaattcatccgtcagcacaagccattgaatccgtaaacaccatcgtgaacgataatggctttttgcgtgcatataacactgattacattgccatcgtaaaattaattgaaaaatatcatttaaataaaaatgctaaagtcattgttcatggcagtggtggtatggcaaaagccgttgtggcagcctttaaaaattcaggttttgagaaattaaaaatttacgcacgcaacgtaaaaacaggtcaatatctcgccgcactttatggctacgcatacattaattctttagaaaaccaacaggcagatattttagtcaatgttacgtcaatcggcatgaaaggcggcaaggaagaaatggatttagcctttccaaaagcgttcattgataatgctagtgtcgcgtttgatgtagtggctatgcctgttgaaacgccctttattcgttatgctcaagcacgaggaaaacaaactatttctggcgcagcagtgattgtacttcaggctgtagaacaatttgaactttatacgcatcaacgcccaagcgatgaattaatcgctgaagctgcggcgtttgctcgaacaaaattttga

SEQ ID NO: 22392 - protein, 271 aa, Haemophilus influenzae
MINKDTQLCMSLSGRPSNFGTTFHNYLYDKLGLNFIYKAFTTQDIEHAIKGVRALGIRGCAVSMPFKETCMPFLDEIHPSAQAIESVNTIVNDNGFLRAYNTDYIAIVKLIEKYHLNKNAKVIVHGSGGMAKAVVAAFKNSGFEKLKIYARNVKTGQYLAALYGYAYINSLENQQADILVNVTSIGMKGGKEEMDLAFPKAFIDNASVAFDVVAMPVETPFIRYAQARGKQTISGAAVIVLQAVEQFELYTHQRPSDELIAEAAAFARTKF

SEQ ID NO: 22393 - DNA, 819 bp, Haemophilus influenzae
  CDS (1)..(819)
atggatctttatgctgtgtggggcaatccgattgcgcaaagtaaatcgccgttaattcaaaataagttagccgcacaaacccatcaaactatggaatacattgcaaaattaggcgatcttgatgcttttgaacaacagcttttggcattttttgaggagggtgcgaaaggttgcaatattacttcgccttttaaagaacgcgcttatcagctggcagacgaatatagccaacgagcaaaactggcggaagcctgtaatacgctaaaaaaactcgatgatggaaaactttatgcggataacactgatgggattggcttagtgacggatttacaacgtttaaattggcttcgtccaaatcagcacgtattaatcttgggggcgggcggagcaacaaaaggcgtattattgccacttttacaagctcaacaaaacattgtgcttgctaaccgcactttttcgaaaaccaaagaattagctgaaagatttcagccttacggcaatattcaagctgtctctatggattcgattccgctacaaacttatgatttggtgattaatgcaacttccgctggattaagtggtggaacggcttcagttgatgctgaaattttaaaattgggctcggctttttatgatatgcaatatgcgaaaggcacagacacgccatttattgcattatgcaaaagtttaggtttaaccaatgttagcgatggctttggaatgttagtcgcacaagcagcacattctttccatttatggcgaggcgtaatgccagattttgtctcggtttatgaacagcttaaaaaggcgatgttatga

SEQ ID NO: 22394 - protein, 272 aa, Haemophilus influenzae
MDLYAVWGNPIAQSKSPLIQNKLAAQTHQTMEYIAKLGDLDAFEQQLLAFFEEGAKGCNITSPFKERAYQLADEYSQRAKLAEACNTLKKLDDGKLYADNTDGIGLVTDLQRLNWLRPNQHVLILGAGGATKGVLLPLLQAQQNIVLANRTFSKTKELAERFQPYGNIQAVSMDSIPLQTYDLVINATSAGLSGGTASVDAEILKLGSAFYDMQYAKGTDTPFIALCKSLGLTNVSDGFGMLVAQAAHSFHLWRGVMPDFVSVYEQLKKAML

SEQ ID NO: 22395 - DNA, 762 bp, Thermotoga maritima
  CDS (1)..(762)
atgaaattctgcatcatagggtatccggtgagacacagcatatcaccaaggctttacaacgagtatttcaaaagggcgggaatgaaccactcgtacggtatggaagagataccacctgaatctttcgacacggagataagaaggattctcgaagaatacgatggtttcaacgcgacaattcctcacaaagaaagagtgatgcggtacgtcgaaccatctgaagatgcgcagagaataaaagccgtgaactgtgtctttcggggaaagggatacaacaccgactgggttggcgttgtgaaatcgctcgagggtgtagaggtgaaggagcccgttgtcgttgtgggagcgggcggagccgcacgtgccgtgatctacgctctcctccagatgggcgtgaaagacatctgggtggtgaacagaacgatcgaaagggcgaaggctctcgattttcctgtgaaaattttctctctcgatcagctcgacgaggttgtgaaaaaggcgaagagtctcttcaacaccacttcggttggtatgaagggagaggaacttcccgtttctgacgattcactgaaaaacctgagccttgtttacgatgtgatctacttcgacacaccacttgttgtgaaagcaagaaaacttggtgtgaaacacatcataaagggaaacctcatgttttactaccaggcaatggagaatctgaagatatggggaatatacgacgaggaggttttcaaagaagtgttcggggaggttctgaaatga

SEQ ID NO: 22396 - protein, 253 aa, Thermotoga maritima
MKFCIIGYPVRHSISPRLYNEYFKRAGMNHSYGMEEIPPESFDTEIRRILEEYDGFNATIPHKERVMRYVEPSEDAQRIKAVNCVFRGKGYNTDWVGVVKSLEGVEVKEPVVVVGAGGAARAVIYALLQMGVKDIWVVNRTIERAKALDFPVKIFSLDQLDEVVKKAKSLFNTTSVGMKGEELPVSDDSLKNLSLVYDVIYFDTPLVVKARKLGVKHIIKGNLMFYYQAMENLKIWGIYDEEVFKEVFGEVLK

SEQ ID NO: 22397 - DNA, 801 bp, Halobacterium sp. NRC-1
  CDS (1)..(801)
atggacgtctacggactgatcgggaacccggtcgggcattcgctgtcgccgccgctgcacgcggccgcctacgacgagtgcgggctcgacgcccggtacgtgaccttcgagccggcaccggacgacgccgcggccgccatccgaggggctggcgcgctcggcgtggcggggttgaacgtcaccgcgccgttcaagcagtcggccgcgtcggcggtggcgaccgactcgatggccgcccgggtgggcgccgtcaacaccatcgacttctccggggccgcgccccgtggatacaacaccgacgttgcgggcgtgaagcgcgcgttcgcccaccacgacgtgtcgctgtcgggcgcgcaggctgtggtcgtcggcgcgggtggtgccggccgcgccgccgcgttcgcgctcgccgacgccggggcgaccgttcggatcgccaaccgaacacgggcggccgccgacgaactcgccgccgacgtgggtggcacggccgtcggcctcggtgacctgccgcggagcctcgccgacgcgacggtcctggtccacgccaccacggtggggatggacgacccggacacgtcgccggtgtccgccgacgccctccacgacgatctcgccgtcctggacgccgtgtactcgccggttgagacgcggctgctgcgggacgccgcggccgccggcgcaaccacgatcgacggcgcgtggatgctgctctatcagggtgccgaggcgttcgagcgctggaccggcctggacgcccccgtggcggcgatgcgcgccgccctccgtgcacggctttaa

SEQ ID NO: 22398 - protein, 266 aa, Halobacterium sp. NRC-1
MDVYGLIGNPVGHSLSPPLHAAAYDECGLDARYVTFEPAPDDAAAAIRGAGALGVAGLNVTAPFKQSAASAVATDSMAARVGAVNTIDFSGAAPRGYNTDVAGVKRAFAHHDVSLSGAQAVVVGAGGAGRAAAFALADAGATVRIANRTRAAADELAADVGGTAVGLGDLPRSLADATVLVHATTVGMDDPDTSPVSADALHDDLAVLDAVYSPVETRLLRDAAAAGATTIDGAWMLLYQGAEAFERWTGLDAPVAAMRAALRARL

SEQ ID NO: 22399 - DNA, 1434 bp, Chlamydophila pneumoniae, Chlamydia pneumoniae
  CDS (1)..(1434)
atgttatgcgccactgttagcggtccctcattttgtgaagcaaaacaacaaattctaaagtctctacaccttgtagatattatagaactacgactcgatctcataaacgaacttgatgatcaagaactgcataccctcattaccacagcccaaaaccccatcctcacctttagacaacacaaagagatgtcgacagcgctatggattcaaaaactatattccctagcaaaacttgaacccaagtggatggatatcgatgtgagtcttcctaagaccgcccttcaaaccatccgcaagagccatcctaaaataaagctcatcctttcctatcatacagacaaaaatgaagacctcgatgcaatctataatgagatgcttgcaactcccgctgagatctacaaaatcgtactctccccagagaactccagtgaagctctgaattatataaaaaaagctcgcctgttaccaaaaccatctacagtcctttgtatgggaacccatgggctcccctctagagttctctccccactgatcagcaacgctatgaattacgctgctggaatcagtgcgcctcaagtagccccgggacaacctaaacttgaggagctgctctcctataactactcgaagctatctgaaaaatcacacatttacggactcatcggagatcctgtagaccgtagcatcagtcacctctcccacaacttcttactctctaagctttctctcaatgcaacatatatcaaattccctgttactataggggaagtcgtcacctttttctctgcgatccgagatcttcctttttcaggacttagtgtcactatgccactaaaaaccgcaatcttcgaccatgtcgatgctcttgatgcatcggcgcaactctgcgagtctataaacaccctggtcttccgaaatcagaaaattctaggttacaatacagacggtgagggagtagccaaactcctaaaacaaaagaatatctctgttaacaacaaacacattgccattgtaggtgctggaggtgctgctaaagcaatcgctgcaacactggcgatgcaaggtgctaatctccacatcttcaatagaactctttcttcagcagctgctttagctacttgctgtaaaggcaaagcctatcccttaggctccttagagaattttaaaactatagacataatcatcaactgtctccctccggaagtgaccttcccttggagattccctcctatagtcatggacatcaataccaaaccgcatccctctccctaccttgaacgtgctcaaaaacatggctctctcattatccatggctacgaaatgttcatagaacaagccctgctacaatttgctctttggttcccagatttcctaactccagagtcttgtgactctttccgaaactatgtaaaaaacttcatggcaaaagtataa

SEQ ID NO: 22400 - protein, 477 aa, Chlamydophila pneumoniae, Chlamydia pneumoniae
MLCATVSGPSFCEAKQQILKSLHLVDIIELRLDLINELDDQELHTLITTAQNPILTFRQHKEMSTALWIQKLYSLAKLEPKWMDIDVSLPKTALQTIRKSHPKIKLILSYHTDKNEDLDAIYNEMLATPAEIYKIVLSPENSSEALNYIKKARLLPKPSTVLCMGTHGLPSRVLSPLISNAMNYAAGISAPQVAPGQPKLEELLSYNYSKLSEKSHIYGLIGDPVDRSISHLSHNFLLSKLSLNATYIKFPVTIGEVVTFFSAIRDLPFSGLSVTMPLKTAIFDHVDALDASAQLCESINTLVFRNQKILGYNTDGEGVAKLLKQKNISVNNKHIAIVGAGGAAKAIAATLAMQGANLHIFNRTLSSAAALATCCKGKAYPLGSLENFKTIDIIINCLPPEVTFPWRFPPIVMDINTKPHPSPYLERAQKHGSLIIHGYEMFIEQALLQFALWFPDFLTPESCDSFRNYVKNFMAKV

SEQ ID NO: 22401 - DNA, 861 bp, Sinorhizobium meliloti
  CDS (1)..(861)
atgaccgaaacgcttgtgagatccttgaaggcgggcctgatcggcaccggcatccaggcttcgctgacgccggccatgcatatggcggaaggcgcggcgcagggcattcgctacgactacgagctgatcgatctcaacctgctaggggcgagcgagaaggacctgccgcgcttgctcgccgacgccgagcggcgggggttcgccggactcaatatcacccatccctgcaagcaggcggtcattccctatctcgacgagctcgcctccgaggcgcggcagctcggcgccgtcaacacggtcgtcctcagaagcggacggcgctacggccacaatacggactggtggggctttgccgaaggcttccggcgcggcctgccggatgccgatctcttctccgccgtgcagctcggcgccggcggagccggggtcgccacggcctatgccgcgctctcgcttggcttgcagcggctcgtcgtgttcgaccgcgaggccggccgggcgcaggcgctcgcccggatgctctcccctctctttccgagagccgaggtggcggccggcaacgaccttccctcggaaatgagaaatgccgccggcctcatccacgcgacgccgaccggcatggcgaaatatcccggattgccgctcgacgccgagcttctttcgcgaagcctttgggtcgccgagatcgtctattttccgctggaaacggcgcttctcagggaggcccggcggcgtggttgcaaaacgctcgacggtggcggcatggcggtgtttcaggcggtcggcgcgtttcggctgttcaccgggctcgaacccgacgccgcgcggatgctcggccacttcagggcgatgaccggctag

SEQ ID NO: 22402 - protein, 286 aa, Sinorhizobium meliloti
MTETLVRSLKAGLIGTGIQASLTPAMHMAEGAAQGIRYDYELIDLNLLGASEKDLPRLLADAERRGFAGLNITHPCKQAVIPYLDELASEARQLGAVNTVVLRSGRRYGHNTDWWGFAEGFRRGLPDADLFSAVQLGAGGAGVATAYAALSLGLQRLVVFDREAGRAQALARMLSPLFPRAEVAAGNDLPSEMRNAAGLIHATPTGMAKYPGLPLDAELLSRSLWVAEIVYFPLETALLREARRRGCKTLDGGGMAVFQAVGAFRLFTGLEPDAARMLGHFRAMTG

SEQ ID NO: 22403 - DNA, 873 bp, Synechocystis sp
  CDS (1)..(873)
atgccttccatcaccggtaaaactaagctccttggtgtgatcggttatcctgttggtcattccttatcccctgtgatgcataatgcggcgctccaggccatggccagtgattatgcatatgttgcctttcccattgctccagaggatttaaccatcgccatagcagggttaggagccagtggagtccagggattaagcgtgaccattccccataagcaagtggtgatgccattgttgacccagataaccgaaaccgctcggcaagtgggggccgtgaatactctctggcgggatggccatggctggcagggaaccaatacggatgttgagggttttttggctcccttgttggagttaaagcaagattggtcagggaggacggcggtgattctcggctatggtggagccgcgcgggccgtggtggtgggtttaacccaattgggttgtccagaaattattgtggtgggtcgcagtcaagaaaaattagctcagttcgccaacagttggacggaccccaaaattaagcaagctctgcaagttctaccctgggaagctctatctaccgtgatccccaaagcaagtttattgattaacagcacccccgtgggcatggctccccaccctaagcaatcccccctggatcaatcccttgtggaaaaactaccgccaacggcgatcgcctatgatttgatttatactccccgccccaccaggtttttacaacatgctcaggagcggggtctagtgaccattgatggagcagaaatgctagtgcaacagggagccgccgccttgaaaatttggctacaacaggaagtgccggtggacgttatgcgccaagccctactccatcacttagaaaaatctgcctga

SEQ ID NO: 22404 - protein, 290 aa, Synechocystis sp
MPSITGKTKLLGVIGYPVGHSLSPVMHNAALQAMASDYAYVAFPIAPEDLTIAIAGLGASGVQGLSVTIPHKQVVMPLLTQITETARQVGAVNTLWRDGHGWQGTNTDVEGFLAPLLELKQDWSGRTAVILGYGGAARAVVVGLTQLGCPEIIVVGRSQEKLAQFANSWTDPKIKQALQVLPWEALSTVIPKASLLINSTPVGMAPHPKQSPLDQSLVEKLPPTAIAYDLIYTPRPTRFLQHAQERGLVTIDGAEMLVQQGAAALKIWLQQEVPVDVMRQALLHHLEKSA

SEQ ID NO: 22405 - DNA, 2195 bp, Lycopersicon esculentum (tomato)
  CDS (80)..(1717)
cacttggaatatttcaagctggctgctgaggctacatttctgttgtttacccatctgtgtgctctaaagttggttgccaatggagttggttgtagattctggagtgaagaagatggagggtgaagcaatgaggaagaatcaaactctaatttgtgcaccaattatggctgattcagtggatcaaatgttgattcttatgcaaaaggctaaaattagtggggctgatcttgtggaggttcgagtggatagcttgaaaagctttaatcctcgcccagatattgataccctgatcaaacaatgccctttgcctactctcttcacttacagctatgttttgggcgtggggcaggggatactgttaatacggtactataaaggcatagggcccacttgggaaggtggtcagtatgctggtgatgaaaagagtcgattggatgcacttcgattagcgatggagttgggagctgattacattgatgttgagctaaaggctattggcgagttcaacaatgccctacatggaaataaatctgcaaaatgcaaacttattgtttcttctcacaactatgaaagcacaccgtcagctgaggatctgggcaatctagtagcaagaatacaggcatctggagctgacattgtgaaatttgctacaactgcacaggatatcactgatgttgcacgtgttttccaaattactgttcattctcaagttccaataatagccatggtcatgggagagaagggtttgatgtctcggatactttgtccaaaatttggtggatacctcacgtttggtactcttgaagtgggaaaagtttcagctcctgggcaaccaacagtcgaagatcttctgaatttatacaatttcagacagttgggaccagataccaaaatatttggcattattgggaagccagttagccatagcaaatcacctttattatataatgaatccttcagatcagttgggtttaatggtgttttcatgcatttgctggtagatgatattgcaaactttttccggacttattcatcattagattttgctggattcagctgtacaattcctcacaaagaagccgctcttgactgctgtgctgaaattgatcctactgctaaggcaataggggctgtcaattgtattataaggcgacctgatgggaagttatttggttgtaatacagactatatcggtgctatttccgccattgaagaaggattgcaaggttcacaacctagtatatctgggtcacctttggctggtaaattgtttgtggtcattggtgctggtggcgctggaaaggcgattgcttatggcgcaaaggaaaagggggctagggtggtgattgctaatcgtacctatgaacgagcgcgagaacttgctattgttgttggagctgaggccttatctcttgacgagcttagcaatttccatccagaaaatgatatgattcttgcaaataccacctccataggcatgcaaccaaaggttgatgatacaccaatctctaaggaagctttgaagcactactcacttgttttcgatgctgtttatacacccaaaatcactagactcctgcgagaagctcaggagagtggagcaaaaattgtgacaggagttgaaatgtttatcgggcaggcatatgaacaatatgaaagatttacaggattgccagctcctaaggaacttttcaagaatataatgtctacatactgagaggatccctttcacttttcaatcggggctgctaattattattactcctaaatctgacatgattgtgttagagtttgctctatctaccactgtttgtacttcagaggaagtaattttgtccacgtaaatcgtactttttgcggaaacagaggatgttcagacataccagttaatctatggcaggaaaatccaccatctttctggctatgttagaactcttgattctttgacaagtattgtattttgggaggaaattcattaaacagagatgtatacattgcttcatcattgtaaaatcatacttagaaattcctcttgattatcatcatcattattaaatgttgtcacattattgtatcatactaagacaaattttgaattgagttcaatgacttttgagttgtaagcatgatgcactgccagtttgtgttttaataaatccaggttccactttactagtccatttctcgtgctttta

SEQ ID NO: 22406 - protein, 545 aa, Lycopersicon esculentum (tomato)
MELVVDSGVKKMEGEAMRKNQTLICAPIMADSVDQMLILMQKAKISGADLVEVRVDSLKSFNPRPDIDTLIKQCPLPTLFTYSYVLGVGQGILLIRYYKGIGPTWEGGQYAGDEKSRLDALRLAMELGADYIDVELKAIGEFNNALHGNKSAKCKLIVSSHNYESTPSAEDLGNLVARIQASGADIVKFATTAQDITDVARVFQITVHSQVPIIAMVMGEKGLMSRILCPKFGGYLTFGTLEVGKVSAPGQPTVEDLLNLYNFRQLGPDTKIFGIIGKPVSHSKSPLLYNESFRSVGFNGVFMHLLVDDIANFFRTYSSLDFAGFSCTIPHKEAALDCCAEIDPTAKAIGAVNCIIRRPDGKLFGCNTDYIGAISAIEEGLQGSQPSISGSPLAGKLFVVIGAGGAGKAIAYGAKEKGARVVIANRTYERARELAIVVGAEALSLDELSNFHPENDMILANTTSIGMQPKVDDTPISKEALKHYSLVFDAVYTPKITRLLREAQESGAKIVTGVEMFIGQAYEQYERFTGLPAPKELFKNIMSTY

SEQ ID NO: 22407 - DNA, 4746 bp, Pneumocystis carinii
  CDS (1)..(4746)
atgaaggaaattatcaaacttagtattttagggaaagattctattcatattgggcttcacttatggccacatataactaatgaactatttacatgtatattttctccaacatatgtaatcattacggattcaaatattgaaaccttatatattcctagtttcaaaacatatttcatttctatggcaaaacaaagatctattaattctcgtcttttattttttacaattcctcctggagaaaaatcaaaatcaagaaaaacaaaagcacttatagaggattggcttttatcagaaaaatgcacaagagatactgttataatagctatagggggcggtgttataggcgatctcgtaggttatgtctctgcaacatttatgagaggagttcgttttattcaaattcctacaactcttttagctatggtagattcatctattggagggaaaaattctataaatacatcttatggaaaaaatgcaattggtactatttggcaaccggaaagaatttttattgattttacatttcttgaaacacttacagaaaaagaatttataaatggtatagcagaactaatcaagactattattatatgggatgaatcagaatttgcatctctagaaaacatttcagaaaaaattgcgaaaacagtgagatcaatgtcattaacatctaataaacattcaaaatttaatgaaattataaaagatcttaaaagatatattatatcttcgataaaaattaaagctcacattgtttctattgatgaaaaagaaaaagatcttagaactcttttaaattttggccattctataggacatgcaatagaaacagttctagctccttatattcttcatggagaatctatttctattggaatggtcaaagaagcagagctttctaggcatttaggtatactaaatcctaatgtagtatcacgactcatcaaatgtttaaacacatggggtttacctacatcttttaaagataggcgatttaaagaagtaattttgggaaaaaaacatttaatagaagatatccttgaaattatgtctatagacaaaaaaaatgatagtaataataaaaaaatagtccttctttcagcaataggaaaaacatatgaaaaaaaagcatcctcagtatctgacgatgatattagaactattttatcacaaaatattcttttatatggtattccattaaatgcatttcaaaaacacactacaattactcttccaggatctaagtctatatccaatagagcattaattttagcttcactttctaacggaatttgttatttaaaaaattttttgcattcagatgatacatattacatgctttctgctttggaaaaactaaatgcagcagaattcaaatgggaacaagatggagatgtattagtcgttaaaggtaaatcaggatatcttgaaaaccctcaaatggaattatatctgggaaattcaggaacaacagctagatttttaaccagtatctgtacactagtacaacctaattcacgtgaaaatcatttaatactgacagggagtaatcgtatgaagcagagacctatcggccctttagtagatgctcttaaaaataatggatgttgtatagaatatcttgagttagaaaattgcttaccattattaattaaaccaaaagaaatagggctttatggggggaatatcaatctttccgctactgtctcatcccaatatgtatcatcaattttaatgtgttcaccatatgcaaaaacacaagtaactctctcattaattggaggaaaaccaatatctcaaccctatatagatatgactatttctatgatgtcatcatttggtattaaagtaaccagatctcattcaaaggaaaatacatattatattccaaaaggatgttacacctgtccctctgaatatataattgaaggcgatgcaacttcagctacttatcctttagcaattgctgcaataacgggtggaagctgcactatatctaatgttggtagtgcttcattacaaggagactctaaattttcagaatatatattaaaacctatgggatgtgaagtggtccaatcgcctacaactacatatataaagggccctccaaaagggaaactcaaatcattagggtctataaatatggaatcaatgactgatacctttttaacagcagcagttttagcctctgttgcttatgaagagtcaaaaccatatgttacaaaaatcaccgggatttctaatcaaagaattaaagaatgcaatagaatcaatgctatggtttgtgaacttaaaaaatttggaatagaagcaggtgaacttccagatggaatatatgtaaaagcattgaatacttccaatcttccatattcagtagaaggaataaattgctataatgatcacagaattgcaatgagttttagtgttttagcatgcatctcttccaaaccaactactattctagataaagcttgtgtcaataaaacctggccttattggtgggatattttaaattcaacttttaaagttcaaatgaaaggaattgaattcgatctaaaccctacaatcaattcatctatattgcatcatccatcagaatgtactatttttcttattggaatgagaggagctgggaaaacaactttaggacagcttgcagctaactttcttgggcgggaatttattgacttagactcaattattgaagaagatattaaaacaacaatcctagaattcattcaaaaatatagttgggatgtttttagaagaaaagaactacattttcttaaaactcttttaacagaaaaaaaagaaaactatattatatcttgtggaggtggcattattgaaactgaagaagctagagatctcttaatatcttatatagaagctaatggaattgttatacatattcatcgtaatattcaggatattattaaatatttaaatactgacaaaacacgtgctccttatcaagataatataatgcatgtatgggaaagacgaaaaagatggtataatttatgcagttctcatcaatttcacatgacttcaacagatcctacagaatttaaaaaaaatataccgttaaatcttaaatcctcctttaataattttttaagaacaattacaggaaaaaataatatattttctctaattttgaagaaaaaaagaagttattttttatctttagcattttctgaccttgaaaacattttttctttacttgatattataacagctggatgtgatgcaattgagataagaatcgatttatttcaaaaacctgaggaaattgacaaatatccaagcttagaatatatagcagagaaaatatttctacttcgtcaaaaaactagtcttcctttgatttatacgttgcgtacaacgaatcatggaggatcatttctttcttctgaaaaaaaattagcgaaagaatatatattacatggtgcaaaatggggattcgaatttcttgatatagaattagatatagcatctgaattatttaagaccataaataactcttggccatatacaaagataattgcatcttatcataatatagaaaaaccaatatcttgcgatgattttgaatggatacaaaagtacaaagaagctcaacactacggtcacattataaaattagtgggaacttcatcatcaattgaagataattttttcttagaagaatttaaaagcaaatttattaataaaaaagtaccttcaataataataaacacaggcataaaaggccaattatctagaataatgaatacatttatgacgcctgttactcatccatcgctaccatccaaaatagcacctggacaactatcaattaaagaaattaacactgctcttcatataatgggtcttcttccagaaaaaaaatattttctttttggaaaacctattaagcattctcaatcacctaatattcataatttaggttttgaaattttaggtcttccatataaatatcaattgtttgaaacagattctattagtgaacttaaagaaatcttacatttagaagaattcgggggagcttctgttactattccactaaaaacaaacatatcaattttattagatgaaatatcagatcatgcagcattaattggttctgttaatactataacaagaacgtataataatggacaatatattcttaaaggtgaaaatacggattggcaaggaataataaaagcaataaagaattttaacaaatttgaaaaatcctttgaaaatttctcagggtttataattggagcaggaggagcaagtagggcagctatatatgcattactttctcttggaatatctccaatttatcttataaatcgatctaaagataaactaaataaattatatcatttttttaacacaaatcacataattcccataacagaatatcatgaattaaataatataaattttgatattcgaataggaatttctacaataccaacagataatccaatagatccttctgttctagaaatagcaaaaattttctttaatttaaaaagaaaatcatcagaaggtatatttttagatatggcatatggatcaaatacaacagaccttactattattgcaaaagcgtgcaattggaaaattatacatggtttagaaattttgctagaacaaggctcagaacaatttttattatggaccgaaacatatatcccttataatcaagtgaaatatgctatattaggaccaaacaaataa

SEQ ID NO: 22408 - protein, 1581 aa, Pneumocystis carinii
MKEIIKLSILGKDSIHIGLHLWPHITNELFTCIFSPTYVIITDSNIETLYIPSFKTYFISMAKQRSINSRLLFFTIPPGEKSKSRKTKALIEDWLLSEKCTRDTVIIAIGGGVIGDLVGYVSATFMRGVRFIQIPTTLLAMVDSSIGGKNSINTSYGKNAIGTIWQPERIFIDFTFLETLTEKEFINGIAELIKTIIIWDESEFASLENISEKIAKTVRSMSLTSNKHSKFNEIIKDLKRYIISSIKIKAHIVSIDEKEKDLRTLLNFGHSIGHAIETVLAPYILHGESISIGMVKEAELSRHLGILNPNVVSRLIKCLNTWGLPTSFKDRRFKEVILGKKHLIEDILEIMSIDKKNDSNNKKIVLLSAIGKTYEKKASSVSDDDIRTILSQNILLYGIPLNAFQKHTTITLPGSKSISNRALILASLSNGICYLKNFLHSDDTYYMLSALEKLNAAEFKWEQDGDVLVVKGKSGYLENPQMELYLGNSGTTARFLTSICTLVQPNSRENHLILTGSNRMKQRPIGPLVDALKNNGCCIEYLELENCLPLLIKPKEIGLYGGNINLSATVSSQYVSSILMCSPYAKTQVTLSLIGGKPISQPYIDMTISMMSSFGIKVTRSHSKENTYYIPKGCYTCPSEYIIEGDATSATYPLAIAAITGGSCTISNVGSASLQGDSKFSEYILKPMGCEVVQSPTTTYIKGPPKGKLKSLGSINMESMTDTFLTAAVLASVAYEESKPYVTKITGISNQRIKECNRINAMVCELKKFGIEAGELPDGIYVKALNTSNLPYSVEGINCYNDHRIAMSFSVLACISSKPTTILDKACVNKTWPYWWDILNSTFKVQMKGIEFDLNPTINSSILHHPSECTIFLIGMRGAGKTTLGQLAANFLGREFIDLDSIIEEDIKTTILEFIQKYSWDVFRRKELHFLKTLLTEKKENYIISCGGGIIETEEARDLLISYIEANGIVIHIHRNIQDIIKYLNTDKTRAPYQDNIMHVWERRKRWYNLCSSHQFHMTSTDPTEFKKNIPLNLKSSFNNFLRTITGKNNIFSLILKKKRSYFLSLAFSDLENIFSLLDIITAGCDAIEIRIDLFQKPEEIDKYPSLEYIAEKIFLLRQKTSLPLIYTLRTTNHGGSFLSSEKKLAKEYILHGAKWGFEFLDIELDIASELFKTINNSWPYTKIIASYHNIEKPISCDDFEWIQKYKEAQHYGHIIKLVGTSSSIEDNFFLEEFKSKFINKKVPSIIINTGIKGQLSRIMNTFMTPVTHPSLPSKIAPGQLSIKEINTALHIMGLLPEKKYFLFGKPIKHSQSPNIHNLGFEILGLPYKYQLFETDSISELKEILHLEEFGGASVTIPLKTNISILLDEISDHAALIGSVNTITRTYNNGQYILKGENTDWQGIIKAIKNFNKFEKSFENFSGFIIGAGGASRAAIYALLSLGISPIYLINRSKDKLNKLYHFFNTNHIIPITEYHELNNINFDIRIGISTIPTDNPIDPSVLEIAKIFFNLKRKSSEGIFLDMAYGSNTTDLTIIAKACNWKIIHGLEILLEQGSEQFLLWTETYIPYNQVKYAILGPNK

SEQ ID NO: 22409 - DNA, 4722 bp, Schizosaccharomyces pombe
  CDS (1)..(4722)
atgtcaaacgaatctaatataattacagttcctatactcggaaaggatactgtgagagttggatttggtatacatcaatatatatgcactgaaattctggaaaacttcaagtcttcgacatacgtcgtaattacagattcaaatattgcacctctttacctggaaaagattgaaagtacttttaataagtctattaaagatgccaaggctgaagcaaggttgcttacttatgtgattcctcctggagaatcttcaaaatgccgagctatgaaagcggaaattgaagattggttgctcacacaatcctgtacacgagataccatccttattgctatgggaggtggagttattggtgatttagtgggatatgtagctgcttcattcatgcgtggcattcgttttattcagatgcctaccaccttgcttgctatggttgattcttctattggagggaagacaggtattgacactcccttgggaaaaaaccttgttggtgctttttggcaacctcttagagtgtatgttgatatggtctttttacataccttacctccccggcaagtcataaatggcttgtccgaaattataaaaacagctgctatgtggaacgaaaatgattttcaattacttgaaaacaattccgctgttttattggatgccttgaacaaaccttccgttccaggagaatacaagtttgatagtatcaaaccgcttttgcaaaaaattattctttcctcaattcgtactaagtgtgaagtagttacgcttgacgaacatgagggtggtctccgtaaccttttaaactttggtcattctattggtcatgcttatgaagcaattttgtacccacaaatccttcatggagagtgtgttgcaattggtatggttaaggaagcagaactcgctagataccttggtattttaaagcctaatgcagttggacgcttaacaaaatgcctcgtttcttacaacttgcctattagcgttaatgatccgaaagtaaaaaaatatgctagctttaagcactgccctgtggaaaaactgattgaatacatggctgtggataagaagaatcaaggatctaaaaaacgtatagttattttaaaggctattggtgaaacttacgaaaaacatgctacagtagtttcagatgacgatattcgctttattctttctcgggatgtaaaggtcgacgaatttactaaatcaagttgggatgttgttgttactcctcctggatctaagtcaatctccaatcgcgctcttgttttggcggctatgggcaatggtacatgccgtcttactaacatgcttcactcagacgatacccagtttatgatgtcggctctggaatcgttaggtgctgctacattttcttgggaagatggtggagaaacattggtagtcaaaggaaatggtggtaagttggccgtccctaaggaagagttatatttaggaaatgcaggaacagctgctcgttttttgactggtattgctgctttggtctcttcaaaggatggtgccaaagttgttttaactggaaatcaccgaatgaaggttagacctataggaccactggttgatgctctaagagcaaatggatgtgaaattaattatcttgaaaaacaaggctctttgcccttagatttatcatctaaaaatggtttaaaaggtggtattatagaactagctgccactgtttcctcgcagtacgtatcttctatcttgatgtgtgctccttatgcttcacaacctgttacactaaaattagtaggcggcaagcccatttctcaattgtatattgacatgaccattgctatgatggcttcatttggtgtcaatgttacgaaatctactacggaagaaaacacttataatataccttgcggaaagtatcaaaaccctccgcattacgaaattgaaagcgatgcaagttcagccacttatcctcttgctattgcggccattaccggtaccaagtgtactgttcctaatattggcagtgcttccctacaaggtgatgcccgttttgcgtgtgatgtgttaaggccaatgggctgtactgtcgagcaaactgctactagtactactgttcagggtcctccaaaaggaactctaaaaccattagagtctatagatatggaaaccatgactgatgcatttttaaccgcttctgttgttgccgcggttgcttgtaacgtttctgaaggagatccagttacacgaatcactggcattgcaaaccaaagagttaaagaatgtaaccggattgccgcaatggttcacgaacttgcaaaatttggtgttcgtaccggcgaattggaagacggcatttacattttcggcaaaaattataaagaacttaaaaaacccgaagaaggaatttatacttatgatgaccatagaattgctatgtcatttagcgttttgtcattaatttgtccctctcgcacattgattattgataaagcttgtgtcgagaagacctggccatattggtgggatgtacttcatcagtctttcggtgttaagcttactggtgcaacctctgttgcttccgatccattaaagggaagtatttcaaaaaatgcttctataattttaattggtatgcgaggtgcaggtaaaactaccattggtaaaattatagcgaagcaactaaactttaagttccttgatttggatgaattactagaagactatcttgagatgcccattgctgaagttattttcaggatgggatgggatgctttccgtcttgaagaacacaaagtattgcgaaagtttattactgaacatcctgaaggttatgttgctgctagcggtggaggggttattgaaatggacgaatcgcggaatctgcttagtaattttgttaaggagggtggaatagtgctacatgtccacagaaatttggagcatatcaagtcttacctttcagaggaccagactagacccacttataaagatcaagaaagcattgacgatgtttataagcgccgtcatgtatggtatcgcgaatgtagatctcattattttattagccctgttttaagtaaccaggtaattgacgaaaaaattcagtattcgatgtctcgtttcttagatgtcgttactggatcctcgcaagtccttcaaaaatttaaaaccaaaaaacgctctacatttttgactctaaattatcctcgtattgaggatgctttgccaactttaagagatgtgacagttggctgtgatgcaattgaagttcgtgtggattatttgaaggatcccaaaagctcaaatggaatttcttctttggactttgtagctgaacaaatttcactacttcgctgttcaactactctacccatcattttcacaattcgtaccatttcgcaaggtggtttattcccgaatgataaggaagaagaggctaaggagttaatgctgtcggcaatgagatacggttgtgactttgtagacgttgagcttggttggagttctgaaaccatcaatattctttatcaacacaagggatacacaaagttgataatgtcgtggcatgatttgtctggtacttggtcatgggcaagacctcacgaatggatgcaaaaagttgaattagcttcttcatacgctgacgttatcaaattggtaggcatggctaacaacttgaatgataatttagaattggaggaatttcgaaccagaattacgaattcaatggatattccattgattttgttcaacatgggacgtttcggacaactttcgagaatacttaacaagttcatgacccctgttacgcatccattacttccttcaaaggctgctcccggtcagttgactgttaaacaacttaatgaagctcgtgttttgataggcgaaattcttcccgagaaatttttcctttttggtaagcctattaagcattctcgctctccaattttacatagcaccgcgtatgagcttttggggctcccacatacctatgaggcattcgaaactgatacagttgacgaagtgcagaaggtgttaaacttaccagatttcggaggcgccaacgttactattccctataagttgtctgttatgaagttcatggatgaactcagtgacgaggcaagattttttggtgctgtaaacactataattccaatcagaattggagacaaacttgttttgcgaggtgacaatactgattggcgtggcatatacgatacatttgcaaatgcattggatggtgtctctcttcgtgatactaatggattagtgattggagctggtggtactagccgtgctgctatttactcattgcatcgtttgggagtatcccgaatttatttgttgaaccgcactttagccaactcttatcgtgttcaagacgttttccctcctgattataacatccatataatagattctgacaatattccttctgaagaattatctagtgttaccctttccgcggtcgtctcgacaattcctgcagatattgagcttcctgaaaaagttgcatctgttattaaagctttgcttgctaacaaagccgatggtggagtattccttgacatggcttacaagcccttgcatacacctctaatggctgttgcatctgacttggaatggaaatgttgcaacggattggaagctttagttcgtcaaggtcttgcgtcttttcatttgtggactggaatgacagcaccatttgatgctgtttatcaaaaggttattgagtaa

SEQ ID NO: 22410 - protein, 1573 aa, Schizosaccharomyces pombe
MSNESNIITVPILGKDTVRVGFGIHQYICTEILENFKSSTYVVITDSNIAPLYLEKIESTFNKSIKDAKAEARLLTYVIPPGESSKCRAMKAEIEDWLLTQSCTRDTILIAMGGGVIGDLVGYVAASFMRGIRFIQMPTTLLAMVDSSIGGKTGIDTPLGKNLVGAFWQPLRVYVDMVFLHTLPPRQVINGLSEIIKTAAMWNENDFQLLENNSAVLLDALNKPSVPGEYKFDSIKPLLQKIILSSIRTKCEVVTLDEHEGGLRNLLNFGHSIGHAYEAILYPQILHGECVAIGMVKEAELARYLGILKPNAVGRLTKCLVSYNLPISVNDPKVKKYASFKHCPVEKLIEYMAVDKKNQGSKKRIVILKAIGETYEKHATVVSDDDIRFILSRDVKVDEFTKSSWDVVVTPPGSKSISNRALVLAAMGNGTCRLTNMLHSDDTQFMMSALESLGAATFSWEDGGETLVVKGNGGKLAVPKEELYLGNAGTAARFLTGIAALVSSKDGAKVVLTGNHRMKVRPIGPLVDALRANGCEINYLEKQGSLPLDLSSKNGLKGGIIELAATVSSQYVSSILMCAPYASQPVTLKLVGGKPISQLYIDMTIAMMASFGVNVTKSTTEENTYNIPCGKYQNPPHYEIESDASSATYPLAIAAITGTKCTVPNIGSASLQGDARFACDVLRPMGCTVEQTATSTTVQGPPKGTLKPLESIDMETMTDAFLTASVVAAVACNVSEGDPVTRITGIANQRVKECNRIAAMVHELAKFGVRTGELEDGIYIFGKNYKELKKPEEGIYTYDDHRIAMSFSVLSLICPSRTLIIDKACVEKTWPYWWDVLHQSFGVKLTGATSVASDPLKGSISKNASIILIGMRGAGKTTIGKIIAKQLNFKFLDLDELLEDYLEMPIAEVIFRMGWDAFRLEEHKVLRKFITEHPEGYVAASGGGVIEMDESRNLLSNFVKEGGIVLHVHRNLEHIKSYLSEDQTRPTYKDQESIDDVYKRRHVWYRECRSHYFISPVLSNQVIDEKIQYSMSRFLDVVTGSSQVLQKFKTKKRSTFLTLNYPRIEDALPTLRDVTVGCDAIEVRVDYLKDPKSSNGISSLDFVAEQISLLRCSTTLPIIFTIRTISQGGLFPNDKEEEAKELMLSAMRYGCDFVDVELGWSSETINILYQHKGYTKLIMSWHDLSGTWSWARPHEWMQKVELASSYADVIKLVGMANNLNDNLELEEFRTRITNSMDIPLILFNMGRFGQLSRILNKFMTPVTHPLLPSKAAPGQLTVKQLNEARVLIGEILPEKFFLFGKPIKHSRSPILHSTAYELLGLPHTYEAFETDTVDEVQKVLNLPDFGGANVTIPYKLSVMKFMDELSDEARFFGAVNTIIPIRIGDKLVLRGDNTDWRGIYDTFANALDGVSLRDTNGLVIGAGGTSRAAIYSLHRLGVSRIYLLNRTLANSYRVQDVFPPDYNIHIIDSDNIPSEELSSVTLSAVVSTIPADIELPEKVASVIKALLANKADGGVFLDMAYKPLHTPLMAVASDLEWKCCNGLEALVRQGLASFHLWTGMTAPFDAVYQKVIE

SEQ ID NO: 22411 - DNA, 792 bp, Amycolatopsis mediterranei
  CDS (1)..(792)
atgccgatcagcggcaccacccgcctgtacgtcgtgctgggcgacccggtcgcccaggtccggtcgcccgggctgctgaacccgctcttcgcggacctggacgtcgacgcggtgctcgtcccggtgcacgcgccgccgccgcacctcgagcggatcgtcgccgggctgcaggccgtcgccaacctcgacggcatcttcgtcaccgtgccgcacaaggtggccgtggccgggctcgccgaccggcgcagcccgatggtggagatcaccggcagcgccaacgccttgcggcgcgaagccgacggccggtggtacgccgagaacttcgacggcaccggcttcgtcgccgggctggtcgaggccgggcacgacccgaaggcccggcgggtgtccctcgtcggcgccggtggggcgggcagcgccatcgcggccgccgtgctggcggccggcgccgaccggctggcgctgtgcgacccggacaccgcgaagctggccgccctcaagggccgcctggacgtgcactggccgggccggacgtcggtgtcggccgagccggacaccgcgggcgccgacctcgtcgtgaacgcgaccccgctcgggctgcggcccggcgacccgctgccgttccggccggaccggctggcgccgggccgcgtggtcgccgacatcatcatgaaaccccgcgaaacccgccttctccgcgaagcggcggccctcggccacgacgtccattacggcagccacatgctcgccgggcaattggactcctatcgcgatttcttcggcctgggttga

SEQ ID NO: 22412 - protein, 263 aa, Amycolatopsis mediterranei
MPISGTTRLYVVLGDPVAQVRSPGLLNPLFADLDVDAVLVPVHAPPPHLERIVAGLQAVANLDGIFVTVPHKVAVAGLADRRSPMVEITGSANALRREADGRWYAENFDGTGFVAGLVEAGHDPKARRVSLVGAGGAGSAIAAAVLAAGADRLALCDPDTAKLAALKGRLDVHWPGRTSVSAEPDTAGADLVVNATPLGLRPGDPLPFRPDRLAPGRVVADIIMKPRETRLLREAAALGHDVHYGSHMLAGQLDSYRDFFGLG

SEQ ID NO: 22413 - DNA, 810 bp, Neisseria meningitidis
  CDS (1)..(810)
atgcacgccctcccccgctacgccgtttttggcaaccccgtcgcccacagcaagtcgccgcagattcatcaacaatttgcccttcaggaaggcgttgacattgaatacgaacgcatttgcgccgacatcggcggtttcgcgcaggcggtttcgacattttttgaaacaggcggttgcggggcaaacgttaccgtaccgttcaagcaggaagcgtttcatctggcggacgagcattctgaacgcgcattggctgccggcgcggtcaacacgctgatttttctgaaaaacggaaaactgcgcggcgacaataccgacggtatcggtttggccaacgacatcacgcaggtcaaaaacattgccatcgagggcaaaaccattttgcttttgggcgcgggcggccgggtgcgcggcgtgattcctgttttgaaagaacaccgccctgcccgtatcgtcattgccaaccgcacccacgccaaagccgaagaattggcgcggcttttcggcattgaagccgtcccgatggcggatgtgaacggcggttttgatatcatcatcaacggcacgtccggcggcttgagcggtcactgtcctgccgtcagccgtgaaatttttcgcaactgccgccttgcctacgatatggtttacggcgacgcggcgcaggcgtttttgaactttgcccaaagcaacggtgcggccgaagtttcagacggcctgggcatgctggtcggtcaagctgccgcctcctaccatatttggcgcgggtttacgcctgatatccgccccattatcgaatacatgaaagccctgtaa

SEQ ID NO: 22414 - protein, 269 aa, Neisseria meningitidis
MHALPRYAVFGNPVAHSKSPQIHQQFALQEGVDIEYERICADIGGFAQAVSTFFETGGCGANVTVPFKQEAFHLADEHSERALAAGAVNTLIFLKNGKLRGDNTDGIGLANDITQVKNIAIEGKTILLLGAGGRVRGVIPVLKEHRPARIVIANRTHAKAEELARLFGIEAVPMADVNGGFDIIINGTSGGLSGHCPAVSREIFRNCRLAYDMVYGDAAQAFLNFAQSNGAAEVSDGLGMLVGQAAASYHIWRGFTPDIRPIIEYMKAL

SEQ ID NO: 22415 - DNA, 810 bp, Neisseria meningitidis
  CDS (1)..(810)
atgcacgccctcccccgctacgccgtttttggcaaccccgtcgccacaagcaagtcgccgcagattcatcaacaatttgcccttcaggaaggcgttgacattgaatacgaacgcatttgcgccgacatcggcggtttcgcgcaggcggtttcgacattttttgaaacaggcggttgcggggcaaacgttaccgtaccgttcaagcaggaagcgtttcatctggcggacgagcattctgaacgcgcattggctgccggcgcggtcaacacgctgatttttctgaaaaacggaaaactgcgcggcgacaataccgacggtatcggtttggccaacgacatcacgcaggtcaaaaacattgccatcgaaggcaaaaccatcttgcttttgggcgcgggcggccgggtgcgcggcgtgattcctgttttgaaagaacaccgtcctgcccgtatcgtcattgccaaccgcacccacgccaaagccgaagaattggcgcggcttttcggcattgaagccgtcccgatggcggatgtgaacggcggttttgatatcatcatcaacggcacgtccggcggcttgagcggtcagcttcctgccgtcagtcctgaaattttcctcggctgccgccttgcctacgatatggtttacggcgacgcggcgcaggagtttttgaactttgcccaaagcaacggtgcggccgaagtttcagacggactgggtatgctggtcggtcaagcggcggcttcctacgccctctggcgcggatttacgcccgatatccgccctgttatcgaatacatgaaagccatgtaa

SEQ ID NO: 22416 - protein, 269 aa, Neisseria meningitidis
MHALPRYAVFGNPVATSKSPQIHQQFALQEGVDIEYERICADIGGFAQAVSTFFETGGCGANVTVPFKQEAFHLADEHSERALAAGAVNTLIFLKNGKLRGDNTDGIGLANDITQVKNIAIEGKTILLLGAGGRVRGVIPVLKEHRPARIVIANRTHAKAEELARLFGIEAVPMADVNGGFDIIINGTSGGLSGQLPAVSPEIFLGCRLAYDMVYGDAAQEFLNFAQSNGAAEVSDGLGMLVGQAAASYALWRGFTPDIRPVIEYMKAM

SEQ ID NO: 22417 - DNA, 810 bp, Neisseria meningitidis
  CDS (1)..(810)
atgcacgccctcccccgctacgccgtttttggcaaccccgtcgcccacagcaagtcgccgcagattcatcaacaatttgcccttcaggaaggcgttgacattgaatacgaacgcatttgcgccgacatcggcggttttgtacaggcggtttcgacattttttgaaacaggcggttgcggggcaaacgttaccgtaccgttcaagcaggaagcttttgcgctggcggacgaacattccgaccgcgctttggcagcaggtgcggtcaatacgctgattctgttgaaaaacggcaagctgcgtggcgacaatactgacggtatcggtttggccaacgacatcacgcaggttaaaaacattgccatcgatggcaaaaacattttgcttttgggcgcaggcggccgggtgcgcggcgtgattcccgtattgctggcgcaaaatcccgcccgcatcgtcattgccaaccgtacccgcgccaaagccgaggaattggcgcagcttttcggcattgaagccgtcccgatggcggatgtgaacggcggtttcgacatcgtcatcaacggcacgtcgggcggtctgaacggtcagattcctgccgtcagccctgaaatttttcgcaactgccgccttgcctacgatatggtttacggcgacgcggcgcaggagtttttgaactttgcccaaagcaacggtgcggccgaagtttcagacgcactgggcatgctggtcggtcaggcggcggcttcctacgccctctggcgcggatttacgcccgatatccgccccgttatcgaatacatgaaagccctgtaa

SEQ ID NO: 22418 - protein, 269 aa, Neisseria meningitidis
MHALPRYAVFGNPVAHSKSPQIHQQFALQEGVDIEYERICADIGGFVQAVSTFFETGGCGANVTVPFKQEAFALADEHSDRALAAGAVNTLILLKNGKLRGDNTDGIGLANDITQVKNIAIDGKNILLLGAGGRVRGVIPVLLAQNPARIVIANRTRAKAEELAQLFGIEAVPMADVNGGFDIVINGTSGGLNGQIPAVSPEIFRNCRLAYDMVYGDAAQEFLNFAQSNGAAEVSDALGMLVGQAAASYALWRGFTPDIRPVIEYMKAL

SEQ ID NO: 22419 - DNA, 810 bp, Neisseria meningitidis
  CDS (1)..(810)
atgaccgccctcccccgttacgccgttttcggcaaccccgttgcacacagtaaatctccgcagattcatcggcaatttgcccttcaggaaggcgttgacattgaatacgaacgcatttgcgccgacatcggcggtttcgcgcaggcggtttcgacattttttggaacaggcggttgcggggcaaacgttaccgtaccgttcaaacaggaagcgtttcatctggcggacgagcattccgaccgcgctttggcagcaggtgcggtcaatacgctgattctgttgaaaaacggcaagctgcgtggcgacaataccgacggtatcggtttggccaacgacatcacgcaggtcaaaaacattgccatcgagggcaaaaccattttgcttttgggcgcaggcggccgggtgcgcggcgtgattcctgttttgaaagaacaccgtcctgcccgtatcgtcattgccaaccgtacccgcgccaaagccgaggaattgtcgcggcttttcggcattgaagccgtcccgatggcggatgtgaacggcggttttgatatcatcatcaacggcacgtcgggcggtctaaacggtcagattcccgatattccgcccgatatttttcaaaactgcgcgcttgcctacgatatggtgtacagctgcgcggcaaaaccgtttttggattttgcccggcaatcgggtgcgaaaaaaactgccgacggactgggtatgctggtcggtcaagcggcggcttcctacgccctctggcgcggatttacgcccgatatccgccccgttatcgaatacatgaaagccatgtaa

SEQ ID NO: 22420 - protein, 269 aa, Neisseria meningitidis
MTALPRYAVFGNPVAHSKSPQIHRQFALQEGVDIEYERICADIGGFAQAVSTFFGTGGCGANVTVPFKQEAFHLADEHSDRALAAGAVNTLILLKNGKLRGDNTDGIGLANDITQVKNIAIEGKTILLLGAGGRVRGVIPVLKEHRPARIVIANRTRAKAEELSRLFGIEAVPMADVNGGFDIIINGTSGGLNGQIPDIPPDIFQNCALAYDMVYSCAAKPFLDFARQSGAKKTADGLGMLVGQAAASYALWRGFTPDIRPVIEYMKAM

SEQ ID NO: 22421 - DNA, 879 bp, Burkholderia mallei ATCC 23344
  CDS (1)..(879)
atgagcacggccgtcgaatcggcagcgcgcgcgcgcgatcgctatgcggtgatcggcaatccgatcgcgcacagcaaatcgccgttcatccattcgcgtttcgccgagcagacgggcgaggcgatcgaatacacgcatctgctcgcgccgctcgacggcttttcggccacggtgcgcgcgttcatcgcgcagggcggccgcggcgtgaacgtcacggtgccgttcaagctcgaggcctatgcgcttgccgatgcgctgtcgccgcgcgcggcggcggcgggcgcggtcaacacgctgcgcttcgacgcggacggcgttttcggcgacaacaccgacggcgtcggcctcgtgcgcgacatcgaggtgaatctcggcgtgagcctcacgggcgcgcggatcctgctgctcggcgcgggcggcgcggcacgcggcgtcgtgctgccgatgctcgagcgcgggcccgcgtcgctcacgatcgtcaaccggaccgcgagcaaggcggaagaactcgtcggccagttcacgcaggcggcgcacgacgcgggctgcgtgctcgccggcggcgggcccgaacggatcgcgcgcgagccgtacgacgtgatcgtcaacgcgacggcgggcagcctcgacgcggcgctgcccgagtgcgacgcggcggccttcggcccggcgacgctcgcgtacgacatgatgtacggcgcgcgcccgaccgtgttcatggagcacgccgcggcgctcggcgcgcgcacggcggatggcctcggaatgctcgtcgagcaggccgcggaatcgttccacgtctggcgaggcgtgcggcccgacagcgcgcccgtgctcgccgcgctgcgcgccgcgctcgcggcgtcggccgcgcactga

SEQ ID NO: 22422 - protein, 292 aa, Burkholderia mallei ATCC 23344
MSTAVESAARARDRYAVIGNPIAHSKSPFIHSRFAEQTGEAIEYTHLLAPLDGFSATVRAFIAQGGRGVNVTVPFKLEAYALADALSPRAAAAGAVNTLRFDADGVFGDNTDGVGLVRDIEVNLGVSLTGARILLLGAGGAARGVVLPMLERGPASLTIVNRTASKAEELVGQFTQAAHDAGCVLAGGGPERIAREPYDVIVNATAGSLDAALPECDAAAFGPATLAYDMMYGARPTVFMEHAAALGARTADGLGMLVEQAAESFHVWRGVRPDSAPVLAALRAALAASAAH

SEQ ID NO: 22423 - DNA, 834 bp, Bacillus cereus ZK
  CDS (1)..(834)
atgaaacaattatatggtgtaatcggaaatccaattggacattcattatcacccgttatgcataacgatgcatttgaacacttgaatatggatgcccattaccatgcctttcttgttaaagaggaagtgttaggggaagcagtaagaggtttaaaagcgttaggtatttcaggatttaatgtaacaactccgcacaaggttgcgattatggattatttggatgagattgacccgctagcaaaacaaattggtgcagtaaatacggtggttcataaggatgggaaattgattggctacaatacagatggaattggttttgtccgagcactgcaatccattagtaatgaaccacttcaagagaaacgtattttattacttggcgcaggcggtgctagtcgagctatttatttttcacttgctgatgtaggggtgaaagagattgatgtagctaatcgtacagtagataaggcgaaagaacttattgctgcatgtacggctactgttcattctgttgctttatcattagaaaaagcaacaaaagaacaagggaattatgatattatcattcagacgacaacgataggtatgcatccacgcgtcgaacatacgcctttacaaatttcttcgttgaaaaagggaacaattgtatcagatataatttataatccatttgaaacgaaaattttatgtgaggcgaaagagcaaggtgcaatcattcaaaatggtattgatatgtttgtttatcaaggagcgcttgcatttgaaatgtggacaggttgcgtaccgaatatcgaacgaatgaaacaattagttataagaaagcttggaggctaa

SEQ ID NO: 22424 - protein, 277 aa, Bacillus cereus ZK
MKQLYGVIGNPIGHSLSPVMHNDAFEHLNMDAHYHAFLVKEEVLGEAVRGLKALGISGFNVTTPHKVAIMDYLDEIDPLAKQIGAVNTVVHKDGKLIGYNTDGIGFVRALQSISNEPLQEKRILLLGAGGASRAIYFSLADVGVKEIDVANRTVDKAKELIAACTATVHSVALSLEKATKEQGNYDIIIQTTTIGMHPRVEHTPLQISSLKKGTIVSDIIYNPFETKILCEAKEQGAIIQNGIDMFVYQGALAFEMWTGCVPNIERMKQLVIRKLGG

SEQ ID NO: 22425 - DNA, 855 bp, Burkholderia pseudomallei K96243
  CDS (1)..(855)
atgagcgggcgttcgtttctgatcggcctgatcggcgccgggatcggcggctcgctgtcgcccgcgatgcacgaggcggaggggtgcgggcagggtctgaactacgtgtaccggcgcatcgatctcgacgcgctggggctgacggccgacgcgctgcccgagctgctcgcggccgccgagcggatgggcttcgacgggctgaacatcacgcatccgtgcaagcagcgcgtgatcgagcatctcgacgaattgtcggcggacgcggccgcgctcggcgcggtcaacacggtgtgcttcgcgcacggccggcgcatcggccacaacaccgattggtcgggcttcgcgaaggcgttcgcgcgcgggctgccgggcgcgtcgctcgagcgcgtcgtgcagcttggcgcgggcggcgcaggcgcggccgtcgcgcacgcggcgctcacgatgggcgccgcgcaactcgcgctcttcgatgtcgaccccgtgcgcgcgcgctcgcttgccgaccagttgcaggcgcgctttccgcacgcgcggctgagcgccggcggcacgctcgccgacgcgctcgcgaacgcgaccggcctcattcacgcgacgccgacgggcatgctcgggcatccgggcctgccgctgccggcgcacctgctgcgaagcgggctctgggtggccgacatcgtctattttccgctcgagaccgagctgatccgcgcggcgcgcgcgctcggctgccgcacgctgccgggcggcggcatggcggtctatcaggcggtcgatgcgttcgagctcttcacgggccgcgcgccggatgccgagcgaatgttcgagcacttccgggcgctcgtcgcgcgctga

SEQ ID NO: 22426 - protein, 284 aa, Burkholderia pseudomallei K96243
MSGRSFLIGLIGAGIGGSLSPAMHEAEGCGQGLNYVYRRIDLDALGLTADALPELLAAAERMGFDGLNITHPCKQRVIEHLDELSADAAALGAVNTVCFAHGRRIGHNTDWSGFAKAFARGLPGASLERVVQLGAGGAGAAVAHAALTMGAAQLALFDVDPVRARSLADQLQARFPHARLSAGGTLADALANATGLIHATPTGMLGHPGLPLPAHLLRSGLWVADIVYFPLETELIRAARALGCRTLPGGGMAVYQAVDAFELFTGRAPDAERMFEHFRALVAR

SEQ ID NO: 22427 - DNA, 819 bp, uncultured archaeon GZfos34A6
  CDS (1)..(819)
atgaaaaatatatacggtattatcggcgacccggtcgcacacagcctctctccggttatgcataatgccgcatttaagaaactcggactggatgcagtctatattgcattctgtgttcctctagaagaacttggcgatgcaataagaggcgcgaaaagtctcggcatctctggtcttaacgttactataccactgaaggaaaaagcgctttcctttgtggcaacagaagaagtagcgaagaaaataggcgctatcaataccattgactttagcagtactcctactggctacaacactgatgggataggcgcgcttatggtattagaagagacagtgggagaagtaagaggtaaaaacgtgttgattattggtgcaggtggagcagcaagggctatctcattttatctcgatgcaagtggtgcgatggtgacattggcgaacaggacagaaggtagatccgcgcaattggcttctaatctccgtaatgcgaattctattagcctgggtgcagagcttaaaaatcagatcagggattctgatattttgataaatgcgacttctgtgggtatgcatccaaatgaagatgccactttgataaccgcagatctaatgcatccggaccttgtagtgttcgacatagtgtataatccaatagagacgaagttgttgaaggaagcgaagcgtgcgggcgtaaagaagacagtgaatggagtgaagatgttagtatatcaaggagcggcatcgttcaatttgtggacaaaaaaggatccaccggtagaagtgatggaaaatgcggttaaggctgctttgattcgttga

SEQ ID NO: 22428 - protein, 272 aa, uncultured archaeon GZfos34A6
MKNIYGIIGDPVAHSLSPVMHNAAFKKLGLDAVYIAFCVPLEELGDAIRGAKSLGISGLNVTIPLKEKALSFVATEEVAKKIGAINTIDFSSTPTGYNTDGIGALMVLEETVGEVRGKNVLIIGAGGAARAISFYLDASGAMVTLANRTEGRSAQLASNLRNANSISLGAELKNQIRDSDILINATSVGMHPNEDATLITADLMHPDLVVFDIVYNPIETKLLKEAKRAGVKKTVNGVKMLVYQGAASFNLWTKKDPPVEVMENAVKAALIR

SEQ ID NO: 22429 - DNA, 744 bp, Bacteroides fragilis
  CDS (1)..(744)
atgcaaaagtacggtttaattggctatccactgaaacattcgttttctatcggctttttcaatgaaaaattcaaatctgaaggcatagatgccgaatatgtaaacttcgaaattcctgaaatcaatgattttatggaggtggttgaagagaaccccaatctgtgcggactaaatgtgacaatcccttataaagagcaggtaatccccttccttgatgaattggataaagacactgcaaaaatcggtgcggtcaatgttattaaaataattcgtacccctaaaagaaaaataaagctggtgggatataattctgatattataggattcagccagtccattcagcccttgttgcaaccttatcataaaaaagccttaatcctaggtaccggcggttcgtcaaaagcgatttatcatggcctgaagaatctgggtatcgacagtgttttcgtatcacgcaccaagaaagaaggtatgctgacttacgaagaattgacaccggaagttatggcagagcatacggtgattgtaaactgtaccccggtaggtatgtatccgaaagtagacttctgtcctgccataccttatgagttgctaaccccaaaccatttactctacgatttgttatataatcctaacattactcttttcatgaagaaaggagaagagcatggggcagtaaccaaaaatgggcttgaaatgctactattacaagcgtttgccgcatgggaaatatggaataagtaa

SEQ ID NO: 22430 - protein, 247 aa, Bacteroides fragilis
MQKYGLIGYPLKHSFSIGFFNEKFKSEGIDAEYVNFEIPEINDFMEVVEENPNLCGLNVTIPYKEQVIPFLDELDKDTAKIGAVNVIKIIRTPKRKIKLVGYNSDIIGFSQSIQPLLQPYHKKALILGTGGSSKAIYHGLKNLGIDSVFVSRTKKEGMLTYEELTPEVMAEHTVIVNCTPVGMYPKVDFCPAIPYELLTPNHLLYDLLYNPNITLFMKKGEEHGAVTKNGLEMLLLQAFAAWEIWNK

SEQ ID NO: 22431 - DNA, 837 bp, Bacillus licheniformis DSM 13
  CDS (1)..(837)
atgaaaccgatatacggactgattggcaatccggtggcccattccatgtctccggacatccataatgcggctttgaaggatctttctttagaagggcattatcacgcttttcgcgtggaaaacgaagatcttgaagatgctgtgaaaggtatgcgggcccttggcattcaagggtttaatgtgaccgtcccccacaaagtatcgatcatgaagcatctcgaccgtattgatgaaagcgccgaagctctcggggcggtaaacactgtcagaagagaaaaagaagggctggtcggatataatacagatggagcagggtttcttaaatcgctgaagccatcccttgatcgtccgctttctgagctctcgatactgttgatcggagcaggcggtgcggcgagggcgatatttaccactctggcagccgagacgcccaagcggcttgatgtggcgaatcgtacgcctgaaaaggcattagcattcactcagcgttttgatggagaggcacgcgccttgtcactgcaggaagcggaagcagacttgtcagcatatgatatcgtgattcaaacgacgtcggtcgggatgcatccgaatgtcgaagctgccccgctttcattggcgaatgcgaaagaaacgtgccttgtatgcgatattatctacaatccgctgaaaacggccctgctgcatgaggctgaagcaaaaggcttgaaaacattggacggagtcggcatgttcatcggccaggcagcccttgcttttgagctgtggacaggacatgagccgaatatggaaaaaatgaaatcaattgtgttgcagcaactaggaggaaaatcatgctaa

SEQ ID NO: 22432 - protein, 278 aa, Bacillus licheniformis DSM 13
MKPIYGLIGNPVAHSMSPDIHNAALKDLSLEGHYHAFRVENEDLEDAVKGMRALGIQGFNVTVPHKVSIMKHLDRIDESAEALGAVNTVRREKEGLVGYNTDGAGFLKSLKPSLDRPLSELSILLIGAGGAARAIFTTLAAETPKRLDVANRTPEKALAFTQRFDGEARALSLQEAEADLSAYDIVIQTTSVGMHPNVEAAPLSLANAKETCLVCDIIYNPLKTALLHEAEAKGLKTLDGVGMFIGQAALAFELWTGHEPNMEKMKSIVLQQLGGKSC

SEQ ID NO: 22433 - DNA, 819 bp, Mannheimia succiniciproducens MBEL55E
  CDS (1)..(819)
atgattaataaagacacacaactttgtatatcgctttcgggcagaccgagtaatttcggcacccgttttcataactatatgtatgaaaaactcggcttaaacttcgtatataaggcgttcaccaccaacgatattgaacatgcagtaaaaggcgtacgggctttaggaattcgcggttgtgccgtatcgatgccgtttaaagagagctgtatgccgtttttagatgaaatatcgccatccgccaaagcaatcgaatcggtgaataccattgtaaataccgacggttatctaaaagcctataacaccgactatattgcaatctccaaattaattgcgaaatatcagctcaaaccgactgcttgtgtgatcatacagggtagcggcggaatggcgaaagcggtggcggcggcgtttaaaaatgccggcttcgacaatcttaaaatctatgcgcgtaatgcgactaccggcggctatttggcaaaactctacggctatcaatatatcgactctctttatggacaaaatgcggatattttggtgaatgcgacgccgatcgggatgaaaggcggcggtaaagaagagtctattatttcttttcccgaagcgatgattgaccaagcctcggttgcttttgacgtagttgcaatgccggcggaaacgccgttaatcaaatatgcccgacagcagggtaaaacggtcatttccggtgcggaggtggcggtattacaggcggtagagcagtttgaactttataccggacaacgcccaggcgatgaattaatcgctgaagccgcgtcattcgcccgcgcgaacagttga

SEQ ID NO: 22434 - protein, 272 aa, Mannheimia succiniciproducens MBEL55E
MINKDTQLCISLSGRPSNFGTRFHNYMYEKLGLNFVYKAFTTNDIEHAVKGVRALGIRGCAVSMPFKESCMPFLDEISPSAKAIESVNTIVNTDGYLKAYNTDYIAISKLIAKYQLKPTACVIIQGSGGMAKAVAAAFKNAGFDNLKIYARNATTGGYLAKLYGYQYIDSLYGQNADILVNATPIGMKGGGKEESIISFPEAMIDQASVAFDVVAMPAETPLIKYARQQGKTVISGAEVAVLQAVEQFELYTGQRPGDELIAEAASFARANS

SEQ ID NO: 22435 - DNA, 1362 bp, Mannheimia succiniciproducens MBEL55E
  CDS (1)..(1362)
atgcaactgaaatcaagtcttattgttaatcaacatttacggctggaacaaatcaccgaggatgatgcagaacccgttttccggttgatttgccggcaacgggattatctctcccgctggctgccgggcgtgggattgacttccaacgtaagcagtacccttaaattcattcgttcccttaaaccgctggagcaggtttttaccattcgccgtgacgatgaaattatcggcttggtgagctttaataaagcggattattcaaatctgaaacttgaaatcggttattggctttctcaatccgagcaaaagcagggcattatgacccaatgcgtgcaaacaatgatagattatgcttttaatcaattatattttaaccggattcaaatcaaatgtgcgataggcaataccgcaagcaaaggaatcccgcagcgtttgggttttcagctggagggtatcgaacggcagggcttgttgctgctttccggcgaattcgccgattttgaaatttacagtatgctggctcaagattggaaaaataaacaggataaacaaattatggatacatacgctgtgtggggcaacccgattgcgcaaagtaaatcacccgccattcacaaaatttttgccgaacaaaccgggcagaacatgaaatatattgccatgttaggcgatgaacaacattttgagcggcaattacaggaattttttgcgcaaggcgccaaagggtgcaacattaccgctccttttaaagagcgggcttatcggcttgccgatgaatacagtgagcgagctttaaccgccggcgcctgtaacacattgaaaaaactggaaaacggcaaactttatgcggataacaccgacggtgccggattggtgagtgatttgcagcgtttaggctggttgaagccgaatcagcagatattaattctcggtgccggtggcgctactaaaggcgtgttgttgccgttattacaggctcaacagaaaatcctgattgctaaccgcactttagcgaaagcggaggaattagcggaaaaattcagcccgtacggtgaaatccgcgcggtggaactgaagacaattccgccgtaccgatacgatgttgtcattaatgcaacgtctctcggtttaacaggtaaaaccgcagatattcagccggaaattttgcaacaagccggtgcggtttacgatatgcaatatgctaaagagactgacacgccctttattgccttagccaaatcccttggcgtaaacaatgtcagcgacggttttggcatgctggtagggcaggcggcgcattctttccgattatggcgggggataatgcccgatatagaagtgctgctgaaccgcggtatttga

SEQ ID NO: 22436 - protein, 453 aa, Mannheimia succiniciproducens MBEL55E
MQLKSSLIVNQHLRLEQITEDDAEPVFRLICRQRDYLSRWLPGVGLTSNVSSTLKFIRSLKPLEQVFTIRRDDEIIGLVSFNKADYSNLKLEIGYWLSQSEQKQGIMTQCVQTMIDYAFNQLYFNRIQIKCAIGNTASKGIPQRLGFQLEGIERQGLLLLSGEFADFEIYSMLAQDWKNKQDKQIMDTYAVWGNPIAQSKSPAIHKIFAEQTGQNMKYIAMLGDEQHFERQLQEFFAQGAKGCNITAPFKERAYRLADEYSERALTAGACNTLKKLENGKLYADNTDGAGLVSDLQRLGWLKPNQQILILGAGGATKGVLLPLLQAQQKILIANRTLAKAEELAEKFSPYGEIRAVELKTIPPYRYDVVINATSLGLTGKTADIQPEILQQAGAVYDMQYAKETDTPFIALAKSLGVNNVSDGFGMLVGQAAHSFRLWRGIMPDIEVLLNRGI

SEQ ID NO: 22437 - DNA, 819 bp, Yersinia pseudotuberculosis IP 32953
  CDS (1)..(819)
atgacccggtacttaaacaaagatacgacagtgtgtatttccctcgcggccaggcccagcaattttggtacccgttttcataactttttgtatgatgctttagatctcgattatttgtataaagcttttaccaccaacgacttggctgcggctattggtggtgtgcgagcgttgggtttccgtggctgcgcgatctcaatgccgtttaaagaggctgttattccaatggtagatgagatggatccctcggccaaagcgatcaactcagtgaatacactggttaatactggcggttatctgaaagcatacaataccgactatattgccattgccaaattgttacaggagtatcaggtcccggtagataacgtgtttgccttgcggggcagtggcggtatggcgaaagccgttgcttttgcgctgaaaaatgctggcttcaaacagggttatattatcgccaccaatgaaaagaccggcaagcaacttgcagagcaatctggttacatctatcgccctgatatgcagaatattcaggctgatatgctcattaatgcgacaccagtcggcatggctgggggggctgatgctgataaattggcttttactgaaactgaagtggaccgcgcgaaaattgtttttgatgttgtggcgttgcccgccgtcaccccgcttatccgctatgctcagactcagggaaaaacagtgatcaccggtgccgaggtttttgctattcaggctgtagagcaatttgtgttatacaccggtatccgcccaagtcaggcgctgtttgaacaagccgcagcttatgcaagaggctga

SEQ ID NO: 22438 - protein, 272 aa, Yersinia pseudotuberculosis IP 32953
MTRYLNKDTTVCISLAARPSNFGTRFHNFLYDALDLDYLYKAFTTNDLAAAIGGVRALGFRGCAISMPFKEAVIPMVDEMDPSAKAINSVNTLVNTGGYLKAYNTDYIAIAKLLQEYQVPVDNVFALRGSGGMAKAVAFALKNAGFKQGYIIATNEKTGKQLAEQSGYIYRPDMQNIQADMLINATPVGMAGGADADKLAFTETEVDRAKIVFDVVALPAVTPLIRYAQTQGKTVITGAEVFAIQAVEQFVLYTGIRPSQALFEQAAAYARG

SEQ ID NO: 22439 - DNA, 885 bp, Symbiobacterium thermophilum
  CDS (1)..(885)
atgaccaagcgtcggagcacatcgcggggtccggggcggatcctggggatcctgggccatccggtggcgcactccgcctcgcccgccatgcacaacgccgcattcgccgcgcaggggatgcacgccatgtacggggcctttgacgtcccgccttcccagctggagaaggcgatcgccgggattcgcgcgctggggctcctgggcgtcaacgtcaccattccccacaaggaggcggtcatggcctacctggacgacgtggcccccaccgcccggcaggtgggtgcggtgaacaccatcgtcaaccggggcggccggctgatcgggtacaataccgacggctggggcttcctgctcagcctggaggagcggggcgtgcgggtcgccggccggaacgccgtggtgctgggtgcgggtggcgccgcccgggcggtggccctgcacctgggcatggccggggtggcgcgcctgacgatcatcaaccgttcccgccagcgggccgagttcctggcggccgatctcgcccgggccaagaccccggtgcgggcggaggtggccgatccggggtcggaggaggcccgggccgcgctcgcggaggccggcctggtcgtcaactgcacccctctgggcatggagcccgacaccgagtcgacgccgctggaggacgtcgggctgctcccggcccactgcgtggtctacgacaccgtgtaccggccgctggagacccgcctcctgcgggaggcgcggcagcacgggctcatcaccgtcaacggcctggcgatgctggtgcaccagggcgcctgcgcctgggagtactggttcggccggcggggcccggtggacgtgatgcggacggccgcgctggcggccctggagggacagccatga

SEQ ID NO: 22440 - protein, 294 aa, Symbiobacterium thermophilum
MTKRRSTSRGPGRILGILGHPVAHSASPAMHNAAFAAQGMHAMYGAFDVPPSQLEKAIAGIRALGLLGVNVTIPHKEAVMAYLDDVAPTARQVGAVNTIVNRGGRLIGYNTDGWGFLLSLEERGVRVAGRNAVVLGAGGAARAVALHLGMAGVARLTIINRSRQRAEFLAADLARAKTPVRAEVADPGSEEARAALAEAGLVVNCTPLGMEPDTESTPLEDVGLLPAHCVVYDTVYRPLETRLLREARQHGLITVNGLAMLVHQGACAWEYWFGRRGPVDVMRTAALAALEGQP

SEQ ID NO: 22441 - DNA, 807 bp, Propionibacterium acnes
  CDS (1)..(807)
atgcgctgtgcggtgattggccatccagtggctcactccttgtccccggcaattcaccgcgccgcataccaggtcctcggcctggagtggtcctaccaggccatcgacgtcgagcctggtggtttgcgtgcttttattgaggggctcgacggttcctggcgagggctatcagtgacgatgcctcacaaggccgatctcgtcgagttgggggagaccgacgcgacggttgacatgttgggagcggcgaatacctgggtttgtcgtgacggcacgaccatcgtccgcaataccgacgtcacgggggcagaggctgcgcttcgtgccaggggagtgactgatgtcgagaaggttgtcatgctgggggcgggcgcaacagcccggtctgttcttgcggctgccattgggatgggagcgggcgaagccgtcgtgatgtcgcgctcgcgcgaacggtccacgaagatccttaaacttgctgatggcctcggcattcgtgttgcctggttgcctttcgaatcggagcctccgcggtgcaacctcatagtctcgacggttccagccggttccttgataaggcgtgctgaagatctcgctgctcgagctaatgcggtttttgacgtcgtctatgatccctggccaacccctttggccgtggctgggaagatcgctggtgcaaccgtcattgacggcttggacctgctcgctgggcaggcggtcggtcaggtgcaactcatgactggctacccggtgccgatggacgttttgaggtccacagcgcagaacggcctggctgagcacgcccgcctttga

SEQ ID NO: 22442 - protein, 268 aa, Propionibacterium acnes
MRCAVIGHPVAHSLSPAIHRAAYQVLGLEWSYQAIDVEPGGLRAFIEGLDGSWRGLSVTMPHKADLVELGETDATVDMLGAANTWVCRDGTTIVRNTDVTGAEAALRARGVTDVEKVVMLGAGATARSVLAAAIGMGAGEAVVMSRSRERSTKILKLADGLGIRVAWLPFESEPPRCNLIVSTVPAGSLIRRAEDLAARANAVFDVVYDPWPTPLAVAGKIAGATVIDGLDLLAGQAVGQVQLMTGYPVPMDVLRSTAQNGLAEHARL

SEQ ID NO: 22443 - DNA, 1086 bp, Leifsonia xyli
  CDS (1)..(1086)
atggtcttgcagcgtccgcgcctggcggtgctcggttcgccgatcggccactccaaatcccctgacctccaccgcgccgcctacgatgtgctgggtctcgactgggagtatggccgcgaagaggtcgccgaagccgaattgcccgcctacctcgacggtctcggagaggagtggcgtggactttcgctgacgatgccgcttaagaaggccgtcatcccgctgctcacggatatcgacagggtggccgcggagaccggtgctgcgaacacggtgctgttcgacggcgaagaggtccgcgggttcaacaccgatgtcggcggcatcgtgcgcgcgctgtcggcggcggggcttgaacgtgtccgctacgttcacattctgggcggaggggccacggccgcgtccgccctcgtggcggccgctgaactcggggcagagcgggtcgacttgcacgtccgcgacctggagaagagcctgtcgctcgagccgccggctcacgggctggggctgcgcatccgcatccggtccttcctgcaggccgatcgctcgctcgacgttcccgaactcgtgatcagcaccttgccgggcgatgtgtccatcccggtgctctacacagactcgacgcggcgcaaagccgtgctgctcgatgtggcctacgagccgtggccgacgaccctggcgaaggcatggcaatccgtcggcggcaccgtggtgtcggggctcgggatgctggttcatcaggcgctgctgcaggtgcgcgtgttcgtctccggtgacccgctggagccgctgcccgacgaagaggctgtgctccgggcaatgctcgcggttgcggcggtggacgctgcgggggcgccgttggacgctgcggcggcgcacacgccgggaacgccgcccgacggggccgcggtggacgccgcgggggcgccgttggacgctgcggcggcgcacacgccgggaacgccgcccgacggggccgcggtggacgccgcggggacgtcgttggacgctgcggcggcgcacacgccgggaacgccgcccgacggggccgcggggacgtcgttggatgctgcggcggcgggagcgtag

SEQ ID NO: 22444 - protein, 361 aa, Leifsonia xyli
MVLQRPRLAVLGSPIGHSKSPDLHRAAYDVLGLDWEYGREEVAEAELPAYLDGLGEEWRGLSLTMPLKKAVIPLLTDIDRVAAETGAANTVLFDGEEVRGFNTDVGGIVRALSAAGLERVRYVHILGGGATAASALVAAAELGAERVDLHVRDLEKSLSLEPPAHGLGLRIRIRSFLQADRSLDVPELVISTLPGDVSIPVLYTDSTRRKAVLLDVAYEPWPTTLAKAWQSVGGTVVSGLGMLVHQALLQVRVFVSGDPLEPLPDEEAVLRAMLAVAAVDAAGAPLDAAAAHTPGTPPDGAAVDAAGAPLDAAAAHTPGTPPDGAAVDAAGTSLDAAAAHTPGTPPDGAAGTSLDAAAAGA

SEQ ID NO: 22445 - DNA, 891 bp, Desulfotalea psychrophila
  CDS (1)..(891)
atgcccgttatccgtaaaaatatattaggtggtacttttatgatagttggtgcaacagcagtttatggaattataggcaatccagtgagccactccatgagtccccttatgcataatgcagcctttgagtcccttggcatagatgctgtttatgtgccctttcgggtggaggatgtggagagtgctgtccagggattgcgtggtttaaatatatgcggggtaagtgttaccatccctcataaagaggctgttatccctcttttggatgaggttgaccccgttgccggcaagataggggcggttaataccattgtttcatctatgcgggatggcagaccctttctcaagggctttaataccgattggattggggccaacagggccctgcaggccgtggtttctcttaagggcaagcaggtcttgcttttgggggcaggcggatctgcccgtgccattggctttggcctgttggaggctggggcggaggtgattctctgtagcagaactccatcccgtggccgccagctggcagatgagtttggttgtctttggctgagtcttgaggatattggcagcgtccgggcagatattgtggtcaacgctacctcggtgggcatggcaccacaagaggatgtcagcctgatgacggtggagcagttgagcggggttgaggcagttatggatattgtctattcaccccatagaacaaggttgctagcgaatgcagataaggcgggatgtgcaatagtttcaggtcttgaaatgttgctctatcaaggtgtccaacaatttgagctgtggcagggccgggaagcacctcttgcggtgatgcggcataccctgtatcgattgttgggctacgatgctgtattaaaggaaaaagagatatga

SEQ ID NO: 22446 - protein, 296 aa, Desulfotalea psychrophila
MPVIRKNILGGTFMIVGATAVYGIIGNPVSHSMSPLMHNAAFESLGIDAVYVPFRVEDVESAVQGLRGLNICGVSVTIPHKEAVIPLLDEVDPVAGKIGAVNTIVSSMRDGRPFLKGFNTDWIGANRALQAVVSLKGKQVLLLGAGGSARAIGFGLLEAGAEVILCSRTPSRGRQLADEFGCLWLSLEDIGSVRADIVVNATSVGMAPQEDVSLMTVEQLSGVEAVMDIVYSPHRTRLLANADKAGCAIVSGLEMLLYQGVQQFELWQGREAPLAVMRHTLYRLLGYDAVLKEKEI

SEQ ID NO: 22447 - DNA, 4713 bp, Debaryomyces hansenii CBS767
  CDS (1)..(4713)
atgtcagaagttgaaaaagtatctattttgggtgccaaaaccattcatgttgggtatggtattcaggaccacattgttgaagagaccattacgaatacggcttcttcgacatatgtgattataactgatactaatatggctagtacccagccatttataaagttggttgaaaagtttacaaaaaaattaaatgaaaagagacctgaatctcgtctacttagatataatgtatccccaggtgaaaataataagagtagagagaccaaggctgcagttgaagacttcttattgcaacaaggatgtactagagatacgatcattattgctgtaggtggaggtgttattggtgatatgattggctttgtagctgccacctttatgagaggagttagactcattcaagttcctactagtttattatcgatggtcgattcttcaattggtggtaagactgccattgatactcctttaggtaagaatttcattggtgcattttaccaaccacaatatgttttcgtcgatgtatcgttcttagaaactttaccaacaaggcaatttataaatggtatggccgaagtagtgaaaactgctgctatttggaatgagaaagagttcgtaagactagaagaatttgctgagaagttcatttctgtggtgactcaaaaggatattgagctcagtacgataagagacgatttggttaagacagttttggaatctattaaagttaaagctgatgttgtgtcgtcggacgaaaaagaggcaagtttaagaaaccttcttaatttcggacacactataggtcatgctattgaagccatcttaactccacaagccttgcatggtgaatgtgtgtctattggtatgattaaggaagcggaattagcaagatacttaggtatattatctcctgttgcagttgcaagattatctaaatgtcttgtgtcttatcaattacctgtttcactagatgataaggtattctcaaagagagttggcaacaaacgtcattatgttgtaattgatactttattagaaaaaatgcttatagataagaaaaacgatggtagtaaaatcaggtgtgttatattagaagctattggtaaatgttaccagttgaaggcacatcaaatatcaaaagaagaattgaagttcgtcttaactgatgaagtattagtacatccatttgatgcagaacaagttccaagtgccaatacaatcattccacctgggtccaaatctatttcgaatagagcgttggttttggcagccttaggttctggtaccgttagaattaaaaatttgttacattctgatgacactaagcatatgttagatgcggtatctcatttgaaaggtgcagaaataactactgaaaataacggtgaaactattgtcttaaaaggtaatggaggtaagatgataacatgtgagcaagaattatacttgggaaatgctggtacagcatcaagatttttaacaactgttgcttctttagttggcattaatcaatcttcttcgaacaaacatgttattttgacaggtaatgctagaatgcaggagagaccaatcggcccacttgttgatgcgttaagatcgaatggctcatctattgattatatgaataaagaaggttcgttaccattgaagattgaagcaggtaatggcataaagggtggtagagttgaattagctgctactatctcttctcagtatgtttcatctattttaatgtgtgccccttacgcacaagaacctgttacattatcattggtgggaggtaaacccatctcgcagttatacatcgatatgactatctctatgatgaagtcctttggtattaatgttaccaggtcaacaactgaagagcatacttatcatataccaaaaggtgcatacgtgaatccatctgaatatgttattgaatctgatgcgtcttcagctacttatccgttagcatttgcagctatgacaggcacttcatgtactgttccaaatattggatcttcgtcattacaaggagatgcaagatttgcagtcgatgttttaaaaccaatgggatgtaaagttgatcagactgctacatctactacagtaacaggtccaccaaaaggacaattgaaaccattaccgcatgttgatatggagccaatgaccgatgcatttttaacggcttcagttgttgcagccattgctaatgatccgtatcagtcgacgtcgatcactggaattgctaaccagagagttaaagaatgtaatagaattgaggctatgattactgaattagctaagtttggtgtcaaagccgacgaattacccgacggaattagaatcaacggtattgattaccataatttaactactccttctatcaaggcaagaggaataaaggcatatgatgaccatagagttgctatgtcgttctcattattagctggtatgtgtgtaaaccctgtgttgatccaagaaagatcatgtactggtaagacatggcctggatggtgggacattttgcatacgaagttcaagacaactcttgacggttatgaattaccagtcaatactgacgatccatcgttgttgattgacaagcatgcaaatggtgatagaagtataattgttattggtatgagagctgcaggtaagagtactttatccaagtggatggcctcattcatgggattcaagtttcttgatttggatgaggttcttgaggaaaaatatggtgttaagattagaccatttattaaggaaaacggttgggatgaattccgtagattggaggccattgtagctaaagaatgcttcgagactcataagaaaggatatgttctttcaacgggtggaggtattgttgaaggtaaagaagcaagagaatcattgaaagaatacgtaaaatccggaggtattgttctacacttacatcgtgatttggatgaaaccgttgtctctttatcagcagatactacaagacctgcttttgtcaatgagattaaggatgtatggatcagaagagaaggatggtaccatgagtgctcgaactatcactcttattcatcacattgttcaaatgagctagaattcaagcatttgagaaattcgtttatcagttacttgaagaccatcactggtcttcacgtcacagagattcctaaaaagagatctgcgtatgttagtttgacatatccagatttgaatgaagtggctgagtctttagaggaaatagcaactgggtgtgaggcaattgaattaagagttgatcttttgaaggattattctaagtcgttcgttgccgatcagacagcaactttaagaaagtatgtaaacctcccaatcatctacactatcaaaacagagtcacaaggtggtaaattttcagatcatgaagtggaacaaattgaagaattgagttatttgggtattaaattaggggtagagtatttggatattcaattaaattaccctaatggattgattcacaaaataatggaaagaaaggcattcaccaggataattggttcgtaccatgataagagtggtcttttgaactggaagaatgttgaatgggataacaaatacaatcaagcagtctctttacaggtcgatattattaaattgactggggtggcttcatgtttccaagacaatttagatttagaaacttttagatcatcacgcgatttaaaacctttgattgcaattaacttgggtgagagcggcaagttatcgagtgtattaaataaagttttaactccagtgacacattccttattaccaccaaatgctactagtgcgcaattgacaatcgatgaagtaaacaagtcttttgcagaaatcggtggctttgttaacaagaaattttgggtcgtcggttatccaataatgcattcgagatctccaaatttgcacaatgcggcatacaagaagttaaatcttccttatgtgtttgatagactcgaaactgatgatgcgagcgaggtatacgagaagttgatgaaacaagaaaactttggtggattagcagtgacaatgcctttgaaattggatataatgaagtatttgcatgaattatctgatgcggctaaggctattggtgctgtcaacactgttattccattggaaggtaaaccaggcaagttcttaggtgacaacactgactgggtaggaattactaactccttcaccagatacggggtcccaagtattgagaactcgaatgtcaacgggcttgttgttggtggtggaggtacatcaagagcggcggcatttgcattacacgaaatgggatgccaaaccatctacatgatgaacagaacgtcgtcgaaactctacgacatcaagaactcgcttccagctctgttcaacatcgagatcttggaatctgttgaccaagtggacgccgccaagccagtctcgttggtagtctcgtgcgtacccgctgacaagcctatcgacgacaaccttctcaatatgttggaaagaatgctccaccaaggtatcctcatcaagcacggctcttttacgccaactttgctcgaggccacctacaagccaagactcacgccggtgatgagaattgccgaggagaagttcgagtggaatgttatccctggtgttgaaatgcttgtcaaccaaggtgaaagacaattcgagcttcacacggggttcacccctccttatagtgttattcaccacgctgtggtctccgaatag

SEQ ID NO: 22448 - protein, 1570 aa, Debaryomyces hansenii CBS767
MSEVEKVSILGAKTIHVGYGIQDHIVEETITNTASSTYVIITDTNMASTQPFIKLVEKFTKKLNEKRPESRLLRYNVSPGENNKSRETKAAVEDFLLQQGCTRDTIIIAVGGGVIGDMIGFVAATFMRGVRLIQVPTSLLSMVDSSIGGKTAIDTPLGKNFIGAFYQPQYVFVDVSFLETLPTRQFINGMAEVVKTAAIWNEKEFVRLEEFAEKFISVVTQKDIELSTIRDDLVKTVLESIKVKADVVSSDEKEASLRNLLNFGHTIGHAIEAILTPQALHGECVSIGMIKEAELARYLGILSPVAVARLSKCLVSYQLPVSLDDKVFSKRVGNKRHYVVIDTLLEKMLIDKKNDGSKIRCVILEAIGKCYQLKAHQISKEELKFVLTDEVLVHPFDAEQVPSANTIIPPGSKSISNRALVLAALGSGTVRIKNLLHSDDTKHMLDAVSHLKGAEITTENNGETIVLKGNGGKMITCEQELYLGNAGTASRFLTTVASLVGINQSSSNKHVILTGNARMQERPIGPLVDALRSNGSSIDYMNKEGSLPLKIEAGNGIKGGRVELAATISSQYVSSILMCAPYAQEPVTLSLVGGKPISQLYIDMTISMMKSFGINVTRSTTEEHTYHIPKGAYVNPSEYVIESDASSATYPLAFAAMTGTSCTVPNIGSSSLQGDARFAVDVLKPMGCKVDQTATSTTVTGPPKGQLKPLPHVDMEPMTDAFLTASVVAAIANDPYQSTSITGIANQRVKECNRIEAMITELAKFGVKADELPDGIRINGIDYHNLTTPSIKARGIKAYDDHRVAMSFSLLAGMCVNPVLIQERSCTGKTWPGWWDILHTKFKTTLDGYELPVNTDDPSLLIDKHANGDRSIIVIGMRAAGKSTLSKWMASFMGFKFLDLDEVLEEKYGVKIRPFIKENGWDEFRRLEAIVAKECFETHKKGYVLSTGGGIVEGKEARESLKEYVKSGGIVLHLHRDLDETVVSLSADTTRPAFVNEIKDVWIRREGWYHECSNYHSYSSHCSNELEFKHLRNSFISYLKTITGLHVTEIPKKRSAYVSLTYPDLNEVAESLEEIATGCEAIELRVDLLKDYSKSFVADQTATLRKYVNLPIIYTIKTESQGGKFSDHEVEQIEELSYLGIKLGVEYLDIQLNYPNGLIHKIMERKAFTRIIGSYHDKSGLLNWKNVEWDNKYNQAVSLQVDIIKLTGVASCFQDNLDLETFRSSRDLKPLIAINLGESGKLSSVLNKVLTPVTHSLLPPNATSAQLTIDEVNKSFAEIGGFVNKKFWVVGYPIMHSRSPNLHNAAYKKLNLPYVFDRLETDDASEVYEKLMKQENFGGLAVTMPLKLDIMKYLHELSDAAKAIGAVNTVIPLEGKPGKFLGDNTDWVGITNSFTRYGVPSIENSNVNGLVVGGGGTSRAAAFALHEMGCQTIYMMNRTSSKLYDIKNSLPALFNIEILESVDQVDAAKPVSLVVSCVPADKPIDDNLLNMLERMLHQGILIKHGSFTPTLLEATYKPRLTPVMRIAEEKFEWNVIPGVEMLVNQGERQFELHTGFTPPYSVIHHAVVSE

SEQ ID NO: 22449 - DNA, 4671 bp, Yarrowia lipolytica CLIB99
  CDS (1)..(4671)
atgtttgccgagggtcagatccaaaaggtcccgattctgggcaaggagtccatccacattggctacaagatgcaggaccacattgtgtctgaaatcgtggccaacatcaagtcgtccacctacattctggtaaccgacaccaacattgaggatctgggctacgttgagtctcttaagacgaaattcgaggctgcgtttgccaaggacggcatcaagagccgactgctgacctacaccgttgcgcccggagaaacctccaagtccagagccaccaaggccgccattgaagactggatgctgtccaagggctgcacccgagatacggtgatcctggctgtgggaggcggagtgatcggagacatgatcggctacgtggccgccaccttcatgcgaggagtgcggtttgtccagatccccaccactctgcttgccatggttgactcgtccattggaggcaagaccgccattgatacccctctgggcaagaatctggtcggcgccttctggcagcccgtcaacattttcatcgacacttctttcctcgagactctgcccgttcgagagttcattaacggtatggcggaggtcattaagactgcggcattctacgacgccgaagagttcacacggctcgagtccgcgtcggaaatcttcctgtccactatcaagaagcgagacgccaaggacccccgacgagtcgatctgtcccccatcaccgacaccattggccgaattgttctcggttctgctagaatcaaggccgccgttgtctctgccgacgagcgagagggcggtttgcgaaacctgctcaactttggccactccattggccacgcctacgaggccattctcactccttacattctgcacggcgagtgtgtggctatcggtatggtcaaggaggccgagctgtctcgatacctgggaattctctctcccgttgctgtggctcgtctggccaagtgcatcaaggcctacgagctgcccgtgtctctggacgacgctacagtcaaggcccgaagccacggcaagaagtgccccgttgatgatctgcttcgaatcatgggcgtcgacaagaagaacgacggctccactaagaagattgtcattctgagcgccattggcaagacccacgagcagaaggcgtcttctgtggcagacaaggacattagattcgttctttccgaggaggtcattgtcggagaggctcctgttggcgacaaaaagtcctacaccgtcactccacctggatccaagtccatttccaaccgagcctttgttctgactgccctgggtaagggtccttgcaagctgcgaaacctgctgcattcggacgacacccagcacatgctcgaggccattgagctgcttggtggcgcatcgttcgagtgggaggccgacggtgagactctgcttgtcaccggaaatggcggcaagctcactgctcccgcccaggagttgtacctaggaaacgccggtactgcttctcgattccttaccaccgctgctactctggttcagaagggagacaaggaccacgtgatccttaccggaaacaagcgaatgcaggagcggcccattgggcctcttgtggacgctcttcgatccaacggagccgacattgctttccagaacgccgaaggctctctccccctcaagatcgaggccggtgttggactcaagggtggcttgattgaggtggctgctactgtttcttctcagtatgtctcttctctacttatgtgtgccccctacgcacagacacccgtcactctgtctctggttggaggcaagcccatctcgcagttctacattgacatgaccattgccatgatggccgacttcggtgtggttgtcaccaaggacgagaccaaggagcacacctaccacattcctcagggtgtgtacaccaaccctgaggagtacgtggtggagtcggatgcttcttcagccacctaccctcttgcttacgctgccatgactggccacaccgtcactgttcccaacattggcagcaagtctctgcagggagacgcccgatttgccattgatgttctcaaggctatgggctgcaccgttgagcagaccgctacctcgaccactgttactggtgtgcccaacctcaaggctatcgctgttgatatggagcctatgactgacgccttcctcaccgcctgtgtcgttgccgctgtgtccgagggcaccaccgtcatcaccggcattgccaaccagcgagtaaaggagtgcaaccgaatcgaggccatgcgagtgcaactggccaagtacggcgtcgtttgccgagagcttgaggacggcattgaggtcgacggaatttcccgatcagatctcaagacccccgtctctgtgcactcttacgatgaccaccgagttgctatgtctttctcgctgctctcttctatcatggctgctcccgtggctattgaggagcgacgatgtgtcgaaaagacctggccgggatggtgggacgtgctctccggcgtgttcaacgttcctctggagggcgtaacgctggccaagaccgtttccaaggccgagtccggactttccaagccctccatcttcattgtgggcatgcgaggtgccggaaagacccatctgggcgcccaggccgccaaccatcttggctacgagttcattgatctcgaccagctactcgaaaaggatctggataccaccattcctcagctgattgcggacaagggctgggaccatttccgtgccgaggagctgcgtctgctcaagcagtgtctcaatgacaagtccgagggctacgtcatttcctgcggtggcggagttgttgagactcctgctgctcgagacgctcttcagaccttcaagggtgttggtggtattgttctgcatgtccaccgacccgtttccagaatcctcgagtacctcaacaaggaccagtctcgacctgcatttgtggacgatctggaggcggtgtggcagcgacgaaaggagctgtaccgatctgtctcttccaatgtcttctttgctcctcactgcgactctgccgaggccactgccaaggtgcagcagatgctgggcgccttcctggaccgagtcaccggcaagtccgagtttgtgattccccacaaggaccaattcacttccttcctgtcgctaaccttccccgacgtgtctattgccgcaaccatgctcccctcgctgtctgagggttgttctgctctggagctgcgagtcgatctgctcaatgagaatgacgaggccattccctccgaagagtacgttctctctcagttggcgattctgcgacagaatgtcgacctccccattctttacacggtgcgaaccaaggctcagggaggccgtttccccgacgacaaacctgtggagctggccaacctggtcaacctgggtctcaagaccgccgttgagctgctggacgttgagctgacctaccctgccgagcttgtttcgtccgtcggagcttccagaggctacaccaagctgctgggctctcaccacgactttcccggcgctctcaactggtcttctctcgagtgggagaacatgtacgcccgagccgaggctgtgcctgtggacgtggtcaagctcgtcggtatggccaagtctttctccgacaactttgctctggagaacttccgagaggcccacacctcttctcctcttctggctatcaacatgggctcccatggtcagctgtctcgagtcaccaacactctgctgactcccgtgactcacgctgacttgcctgtggctgctgctcctggccagctttccgtggaggagatcaaccagacccggtcgaccatcggcatgttcaacaagaacctgtccttcttcattgtcggcactcccatcggccactccaagtcgcccattttgcacaacaccatgttcaagaagctgggtctgccctacgagtactcgcggttcaagactgatgatgctgctgccgtcaacgctaaggcccgtgctctgcttgcccagggcaaccttggaggtatcagtgtgaccattcctctcaagcaggacattattcctttccttgacgaggtgtctcccctcgctcagcagattggagccgtcaacaccatcattcctggacctaacgggactctcaagggcgacaacaccgatattctcggtctggtgaacgctctgactcggtttggagccaactcgctggacaagaagactgctctgattgtcggagccggtggcacatctctggctgccgtgcacggactgcgatcgctcggcttcgccaagattctcattgccaaccgaactctgtccaaggccgaggccattgctgacaagtttgataacgtggaggccgtgactttggactcgtttgtggccaacaagtacactccgtctgtgattgtgtcttgcgtgccagccaccactttctcgatgctggatgagtccaacaagctggtgtctgccgctctggctgcttctcccaagggtctggttcttgaggctgcctattctgccgaggccactcctctgctcaagcaggtgatggacgtcgagggctgggagttcatctccgggctctacatgctcaccgagcagggctttgagcagttccggctgtggaccggaattcccgcccccaaggaggttggagagaaggctgttcttggtaactaa

SEQ ID NO: 22450 - protein, 1556 aa, Yarrowia lipolytica CLIB99
MFAEGQIQKVPILGKESIHIGYKMQDHIVSEIVANIKSSTYILVTDTNIEDLGYVESLKTKFEAAFAKDGIKSRLLTYTVAPGETSKSRATKAAIEDWMLSKGCTRDTVILAVGGGVIGDMIGYVAATFMRGVRFVQIPTTLLAMVDSSIGGKTAIDTPLGKNLVGAFWQPVNIFIDTSFLETLPVREFINGMAEVIKTAAFYDAEEFTRLESASEIFLSTIKKRDAKDPRRVDLSPITDTIGRIVLGSARIKAAVVSADEREGGLRNLLNFGHSIGHAYEAILTPYILHGECVAIGMVKEAELSRYLGILSPVAVARLAKCIKAYELPVSLDDATVKARSHGKKCPVDDLLRIMGVDKKNDGSTKKIVILSAIGKTHEQKASSVADKDIRFVLSEEVIVGEAPVGDKKSYTVTPPGSKSISNRAFVLTALGKGPCKLRNLLHSDDTQHMLEAIELLGGASFEWEADGETLLVTGNGGKLTAPAQELYLGNAGTASRFLTTAATLVQKGDKDHVILTGNKRMQERPIGPLVDALRSNGADIAFQNAEGSLPLKIEAGVGLKGGLIEVAATVSSQYVSSLLMCAPYAQTPVTLSLVGGKPISQFYIDMTIAMMADFGVVVTKDETKEHTYHIPQGVYTNPEEYVVESDASSATYPLAYAAMTGHTVTVPNIGSKSLQGDARFAIDVLKAMGCTVEQTATSTTVTGVPNLKAIAVDMEPMTDAFLTACVVAAVSEGTTVITGIANQRVKECNRIEAMRVQLAKYGVVCRELEDGIEVDGISRSDLKTPVSVHSYDDHRVAMSFSLLSSIMAAPVAIEERRCVEKTWPGWWDVLSGVFNVPLEGVTLAKTVSKAESGLSKPSIFIVGMRGAGKTHLGAQAANHLGYEFIDLDQLLEKDLDTTIPQLIADKGWDHFRAEELRLLKQCLNDKSEGYVISCGGGVVETPAARDALQTFKGVGGIVLHVHRPVSRILEYLNKDQSRPAFVDDLEAVWQRRKELYRSVSSNVFFAPHCDSAEATAKVQQMLGAFLDRVTGKSEFVIPHKDQFTSFLSLTFPDVSIAATMLPSLSEGCSALELRVDLLNENDEAIPSEEYVLSQLAILRQNVDLPILYTVRTKAQGGRFPDDKPVELANLVNLGLKTAVELLDVELTYPAELVSSVGASRGYTKLLGSHHDFPGALNWSSLEWENMYARAEAVPVDVVKLVGMAKSFSDNFALENFREAHTSSPLLAINMGSHGQLSRVTNTLLTPVTHADLPVAAAPGQLSVEEINQTRSTIGMFNKNLSFFIVGTPIGHSKSPILHNTMFKKLGLPYEYSRFKTDDAAAVNAKARALLAQGNLGGISVTIPLKQDIIPFLDEVSPLAQQIGAVNTIIPGPNGTLKGDNTDILGLVNALTRFGANSLDKKTALIVGAGGTSLAAVHGLRSLGFAKILIANRTLSKAEAIADKFDNVEAVTLDSFVANKYTPSVIVSCVPATTFSMLDESNKLVSAALAASPKGLVLEAAYSAEATPLLKQVMDVEGWEFISGLYMLTEQGFEQFRLWTGIPAPKEVGEKAVLGN

SEQ ID NO: 22451 - DNA, 4737 bp, Kluyveromyces lactis NRRL Y
  CDS (1)..(4737)
atgagcgttgaacttgcaaaagtctccatcttggggaaagagtgcgtccacgttggttatcagattcatgagcacattgtgaagtccactttggaacattgtaagtcttctacatatgtgattattaatgatacaaatgtatccaaggttccatactatcatgatttggttagtttgttcgagaaatccctaccggaaggttctcgtttacttagatacgacgtgaagccaggtgaagctcacaagagccgtgaaacgaaggctgacatcgaagactatttattacttgaagggtgtacccgtgacactgttatcattgccgttggtggtggtgtgattggtgatatgatcggttttgttgcgtccacatttatgagaggtgttcgtgtcattcaagttccaacatcgttgttagctatggttgattcatccatcggtggtaagacagctgtggatactccgcttggtaagaactttgttggcgccttttggcaaccgcaattcgttttcgtagacatcaaatggttggaaactctccctcaaagagaatttatcaatggtatcgctgaagttatcaagacagcttgtatctggaatggtgaagagtttgcaagattggaggctaatgcagaaacgttcttgtctgtggtgaataactcacaaacagtatcggtgttcagtccacaccataatgaaactgtagaactcacttacaccaatattgaatcaatgcttgaacatacctacaaattggtgttagaatctattaaggttaaagctcatgtggtttcgagtgatgaaagagagtcaggattgagaaatttactaaatttcggtcacaccattggtcatgcttacgaagcgatcttaacaccccaagctttgcacggtgaatgtgtgtcaataggtatggtcaaggaggcagaactttcacgttatatgaatatactatctgcgacacaagttgcccgtatggtaaaaattctagctgcctacggtttgcccatcagtgttaatgagaaatggtttaaagagttaactttgaataaaaagacacctttggacgttttattgaagaagatgagtatcgacaaaaagaatgatggttcaaaaaagaaggttgtcatcctagaaaaaattggtaaatgttatggaacatccgctcacgtagtttcagatgaagatttgagatttgttttgtcagatgaaaccttggttcatccattcaataacatcccagaaggacaaaataaggtaatcacaccaccaggttctaaatctatttcaaaccgtgctctaattctcgcagcattaggtaaaggtacgtgtaagatcaagaacttgttgcattctgatgataccaaacatatgttaaatgcagttcaacagttgaagggggctactatctcttgggaagatgatggtgaaacagtagtagtccacggccaaggtggttccacgttaaccgccccttctgaagcattatacttaggtaatgcgggtactgcttcaaggttcttgactactgttgctgcattggccaagaaagatggtaagaatgaccatgtcatattaactggtaatgcaagaatgcaggaaagaccaatcggacctctagtcgactctctccgttccaacggtctaaaaatcgattacttgaacagacaaggatctttacctttgaaaataaacacagaaaccaatttcaaaggtggaaaaattgagttggctgccactgtctcctctcaatatgtctcttcgatcttaatgtgtgctccatacgcagaagagccagttacgttatccctcattggtggtaagccaatctcacaactttatgtcgatatgactatcaagatgatggatgctttcggtattaaagtcactacgtctactacagagcctttcacctatcacattccgaagggaaattacatcaatccagcagagtataccatcgagtcagatgcttcttctgctacctacccattatcatttgctgctatcactggaaccacggtgactgttccaaatattggatcggcctctttgcaaggtgatgccaggtttgcagttgatgttttgagaccaatgggatgtgaggttactcagactgcaacctcaactaccgtgactggtccaccaagaggtcagttaaaacctttaaagcacgtggatatggagccgatgactgatgcatttttgacggcatcagtggttgctgccatttgtaataacggtaccacaaacactactaccattgaaggtattgccaatcaaagagtcaaggaatgtaacagaatcgaagccatggttacacaattagcaaaattcggtgtgagggctaatgaattacctgatggtattcaaattcatggtgttaattctatctcggaattgagacaaccatctgatgcaggaattgagacttacgacgaccatcgagtagctatgtcattctcactgttggctggtatggttaattctgataagaaggatgatgaatcatctgttagaattttggagagacaatgtaccggtaaaacatggcctggttggtgggatgtcctacattctcaattgggtgcaagacttgacggcgctgaaccttcaacaacaaaatcatctgaagttaaaaaaagtgtagtcattataggaatgagagcggctggtaaaagtactgtcagcaagtggtgtgctgagtccttgggttacaggcttcttgatttagatgaggaatttgaaagacagtacggcaaaggtactgtgaaagactttgtagcagaatctggatgggatgagttcagaaaggaagaaactaggatattccaggaagcggtagacaaatacggtgacaagggctatgtgttatcttctggcggtggaattgttgaaagatcagaatcaagacaggctttgaagaggtttgccgaaagcggcggtatcgtcctacatcttcaccgtgatatcgaagagacaatcgttttcctaaagagcgacccaactagaccagcttacattgaagaaattcgcgatgtgtgggaaagaagagaaaagtggtaccatgaatgttcgaactttaccttctttgcggctcattgctccaatgaaattgaattcaggaatttaagacatgtgttcagcaacttcattcgtcgtgtacttggcgctgaaaagattcctgtaccttccaggagatcagctttcgtctgtttgactttcgaagacctatcggatcatttgtcaaaattggatgaaataacctatggttgtgaagcagtagaactaagagttgatcatttatcatccttttcttcagactttgtcaccaaacaaatctccttgttaagagctgcaaccaaatcgctacctattgttttcactgtgagaacagttagccaaggagggaaattccaagatgatgattatgatttacttgaatcattgttgaaggtcgctctgaagaacgctgttgaatacatcgatttagagttgacattgcctaacaacatactctacaatgttttgaacaagaaatcaaacacaaagattattggctcccatcatgattttgcagctaaattcccatgggatgatgctgaatgggaaaatagatataaccaagctctttctttagacgtggacattgtgaagttcgttggcacagcagtaagcttcgatgacaatttggctttggaaaaattcaggtccactcatactttgaagccactaattgctatcaatatgactgaaacaggtaagctatccagggtgctaaataatattttgacacctgttacctccaagttactaccatccgccgctgcccctggtcaattgacactagctgaaatcaaccaattgtatcaccaaatcggtggattaccagccaagaagttctttgttattggttctccaattggacattccagatctccgatcttgcacaacactgggtatgagctactaggcttacctcatcattttgataaattcgaaactgaagatatcgaagtagttaagaaagaacttttgaccagagaagatctcggtggcttagctgtaaccatcccattaaaactagatattattgatagtatgtttgaattgagcgaagccgcaaagaccattggcgctgtaaacactgttattcctttaggaaagaacaaattcaggggtgacaatactgattggttaggtatcaaaaactctttggtttcaaatggtgttcctagttctgttagtggttctgcaggtctgattatcggtgctggtggtacttcaagagctgctatatacgctttgaaacaaattggttgtgacaccatttatatgctcaacagaaccacggagaaactacaaaagctgaaatccgaattttccgaagaatataagattgttgtcgtcgaatctgccgaacaaacagagtcaattaaggaacaagtttctgttgctgtttcttgtgttccagctgataagcctttagatccagagttactaaacaaattggaaagacttttggcaaaaggtacaaatagctccttcaaaccaaccttgttagatgccgcatataagccttcagtgacccctatcatgaagctcgcacgtgataagttcaactggaatatcgttccgggcgctgaaatgttggttcatcaaggtgtggaacaattttctaaatggacaggtgcaaaaccaccatttaaagctatctttgatgcagttacccaagaatag

SEQ ID NO: 22452 - protein, 1578 aa, Kluyveromyces lactis NRRL Y
MSVELAKVSILGKECVHVGYQIHEHIVKSTLEHCKSSTYVIINDTNVSKVPYYHDLVSLFEKSLPEGSRLLRYDVKPGEAHKSRETKADIEDYLLLEGCTRDTVIIAVGGGVIGDMIGFVASTFMRGVRVIQVPTSLLAMVDSSIGGKTAVDTPLGKNFVGAFWQPQFVFVDIKWLETLPQREFINGIAEVIKTACIWNGEEFARLEANAETFLSVVNNSQTVSVFSPHHNETVELTYTNIESMLEHTYKLVLESIKVKAHVVSSDERESGLRNLLNFGHTIGHAYEAILTPQALHGECVSIGMVKEAELSRYMNILSATQVARMVKILAAYGLPISVNEKWFKELTLNKKTPLDVLLKKMSIDKKNDGSKKKVVILEKIGKCYGTSAHVVSDEDLRFVLSDETLVHPFNNIPEGQNKVITPPGSKSISNRALILAALGKGTCKIKNLLHSDDTKHMLNAVQQLKGATISWEDDGETVVVHGQGGSTLTAPSEALYLGNAGTASRFLTTVAALAKKDGKNDHVILTGNARMQERPIGPLVDSLRSNGLKIDYLNRQGSLPLKINTETNFKGGKIELAATVSSQYVSSILMCAPYAEEPVTLSLIGGKPISQLYVDMTIKMMDAFGIKVTTSTTEPFTYHIPKGNYINPAEYTIESDASSATYPLSFAAITGTTVTVPNIGSASLQGDARFAVDVLRPMGCEVTQTATSTTVTGPPRGQLKPLKHVDMEPMTDAFLTASVVAAICNNGTTNTTTIEGIANQRVKECNRIEAMVTQLAKFGVRANELPDGIQIHGVNSISELRQPSDAGIETYDDHRVAMSFSLLAGMVNSDKKDDESSVRILERQCTGKTWPGWWDVLHSQLGARLDGAEPSTTKSSEVKKSVVIIGMRAAGKSTVSKWCAESLGYRLLDLDEEFERQYGKGTVKDFVAESGWDEFRKEETRIFQEAVDKYGDKGYVLSSGGGIVERSESRQALKRFAESGGIVLHLHRDIEETIVFLKSDPTRPAYIEEIRDVWERREKWYHECSNFTFFAAHCSNEIEFRNLRHVFSNFIRRVLGAEKIPVPSRRSAFVCLTFEDLSDHLSKLDEITYGCEAVELRVDHLSSFSSDFVTKQISLLRAATKSLPIVFTVRTVSQGGKFQDDDYDLLESLLKVALKNAVEYIDLELTLPNNILYNVLNKKSNTKIIGSHHDFAAKFPWDDAEWENRYNQALSLDVDIVKFVGTAVSFDDNLALEKFRSTHTLKPLIAINMTETGKLSRVLNNILTPVTSKLLPSAAAPGQLTLAEINQLYHQIGGLPAKKFFVIGSPIGHSRSPILHNTGYELLGLPHHFDKFETEDIEVVKKELLTREDLGGLAVTIPLKLDIIDSMFELSEAAKTIGAVNTVIPLGKNKFRGDNTDWLGIKNSLVSNGVPSSVSGSAGLIIGAGGTSRAAIYALKQIGCDTIYMLNRTTEKLQKLKSEFSEEYKIVVVESAEQTESIKEQVSVAVSCVPADKPLDPELLNKLERLLAKGTNSSFKPTLLDAAYKPSVTPIMKLARDKFNWNIVPGAEMLVHQGVEQFSKWTGAKPPFKAIFDAVTQE

SEQ ID NO: 22453 - DNA, 828 bp, Erwinia carotovora
  CDS (1)..(828)
atgtctgaagtaacgtcttttgcggtttttggcaatccgattgcacatagtaaatcacctcgcatacacgagctatttgcggcgcaaacggggataacgttgacgtaccagcgtgtgttagcgcctttggataattttgagcagatgctgcgccagtattttcacgatggtgctggtggcgcgaatgtaactgcgccctttaaagagcgagcttttgctgaagccgatgaacgcagcgaatgtgctgcgcttgcgggggcggtcaatacattgaagaggctgagtgacggtcgcctgtatggtgataatactgatggcatcggtttgctcagcgatctgcaacgattggcgttggtaaaacctttggatcgtgttttgctcgttggtgcgggtggcgcggcgcgtggtgttatccaacccctgctggcctctggttgtactgttgtgctgaccaataggacctttttcaaggctgaagcattagctaaaatcttctgtgatattggtgatattcaagctactgctcttgacggtctgcatggtcaatctttcgatctgatcattaacgccacatcttctgggatgtacgacagcattcctaacttaccggcagaactcatttcgccggaaacgagctgttatgacatgttttacttaccgcagctaacgccctttttgtcatggtgcgtacaacagggggctatccactatgcagatggtttgggaatgctggtggggcaagcggcacatgcgtttaaactttggcatggtgtgatgccagacgtggagccagtgattgatctactgaagcaggatctcgctaaatga

SEQ ID NO: 22454 - protein, 275 aa, Erwinia carotovora
MSEVTSFAVFGNPIAHSKSPRIHELFAAQTGITLTYQRVLAPLDNFEQMLRQYFHDGAGGANVTAPFKERAFAEADERSECAALAGAVNTLKRLSDGRLYGDNTDGIGLLSDLQRLALVKPLDRVLLVGAGGAARGVIQPLLASGCTVVLTNRTFFKAEALAKIFCDIGDIQATALDGLHGQSFDLIINATSSGMYDSIPNLPAELISPETSCYDMFYLPQLTPFLSWCVQQGAIHYADGLGMLVGQAAHAFKLWHGVMPDVEPVIDLLKQDLAK

SEQ ID NO: 22455 - DNA, 789 bp, Acinetobacter sp
  CDS (1)..(789)
atgaccaagcagtttgctgtaattggtaatccaattgaacaatcccgctcaccagaacttcatcatgcttttgcagaaaagctgggaattgagctgaactacagtaaacgacttgcacctctcgatggctttgaagccaatgtcaaaactttcttcgatcaaggtggcttgggaataaatgtcactgttccatttaaggaacaggcatttgccatgtgtcatcaacttaccgaacgtgccaaaattgctaaagcggtaaatacgctctggatcgaaaacggtcaacttcatggggataataccgatggtcaaggtctagtcgatgccattcaagctctaaactggcctttacagggtactcgtattttaatccttggtgctggcggtgcaacacgtggcgtgatttatccactggttcaggcaggcgtcactgaaattgtgattgccaaccgcacacaacagcgcgctgaacaactggttcaggatcttgctggatccgtttcagaagcaacattgagggttatgacactcgatcagttacacggcaattttgatctggttattaacgcaacgtctgcgagcctcagcggcgatgcactggtattgccagaaacactacagtttaaatatgcttatgaaatggcatatggtaaaccctcttcttttctggatcaggccaaagctcgcggcgttcctacaacagaaggtttcggtatgttagtcggtcaggcgattgaagccttttcaatctggcatggggtcaaaccaaatcttaccgattttttataa

SEQ ID NO: 22456 - protein, 262 aa, Acinetobacter sp
MTKQFAVIGNPIEQSRSPELHHAFAEKLGIELNYSKRLAPLDGFEANVKTFFDQGGLGINVTVPFKEQAFAMCHQLTERAKIAKAVNTLWIENGQLHGDNTDGQGLVDAIQALNWPLQGTRILILGAGGATRGVIYPLVQAGVTEIVIANRTQQRAEQLVQDLAGSVSEATLRVMTLDQLHGNFDLVINATSASLSGDALVLPETLQFKYAYEMAYGKPSSFLDQAKARGVPTTEGFGMLVGQAIEAFSIWHGVKPNLTDFL

SEQ ID NO: 22457 - DNA, 4740 bp, Candida glabrata CBS138
  CDS (1)..(4740)
atgctggtcaaagttcctattctagggcgggagaccattcatgttggttacggtgtgcgttcgcacattgtggagacgattgtggggctgaagtcgtcgacctatgtggttatcaatgacagcaatgttgggcgtgtgccatacttccaggagcttttgagtgattttgaagcgcaattgcctgctgggtcgcggttgctgcggtatgtggtgaagcccggtgaggctaacaagactagggccaccaaggagcagatcgaggactacctgctgagcgaaggctgcacccgtgacactgtgatcgtggctgtcggtggtggtatcatcggcgatatgatcgggtatgtcgctgccaccttcatgcgtggtgtgcgtgtcgtgcaagttcccacctctctgctggcgatggtcgattcatccattggtggtaagactgcggtcgacaccccgttgggtaagaacttcatcggtgcgttctggcagcctgagtttgttctagtggacatcaagtggctgcagagcttgccaaagagagaatttattaacggtatggcagaggtcatcaagacggcgtgtatctggaacgccgacgaattccaaagattggagacccacgcagacgagtttttgcacgttgtcaacaccccaaaaatctcagagaaggaaggattccaactatacgacactgacattgaatctataaaggaacacatcttcaagctggttctagagagtatcaaagttaaagcagaagtggtctcatcagatgagcgtgaatcaagcttgagaaacctgctgaacttcggccactcaattggccatgcttacgaagctatcctaacaccacaagctctacatggtgaatgtgtatcgattggtatggttaaggaagcggaattatcacgttacttgggtattctttccgctacccaggttgcaagattgtcgaagattctggtcgcatacggcttgccagtgtccaaggatgaaaaatggttcagagaactaacactaaacaaaaagacccctctagatactttactgaagaagatgagtattgacaagaagaatgatggttctaaaaagaaggtggtattgcttgagacaattggtaaatgttatggtaagtctgcccatgtagtatctgatgaggatttgagatttgtgctaacagatgaaaccttggtttatcctttcaacaacatccccagagatcagaacaagactgtcaccccaccaggttctaagtctatctctaatagagcgctggttttggctgccctaggtaaaggtacctgtagaatcaagaacttactgcattctgatgatactaaacacatgctgacagctgttcaagaactaaagggagccaacatttcctgggaagacaatggtgaaactgttgttctagagggccaaggtggtagtaccttggtagcttgtgaaaacgatctttacttgggtaatgctggtactgcctctcgttttttgacatctgttgctgcactagtaaactccacttcacaaaaagaccatgttatattaacaggtaatgctagaatgcaacaacgtccaatcggtccattggttgattctctacgtaacaatggtattaaaatcgattatgtaaaaaatgaaggctgtctaccgttgaaagtacatactgactctgtctttaaaggtggtagaattgagcttgctgcaactgtttcatctcaatatgtttcatccattctaatgtgtgccccatatgctgaaaaccctgttactttagctcttgttggtggtaaaccaatttcaatcttatatgttgagatgactatcaagatgatggaaaaattcggtattaaggttgaaaaatcaactactgaagaatacacttacattattccaaagggccattacgttaatccagcagaatatgttattgagagtgatgcatcaagcgctacatatccattggctttcgctgcattgactggtactacagtgactgttccaaatattggttctgcttctctgcaaggtgatgctagatttgccactgacgttctacaaccaatgggctgttctgttactcaaacagccacatcaacaaccgttactggtcctccagttggccacttgaaaccattaaagcatgttgatatggagcctatgactgacgcgttcctaacagcctgtgttgtagctgcagtagctcacgacaatgaccctacatcgaagaacacaactaccattgaaggtattgctaaccagagggtaaaggaatgtaacagaattgaggcaatgtgtacacaattggctaagtttggtgtaagaactaacgaattaccagatggtattcaagttcatggcttacattctatcaatgacttgaaagtaccaagcattggtaacgaagctgttggtgtctgtacctatgatgatcaccgtgttgctatgagtttctctctactagctggcatggtcaactcagaacaaccaaattcaagtaacccaacacctgtccgtattctagaaagacactgtaccggtaagacttggcctggctggtgggatgttttacatactgagcttggtgctcaactagatggtgctgaaccacttgagttgaattcgatgaagaacgcaaagaaaagtgtggtaatcatcggtatgagagcagctggtaaaactacaattagcagatggtgtgctgcagcactgggctataaacttgtcgatctagatactctatttgaagaaagatatggacatggaatgataaaagatttcgttagccaacacggctgggaaaagttccgtgaagaggaagctagaattttcaaagaggttattgaaaactatggcgatgcaggttacgttttttcaagtggtggcggcttagttgaaagttctgaatctagacgtatattgaaatcattttccaagagcggtggttatgtacttcatctgcacagagatatcgaagagactattatgtttcttcaaaaggatcctaccaggcctgcatatgtggaagagatcagagaagtttggaatagaagggaatcttggtacaaggattgctcaaacttctcgttcttcgccccacattgtaactctgaagtagaattccaaaatctaaggagggcattcaccaaattcattagaactatcacaggtgtaacgactgtagatatccctacaagaagatcagcatttgtttgtttgacatttgaaaatttgactgaatatacaaattcattaaaagcgattacatacggttgcgatgctgtagaagttagagtagatcacttatccaatatggacgaagacttcgttagtaagcaaatttctattctcagagcttcaactgatggcctgccaattatctttactgttagaaccaaaaagcaaggtggtaagttccctgatgaggactatgaaacccttcaaaagctactgataactgctttgaaggttggtgttgattacattgatttggaactaactttgccaattggtattcaatacaaagttttgaacatgaagagaaatacgaaaattattggctctcaccatgactttgctagtgcctacccatgggatcactccgaatgggagaacaggtacaatcaagctcttgccatggatgttgatattgttaaatttgttggaatggccaaaagcttcgaagacaatttaatgttagagagattcagggactcacatacaactaaaccattaattgccatcaatatgggagcacatggtcgtgtctctcgtgttttaaatacaattttgactcctgtgacctcagaacatctttcagaagttgctgctcctggccaactaactgttgctgagatcaaccgtatctacacagaaatgggtggtatcactaagaaggatttctttgttgttggtagcccaattggccattctaggtcacctgttcttcacaacactggctactcagtgttgggcctaccacatcatttcgataaattcgaaactacctcggctgaagaagttaagaagcacttactagataacaaagctaacctaggtggtttggctgtaactattcctctaaaattggacattatcaagtatatggatgaattaacggagtctgctaaggtaattggtgctgtgaacactgtcattccattaggtaattctaaattcaaaggtgacaacactgattggctgggcattcgtaactctcttgtttcaaacggtgttcctgagtctgtctcaggcttatctggtttggttgttggtgctggtggtacctccagagccgcaatctttgccctacataagcttggctgccagaagatattcattgttaataggacaaccgaaaagttagaagaacttgtgaaatttttccctgaagagtacaacatagttccaatcaaggaagctgaagaggcagaagctgtaaatgaaactatcggcgttgcagtgaactgtgtaccagctgataaaccattagatgcaaagctagagagcttgctggaaagactactattaaaatcttctcacactcattttgtatcaactttggtggaagctgcatacaagccaagtgtgacgccagtgatgaagctggctaaggacaaatatcagtggagagttgtcccaggtgcccaaatgttggttcaccaaggtgttgcacagttcgagacctggaataactgtagagccccattcaaggctatctacgatgcagtaaccgagatatga

SEQ ID NO: 22458 - protein, 1579 aa, Candida glabrata CBS138
MLVKVPILGRETIHVGYGVRSHIVETIVGLKSSTYVVINDSNVGRVPYFQELLSDFEAQLPAGSRLLRYVVKPGEANKTRATKEQIEDYLLSEGCTRDTVIVAVGGGIIGDMIGYVAATFMRGVRVVQVPTSLLAMVDSSIGGKTAVDTPLGKNFIGAFWQPEFVLVDIKWLQSLPKREFINGMAEVIKTACIWNADEFQRLETHADEFLHVVNTPKISEKEGFQLYDTDIESIKEHIFKLVLESIKVKAEVVSSDERESSLRNLLNFGHSIGHAYEAILTPQALHGECVSIGMVKEAELSRYLGILSATQVARLSKILVAYGLPVSKDEKWFRELTLNKKTPLDTLLKKMSIDKKNDGSKKKVVLLETIGKCYGKSAHVVSDEDLRFVLTDETLVYPFNNIPRDQNKTVTPPGSKSISNRALVLAALGKGTCRIKNLLHSDDTKHMLTAVQELKGANISWEDNGETVVLEGQGGSTLVACENDLYLGNAGTASRFLTSVAALVNSTSQKDHVILTGNARMQQRPIGPLVDSLRNNGIKIDYVKNEGCLPLKVHTDSVFKGGRIELAATVSSQYVSSILMCAPYAENPVTLALVGGKPISILYVEMTIKMMEKFGIKVEKSTTEEYTYIIPKGHYVNPAEYVIESDASSATYPLAFAALTGTTVTVPNIGSASLQGDARFATDVLQPMGCSVTQTATSTTVTGPPVGHLKPLKHVDMEPMTDAFLTACVVAAVAHDNDPTSKNTTTIEGIANQRVKECNRIEAMCTQLAKFGVRTNELPDGIQVHGLHSINDLKVPSIGNEAVGVCTYDDHRVAMSFSLLAGMVNSEQPNSSNPTPVRILERHCTGKTWPGWWDVLHTELGAQLDGAEPLELNSMKNAKKSVVIIGMRAAGKTTISRWCAAALGYKLVDLDTLFEERYGHGMIKDFVSQHGWEKFREEEARIFKEVIENYGDAGYVFSSGGGLVESSESRRILKSFSKSGGYVLHLHRDIEETIMFLQKDPTRPAYVEEIREVWNRRESWYKDCSNFSFFAPHCNSEVEFQNLRRAFTKFIRTITGVTTVDIPTRRSAFVCLTFENLTEYTNSLKAITYGCDAVEVRVDHLSNMDEDFVSKQISILRASTDGLPIIFTVRTKKQGGKFPDEDYETLQKLLITALKVGVDYIDLELTLPIGIQYKVLNMKRNTKIIGSHHDFASAYPWDHSEWENRYNQALAMDVDIVKFVGMAKSFEDNLMLERFRDSHTTKPLIAINMGAHGRVSRVLNTILTPVTSEHLSEVAAPGQLTVAEINRIYTEMGGITKKDFFVVGSPIGHSRSPVLHNTGYSVLGLPHHFDKFETTSAEEVKKHLLDNKANLGGLAVTIPLKLDIIKYMDELTESAKVIGAVNTVIPLGNSKFKGDNTDWLGIRNSLVSNGVPESVSGLSGLVVGAGGTSRAAIFALHKLGCQKIFIVNRTTEKLEELVKFFPEEYNIVPIKEAEEAEAVNETIGVAVNCVPADKPLDAKLESLLERLLLKSSHTHFVSTLVEAAYKPSVTPVMKLAKDKYQWRVVPGAQMLVHQGVAQFETWNNCRAPFKAIYDAVTEI

SEQ ID NO: 22459 - DNA, 882 bp, Bartonella quintana
  CDS (1)..(882)
atgattgatttgacaataaagtgtaaagaaaaagttccttctcgtgcctttgttgttggttatcctattcaccattcaaaatcgccaaaaattcacaatttttggcttaaacagtatggtttacaaggtgaatatttggcacaagaagtaaaattggaagaatttagtgattttcttacatctacaaaaaaaagaggtttttgtggaggtaatgtcactctaccttacaaacaggaagcctttcgtttggcaaattataaagacgaggtagcaacaatgattggtgctgctaatacactctggtatgaaggagataaactttgtgccacaaatagtgatgcctatggttttagcgctaatcttgatgattctgctcctaattgggtaggagaaacagctcttatttttggtgcaggtggtgctgcacgtgctatcctatatgccttaaaaaaacggggatttgagcgtatttgcttgcttaatcgtacaagacaacgcgccgataatttagctgagcatttcggaaaacctgttgaagtccacgattggcataatgtcggcgagatactttatgaagctgatttgattgttaatacgacctctgtaggtatgacagacccacacggatggaaaactggttctttgttttgtgattttcaaaaaacaaagacaacaacgttggtgacagacatcgtttatacaccattaacaaccccttttttacagcaagcaaaagcccatggtctaagaacagttgatgggcttggcatgcttttacatcaagccgttcctggctttgaacgatggtttggaataactccacaggtaacaaaggctttacgaacgaaaattttagaagatatgggtgaagaaagaggatga

SEQ ID NO: 22460 - protein, 293 aa, Bartonella quintana
MIDLTIKCKEKVPSRAFVVGYPIHHSKSPKIHNFWLKQYGLQGEYLAQEVKLEEFSDFLTSTKKRGFCGGNVTLPYKQEAFRLANYKDEVATMIGAANTLWYEGDKLCATNSDAYGFSANLDDSAPNWVGETALIFGAGGAARAILYALKKRGFERICLLNRTRQRADNLAEHFGKPVEVHDWHNVGEILYEADLIVNTTSVGMTDPHGWKTGSLFCDFQKTKTTTLVTDIVYTPLTTPFLQQAKAHGLRTVDGLGMLLHQAVPGFERWFGITPQVTKALRTKILEDMGEERG

SEQ ID NO: 22461 - DNA, 882 bp, Bartonella henselae
  CDS (1)..(882)
atggttaatttaacaataaagcgcgaaaaaaaaaaaattccacgtgcgtttgttgttggtactcctattcatcattcaaaatcgccaaaaattcacaatttttggcttaaacaatatgatttacagggtgaatatttagcacaggaagtaacatctgaagaatttagagattttttaacatctctaaaaaggagaggattttgtggaggcaatgtcactttacctcataaacaggaagcctttcatttggcaaattataaagatgatgtagcaacgatgattggtgctgttaatacactgtggtatgaaggagataaactttgtggcacaaacagtgatgcttatggttttagtgctaaccttgatgattctgctcctgattggatgggggaaacagctcttgtttttggtgccggtggtgctgcacgcgctattctctatgctttaaaaaaacgaggatttgagcgtatttgtttagttaatcgtacaaaacaacgggcagagagtttagctgagcattttggaaaaccggttgaagtttgtgattggtataaggcgcatgaaatactttatcaggctgatttaattgtcaatacgacttctgtaggcatgataaactcaaatgagaaagaaagtacttcttttttttgtgattttcataaaacgaagacaacagcgttagtaacagatattgtttatacgcctttggtaacccctttcttacaacgagcaaaagcacacggtctaagaacagttgatggactaggaatgcttttacatcaggctgttttagggtttgaacgatggtttggaataagaccacgggtgacaaaggcattacgggcgacaattttacaggatatgggtgaaaagagaggatga

SEQ ID NO: 22462 - protein, 293 aa, Bartonella henselae
MVNLTIKREKKKIPRAFVVGTPIHHSKSPKIHNFWLKQYDLQGEYLAQEVTSEEFRDFLTSLKRRGFCGGNVTLPHKQEAFHLANYKDDVATMIGAVNTLWYEGDKLCGTNSDAYGFSANLDDSAPDWMGETALVFGAGGAARAILYALKKRGFERICLVNRTKQRAESLAEHFGKPVEVCDWYKAHEILYQADLIVNTTSVGMINSNEKESTSFFCDFHKTKTTALVTDIVYTPLVTPFLQRAKAHGLRTVDGLGMLLHQAVLGFERWFGIRPRVTKALRATILQDMGEKRG

SEQ ID NO: 22463 - DNA, 801 bp, Picrophilus torridus
  CDS (1)..(801)
atgataatctctggtcttataggcaggcctgtaacacattcaataggccagcttgtatacaacaggatctttaaagatcttaaaatggatgccatatacatgtcctttgatataataaaagaaaacctgggcatcttctgtaaatatgcagcggaaaacatggcaggtttcaacgtcacggcaccatataaaaatgatattattaaatatacaaacagcgtggattcaatatctttgaaaacaggatcagttaaccttgtaagggttcttgataacagactctatggatataattctgattacgctggctttattaaaacaatggatgaaaataatattgaattaaaaaacaaaagaatcctaatctcaggaaccggtggtatcgccagaacggttttcaatgcaataaaagacaaaaatgttaacgctgatgtatcattcttatccagatcaggaagaaagccatggatacctgaaaacataaatgtttataattataataatgtaaaggatgattatgatatacttataaactgcacacctctgggaacctatcctgataattccattgcattccctgataatataataaaaaaggtcactggcatagacgtagtttacaatcccgtaaggacaagattcctgagcattgtggaatcaaatggtggccgggcggtgaacggcgttgatctgttcacaggccagggtgttgaaactttaaagttaatatttaatatggatcttgattacaatgattttaagttatatgttctaaaagccttaagtgatatcaatgaatag

SEQ ID NO: 22464 - protein, 266 aa, Picrophilus torridus
MIISGLIGRPVTHSIGQLVYNRIFKDLKMDAIYMSFDIIKENLGIFCKYAAENMAGFNVTAPYKNDIIKYTNSVDSISLKTGSVNLVRVLDNRLYGYNSDYAGFIKTMDENNIELKNKRILISGTGGIARTVFNAIKDKNVNADVSFLSRSGRKPWIPENINVYNYNNVKDDYDILINCTPLGTYPDNSIAFPDNIIKKVTGIDVVYNPVRTRFLSIVESNGGRAVNGVDLFTGQGVETLKLIFNMDLDYNDFKLYVLKALSDINE

SEQ ID NO: 22465 - DNA, 852 bp, Photobacterium profundum
  CDS (1)..(852)
atggcttcaagttttttggataacgatcacatggataagtacgttgtttttggcaaccctatcgcacaaagtaaatcgcctttcatccatacattatttgcccgccaaacagcgcaaaagatggaatacaccgcagagctagcaccggcagatggctttaaacttgctgcggataactttttctcagcgggagggcgaggatgtaatattacagcgcctttcaaagaggacgcatatcagtatgcaactcaactttctgaacgtgcgaaattagccggtgccgtaaatacactcaaaaaactagatgatggtggtatcttaggtgataacaccgatggtgaaggtctagttcaagatttattactcaatcaagttgaattggctggtaagcgtattctattagttggggctggtggcgctgcccgcggcgtgattttacccttacttgctcaaaatcctgtcgaattagtgataaccaatcgcacattatctaaagcgcagcagttggctgacctatttgcgccttttggttctgtttcgtcggccgcaatagatacactgaatcaaccggattttgatgtgatcatcaactctacttctgcagggttaagtgggcagctgcctggcttgtcagaaagtctgatcaaacatgatatggtttgttatgacatggtttatagcgcccaaattacagcgttcaatttatgggcgcgagatttaggggctggaaaagtgattgatgggctgggtatgcttgttggtcaagctgcagaaagctttatgttatggcgagggttacgccctggagccaagcaggtactgcgagaattacgccgtatattgcaggaataa

SEQ ID NO: 22466 - protein, 283 aa, Photobacterium profundum
MASSFLDNDHMDKYVVFGNPIAQSKSPFIHTLFARQTAQKMEYTAELAPADGFKLAADNFFSAGGRGCNITAPFKEDAYQYATQLSERAKLAGAVNTLKKLDDGGILGDNTDGEGLVQDLLLNQVELAGKRILLVGAGGAARGVILPLLAQNPVELVITNRTLSKAQQLADLFAPFGSVSSAAIDTLNQPDFDVIINSTSAGLSGQLPGLSESLIKHDMVCYDMVYSAQITAFNLWARDLGAGKVIDGLGMLVGQAAESFMLWRGLRPGAKQVLRELRRILQE

SEQ ID NO: 22467 - DNA, 837 bp, Methanococcus maripaludis
  CDS (1)..(837)
atgataaactctaaaacaaaactagttggacttattggacacccggtagatcattcattttcaccgataatgcataacgctgcaataaaagaccttaaaataaattacagatactttgcatttgacgtttcagaagaaaatttaaaagacgttgtagcaggtgcaaaagcatttaattttaggggatttaacattacaattcctcacaaaatgaatatcatgaaatatcttgatgaaattgattgtgatgcagaggctatcggtgcagtcaacacagtaaaaattgaaaacggaaaagcaataggatataacactgacggaattggtgtaaaaaaagcacttgaagaaaaaacaggcattttaatcaataaaaacattttaattataggctcaggaggtgcctcaagagctgtttctttcgaacttgcaaaggataataatttaacaattgtaaatagaaatattgaaaaagcagaaaatctctcaaaagaaatttctagaaagttgaaaaaagaaaatcctctaaattacggcggccttgatataaacattgaaaattttgatataataataaatacaacacctgttggaatgtacccgcatactgaagtggagccagttataccattaaataacattaaaaaagatgctgtcgtaatggacttgatatacaacccccttgaacctgtttttttaaaagaagcaaaaaaatatggcgcaaaaaccattaatggcattggaatgttagtataccagggtgcagtttcctttgagatatggacaggaataaaaccagacatattcgtgatgaagaaaagtattatttcaaaaatttaa

SEQ ID NO: 22468 - protein, 278 aa, Methanococcus maripaludis
MINSKTKLVGLIGHPVDHSFSPIMHNAAIKDLKINYRYFAFDVSEENLKDVVAGAKAFNFRGFNITIPHKMNIMKYLDEIDCDAEAIGAVNTVKIENGKAIGYNTDGIGVKKALEEKTGILINKNILIIGSGGASRAVSFELAKDNNLTIVNRNIEKAENLSKEISRKLKKENPLNYGGLDINIENFDIIINTTPVGMYPHTEVEPVIPLNNIKKDAVVMDLIYNPLEPVFLKEAKKYGAKTINGIGMLVYQGAVSFEIWTGIKPDIFVMKKSIISKI

SEQ ID NO: 22469 - DNA, 2820 bp, Parachlamydia sp
  CDS (1)..(2820)
atgattttaattgcattgaatcttatggcacaaaagccctcttttcattcttgtcaattatgtgtctctttaattgatcttacctgcgatgcgtttatctatcaaattcaacaacttccttcgcaagtggacttaattgaaattcgattagataagctgttaaaaattgattttgcagaattagatagattaaaagagatagctcatcgtcctttaatttggacacttcgaaaaaaatcacaaggaggaaattttttaggaaatattcaaaaacagtttttaatctttaaagagttagctaaaagacagcctgactttgtcgatatagaagcggatattcctttagaatggcttcaagagcttcaaaaaatttctcctcagacacagtggattatttcttggcacgaagtgaaggagacacctcatctaaaaacctgcttagatcaattatatgccttgcctggaaattattataaattagcttgctatacccattctatcattgattctctcaaacttcttgaaatggctcagcaagaaaataaacattcgaggcgcctgtgtacaatcggcctcggaatgaaggggcagtgtacgcgaattttagctccagtaacgggtcaaccatttacatttgcttctttaaaagaaggcttagaatctgcccctggacagatttcatttcaaacgctttttcaaacttatcgctttaaaaaacttagccagcaaacggaaatttttggtttaattggacatccaatcgataaaagtttgagtcatttgacccataatgctgttttagatcatttaaatcagaatgctgtttatattaaatttgatgtcgaagagacagaattggaattgttttttcagcatatccaacgtttttctgttcgtggatttagcgtgacaatgcctcataaagaacgagtaaaaaaaattcttgctttgaatatggatgatgagagtcatttagcttgtaacactcttttgttcagctcttcaataattaacggaactaatacagatggaatcggagctttaaaagcactaaaagtcgaagacttaaaagataagaaattgattttacttggagcaggaggaacctcccaggcaattgcttatgaagcaaaaaaaagaggagcggaagttacgattttaaatcgcacagttttacgtgctaaagatgttgctgaaaagattcaggtaaagtggggaggctttgaacaacttaaagaggctaaaaaaaatgaatgtgatattctaattcagacgacttctgtggggatgtcacctcatgtggatgcactagttgtttcggctgactggattccccaacaaattactgctttagacgtgatttcacaccctttcgagactctttttttgcaaaaagcgcgtttaaaaggttgcgaaattcatcacgggatcgaactttttatccatcaagctgcctttcaatttggtttttggtttaataaacagttcgatcaaaaacttattgaacaaacaatacgagaggcacttccaatgccatttaatcaaaaaaaagttgctgttcaaaaaagcgctttagcgggagaaatttctttacctccctcaaagtctcattcaattagagctattttattaggggcaatgactcaaggcatttcacgtgttaaaaatttattagattctcccgatgtggaacatgctaagttggcggctatagcattaggagctaaaattgaacaggttcaagatgagtatttaatttcaggtgttgctggccaacctaaaaccccttcagggataattgatgttggaaattcaggtcaagttctaagatttgcgggggcatttgcagccttaaatcatggatatactgtcatcacgggcgatcattcaatttgttctaaccgtccagcacaaccacttttagatgggctaagatgtttgggagcttttgccaaatcaacaagagagaatgggtacgcccctttaattatcaaaggacctatttatgaaggaacagcagaattagaaggacaggattcgcaacccgtctccgctctattgatggcatcagcatttattcatggcacaacagaaattttcgttaaatatccaggtgaaaaaccttggattgacctcactcttcactggttgaaccgtctaggagtttcttatattaatcaaaactatgaatactttaagattgaaggcattcaacaaagacctcattttgaggtaaatattccaggcgatttgagtgctgccgcctttcctgtagcagcagctattttaactcaatcaaaaatcactttgtataacgttgatatgagtgatgtacaaggagataaacaagtaatccatgttctccaagaaatgggagctgatattcaaattgatcaggcaagtcacacgttaacagttttaccaggggctttattgaagggaacaactatcgacgtcaacccctttattgatgctgttcctattttagctgttcttgcttgttttgcaaaaggggagacccatttaatcaatgcagcaattgctcgacaaaaagaaagtaatcgattgagctgtatcactattgagttaaaaaaaatgggggcgcaaattatggaaacagatgatgggttactgattcgtaactctaacttgcgaggggctattgttgagagttatgatgatcatcgtctagcaatggctttaatcgtagctgggctggctagcgagggcattactgaagtgaaagggattgattgcatcaaaaagagttttcccaactttattcaagatttaaaaaaacttggggctcggtttacatga

SEQ ID NO: 22470 - protein, 939 aa, Parachlamydia sp
MILIALNLMAQKPSFHSCQLCVSLIDLTCDAFIYQIQQLPSQVDLIEIRLDKLLKIDFAELDRLKEIAHRPLIWTLRKKSQGGNFLGNIQKQFLIFKELAKRQPDFVDIEADIPLEWLQELQKISPQTQWIISWHEVKETPHLKTCLDQLYALPGNYYKLACYTHSIIDSLKLLEMAQQENKHSRRLCTIGLGMKGQCTRILAPVTGQPFTFASLKEGLESAPGQISFQTLFQTYRFKKLSQQTEIFGLIGHPIDKSLSHLTHNAVLDHLNQNAVYIKFDVEETELELFFQHIQRFSVRGFSVTMPHKERVKKILALNMDDESHLACNTLLFSSSIINGTNTDGIGALKALKVEDLKDKKLILLGAGGTSQAIAYEAKKRGAEVTILNRTVLRAKDVAEKIQVKWGGFEQLKEAKKNECDILIQTTSVGMSPHVDALVVSADWIPQQITALDVISHPFETLFLQKARLKGCEIHHGIELFIHQAAFQFGFWFNKQFDQKLIEQTIREALPMPFNQKKVAVQKSALAGEISLPPSKSHSIRAILLGAMTQGISRVKNLLDSPDVEHAKLAAIALGAKIEQVQDEYLISGVAGQPKTPSGIIDVGNSGQVLRFAGAFAALNHGYTVITGDHSICSNRPAQPLLDGLRCLGAFAKSTRENGYAPLIIKGPIYEGTAELEGQDSQPVSALLMASAFIHGTTEIFVKYPGEKPWIDLTLHWLNRLGVSYINQNYEYFKIEGIQQRPHFEVNIPGDLSAAAFPVAAAILTQSKITLYNVDMSDVQGDKQVIHVLQEMGADIQIDQASHTLTVLPGALLKGTTIDVNPFIDAVPILAVLACFAKGETHLINAAIARQKESNRLSCITIELKKMGAQIMETDDGLLIRNSNLRGAIVESYDDHRLAMALIVAGLASEGITEVKGIDCIKKSFPNFIQDLKKLGARFT

SEQ ID NO: 22471 - DNA, 837 bp, Rhodopseudomonas palustris
  CDS (1)..(837)
atggctgcgaccaagcgcgccgcgtgtctgatcggctgtccggcggcgcattcgcgctcgccgctgatccatcactattggctgcgccagctcggcatcgagggcggctactcgatcgaagcggtaccgccggaaggctttgccgaattcgtgctgcacctgaagacgcacggctatgtcggcgccaacgtcaccatcccgcacaaggaacgcgccctgcagctcactgagcccgacgagcgcgcttgtgccgtcggcgccgccaacacgctgtactacgacggtgatctgttgcgctcgaccaacaccgacatcgaaggcttcatcggcaatctcgacgcctcggcgccgggctgggaccgctccgcgcatgcgctggtgctcggcgccggcggctcgtcgcgggcggtggtgttcggcttgctggagcgcggcgtgcagcggatcgcacttgccaaccgttcgatcgagcgggcgcaggcgctgcgcgatctgttcggcgaacgcgtggtaccgatcgcgtggagcgacatcccggccgcgctgccgggcgcgggcctgttggtcaacaccacctcgctcggcatgaagggacagcctccgcttcagatcgacctgtcggcgctgccggcggacgcggtggtttcggacctcgtctatgtgccgctggagaccgatctgctcgccgccgccaaggcgcgcggcctgcgcaccgcggacggtctcggcatgctgctgcaccaggcggtgcgcggcttcgatctgtggttcggggcgcggccgcacgtcaccccggagctgcgggcgctggtcgaggccgatctggccccgaagtaa

SEQ ID NO: 22472 - protein, 278 aa, Rhodopseudomonas palustris
MAATKRAACLIGCPAAHSRSPLIHHYWLRQLGIEGGYSIEAVPPEGFAEFVLHLKTHGYVGANVTIPHKERALQLTEPDERACAVGAANTLYYDGDLLRSTNTDIEGFIGNLDASAPGWDRSAHALVLGAGGSSRAVVFGLLERGVQRIALANRSIERAQALRDLFGERVVPIAWSDIPAALPGAGLLVNTTSLGMKGQPPLQIDLSALPADAVVSDLVYVPLETDLLAAAKARGLRTADGLGMLLHQAVRGFDLWFGARPHVTPELRALVEADLAPK

SEQ ID NO: 22473 - DNA, 870 bp, Corynebacterium diphtheriae
  CDS (1)..(870)
atgccaggtcattttatactgaccattatgattcactttcgagcagccgtcttaggacaccccattgagcattccttatctccgttacttcataacgctggttatgcggctttaggtctttcgcaatggtcttatggacgatttgattgtgattcacagcagttatctgaattagtcgataaatgtgatccatcatttcagggtttctcagtaacaatgccgtgcaaatttgaggcgttagaatacgcaacgtcggtaagcgaacgtgcacagagaattggctctgcaaatactttggtccgagctgaaaatggctggtatgcggacaacacggatacagagggggttcgcggtgccttggagatcctttttagtgatcggggcggtgctgcggaggcactcaaaaatacaagggcaatagttgtcggtgctggaggtacgtctcggccagcaatctggacattaggtactttaggcgtcgcagaaatagttgtggtcaatagaagcgatcgtcgtgaagaattggaaccagttctagaaggggaacccaccaaaataagttttgttgggtttgattcaaatcttcggtcacacgcgcagtcagcttcagtggttatttcgactgtgccgtctgttggggtgtcagattatattgatgacctagtgcatgctccagttctcgatgtcatttatgatccgtggccgacaccattaatccaacatgctcaaaagaaaggcgtgccgtgtataggtggacacataatgcttttgcaccaagctttgagccagtttgaacaatttacgggggtaaaggcacctcgcgaagcaatgcaaaaagcactgtttgaccacctgtttggggacaattaa

SEQ ID NO: 22474 - protein, 289 aa, Corynebacterium diphtheriae
MPGHFILTIMIHFRAAVLGHPIEHSLSPLLHNAGYAALGLSQWSYGRFDCDSQQLSELVDKCDPSFQGFSVTMPCKFEALEYATSVSERAQRIGSANTLVRAENGWYADNTDTEGVRGALEILFSDRGGAAEALKNTRAIVVGAGGTSRPAIWTLGTLGVAEIVVVNRSDRREELEPVLEGEPTKISFVGFDSNLRSHAQSASVVISTVPSVGVSDYIDDLVHAPVLDVIYDPWPTPLIQHAQKKGVPCIGGHIMLLHQALSQFEQFTGVKAPREAMQKALFDHLFGDN

SEQ ID NO: 22475 - DNA, 813 bp, Corynebacterium diphtheriae
  CDS (1)..(813)
atggtaaatctcgtcgaccgaaataccgttttgtgtgtctcattggccgcacggccctcaaatcatggggtgcgctatcataattggctatatgaccagctgggattgaactttatctataaggcaatcgcaccggcagatattactgctgccgtggctggaattcgtggattgaatattcgtggcgccggtgtgtccatgccctataagcaggacgttatcccgctgatagatgcgcttcacccctcggcacaacgcattcatgctgtgaacacgattgttaatgacgacggtgtactcaccggatataacaccgattatgtcgcagttgcctcgttgcttaagtcccatgagattcccgctgatatgagcgttgcagtccgtggttcaggtggcatggccaatgcggttgtggcagcactagctgaccatggcatgacgggcactgtggttgcgcgcaatgcagaaactggttccgcattggcacagcgctatggttgggagcattccaccgaggtaccggctaaaaccagcatgttggttaatgtgactccccttggcatgtgcggcgatcatgaacatgtgcaggcgtttagcaatgccgagatcgatgctgcgcaggtgatcttcgatgtcgttgcctatccggtagaaactccactgatcaaggcagctgagtctaagggcaaaaagattattaacggtggtgaggtgatctgtttgcaggctgctgagcagtttgcgctctacaccggagtaactccttctgctgcgtttgtgcgcgcggcagaagattacgcacagcagggttaa

SEQ ID NO: 22476 - protein, 270 aa, Corynebacterium diphtheriae
MVNLVDRNTVLCVSLAARPSNHGVRYHNWLYDQLGLNFIYKAIAPADITAAVAGIRGLNIRGAGVSMPYKQDVIPLIDALHPSAQRIHAVNTIVNDDGVLTGYNTDYVAVASLLKSHEIPADMSVAVRGSGGMANAVVAALADHGMTGTVVARNAETGSALAQRYGWEHSTEVPAKTSMLVNVTPLGMCGDHEHVQAFSNAEIDAAQVIFDVVAYPVETPLIKAAESKGKKIINGGEVICLQAAEQFALYTGVTPSAAFVRAAEDYAQQG

SEQ ID NO: 22477 - DNA, 1812 bp, Arabidopsis thaliana
  CDS (1)..(1812)
atggcagcttcttcaactaatgctcgtctcaccaaccctcctcgtctactctccaaaccccgactttcacctacctccgtcgccaatctccgttttccagccgccgatttctccactcgcttctttgccgattcttcgtccccgcggctaaggagtgtaccgtttccggtggtattttccgatcaaaggcgccggcgaagcatggaacctagcaatgtctatgtggcttcaaattccacggaaatggagatcggaagtcatgatatcgtgaagaatccgagcttgatctgtgctccagtgatggcggattcaatagacaagatggtgattgaaacgagtaaagcccatgaattgggtgcagacttggttgaaattcgattagattggctaaaggacttcaatcctcttgaggatctaaaaaccattattaagaaatctcctctacccactttattcacctacagaccaaaatgggaaggtggtcagtatgaaggtgatgaaaatgagagacgggatgtgcttcgtctggccatggagttgggagctgattatattgatgttgaacttcaggtggcaagtgagttcatcaaatctattgacggaaagaagcctggaaagttcaaagtaattgtttcatcgcacaactatcagaataccccttctgttgaggaccttgatggccttgttgcaagaatacaacagactggagccgacattgttaagattgctactactgctgtggacattgcagatgttgctcgcatgttccatataacctcaaaagctcaagttcccacaattggacttgttatgggtgaaagaggtttgatgtctcggattctttgttcgaaatttggtggttatttgacctttggcaccttagattctagtaaagtttctgcgccaggtcaaccaacgatcaaggatctgttggatctttacaactttagaagaattggtcctgacacaaaggtatatggaattattggcaagcctgtcagccacagcaaatcacctattgttcacaatcaagctttcaaatcagttgattttaatggagtatatgtccacctgttagttgataatcttgtaagctttcttcaagcatactcatcctctgatttcgctggattcagctgtacaattccgcacaaagaagctgcattgcaatgttgtgatgaagttgatccattggcaaagtctataggagctgtgaacactatactaaggagaaaaagtgacggaaagttgttgggttacaacacagattgtattggttccatttctgctattgaggatggcctacgaagttcaggtgatccaagcagtgtaccttcttcttcttcgccattggccagtaaaacagtggtggttattggtgctggtggagcaggcaaggctcttgcttatggtgcaaaagaaaagggggccaaagttgtaattgctaatcgaacttacgaacgagcactagaactcgcagaagcaataggaggcaaagcgttatctctgacagatttagataactatcacccagaagatggcatggttttggcaaacacaacatctatgggtatgcaaccaaatgttgaggagactccaatttctaaggatgcattgaagcactatgcactggtctttgatgcggtatacactccgaggatcaccagacagttgagggaagcagaagaaagtggagccataactgtctcagggtcagagatgtttgtcaggcaggcttacgagcagtttgagatcttcaccggtttacccgctccaaaggaactctactggcaaataatgtcaaagtactga

SEQ ID NO: 22478 - protein, 603 aa, Arabidopsis thaliana
MAASSTNARLTNPPRLLSKPRLSPTSVANLRFPAADFSTRFFADSSSPRLRSVPFPVVFSDQRRRRSMEPSNVYVASNSTEMEIGSHDIVKNPSLICAPVMADSIDKMVIETSKAHELGADLVEIRLDWLKDFNPLEDLKTIIKKSPLPTLFTYRPKWEGGQYEGDENERRDVLRLAMELGADYIDVELQVASEFIKSIDGKKPGKFKVIVSSHNYQNTPSVEDLDGLVARIQQTGADIVKIATTAVDIADVARMFHITSKAQVPTIGLVMGERGLMSRILCSKFGGYLTFGTLDSSKVSAPGQPTIKDLLDLYNFRRIGPDTKVYGIIGKPVSHSKSPIVHNQAFKSVDFNGVYVHLLVDNLVSFLQAYSSSDFAGFSCTIPHKEAALQCCDEVDPLAKSIGAVNTILRRKSDGKLLGYNTDCIGSISAIEDGLRSSGDPSSVPSSSSPLASKTVVVIGAGGAGKALAYGAKEKGAKVVIANRTYERALELAEAIGGKALSLTDLDNYHPEDGMVLANTTSMGMQPNVEETPISKDALKHYALVFDAVYTPRITRQLREAEESGAITVSGSEMFVRQAYEQFEIFTGLPAPKELYWQIMSKY

SEQ ID NO: 22479 - DNA, 2062 bp, Nicotiana tabacum
  CDS (79)..(1788)
ggggggactttttcaagctggctgctgagcctacatttctgctgtttacccatttttgtgctctaaagttggttgctaatggagttggtagtggattcaggggtgaggaagatggagggggaggcaatgacgaggaacgaaacactaatttgtgcaccaatcatggcagacacagtggatcaaatgttgaatctaatgcaaaaggctaaaattagtggtgctgatcttgtggaagttcgattggatagcttgaaaagctttaatcctcaatcagatatcgatactattatcaaacagtcccctttgcctacccttttcacttacaggcccacttgggaagggggtcagtatgctggtgatgaagtgagtcgactggatgcacttcgagtagcaatggagttgggagctgattacattgatgttgagctaaaggctattgacgagttcaatactgctctacatggaaataaatcagcaaaatgcaaagttattgtttcttctcacaactatgataatacaccatcatctgaggagctcggcaatctagtagcaagaatacaggcatctggagctgacattgtgaagtttgcaacaactgcactggatatcatggatgttgcacgtgtattccaaattactgtacattctcaagtaccaataatagccatggtcatgggagagaagggtttgatgtctcgaatactttgtccaaaatttggtggatacctcacatttggtactcttgaagtgggaaaggtttcggctcctgggcaaccaacaattaaagatcttttgaatatatacaatttcagacagttgggaccagataccagaatatttggcattatcgggaagcctgttagccatagcaaatcacctttattgtataatgaagctttcagatcagttgggtttaatggtgtttatatgcctttgctggttgatgatgttgcaaatttctttcggacttactcatctttagattttgctggctcagctgtaacaattcctcacaaggaagccattgttgactgctgtgatgagttgaatcctaccgctaaagtaataggggctgtcaattgtgtcgtaagccgactcgatgggaagttgtttggttgcaatacagactatgtgggtgcaatctccgccattgaagaagcgttgcaaggctcacagcctagtatgtctgggtctcccttagctggtaaattatttgtggtcattggtgctggtggcgctggcaaggcacttgcttatggtgcaaaggaaaagggggctcgggtggtgattgctaaccgtacctatgaacgagcgagagaacttgctgatgtagttggaggtcaggctttgtctcttgacgagcttagcaatttccatccagaaaatgacatgattcttgcaaataccacctccattggcatgcaaccaaaggttgatgatacaccaatctttaaggaagctttgaggtactactcacttgtatttgatgctgtttatacgcccaaaatcactagactcttgcgggaagctcacgagagtggagtaaaaattgtaacaggagttgaaatgtttatcggccaggcatatgaacaatatgagagatttacagggcttgccagctccaaaggaacttttcaagaaaattatggctggatattgagagcaaggtctctttcccttttcaatgcggccctgctagttacttttcctcctaaatccctacatagttgtgtgatagcaatggtcttagattcctctgccctaccatttgtgcttcggaggaattaattcgttccaggtaaatcgtgattttcaccaaaacaaattcttgaggatgttcaggaaggcagtcagacataccagtggacaatcgccgtcattctggcttatattagactcttgtagcacttcattctttgacaactatggtatctctaattgtgctttcattaaacacagatgtatcagtgtttctcattgtgaccccatacttggaattcctcttgattatcattattattaaatcttgtcacattattgtatgatttgtatcaaaaaaaaa

SEQ ID NO: 22480 - protein, 569 aa, Nicotiana tabacum
MELVVDSGVRKMEGEAMTRNETLICAPIMADTVDQMLNLMQKAKISGADLVEVRLDSLKSFNPQSDIDTIIKQSPLPTLFTYRPTWEGGQYAGDEVSRLDALRVAMELGADYIDVELKAIDEFNTALHGNKSAKCKVIVSSHNYDNTPSSEELGNLVARIQASGADIVKFATTALDIMDVARVFQITVHSQVPIIAMVMGEKGLMSRILCPKFGGYLTFGTLEVGKVSAPGQPTIKDLLNIYNFRQLGPDTRIFGIIGKPVSHSKSPLLYNEAFRSVGFNGVYMPLLVDDVANFFRTYSSLDFAGSAVTIPHKEAIVDCCDELNPTAKVIGAVNCVVSRLDGKLFGCNTDYVGAISAIEEALQGSQPSMSGSPLAGKLFVVIGAGGAGKALAYGAKEKGARVVIANRTYERARELADVVGGQALSLDELSNFHPENDMILANTTSIGMQPKVDDTPIFKEALRYYSLVFDAVYTPKITRLLREAHESGVKIVTGVEMFIGQAYEQYERFTGLASSKGTFQENYGWILRARSLSLFNAALLVTFPPKSLHSCVIAMVLDSSALPFVLRRN

SEQ ID NO: 22481 - DNA, 1692 bp, Nicotiana tabacum
  CDS (136)..(1692): n means a or g or c or t/u, s means g or c
gaaatagcttaaagttccattcttttcttgattcytaattcttgattcttaattctttattcttaattcttaattcttgattcttgattcttgattcttgattcttgatycttgattcttatttggtttgtggaaatgggtagtgttggattgttgaagaatcccgccatggtttgtgctccattaatggccccatcagtggaccaattggttcatggtatgcttcaggcaaaagcacaaggtgctgatttagttgagattaggctggatggtatccacaacttccaaccccagaaagatcttcaagtcctcctaaaaaataatccacttcctgttctcattgtttacaggccaatatgggaaggaaatgagtttgaagaggatgatgaccacatccacaagcagttggaagtccttcggtgggctaaagaattgggagctgattatattgagttggacctcaagatagctagtgacttcacgaaaaaagaaaagtcgaggtggagtagtggttgtaaagtaattgcatcatgctttgtggacaatgtgacctcaaaagaagacctcagccaagttgttgcacacatgcaatctactggggctgatatcctcaaaattgttacaaatgcaaatgacattacagaactagagaaaatgtttcacttgctttcacattgccaggtaccacttattgcatactctcttggggaaagaggtctcataagtcagttgttgggcccgaaatttggtagtgtcctagtatatggatctcttgattgtaatgctgtacctggtctgcctactctcggcagccttagacaagcctatggagttgattttatggatactgatactaaagtgtttgggctcatctctaaaccagtgggtcatagtaaaggacctattttgcataatcctacatttagacatgtggggtacaatggaatttatgttccaatgtttgtcgatgatcttaaggagttcttcagggtctactcaagtcctgactttgctggtttcagtgttgggatcccttacaaggaagcagtggtgagtttttgtgatgaagtcgatcctctggctaagtctataggggctggtcaaatactatcatacagaggccttgcgacgggaaagctaattggttataacncagattgtgaggcttctataacagccattgaggatgctttgaaagtaaatggagcagcttttcttccttctccactcgcgggtaaactgtttgtgctggtgggtgctggaggtgcaggaagagctttggcattcggagccaaaagcaggagagctcaaattatgatttttgacattgattttgatagagcaaaggctcttgctgctgcagtttctggtgaagctctgccatttgagaatttagcttcttttcagcctgagaaaggtgcaatccttgccaatgcaacacctatcggaatgcatccaaataaagataggatacctgtttctgaggcaaccttgaaggattatctagtggtctttgatgctgtttatacacctagaaagactactctgctgaaagacgctgaggctgctggagcaatcactgtcagtggagttgaaatgtttcttagacaggccattggccaattccaccttttcacgggaagtaaagcacccgaagaattcatgcgcgacatcgttatggcaaaattctaa

SEQ ID NO: 22482 - protein, 518 aa, Nicotiana tabacum
  Xaa in position 340 is unknown
MGSVGLLKNPAMVCAPLMAPSVDQLVHGMLQAKAQGADLVEIRLDGIHNFQPQKDLQVLLKNNPLPVLIVYRPIWEGNEFEEDDDHIHKQLEVLRWAKELGADYIELDLKIASDFTKKEKSRWSSGCKVIASCFVDNVTSKEDLSQVVAHMQSTGADILKIVTNANDITELEKMFHLLSHCQVPLIAYSLGERGLISQLLGPKFGSVLVYGSLDCNAVPGLPTLGSLRQAYGVDFMDTDTKVFGLISKPVGHSKGPILHNPTFRHVGYNGIYVPMFVDDLKEFFRVYSSPDFAGFSVGIPYKEAVVSFCDEVDPLAKSIGAGQILSYRGLATGKLIGYNXDCEASITAIEDALKVNGAAFLPSPLAGKLFVLVGAGGAGRALAFGAKSRRAQIMIFDIDFDRAKALAAAVSGEALPFENLASFQPEKGAILANATPIGMHPNKDRIPVSEATLKDYLVVFDAVYTPRKTTLLKDAEAAGAITVSGVEMFLRQAIGQFHLFTGSKAPEEFMRDIVMAKF

SEQ ID NO: 22483 - DNA, 861 bp, Rhizobium sp
  CDS (1)..(861)
atgcacgacaagaaattcctcgtgggactgatcggcgccgatatccaaatgtcaaagtccccggcgctccacgaaacggaggctcgacaccagggcgtcgactatcgttacgagcttctcgacctagccgagcgaggccttcccccttcggcgctgccggacctcctagacgagcaggagcggcgcggttttgccgggagcaacattacacatccgtgcaagcagacggtgatcgcccacctcaatcgcctttccgatgatgcagagatgctcggtgcggtcaacaccgtggtctttcgtgacggcgagaggatcggccacaacactgattggtacggtttttacgagaatttccagcgcggccttccgcacgtcgcgaagtcgcatggcgtcctgcttggcgccggcggcgccggtgtcgccgtggcgcatgccgcaatcaagcttggtattgagacattatcgatctttgaccaggattcgaaacgggcagaaaccttggctcggcagttgaaccatcggttctcaagggattgtgctcgtgccacgacggatgtcggcagcaccctgcgctccgcggacggcctcattcacgcgacgccgacgggtatgaagagccatcctggtttgccgatcgacccggaatggcttctgccacggcattgggtcgccgacatcgtctatatgccgctcgtcacagagctccttgctctcgctgaaggaaaaggctgccggacccttcgtggcggcggcatgaccgtctaccaggcagcagcggctttcgaattgttcaccgggatagcacccgacgcagagcgcatgtcccgtcactttacggatctatgccgcctgtcggcttga

SEQ ID NO: 22484 - protein, 286 aa, Rhizobium sp
MHDKKFLVGLIGADIQMSKSPALHETEARHQGVDYRYELLDLAERGLPPSALPDLLDEQERRGFAGSNITHPCKQTVIAHLNRLSDDAEMLGAVNTVVFRDGERIGHNTDWYGFYENFQRGLPHVAKSHGVLLGAGGAGVAVAHAAIKLGIETLSIFDQDSKRAETLARQLNHRFSRDCARATTDVGSTLRSADGLIHATPTGMKSHPGLPIDPEWLLPRHWVADIVYMPLVTELLALAEGKGCRTLRGGGMTVYQAAAAFELFTGIAPDAERMSRHFTDLCRLSA

SEQ ID NO: 22485 - DNA, 870 bp, Listeria monocytogenes
  CDS (1)..(870)
atggaaaatagaatttcaggaacgactaggcttcttggcttaattgggacacccgtagaccattcaaaatctccaatcatgtataattacagttttcaaaaagcggggttggattatgcttacctagcttttgacacacctattgaaaaagttgctgatactataaaagcaatcaagacatttaatctgcgtggcgcaaacgtgaccatgccttgtaaaagtgaagttttaaaacacatggatgacctttcccctgctgctcggatgattggcgctgttaacactatcgtaaatgaagacgggaagctaactgggcatataacagatggccttggttttattgcaaatttacgagatgctagtgtagatgtcaccggcaaaaaaatgactataattggtgctggtggtgcagctacagcaatccaagtccagtgtgcacttgatggggccaaggaaatcaccatttttaatattaaagacgctttttatgacaaagcaaaacaaactgctgcttccattaaacaagaagtgccaaattgcatcgtacatatttatgatttgaacgatacagaaaaactaaatgcggaaattgccactagcgatatccttgttaatgcgacactcgttggcatgcatccgaatgaacacgaaacacctattagcgatacatccgtttttagaaaagagcttatcgttgcagatattatttataaccctaaaaaaacgcaacttctactagatgctgaagctgctggttgtaagactgtaggcgggttaggaatgcttttgtggcaaggcgctgaagcatacaaattgtttactggtaaagatatgccagtttcagaagtaaagaatctatatttcaactaa

SEQ ID NO: 22486 - protein, 289 aa, Listeria monocytogenes
MENRISGTTRLLGLIGTPVDHSKSPIMYNYSFQKAGLDYAYLAFDTPIEKVADTIKAIKTFNLRGANVTMPCKSEVLKHMDDLSPAARMIGAVNTIVNEDGKLTGHITDGLGFIANLRDASVDVTGKKMTIIGAGGAATAIQVQCALDGAKEITIFNIKDAFYDKAKQTAASIKQEVPNCIVHIYDLNDTEKLNAEIATSDILVNATLVGMHPNEHETPISDTSVFRKELIVADIIYNPKKTQLLLDAEAAGCKTVGGLGMLLWQGAEAYKLFTGKDMPVSEVKNLYFN

SEQ ID NO: 22487 - DNA, 822 bp, Listeria monocytogenes
  CDS (1)..(822)
atggaaaaatatgttgttatcggaaatcctattcgtcactcgttatcaccagctatgcaaaatcggattttccaagaacttggaatgaatgcggagtataactctgttttaatagaagaagacgcttttgaaacagaaatcaaaaaattaatggattctggagtgcgtggatttaatattacaacaccatttaaagagcgtattttaccatttttagatgaattagaggatcttgcagcagcttctggcgcagtgaatactgtgctaaaaaaagaggacaaatggtacggatttaatacagatggcaaaggctacttagaaggattagaagaaatccgctcaattacagaagatgattctattttaattaccggtgcgggtggcgcaagcaaggcaatttacctagcgctttccactcacacggatgctaaaataaccgttactaatcgtacaacggaaaaagcgatagaaatgacgaaagataatgaaaatcatcacgccgtcacactagaagaagcagaaaaacaactggctgattttacggttatcattcaaacaacatctatcggtttagaagcttccaaaaacaaaagcccaatttcgctggctaatgtaaaaaaaggaacgatttgttctgatattatttataatccagccgaaacagcctttttgaaagaagcaaagaaaaatggagctattacccaaaatggcttaccgatgtttgttaatcaaggggcacttgcctttgaaatatggactgggataaaaccagagcgatcactgatgaaagaagcagtactcgaacaattaggaggaaactaa

SEQ ID NO: 22488 - protein, 273 aa, Listeria monocytogenes
MEKYVVIGNPIRHSLSPAMQNRIFQELGMNAEYNSVLIEEDAFETEIKKLMDSGVRGFNITTPFKERILPFLDELEDLAAASGAVNTVLKKEDKWYGFNTDGKGYLEGLEEIRSITEDDSILITGAGGASKAIYLALSTHTDAKITVTNRTTEKAIEMTKDNENHHAVTLEEAEKQLADFTVIIQTTSIGLEASKNKSPISLANVKKGTICSDIIYNPAETAFLKEAKKNGAITQNGLPMFVNQGALAFEIWTGIKPERSLMKEAVLEQLGGN

SEQ ID NO: 22489 - DNA, 906 bp, Desulfovibrio vulgaris
  CDS (1)..(906)
atgtctgcacccattcccacccggtcggtgaagttgtctcaatcgccctgtgcggcagattcgagcgaatcggcccatcgcgtcccgttccgtatccctgaacggctgtacggcatcgtcgggcatccgctcggccacaccctgagcccgttgctgcacaactggggcttcgccctgcacagcctgcctgcggtgtacatggcgtggcccgtgccgccggggaggttcgcgtcgttcatggaggctgtgcgcacgctgcctgtgcatggtgccagcgtcaccatcccccacaaggaggaggcattgcgcctgtgcgaccgtgtcacggacagggcgcgggcggtgggggcggtgaacacgctctttcttgaagacggggtcgtgtgcggggagaataccgatgtgacaggctttctcgccccgttgcgtgcccgtggcgtgcgcatcgacgaagccctcgtgctgggtgcgggcggtgctgcgcgcgccgtgctggcggggcttgtcgaactgggggtgcgccgggtgcgcatctccaaccgtacccacgacaaggccatggaacttgccggggcgttcggtgccgatgtcgtgccgtgggatgagcgcgggagtgccgccgcggggcttgtggtcaacaccaccccgtgcgggatgcagggcgcacgcatgggcgaatcgcctttgcccgaaggggcattctcgggccgtggcatggcctacgaccttgtgtacaaccccctcacgacgcgctttctcgccgatgcgcgtgcggcagggtgggagacgcaggacgggcttggcatgttcgtggaacaggggcgcgagcaattccgcatctggacgggactggacctgcctgccgagggtgcgcgtcgtctgattgcggaagccctcgggctgtga

SEQ ID NO: 22490 - protein, 301 aa, Desulfovibrio vulgaris
MSAPIPTRSVKLSQSPCAADSSESAHRVPFRIPERLYGIVGHPLGHTLSPLLHNWGFALHSLPAVYMAWPVPPGRFASFMEAVRTLPVHGASVTIPHKEEALRLCDRVTDRARAVGAVNTLFLEDGVVCGENTDVTGFLAPLRARGVRIDEALVLGAGGAARAVLAGLVELGVRRVRISNRTHDKAMELAGAFGADVVPWDERGSAAAGLVVNTTPCGMQGARMGESPLPEGAFSGRGMAYDLVYNPLTTRFLADARAAGWETQDGLGMFVEQGREQFRIWTGLDLPAEGARRLIAEALGL

SEQ ID NO: 22491 - DNA, 792 bp, Thermus thermophilus
  CDS (1)..(792)
atgctgcgcttcgccgtgctgggccaccccgtggcccactccctctcccccgccatgcacgccttcgccctggaaagcctggggcttgagggcagctacgaggcctgggacacccccttggaggccttgcccgggcgcctaaaggaggtgcgccgggccttccggggggtcaacctcaccctccccctgaaggaggcggctttggcgcacctggactgggtctcccccgaggcccaaaggatcggggcggtgaacacggtcctccaggtggaggggcggcttttcggcttcaacaccgacgccccgggcttcctcgaggccctgaaggcgggggggatccccctaaagggccctgccctggtgctgggggccgggggggcggggcgggccgtggccttcgccctgagggaagcggggcttgaggtctgggtctggaaccgcaccccccaaagggccctcgccctggcggaggagttcggcctcagggccgtgcccctggagaaggcccgggaggcccgcctcctcgtgaacgccacccgggtgggcctcgaggacccctccgcaagccccctcccggcggagcttctcccggaggagggggctgtggtggacctcgtctaccgccccctctggacccggtttctgcgggaggctcaggaaaggggcctgaaggtccagaccggccttcccatgctcgcctggcagggggctttggccttccgcctctggacgggcctcctcccggacccctcgggcatggaggaggcggcccgccgggccttgggggtgtaa

SEQ ID NO: 22492 - protein, 263 aa, Thermus thermophilus
MLRFAVLGHPVAHSLSPAMHAFALESLGLEGSYEAWDTPLEALPGRLKEVRRAFRGVNLTLPLKEAALAHLDWVSPEAQRIGAVNTVLQVEGRLFGFNTDAPGFLEALKAGGIPLKGPALVLGAGGAGRAVAFALREAGLEVWVWNRTPQRALALAEEFGLRAVPLEKAREARLLVNATRVGLEDPSASPLPAELLPEEGAVVDLVYRPLWTRFLREAQERGLKVQTGLPMLAWQGALAFRLWTGLLPDPSGMEEAARRALGV

SEQ ID NO: 22493 - DNA, 942 bp, Leptospira interrogans
  CDS (1)..(942)
atgcatttaacaagaaacgaatcgaaaaaattgaatcttgtttgtaaaattcacaaagagaaaattgaaatgaaaactaaaacaaatcaatctgttaaaactttcggtatagtaggatttcctctttcacattctctttctcctctaattcataattcaatttataaagatagaaatataaacgcctcttatctcgtttttgaaactcaaaacctaaatgtagaaaaaatacaagaattccgaaactctggaattttaggactttctgtaaccattcctcataaagaaaccgcttttactctcgcagataaagcagatgacacatctagaattatgaaagcttccaacacgttgttgatcggaccggattcaacttatgcatacaacaccgatggagaaggcgcctatcattctatcttagaattttctccagaatccttaaaaaccggaaaggtagtaatcttaggaagcggcggaagcgcgagaggaattgcatttagtcttgcagtttcgggtaaaattcaaaacttacttgtatgttccagaaatgaaatcactgcaaaagaaatttgtttattagttactaaaaattcaaatgtaaaagcggaaccaatttcgcaagatgtattacttactcgaaaagaagaaatttcattagtaattcatacaactcctttgggaatgaagggacaatcaccaggtccgtatcttcccgaagatttttttaactcgaacatgactcttttcgatatagtttataatcctttagaaactcctttggtaaaagccgcacaaaaagcgggagcaaaaatcattccaggatcggagatgcttttatatcaagcaatgaaacagttcgaactttttacagaaatttcgcctaacgcagaagatataatcaaaaccagggaacgtttgtctaaagcattagaaaatcgatga

SEQ ID NO: 22494 - protein, 313 aa, Leptospira interrogans
MHLTRNESKKLNLVCKIHKEKIEMKTKTNQSVKTFGIVGFPLSHSLSPLIHNSIYKDRNINASYLVFETQNLNVEKIQEFRNSGILGLSVTIPHKETAFTLADKADDTSRIMKASNTLLIGPDSTYAYNTDGEGAYHSILEFSPESLKTGKVVILGSGGSARGIAFSLAVSGKIQNLLVCSRNEITAKEICLLVTKNSNVKAEPISQDVLLTRKEEISLVIHTTPLGMKGQSPGPYLPEDFFNSNMTLFDIVYNPLETPLVKAAQKAGAKIIPGSEMLLYQAMKQFELFTEISPNAEDIIKTRERLSKALENR

SEQ ID NO: 22495 - DNA, 834 bp, Bacillus cereus
  CDS (1)..(834)
atgaaacaattatatggtgtaatcggaaatccaattggacattcattatcacccgttatgcataacgatgcatttgaacacttgaatatggatgcccattatcatgcctttcttgttaaagaggaagtgctaggggaagcagtaagaggtttaaaagcgttaggtatttcaggatttaatgtaacaactccgcacaaagttgcgattatggattatttggatgagattgacccgctagcaaaacaaattggtgcagtaaatacggtggttcataaggatgggaaattgattggctacaatacagatggaattggttttgtccgagcactgcaatccattagtagtaaaccacttcaagagaaacgtattttattacttggcgcaggcggtgctagtcgagctatttatttttcacttgctgatgtaggtgtgaaagagattgatgtagcgaatcgtacggtagataaggcgaaggaacttattactgcatgtaaggctactgtccattctgttgctttatcgctagagaaagcaacagaagaacaagggaattatgatattatcattcagacgacaacaataggtatgcatccacgcgtcgaacatacgccgttacaaatttcttcgttgaataagggaacgattgtatcagatataatttataatccatttgaaacgaaaattttatgtgaggcgaaagagcaaggtgcaatgattcaaaatggtattgatatgtttgtttatcaaggagcgcttgcatttgaaatgtggacagggcgtacgccaaatatcgaacgaatgaaacaattagttataagaaagcttggaggctaa

SEQ ID NO: 22496 - protein, 277 aa, Bacillus cereus
MKQLYGVIGNPIGHSLSPVMHNDAFEHLNMDAHYHAFLVKEEVLGEAVRGLKALGISGFNVTTPHKVAIMDYLDEIDPLAKQIGAVNTVVHKDGKLIGYNTDGIGFVRALQSISSKPLQEKRILLLGAGGASRAIYFSLADVGVKEIDVANRTVDKAKELITACKATVHSVALSLEKATEEQGNYDIIIQTTTIGMHPRVEHTPLQISSLNKGTIVSDIIYNPFETKILCEAKEQGAMIQNGIDMFVYQGALAFEMWTGRTPNIERMKQLVIRKLGG

SEQ ID NO: 22497 - DNA, 1482 bp, Treponema denticola
  CDS (1)..(1482)
atgtctacaaaggtctgtcttgttttaacggaaaaaacaatcgaaaaaaatctttccgcactggaaaagtataagaagtttattgatattgcggagcttcgtgtagattatctcaatcaaagcgaaatactctatttaaggaatttccctgaacgggccggaatcccttgtatcttaaccgttcgaagaaaatctgacggcggaaattttacgggaggcgaaggtgcaaggatgacaatctttgcacgcggccttgcctttgcaaacgccgacccgataaaaaatttttcttatatagatttggaaagcgattttgattcatccggaatcgaagaagcggcaagggcctttgatattaaaataataagaagccttcacagtaaggttccggtaaaaaatatagtaaagaccgtagaagggttaagccgttttgaaaccgacattcccaaattggcttttacggcaaattgtttaaacgatgtttccgagctttttaaagcatcaaagctgataaaaaaccaagagtacattttatcggttatggggccatacggtttaagctcccgtatcctatcaaataaattaaattcccaaatagtatataccttcactcccgaatacataaagaaaaataaacttgaacaagaacttatagatcctgaaactttagaagaattatacggattttcaaaaatcgatgaggagacaagtctttatggagttataggtaaggatgtaaacacaagtttgagcccccaaattcataataagggttttaaacgaaaaaatcttaattccgtttatatcccaatatcggcggtgtcatcaaaggaagccttggactttgccaatcttcttaagataaaaggtctttccgttacggctccttttaaaagcgaaatcattcctctgataaattccatatccgaagcctctaaatttatcggagccgtaaataccttggtaagcgaaaacaaaaaatggttcggctataatacggatgttgacggttttcagcaggctttaatggaattcttaaacgaaaaagacttacgcaaatataaggtcgctattataggggccggaggagcagccagagccgtcgcagaagtaataagctctctccatggaaaagcctgtatctttaatcgtacggccgaaaaagctaaaaacatagccgaaaaatataaatttaaatgggcactattggatcctataaatataaaacagcttcatgctttttcggaactgataattcaaaccacaaatgccggtatggagcccgacatatatatggaccctcttaatttttatacctttacaggaaaagaaaaagtatttgagttaatctacaggcctgaaaccactaagatgttaaagcgggcaaggacggcaggatgtcaggtttgtaacggctataaaatgcttgaatatcaagcctatcatcaatttaaagcttttgcaggaaaggagtatttataa

SEQ ID NO: 22498 - protein, 493 aa, Treponema denticola
MSTKVCLVLTEKTIEKNLSALEKYKKFIDIAELRVDYLNQSEILYLRNFPERAGIPCILTVRRKSDGGNFTGGEGARMTIFARGLAFANADPIKNFSYIDLESDFDSSGIEEAARAFDIKIIRSLHSKVPVKNIVKTVEGLSRFETDIPKLAFTANCLNDVSELFKASKLIKNQEYILSVMGPYGLSSRILSNKLNSQIVYTFTPEYIKKNKLEQELIDPETLEELYGFSKIDEETSLYGVIGKDVNTSLSPQIHNKGFKRKNLNSVYIPISAVSSKEALDFANLLKIKGLSVTAPFKSEIIPLINSISEASKFIGAVNTLVSENKKWFGYNTDVDGFQQALMEFLNEKDLRKYKVAIIGAGGAARAVAEVISSLHGKACIFNRTAEKAKNIAEKYKFKWALLDPINIKQLHAFSELIIQTTNAGMEPDIYMDPLNFYTFTGKEKVFELIYRPETTKMLKRARTAGCQVCNGYKMLEYQAYHQFKAFAGKEYL

SEQ ID NO: 22499 - DNA, 861 bp, Geobacter sulfurreducens
  CDS (1)..(861)
atgccgtttacgggtgctaccagagtactgggaatcatcggtcagccggtgtcccattcgctttcgcctctcatgcagaatgcggcgctgcaggccatggggctcgattatgcgtatgttccctttgccgttgaggaggactgcctggccgacgcggtgagggggttggcggccctgggtgtggtcggtttcaatgtgaccattcctcataaatcggccatcctgccgctgctggaccggctttcgccggaagccgagctgatcggcgccgccaatgtcgtaaaacgcgaagggagcgatctggtcggatacaacaccgacggcacggggtttattcagtctctgagcgaagatctcggttttactccggccgggtgtcggattctcgtcatgggggccggtggtgctgcccgagcagcagttgcatcgttggccggtgccggggcggcatcggtggttatcgccaaccggagcattgccaggggggaagagctgtcggcggcgttcaggcggcactttatcggcacacaatttgctgcaattcccctcgacccggagaacctgaatcggtgcgttcaaaattttgaccttctggtcaacacctcttccgtggggatgggggggactgctttcccgggcatggatctctcccgcatgggtccccacggtgccgtgtacgacatggtctacgttcccgccgttacccccttgctcgccgaggctgagcgttgcggcatacgctacgccaacggcatcggcatgctggcggcccagggtgagtgcgcgctggaactatggaccggagtacggcctcccgagggactcatgaaagcgtgtctcatggcggctctgatgagctaa

SEQ ID NO: 22500 - protein, 286 aa, Geobacter sulfurreducens
MPFTGATRVLGIIGQPVSHSLSPLMQNAALQAMGLDYAYVPFAVEEDCLADAVRGLAALGVVGFNVTIPHKSAILPLLDRLSPEAELIGAANVVKREGSDLVGYNTDGTGFIQSLSEDLGFTPAGCRILVMGAGGAARAAVASLAGAGAASVVIANRSIARGEELSAAFRRHFIGTQFAAIPLDPENLNRCVQNFDLLVNTSSVGMGGTAFPGMDLSRMGPHGAVYDMVYVPAVTPLLAEAERCGIRYANGIGMLAAQGECALELWTGVRPPEGLMKACLMAALMS
